United States Patent 7,557,201 (NUCLEIC ACID MOLECULES AND OTHER MOLECULES ASSOCIATED WITH PLANTS) - sequence listing, part 4

SEQ ID NO: 18748 - DNA, 280 bp, Gossypium hirsutum
  Clone ID: uC-gsflnu33B019d02b1
tttgtctagatcgcgagcggccgccctacgcgttcggttttaaaaggaataccttaggtcccagagacgaggaagggcgtagtaagcgacgaaatgcttcggggagttgaaaaataagcgtagatccggagattcccgaataggtcaaccctttcgaacctgaggctgaatccagggctaaaaccattgatctctgcaacaattcaatgtcaaccagaaagatttatgactaccctagaagaataggatctgagtggacagaacttgactctaaagctag

SEQ ID NO: 18749 - DNA, 206 bp, Gossypium hirsutum
  Clone ID: uC-gsflnu33B019d05b1
tgacttttgttgcatgggaaaagatgaagctggtagaatgtattttatattgtaacaacatatatattgttgattatttttggttgtatatggaaggtgatgactttcattcgtaacgttgacgatgttgtatactactagttcatcaaagtagtcaaataccattaccagtcaaaactcaaagaacacaaaaaaagaacaaaact

SEQ ID NO: 18750 - DNA, 287 bp, Gossypium hirsutum
  Clone ID: uC-gsflnu33B019d07b1
ttcacgcgtccgaaaaacttggtgtacctccaatctgtcattaaagaaacactacgcctctatcctgctgctccactcgctgtaatccatgaagccattgaagattgctcagttcatggatacgatatttcaactggcacttggcttattcttaatcttcaaaagatacaacgtgatttacaaatatgggaagctcctttaaaatttcaaccagaaagatttatgactacccataaagatattgatgtaaagggacatgactttggacttatttcatttagcagtgg

SEQ ID NO: 18751 - DNA, 460 bp, Gossypium hirsutum
  Clone ID: uC-gsflnu33B019e01b1
ttacgcgtccgctgcgttggcttggattccccccaaacttgaactcgccaactgaaggaacagacgatcgtcctctttccgcaatggcggatgctcaaactgaaaaacccctttccctttccgagcaatatgcacttaaggagaaagaggaaaaatcagatgtgactacaaaaccagcagaagcaaaagaggttgaaaatcctgtaaatgctgccactggttctggtgatgtaactgagaaattggaggagacttctgccgatccagttgagggaagcactgaggcccctcctcctgctgctgaagaaagcactgaagcaaatcctgccactgggaacagtggaggaagatgctgcagaggaaaactcgggtgactctggggaaactccagagattaagcttgtgactgtcccagcagtttccgcttcccaataccaaccaaccaggttttgttacacca

SEQ ID NO: 18752 - DNA, 437 bp, Gossypium hirsutum
  Clone ID: uC-gsflnu33B019e07b1
ttaactatgatgacacgcgcacggtgatgagcagcgttcgtaaggctgatgctttccattcgttgtcaggcatgtggaaaacacctgccgagaggtgtttcttatggcttggtggtttccgttcatctgagcttctaaagcttcttgtaaatcaattggagcctttgaccgagcaacagttggtggggataggcaacttgcagcaatcctcccaacaggctgaagacgcattatcccaagggatggaggcattgcagcaatctctggctgaaacattgtcgactggatctttaggctcttctggatcatctgggaatgtggcgaactacatgggtcaaatggccatggccatggggaagctcgggactcttgaggggtttattcgtcaggctgacaacctacggcagcaaactctacaacaaatgcaccggatattg

SEQ ID NO: 18753 - DNA, 428 bp, Gossypium hirsutum
  Clone ID: uC-gsflnu33B019e08b1
tatgccactagtccattaaaggagtcagctgtgctgattcctgagattgatgatcaaagcctaaatcccagtagtttacctgtaattcccgaggactattttgtgactcatgagccacaagaacaatcatttcaagggtttgatttatgcaaagtttctacctcagctaatgctgacataaattatcaattggattatcatccatttgatttacaacaagattttgaccatgggcatctcctcgatgccaatggcactgaagattacgtgaaggatgctaactccaacatgctgccaaatatctctcctccaccatctgctttcatgggtccgaagtgtgctctgtgggattgtacaaggcctgctcaaggatctgactggtttcaggactactgtagcagttttcatgctaccctagctttgaatga

SEQ ID NO: 18754 - DNA, 539 bp, Gossypium hirsutum
  Clone ID: uC-gsflnu33B019e11b1
tagggtcctcttgctgcccctgttcttcaacacctgacaaatgatgatttgagtaagttatattttggggaattccgaatattggatatcaacggtgcaacatgttttctcactcggacagggtacaccggtgaggatgggtttgaaatctcagttccttcagaaaatgctctggatcttgccaaagcaatcttggagaaatcggaaggaaaggtaaggttgacaggacttggagctcgagacagtctccgactcgaagctggcctatgtttatatggcaatgacatggaacaacacatttcaccagtcgaagctggactgacatgggccatagggaagaggagaagagcagaaggtggattcttaggagctgaggtaatcctgaaacaactggcagagggtccgtcgatcaggagagtcggcttcacctccactggcccacctccaagatctcacagtgagattcaggacgagaaagggaacaacattggtgaaatcaccagcggaggatttagcccctgcctgaagaagacatagca

SEQ ID NO: 18755 - DNA, 557 bp, Gossypium hirsutum
  unsure (1)..(557): unsure at all n locations
  Clone ID: uC-gsflnu33B019f01b1
ctacgcgtccgtttttgtattggaggatggcaagtggggatctagagcgaggaggaaggaatgggaagaacagagcaaatagctatcaccaatcatcatctcctttctatgtagaaaacactgataagcaatggacttcatggcttgttccaatgttcgtggtggctaatgttgctgttttttttgtggtgatgtatatcaatgattgccctaacaacaatctgggatttgaaggcagctgcgtggctaagttccttggcaagctttcttttcagcctttgaaagaaaatcctctctttggtccttcttctcatacattggacaaattgggagcactaaattggagcaaggtagcgcatggcaagcaaggatggaggctcatcacttgcatctggctacatgctggcgntattcatcttcttgctaacatgttgagcttgggctttattggaattcgccttgaacagcaatttggattcctgcgaattgggcttatctatctatttgccggctttgagggagatactatcatctctttcaatcagggaaaaatttct

SEQ ID NO: 18756 - DNA, 97 bp, Gossypium hirsutum
  Clone ID: uC-gsflnu33B019f05b1
taaatatctggttgcattctttatggagttctattgctgatttaaacttattgatttgtagtttatcctatgtgtgtacatttgtggtttgtgggtg

SEQ ID NO: 18757 - DNA, 327 bp, Gossypium hirsutum
  Clone ID: uC-gsflnu33B019f06b1
atatagaactaaaaaaaaaaaaaaaaaaaaaaagaaaaatttaaaaaaaaaaaaccaaaaataaccatagaaaaaaaagggcgaaacggtgcgggcgctcaagaggtccgcgcgtctccgtcggggtcagtgacattattagggggttctcctgagttccctacatttgaattgagtggcccaacgctttacaccgggaaaactgggaaaaccccgacttgacccgatttgatggcgtttccccatatccccgcttggcccagttgctaataggccgaaacggggccgcccttatcgcctttgccaacacctgagcggcctaagggg

SEQ ID NO: 18758 - DNA, 449 bp, Gossypium hirsutum
  unsure (1)..(449): unsure at all n locations
  Clone ID: uC-gsflnu33B019f08b1
atttaaggcaggagatgatcgtaaagaagctgctgatcagtcacttaaggcttatgaggctgccacttccactgcaagctcagatttgcctccaactcacccaattagacttggcctggctttgaacttctcagttttctactatgagatattaaattctcccgagagggcttgtcatctggctaaacaagcatttgatgaggctattgctgagcttgatagccttaatgaagaatcttacaaggatagcacccttatcatgcagcttcttagggacaacctcaccttgtggacctcggatctgccagaggaaggaggtgagcaatcaaaagcagatgaacctcaggctgagagttaattggatgaaagagtattcttttaagactgggcttgtcgagataggaaaggngcttgctgctagagtgacctgctttcaactcatggtagta

SEQ ID NO: 18759 - DNA, 486 bp, Gossypium hirsutum
  unsure (1)..(486): unsure at all n locations
  Clone ID: uC-gsflnu33B019f10b1
ngtcacgcgtccgcccacgcgtccgaaacaaaccactcctatattaaacattgttggtgaaacaatgacgtcttcagctctgacaggtaagcttgaggcagatgtagagattaaggcttctcctgagcagttccatgaaatgtttgcccacaaaccgcaccatgtgcaccatacttgctatgacaagattcaaggatgcgatttacatgaaggtgaatgggggaaagtcggtaccattgtccattggagttatgtgcatgatggaaaggctaaaaaggcaaaggaagtagtggaagcagtagaccctgataagaatttggtcactttcagagtgatcgaaggagatctaatggaagagtataagagctttgtaatcacgattcaagtttcgcccaagagcgagggtagtggcagcgtagtgcactggacttttgaatacaagagctgcactgtggattgagcattctgagactctgctgcatttcg

SEQ ID NO: 18760 - DNA, 467 bp, Gossypium hirsutum
  Clone ID: uC-gsflnu33B019f11b1
tttggtggtcaggacaagattcgacctttgtggaggcactatttccaaaacactcaggggctaatctttgttgttgatagcaatgaccgtgaccgtgtggttgaggccagggatgagcttcatcgtatgctaaatgaggacgagctgagggatgctgtgcttcttgtgtttgcaaacaagcaagatctgccgaatgctatgaatgctgctgagattactgataagcttggccttcactcccttcgtcagcgccactggtatatccagagtacttgtgccacctctggcgaagggctgtatgagggactggactggctttccaacaacattgctaacaagggttggaggttggttgaattccagtcatatcttcaggcagctatcctattattttctgggtccttttttaaggtttacaggaaatgtatcaaattgtgtatataattaatatatattcaccgtactac

SEQ ID NO: 18761 - DNA, 518 bp, Gossypium hirsutum
  Clone ID: uC-gsflnu33B019g01b1
cttatccagcgattggaagcaatgccatattaaggttgattgctggaatcgttttcatgcatgaagaagattatattgaagctcttaaacacaccaatgctggtggcaccatggaacttcatgcattgaatgtgcaaattttcattaagacgcaccggtcagattatgcagagagacaactgagggtcatgcagcagattgatgaggaccatacactgactcaacttgcaaatgcatggttgaatctagcagtgggtggttccaagatacaggaagcttatctgatcttccaagatttctctgagaaatatccaatgactggtttgatcctaaatgggaaggctgtctgctgtatgcacatgggaaactttgacaaggctgaaacactgttacttgaagcacttaataaggatgcaaaggatcctgaaactctggccaacctggttgtatgcggccctcacctcggttaatcatcttcacgttatcttagccaattgaaactcacacatccagagcac

SEQ ID NO: 18762 - DNA, 560 bp, Gossypium hirsutum
  Clone ID: uC-gsflnu33B019g02b1
gttatatggaactcggtggtcgtagaggcctacggcgattgggttttgggagggctcaaggtgaagaacttggtcaccggagaagtttccgatttgaaagtcaatggactattctttgccatcgggcacgagcctgccaccaagtttttgggaggtcagctggagctcgactcagatggctacgttgtcactaaaccaggtacaactcagaccagcgtgcacggcgtttttgctgccggagatgtccaggacaagaagtatagacaagctgttactgcggctggcaccgggtgcatggcagccttggaagccgaacattacttgcaagaacttggatctcaggagggtaagagcgattgatcattgttttaccaaggatttaaaagctgtttgcttcgaattgcgattgttttcggtattcgtctagacgtagaattatcctttgttctggatcaatattagaatttgccattgccatctatattcattattcgttttatgggattggcccagattgactttctgtacttcactaaagctaggaatatatattgtttttc

SEQ ID NO: 18763 - DNA, 487 bp, Gossypium hirsutum
  unsure (1)..(487): unsure at all n locations
  Clone ID: uC-gsflnu33B019g03b1
nctacgcgtccgcccacgcgtccgcactttgccaattccccatgttcgcatgtctgtgaatgttaggttgtagaattattagagttctttattttctctaaaatatatgtaaatgcttctattagatccggagatctgatatgagaacatatccaaatatattaggagacttcaagaagtttagtttaaaaaaaaaaaaaaaaaaaaaaaaaaaaaaaaaaaaaaaaaaaaaaaaaaaacaaaaaaaaaaaaaaaaaaaaaaaaaggaaaaaaatataaaaaaaaataaactaaaaatcagggggcgcgcccccaaaaaactcaatttatcccccccgacttgggtcgcaccccgcttttttttagtaccccccaattaccaaatcccgggggcttttcaccacaatgggcctgggaaacacccccctttccacaattatttctccctgaaagaacccccctctttcccccgttttaaaaataaaaa

SEQ ID NO: 18764 - DNA, 452 bp, Gossypium hirsutum
  Clone ID: uC-gsflnu33B019g06b1
ctcacgcgtccggttcgtcccatgtccggtccaatactggcttctggtcctcaagtgttagagccttcaagaaggttcgagagtggtccgagatcgtcgccggtccccgctggaagacttttatcaggagattcaaccgtagcaaaagtggtagcggaatcgtctccagcggtaggcatgggcaattccattatgatcctttgagttacgctttgaatttcgacgaaggcccgcgacagaatggtaatttggaagacgataatgatttcggtgcctttcgggctttctcaacccgttacgcttctgttccgggttcggagaaaacaacattggcgtagatgacgccgaatggatcatgtacagtgaaccggtgacgtcactacggcgtggcttcttcgtttacttttatatgataagatggcacattgtagggttatttttgcctaatggat

SEQ ID NO: 18765 - DNA, 468 bp, Gossypium hirsutum
  Clone ID: uC-gsflnu33B019g12b1
taaacccttgacctgttgtttccagctcacattccggcgatggatctccgtgaatcgatcactagccaaaccgacgtcgctttgaccctgaccaaaaacgttctccaaactgaagccaaggactcgaacctactgttctcgcccctgtcgatccatgttgtgctcagcttgatcgccgctggtgctaagggtccaaccctcgaccagctcctctctttcctcaagttcaaatccaacgaccagctcagctccttctcctccgagcttgtttccgttgtcttcgcggatggaagtccagccggtggtccccggttgtcatttgctaatggtgtttggcttgaccggtctctccctctcaagccttctttcaaacaggttgtggacaacgtctacaatgctgcttctaagctagtcgattttcaaaacaaggcggttcaagcggcgggtgaagtaaatatgtgggcggag

SEQ ID NO: 18766 - DNA, 59 bp, Gossypium hirsutum
  unsure (1)..(59): unsure at all n locations
  Clone ID: uC-gsflnu33B019h07b1
ngtcacgcgtccgaaaaaaaaaaagaaaaaaaaggaaaaatttaaaagaataatacttg

SEQ ID NO: 18767 - DNA, 482 bp, Gossypium hirsutum
  Clone ID: uC-gsflnu33B019h09b1
tcacgcgtccgcccacgcgtccgcttctccagccgttcctccgaatggattggcgttccttcaatctccgatgccaaccccatcgcgaaacttcgctcaaatccaaccccaagaactcgaacacatcttcaagatgttcgacgctaatggcgacggcaagatctcatcgtctgaactcgcttccatcatgggttctctcggccaacaaccctccgatgaagaagtccaaaagatgatcaaagaattcgatgcagacggtgatgggttcataaatttcgaggaattcgtggagctcaacactaaaggagtcgattccaaggaggttctggagaatctgaaggacgcgttctcggtgtatgatctagatgggaacggttcgatttcagccgaagaactgcacaaggttcttaaaagcctgtgagacgattgctccattactgaatgcaggaagatgataagcggagtcgataatgatgggaacg

SEQ ID NO: 18768 - DNA, 62 bp, Gossypium hirsutum
  Clone ID: uC-gsflnu33B022a04b1
aaaaaaaaaaaaaaaaaaaaaaaaaaaaaaaaaaaaaaaaaaaaaaaaaaaaaaaaaaaaaa

SEQ ID NO: 18769 - DNA, 524 bp, Gossypium hirsutum
  Clone ID: uC-gsflnu33B022b03b1
tcatctatccttggcaaaggatactcattcctaatagtcagtttattcaattaccgatagtcgatgcaaaaatgcatggacccatccttcttctttacgaacaacactggtgctccccatggagacacgctaggttgaatgaatcctcgatccaatagttcttgtatttgagcttttaattccaccagctccttcggtgccatcctataaggagcgatggacactggagctgttcctggcagtagctcaattccaaaatcaacttcgtggttcggaggcaacctagggagctcatcagaaaatacatcgaaaaaatccttaacagtttagatatctctaatagaaggaccctcggaatcagatgtaccactataggctagaaacgccttacaacccttgcgagacagttttccggcccttaatgcagagatcacatttaaacagaaagtccctacgttccccaatcaaggcagcttcttaccctcatacactttaataccatttgcttagagcacattcaaact

SEQ ID NO: 18770 - DNA, 463 bp, Gossypium hirsutum
  Clone ID: uC-gsflnu33B022b07b1
aatctggatgctcgtcaaatcacagatgctggacttgcagctcttacaagtttgactgggctgactcatcttgatctttttggagcccgtatcacagattctgggacaagtcacttacgaaatttgaagaacttgcgctccttggaaatctgtggtggaggattgaccgatgctggtgtgaagaatattaaagatctttcatccctgtcgctgctaaatttgtcacagaactgtaacctgacagataaaactttggagatgatctccgggttgacaggattgatctctttgaacgtttcaaattcccgtgtgacaagtgcaggattgagacatctaaagcccctgaagaacttaagatctctgaccttggaggcttgcaaggtcacagcaaatgacataaggaggcttcagtcagttggtctccctaattttggaaactttcgccccgtgtagtatttatgtt

SEQ ID NO: 18771 - DNA, 354 bp, Gossypium hirsutum
  unsure (1)..(354): unsure at all n locations
  Clone ID: uC-gsflnu33B022b08b1
tgtggcagctgcagatggaggaagcatttgcaagagctcaataaaatattacaccattggcgactatgtaatcaccgaagatgaaatcaagactctcattaaagggagtgaggtagtttacaaggctattgaagcttatcttttggcaaaccccgatgcctgcaactaaagatatagcttcctttgaattctcatgcatgcttttaaagggtggtgtgattataatnggtgtggttttgtttttttatttttttttgnttctatttttttttttttctttatttctttttttttcccttccctcttttcttcttatttctccttttttttttttatctttctcctcctctttct

SEQ ID NO: 18772 - DNA, 481 bp, Gossypium hirsutum
  Clone ID: uC-gsflnu33B022b10b1
cgcgtccgccccgccaccccttctgctatcccttctaaactcaccgttaactttgttcttccttatgcatctgagctctccgctaaagaggttgacatggtaatagttccagcaacaactggacagatgggtattttgcctggacatgtccctacaattgctgaactgaaacctgggatcttgtcggtgcatgaaggaaatgatgtcacaaaatatttccttagcagtggttttgctcttatccatgccaactctgttgcggatattattgctgtggaagcagtgccagtcgaccgccttgacccagccttggtccagaagggtctggctgactttactcaaaagcttgtctcggctacaactgatctggagaaagctgaagcccaataggtgtggacgttcacagtgctatgaattcagctatcacaggtttatcaattttttaaccagctttggttcaatcctaagacttttttctcat

SEQ ID NO: 18773 - DNA, 481 bp, Gossypium hirsutum
  unsure (1)..(481): unsure at all n locations
  Clone ID: uC-gsflnu33B022b12b1
ccggctatgagctatcctaaagagggaaagacaatgcatgcatccatgcatactgaatggaactctggatttctgacgagcgaatgcatgcatactgcaagggagccgctgagacaaacgtggcttactatatgggacaagcgcacctttgactatcaaatcattagccatcaagtttctggagataccagcaaaggtttacaactgcggacaggatcctcatctggctttgcttgagctcccacagagagatcttaatccgcagtcatcaaacgttgttctgtggcttggacgaaaaagacagatattgtaggtgactatgaaaagagtgactgtcggaaagactgggaggcatgaatagggcacccatatgccgtggtaacatcgagcatatcggaccctccggaccgtggccgtacccgctgaccaggccttaggatctngaggcagcttggatttgggtgatgatagcaaagctgga

SEQ ID NO: 18774 - DNA, 542 bp, Gossypium hirsutum
  Clone ID: uC-gsflnu33B022c07b1
cttccacgcgtccggagaggagctaaaatagaatactcccaatcaccaacgcaacagccacagtcagctggctgcagaggattatctcattaactacctagctcggacttcaattatttgaagtacccattcccagcatatgtattaactggccacttcaaggttgcatcgtacaaaccttttttatttttagcaaccgaatcgaattatttacttgcgatgcctttgtataagtagcagtcattgaaggaagttgttgctttctgcaaattcctttggctccgcacattcaccatgtccgtgacgcctagatggagtagaaagaaatcccatttccctttacttgctgttcttctcttggccttcataacttgttccattctttacaatgaattcagcattcaacaaatccatgaaagtccggatcatggttctactcctaccactccacaaacttcctttacttatgtgaaacctaatcttccaaacggagcttcagaggttcttggatcgattcagaagttgcaactcaactaggaact

SEQ ID NO: 18775 - DNA, 455 bp, Gossypium hirsutum
  Clone ID: uC-gsflnu33B022c08b1
tttatttttttgttcctttttcctgttctcattgtgtgaatgttaatttcaatggctagacaagttgactcctgctgcatttgagaagcattctggaagagagacggccagaaagtggaagaataatgtttgggtgatagttaatggggagaaggtttctttatcaaagactgcattgctgaaatactacaaccaagcgtctaaaaatgccaatggtactaacagatcccataatgcaagagtttgtcaccgtgacgagtttgttcgctgtagcaggtgtaacaaggagagaagatttcgattgcggacaaaagaggaatgtcgaattcaccatgatgctctagcagatgtgaattggaaatgttcggatcttccatatgacagaataacttgtgatgatgaagaagaactagcaagtcgcatggcatacaggggcttgacccgttctccacatg

SEQ ID NO: 18776 - DNA, 520 bp, Gossypium hirsutum
  Clone ID: uC-gsflnu33B022c10b1
gaccttcctcaagtttcccatcaatggcggctaacaagaattcccatctgggtttctctttaatttctctaatctttttgttttcaatccctaaatcagtctcagcccttgatcctcaacccgcagtttgggatatgcttcccaaatacggtctccctagtgggcttttacccagcacagtcaccgattatgtcctccacgaagatgggaggttcatcgtcacgttgggcagcccttgctacgttcaattcgagtacttggtctactacgataagaccataaccggaaaactgggttatggttccattactgatttgaaaggtattcaagtgaagcgattcttgttttggctcgatgtcgatgagatcaccgtcgatctgtcacctaccggttctatctatttccaagttgggtttatcaacaagaagctcgacgttgaccagttccagaccgtccattttgccgtgatggggtttctggttctggaaattcttttggaaatctctctttaacttccgat

SEQ ID NO: 18777 - DNA, 499 bp, Gossypium hirsutum
  Clone ID: uC-gsflnu33B022c11b1
ggtccaggattggcacccggtgttagattccgcagcgatgttccgaatggtggacttgcaaacgtggctgcaaccgtcatgaatctccatggtttcgtagctccgaatgactacgagacaacactcatcgaagtggctgacaactaggctcgccgatagaacattgcctcgatttttatatatttgctctgttcctatacccaaacatcaatttagaataaggttcaaaatgttatatttttgttctttttttggccaaaaaacgttatatttttgttagacaattgtggttggagtgtttttccaggaaaactttgggcttcattgcccctttctctttaaatttgacctcataattttgccttgtaatggggccattttctgatgtttgctgagggtcggccttgatcggttcgtagacaatgatattgtgatgtaatgctttgcagacactgcgtgtattgagtttttttcccaaatataattttatgaaattaaa

SEQ ID NO: 18778 - DNA, 490 bp, Gossypium hirsutum
  Clone ID: uC-gsflnu33B022c12b1
cacgcgtccgcccacgcgtccggcctattcttcttcttccttcttaggttcctgctttgccaccccacaaccatatctctcgctatctttaaaagaaaatcgaaaaagggggttaaatttagcatttagtccttgaatttccattttcctttttgaaacagccctttgtttcacttcaagaggaactgagaactcagaattctgaagaacccattttggagatataattttcttttttctttttgctctttttgtcgggtgaaaatagtatcttcttcaacggaacagacaagaaactaataccccatttatctattttgtcagtatggataagcttgatttgctttaagaagcagcatcggtttcttcaacggatcctcctcccaaaggggagaacattgtactgaagaattaggatttttttgaggtggtaagagtaatgttgtctaaaaatgatccaattgaatcgatttcgaattcgattcaattt

SEQ ID NO: 18779 - DNA, 506 bp, Gossypium hirsutum
  Clone ID: uC-gsflnu33B022d04b1
cacgcgtccgcccacgcgtccgctttttgctcagatctcctcatctccactttttttccttcttcaaatacccaatggccgtcactttctcaaatctccacaccgagtctggtcttaaagctcttaatgacttcctctctggaaaatcttacatctctgggaataagctgaccaaggatgacataaaagtttatgccgctgttctgaagaaccctggtgattctttccccaatgttagccagtggtataattctgtttcttctcaacttgccgccagcttccctggtaaagctgttggcgttgggtttggtggcaaagctgctccagctgagtctgctaaagctgaggctgctgatgatgaggacgacttggatctatttggtgatgagacggaggaggataagaaggctgcagaggagagggaagctgcatagaagtcagctaagaagaaagaaagtggaaaggcctctgttcttatggattgtaaaccatgggatgactgagac

SEQ ID NO: 18780 - DNA, 413 bp, Gossypium hirsutum
  Clone ID: uC-gsflnu33B022d06b1
cacgcgtccggttggagcaattcatcccaagaaagaatctaaaggaccgtgagtcaccttcatcgatgcaaggtgggtttagaattctgattcgaggatcatatcgaataatttaggtttataatctcagtatgatgtttaatttgctcattcaactatgaaagcattctagaatttgattcttgtgtttgacaagtagcttgtctttgtctgattttctttacatctgtccctctgctttatgtttggaattctttatcttaatgttgctcgattgttctttgacagagtccattgaatacaaagcgtctattatctaaaaaaaaaaaaaaaaaataaataaaaattaaaattaaaaattatattataatatattaaaacatacataaaaaatattaattcaaaattaatat

SEQ ID NO: 18781 - DNA, 389 bp, Gossypium hirsutum
  Clone ID: uC-gsflnu33B022d08b1
cacgcgtccggaaagagagagtttcttcttcgctgctgcggaaggtttattttctttcccaaagaataaaagctttttctgcagtagcgttcaagtttttaccaatccaaaatttcaatttaaagaaaaaggagaaaacagaaatggctcgctctttctcaaacgctaagcttttctctactttcgttgtcgatggaatctctaacgttatctccagacgaggatatgcggcggcgtcacaaggaattgtgtcgagtggaataagaggaggagcaggaaggagcgctgctgcggtagtcaagaaaacaggggaagagatgtctggcggtgctaaagagaaggtttcatgggttcccgacccggttaccggatgctacagactccgtgaa

SEQ ID NO: 18782 - DNA, 449 bp, Gossypium hirsutum
  Clone ID: uC-gsflnu33B022d10b1
cggtttcgttgggaggcccttacattcctctcaaaactggaagaagagacggtagaaggagcagagcagatgttgtggaggagtatcttccggaccacaatgagaccatctctggcgttctcgacaggtttgccgccatgggtattgacacccctggagtctttgccctcctaggagctcacagtgtcggcagaactcactgtgtgaagctggtgcatcggttgtacccagaggttgaccctgccctcagccccgaccatgttccacacatgctccataaatgccctgatcaaatcccagaccccaaggccgtccagtatgtgagaaacgatcgtgggacacccatggttttggacaacaactactacaggaacatactggacaacaagggtttgttgattgtggatcaccaactggcttacgacaaaaggaccagaccttttgtgaag

SEQ ID NO: 18783 - DNA, 407 bp, Gossypium hirsutum
  Clone ID: uC-gsflnu33B022d11b1
ccacgcgtgcggttggagcaattcatcccaagaaagaatctaaaggaccgtgagtcaccttcatcgatgcaaggtgggtttagaattctgattcgaggatcatatcgaataatttaggtttataatctcagtatgatgtttaatttgctcattcaactatgaaagcattctagaatttgattcttgtgtttgacaagtagcttgtctttgtctgattttctttacatctgtccctctgctttatgtttggaattctttatcttaatgttgctcgattgttctttgacagagtccattgaatacaaagcgtctattatctaaaaaaaaaaaatcaaacaaccggccggtgttttacaaactagggacatgaaaaactcttgcttaccccaaacatattctctttcata

SEQ ID NO: 18784 - DNA, 181 bp, Gossypium hirsutum
  Clone ID: uC-gsflnu33B022e03b1
gcggcggcggtaagaatatggggcagatgggccaaatgggtggtcagatgggtcacatgggtccaatgggtggtcagatgggttataacatgggccaaatgggaaaccatccgatgaaccagatgagtaattttgctgcattgcaaggactaccagcagctatgaataatggtcggttggc

SEQ ID NO: 18785 - DNA, 475 bp, Gossypium hirsutum
  Clone ID: uC-gsflnu33B022e04b1
ccaccgttcgcccacgcgttcgcccacgcgtgcgcccacgcgtacgcccacgcgtccggaagctcaaaagaccagtgagaatgagataatcgaaaagcagatcaaaaatgcagttgttgaggatcgaggccaagcttcagctgtcaggattgaaaccacaatagaatcaagctccaaaatatccattgcagaaggcaatcaaatactcaatgatattcagcagactgatgaaacaacaaagacagcatctgataagcagattccaagggaatttgatcatattgagaacatggagataacaagcttggtcgtcagggaatatgttcggatagatttgcaggacagagttgatccgcaaaaggctgaaatcggagatgtcaaagagatctattcaggaggaatagaacatgctggagacaaaacagttaataattcaagtgaagaaataatcaaggagtctgtatccatggaagat

SEQ ID NO: 18786 - DNA, 211 bp, Gossypium hirsutum
  Clone ID: uC-gsflnu33B022e06b1
taacatgccacgtcatagctttcctatagtgaaacctaaattcaaaacactggccggaagtaacaactgggcgactggggaaaccctggcgaaacccacttttattgcattgaaactcaatgaggatactgctgatggcgcaatagagacaaggcccgcagcaatcgcccttgccatcatgtacgctgcctttatggagaaagtgacccgc

SEQ ID NO: 18787 - DNA, 395 bp, Gossypium hirsutum
  Clone ID: uC-gsflnu33B022e07b1
cgcccacgcgtccgcccacgcgtccgctttttcaactctcttacatccttcgccttcctttcattacccccttcttctttccatcatttctccgaacactgagtgaaaaatcccatcctcttctttgtaattaccctcgatttggatttgggaaatatcccagtcaaactctcttttttctttttcctatcaattcatgattttgtgtgattttaatccaaaacccatcaaatcaatattggatttttcttggcttaatttctcgtgaggtttttttttttgatcaggtgattcaagggatcaactttctcgattgggggtactttttgttgattccaaagagatgaatttcaggagcctggaggacttttggcccttttatgtgaatcagcact

SEQ ID NO: 18788 - DNA, 530 bp, Gossypium hirsutum
  Clone ID: uC-gsflnu33B022e10b1
cacgcgtccgcccacgcgtccgcagcctagcatttggggagatttcttcctcaattgtcccgacaagaatattgatgctggaactgaaaaacgccaccaacaattgaaagaagaagtgaggaagatgattgtggcaccgatggctaattcgacccaaaagttagccttcattgattcactccaaagactgggtgtgagttaccatttcaccaaggagatcgaagatgaactagagaatatctaccataacaacaatgatgccgagaacgacctctacactacatctcttcgattccgactactccgagagcatggatacaatgtttcatgcgacgtattcaacaagtttaaagacgagcaagggaatttcaagtcatccgtgacaagcgatgttcgaggattgttggaactttaccaagctttctatttgagggttcatggggaagatatattggatgaagcaatttctttcaccaccaaccatttaagtcttgcagtagcatttttggaccatcctttatccgagaggt

SEQ ID NO: 18789 - DNA, 384 bp, Gossypium hirsutum
  Clone ID: uC-gsflnu33B022f07b1
aaatggagggtcaggggagtgtgccactaccggttgcatgacggatttgaataaaaagtgcccgtcggagctgaaattcgatggtggcgacgcctgcaagagcgcgtgcgatgccttcggcaatccagagtactgctgtagcggtgcctacagcagtccaacagcttgtaaaccgtccatttattcagaagtgttcaaatcagcttgccccaaatcgtatagctatgcttttgatgatgccactagcactttcacatgcactggggctgattataccatcacattctgtcccaattccccaagtttgaaatcttcaaaggatcctgctgccgaatcaaccggtgaatcaggaccggatacggactccgtgcaggcggctgcact

SEQ ID NO: 18790 - DNA, 279 bp, Gossypium hirsutum
  Clone ID: uC-gsflnu33B022f08b1
acgcgtccgtccccattgaaaagcattgatgatattcaagagaaatttaaaagttattgtctgggaaagttgagaagtagtccttggtccgaactggattcacttcagcctgagacaaagatcatacatgaacagctgggaaagatcaatttgaagggtttccttactatcaatagccaacctgctgtcaatggtgaacgctctgattctccatctgtcggttggggtggccctggagggtattgtctccagatcgcttattcttgagcttatgtgctc

SEQ ID NO: 18791 - DNA, 222 bp, Gossypium hirsutum
  Clone ID: uC-gsflnu33B022f09b1
tactagatatcttatagatagagttacctaaattcaattgactggccgttgacatacaacggactgactggaaaatccctggacctacctaacttaattggcttgaaatacatctttctttagccagctggcgagatagcaaagaggcacggaccgatcgtcctaacaaacaggcgcgcagactggatggtgaaaggcacgctgcctgtagcggtgcattaa

SEQ ID NO: 18792 - DNA, 409 bp, Gossypium hirsutum
  Clone ID: uC-gsflnu33B022f11b1
agttggtgcttgatgtggtgctgagagggtatagtgggtacaatacaaggtgggcgctgaaggtacttgatagggtttttcccacggtgggtcacgacggtgcggcatgctgcgtcgacagtttgctggaaccgtgtttttcgtagctaatgatgcttgcctccctgatagattcgctgctcttcaacacgatccacttgatgagctcatgcagaactctacactatatagtgctctcactttaggaggttttatgcaactatctcatttcctttctaggctcccaatggttcctttcacgacgctgtggtggaaaattactgaaaagtacaagggtggttcttctaccttagctggaggcaaaacaaatccttctcgaaaactacccgctcgggtaatatccctcttc

SEQ ID NO: 18793 - DNA, 298 bp, Gossypium hirsutum
  unsure (1)..(298): unsure at all n locations
  Clone ID: uC-gsflnu33B022g04b1
cgcgtccgggtagcctagtgtttgcatactacaaggacggtgccaccgatccaaccttcctctactttgcctatggcttgaaggaaatcaagtgctaaatggagttttcacccgataccggaccggctttgttatacctaaagacttagttttaattctagatataaggagttcttaactatctattttagtcttttttatctcttttaggtcatatttataatgtttggtttttaagggttatgaactattggttaaaggatatgcttgaggaataaaatttactgttttcngagct

SEQ ID NO: 18794 - DNA, 534 bp, Gossypium hirsutum
  Clone ID: uC-gsflnu33B022g06b1
acgcgttcgggtcatgtcacgagggccggtaaagctgtggaaaaccatggtgtgcttgggtgcctgcaggacatgagagaagaggttagaaccctagctaggaaaggttcgagaagtagtgctgtcgggtatgagtgcgattggtgtcgaagagcaactagtgccagttattcagcgcttgatgacatatttagagcatggttcgaatagtgacaatgattggaaaaccgaagtatcagtagtcggattatccaatggactccccatcttcaagcaatagaaatgcccaacttgaatctgctagttccacgaaagcccctttgttgggaaaatcaatcaagcaagagaagaaaaataaggatcacatagttgcagtgagagatatcgagttggaggaacatcggaaatcaacagatagagtaaaaactgattcaaccacattagatccaagtaaccaaaacggagcaagttcatcaatcacattacagaaggacttgggttcgacaaggatcagacccggatcttaaaacatgt

SEQ ID NO: 18795 - DNA, 551 bp, Gossypium hirsutum
  unsure (1)..(551): unsure at all n locations
  Clone ID: uC-gsflnu33B022g07b1
ggttttcgtgtttgtctattgaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtattgatatattgtcaaggatggatgcctgcaaggtctataattatgtctctgtctgtgtcttgtgtaatagaagctttgtttgtggtgaaaataatgtataagccatttggttgggagcaaattgtccttttctccaaaggattnttgctgctcattcatggtgactngggtttatggtttattctgtggtgtaaaatcttataaaaat

SEQ ID NO: 18796 - DNA, 540 bp, Gossypium hirsutum
  Clone ID: uC-gsflnu33B022g09b1
aataacctccccacaaaaaacctcctttcaagaaggttttcaaccagtgattttctttgtcctctttgtaaggaaaatagagaaacccttgaccctattttcttcaattgcaactttgtgagagcagtttgatttggctctcctcttgctcttcgcattgactccgtaaacgaaaattctatatccaattggattcttcaatggcttcaatgaaataatctctcgcttgagtactcaagaaatttctaccctgctatgtcttgcactctctgaataatctggaagtcaagaaataaactcatatttcgaataaccatcccttgccccattggtgcgattaaaagaatctttgacatgtttcaatcgtcctcaattccttcccggacacctcctgccagaacacattcggcttctatttcggatgctcgcacctcacaatggtctctctctctgaacatggttcaaaatagacaaaataacatgattagaggatcaaccatcatccataattctaacggtttccagctgatgtctatccat

SEQ ID NO: 18797 - DNA, 298 bp, Gossypium hirsutum
  Clone ID: uC-gsflnu33B022h01b1
cgcgtccgcccacgcgtccgaattttctgtgaagcacgagcagaagcttgactgtggtggtggctacatgaagttgctcagtggtgatgttgaccagaagaaatttggcggtgacaccccgtacagcataatgtttggccctgatatttgcggttacagcaccaagaaagtacatgccattcttacatacaatgggacaaatcacttgatcaaaaaggaagttccttgcgagactgaccaactcactcatgtgtatacattcactgtgcgtacagatgctacctacaggatacttatt

SEQ ID NO: 18798 - DNA, 228 bp, Gossypium hirsutum
  Clone ID: uC-gsflnu33B023a04b1
cgttctcgtccggatcggatgtgtaaatttatagttttatccttgaaaatgaatcaatttgttgtaaacgcgattttcgtttgtcgtgctcctttgtttgtttggtgatgttgaattttaaccaaaaatcttagcattcaatagaaataaaaagaattttaatatataaaatacattaacttaaaaaaaaaataataatttaaaaaaaacatccaaattaattaatac

SEQ ID NO: 18799 - DNA, 448 bp, Gossypium hirsutum
  Clone ID: uC-gsflnu33B023a08b1
tttacgcgtccgctcgagcaaaaggttgcacaattgagcaaagtgacttgcaatatctccgagtatacccgaatggtcctgctcgagaaaaataaaatagacaaggccatagaatcttccggagctcaaaaggtaaagaaaactgatccccacaaaatcgaagatcctttagcgcctcgaaagacactgcttcaaagcctttcagttggcttcggtgacctaactgcaaccgctgaaaacatccgtccaggattcgaagaaccgaaattacctgacgcagccgagattttcttgaaggcaacatcgaattgttgtggtcggatgtgtaatcgatgctgttgcatgtgctgcatacaatgttgtttaagatgaatgatcaatgtgccattgtattaacacagattttcactgcattggcattcattggttgcattgaatgttgcacatt

SEQ ID NO: 18800 - DNA, 209 bp, Gossypium hirsutum
  Clone ID: uC-gsflnu33B023a10b1
gtaagaaccacatacaatgaggtggcagatgaacttgtagctgaatttgctgatcctggcaatagagtagcatcaccagatcagcaacagttcgacgagagaaacatccgccgaagggtttatgatgctctgaatgttctaatggcaatggatattatatctaaggataaaaaagaaatacaggggaagggacggtctggaactgggct

SEQ ID NO: 18801 - DNA, 507 bp, Gossypium hirsutum
  Clone ID: uC-gsflnu33B023a11b1
gttagaggaaggcgaattgcattgtggagaaaaagaagggaaaaggatttcactgaaaacgatgcatactgagttctcagttgacgatttctccgactccttttgggcggctccgccggggatgagccgaagccaatcggagtgggcttttgacaattttattgaagagttttctggttcgggcggggcgatcccggtgtcgcgttcggacgagagtgtgatcggtccatccttggcggaacctcggccgtccgtttcgaaatctgaagaagccgatggtgaaggtgacgtgctggagatcaaaagacctggtaatcagaatcataacagtccgccgtccgatctggcaccgacgttctggattgactcggatgagtaccgcgcgatcctcaaggacaagctccatcaagcctgcgcaggtgttgctctctctcgtgcattatctgttaaggcagaagttattttttgcgcaagctgaagatcaagcggttcaaccgagatcccaaa

SEQ ID NO: 18802 - DNA, 190 bp, Gossypium hirsutum
  Clone ID: uC-gsflnu33B023b03b1
attaaacgtttgttggagctctgtgtttttagatgaaatacatgaaaacgtctctgctaagcctattttaaatgacgacttgctgcctgcttgctcgggtgtcattcaaaaaaaataaaaaaaaaaaccaacaaaaaaaaaaaaaaaaaaaaaaaaaaaaaaaaaaaaaaaaaaaataaaaaaaacacca

SEQ ID NO: 18803 - DNA, 501 bp, Gossypium hirsutum
  Clone ID: uC-gsflnu33B023b08b1
ttttactctcttctttttcagtacaaccctcaattccacaacgcgatgcaagtgacccacgacgatttccagtcatgcaacggaacatctgccatcgcctcctacacctctggatccgactccgtaaccctcaaaaggcctggccacttttatttcctttgcggtgttccaggccactgccaagccggtcagaaagtcgacgtattggtcaaatcatcgtccaaagccccaattgcaagtcctagcccatccactttaggttcatcgcctgcaaacccaccgtcagaaatgttgggtgctcctggcccagctcagagcagtgccctgtctctcttctcctccaagaattccctggcatggagtcttgtcgcggttggcggcgtcttcggttttgccttctacttctaggctggcgctccttacaattgtggttgtgtttggggctattatgtgatggcatcatcatatttaggtcatatggtattaatgaattatggttgt

SEQ ID NO: 18804 - DNA, 121 bp, Gossypium hirsutum
  Clone ID: uC-gsflnu33B023b10b1
gtcattttccttggaaatgctagaaggttgcttgaaatgagatgtgatgggaacagccgtcttggacgcctttgtaaattaagccttgccccagttctttagatcatgatcttggaaatgc

SEQ ID NO: 18805 - DNA, 443 bp, Gossypium hirsutum
  Clone ID: uC-gsflnu33B023b12b1
ctcacgcgtccgctcaaaataactctttattctttcttctttattttttttgttccgttctgggctgcctttttttcttttttccctatcttttctttgctatgcgccagtgttggtgcaatttcatttcaaggtgacataaaactgcaaagaatttcaatatatttgttttcctcattgatccaaagtttttccaagtctactcgatttgatatggaaatggaaaactttttgcagtgaattatcagtgggggtctagctatcttcttttagggtttctattcctttacactgcttttctttagggtttctttgagtcttttgatttgtagcttgaataaagttttatccttctgctttgtttggctcagctgaatttgttggcaaaaaaataatggaagaatataatcagcttaacgagaatagtacacccaggggaaatt

SEQ ID NO: 18806 - DNA, 355 bp, Gossypium hirsutum
  Clone ID: uC-gsflnu33B023c01b1
atattgggagcatcattccccaccattctccacatctagcagtcgaattggtagttctgatcaaccttcaaatcctcctgtcagtcaaaggtctgccaggagtggtttctgatatgccaagatcaggatcttttatgcgcccgtatgttgttggccacagatctggtgctagagcatggagttcagtggaatcctcattgatttctccttaccctggtagcaatgctcgagcacgtgatagagttcaagccctccaggcattctattatcaacatcatccgagcactttgccgttaataaggacacccgttatttctggctccctttggtaaagctcagacagaaatttatgctc

SEQ ID NO: 18807 - DNA, 441 bp, Gossypium hirsutum
  Clone ID: uC-gsflnu33B023c06b1
tataaaaaaaaaaaaaaaaaaaaaaaaaaaaaaaaaaaaaaaaaaaaaaaaaaaaaaaaaaaaaaaaaaaaaaagggaggccgttttttagggggcgggcttttttgcggtgccgtgcttccttacgggtcctttgtagggcatcctttttttattgggctgcctattttctttcccctgcccgcttgtttcacccgtggggttggccaatccttggggttgccgaactttctcgttttgccggctgtccttttttcgaggggggcctatttgataggggttcccatacggtgcgcccttctgaacggttattggttcttgcccgtgttgtggggccctctccctgttgcggggtttttttgttccgccgcgtgttttcctcttccccttggcttgggccttttcccctcggcgggctcccttttgcttccctcttttttt

SEQ ID NO: 18808 - DNA, 206 bp, Gossypium hirsutum
  Clone ID: uC-gsflnu33B023c07b1
tccatagtactaacaagggcagggaaactttttgcgttgcatactggagatggacgcattgtctggtctcacttgctacggtctctacacaaatcagaggcgtgtcaatctccaataggattaaacttgtatcagtggcaggttcctcatcatcatgctatggatgaaaatccatctgtgcttgtagttagcacgtgtggttcaag

SEQ ID NO: 18809 - DNA, 331 bp, Gossypium hirsutum
  Clone ID: uC-gsflnu33B023c08b1
atactctcttacatggaagcatggtgacatattccttatgtgtctctcttcttcgcaaattttgtcctcttaccttttgaagccagagagttttcccccttcgtataggtcatttctcaataaacatgttggaaaggatcaggtcatcctgcaaggcgttaaagagcatgcaagtggccttccatacactaatttggaagcaatagagaaatttttataaggcaaaaggagcagacgttaaattagatccaaatatgaaaatcccatgtttcgtgattcaccggaatcaagcatgcagttcacatgtttttactttttttagtgaagcatt

SEQ ID NO: 18810 - DNA, 478 bp, Gossypium hirsutum
  Clone ID: uC-gsflnu33B023c10b1
atttttgctcaactcacaggtcatgaagatgtgggggagaactggacgtgggctgtgctacacgcgagttggccggtcgtgggaggtgcgccgacgcgcgtggtggaagggagcagcggctgttttccttttttgttgaaaagttagtttagttttgggtcgtttgggatctagggttaggtttattttgggcttaattgggtttattgcttttgtaattttggactcttcttttttggatttttttatgtggattatttgggttttatttattgggctagaattaagtatcccgggctaaaattgggtcttacaaaaatcacaagttcaaaagtcttaagactctacggtcaaaaacctagaaatcaagttcgcaactacatttatataagtttttagtttaatgaaaaaatatttgtcagtttgtttactaatccttataccatttcagtctcttccttctttccattttggggtt

SEQ ID NO: 18811 - DNA, 194 bp, Gossypium hirsutum
  Clone ID: uC-gsflnu33B023c11b1
tttcaagtcagtatacaatgttactagggtgtttgtttgtttgtttgtttgttgtgtttttttttttttttgttcttttccttttttggttgggagtttgtggtgatgaacatgatgagatgctcgatcaaattgctaaagttgggtgtgtaaatttgaatcacatatatattttattatgaattttctatttt

SEQ ID NO: 18812 - DNA, 179 bp, Gossypium hirsutum
  Clone ID: uC-gsflnu33B023d02b1
actaatcttcttctccttctcagaaatcttagtatcatcactatggcctcaaatcccaaggtcttctttgacatgacgatcggtggtcagcccgctggtcggattgtgatggagcttttcgcagattgcactcctcgcactgcggagaacttccgtgccctctgtactggcgagaaagg

SEQ ID NO: 18813 - DNA, 271 bp, Gossypium hirsutum
  unsure (1)..(271): unsure at all n locations
  Clone ID: uC-gsflnu33B023d03b1
cgtcngattgtacagtaattgagttgtcatcatgtgaacttcacaataaacagtaactgttggagcagacgaatctctggacaatccggatggccattgtaattttgtgcagaatcagtgaaaatgataccctttttgcacaaaataaaaaaattaataaaaataaaaaataataatataaaatcataattatataataattaataatatatttatctcatatataattaattaaatctttattacttaaatttaattataaatatacttt

SEQ ID NO: 18814 - DNA, 462 bp, Gossypium hirsutum
  Clone ID: uC-gsflnu33B023d04b1
tgtctttctttcgacgacgcaagcggaaaaaggctgtttctttgttatatgcctccatttcccctttcatacaatggtccaaccataaatgcttataaaagaaaattggccgcgaaactgacctttaagtcaagactgggagtaaagtcgttataaaagaaaaagcccacgaaacgttgtcaccaagaaggatgataaagtcgttatacccgacctacgagccggtgacttgaacggatccgtcaacaaattgaatgcttcgaccaacatggtagcattaagacgtactactctgaatacaagggaacgtgatgaggaaactgaaaatatagctcatgaacgatggccaccagaaccgaagaaagacagtatgcatggttgaatggggaaaaaagccacccaggggtaaattgcctcagatgatccaaaaaaaagcttcatattataccaagatttcgaatg

SEQ ID NO: 18815 - DNA, 278 bp, Gossypium hirsutum
  Clone ID: uC-gsflnu33B023d07b1
gttcacggctatggcgcttccccacaagaccccaacatgtactatggagggtatcctgggtacggaaattatcaacagccgcagcaacagcaacaagtcggatatagctaagtgctgatattaactgtctttcgtcgctgctgttctctatttaccagtattatgaacttgtgctacttgatttctcctttgtttcgatatagggggatataaactttaaggttgtgttatttatttgttaaatagcatatcacctgtataaacctctttttaattat

SEQ ID NO: 18816 - DNA, 497 bp, Gossypium hirsutum
  Clone ID: uC-gsflnu33B023d10b1
ttaaacggttggaaaataagtacaaagctgcacaacaggcttctgaagattggtaccgtaaagcacagctggctctgcagaaaggagaagaggatcttgcacgtgaagcccttaagaggcgtaaatcttttgctgataatgctaattcattgaaagctcaacttgatcaacagcaaactgttgttgataatcttgtctctaacacacggcttttggagagcaagatacaagaggcaaagtcgaagaaagagactttgaaagctcgtgctcaatctgcaaaaactgcaactaaagtcaatgagatggtgggaaatgtcaacactggcagtgctttagcagcttttgagaagatggaagagaaagttttggcaatggagtctgaagcagaagcccttgggcagttaaccactgatgatcttgaaggaaagtttgcattacttgagagcacatcagttgatgatgatcttgcacaaatgaaaagggaactctctggtagc

SEQ ID NO: 18817 - DNA, 266 bp, Gossypium hirsutum
  Clone ID: uC-gsflnu33B023e01b1
tctactcgtccgcccacgcgtccgctcatatgggacttttctactatacgtatatgagagcctacattactttaccattatattgtattctttgagacattattattatttttttaccttttgaggacactcttttttgtattagaaggaatttattgtttattttgtttggaatatgttggttgatttattcgattcatatatattatataaaagtaattatgttattcaaaaaaaaaaaaaatattgtatgtaaagaagaacag

SEQ ID NO: 18818 - DNA, 51 bp, Gossypium hirsutum
  Clone ID: uC-gsflnu33B023e02b1
tttcgttcagctgatggaaacgaaactgacgagcatacattgttgctaccc

SEQ ID NO: 18819 - DNA, 516 bp, Gossypium hirsutum
  Clone ID: uC-gsflnu33B023e07b1
ctccatcaggaggaaaaaagcaaaagaaccctaccgactatgttccggcaagcgtcacgcctcttggctcgaactaccaccccatggaggggaagtcttgctattttttcctatttattttttttacattcttatttatttaattatctcttttcttctttcttacttttttttattttttttctatttatttctcttttttttctctttttatattctattattctatttttacctctctttcttttctttttttttcaacctcttttttttatttttttcttttctattttttcttctctttttctattatttatttctttactttatctctttttttgatcttctcatatttttatattcctattatcacattctttttcttctttccattttcattctttcttattccttttattttattttttttattttcttttcttttaactttttctaattcttcttaattttattttattttcatttcatctttttatttttctttcttttattttt

SEQ ID NO: 18820 - DNA, 330 bp, Gossypium hirsutum
  unsure (1)..(330): unsure at all n locations
  Clone ID: uC-gsflnu33B023f02b1
gttcngccggcatttcaggtggtcatattaaccctgctgtgacctttggattgtttctagcaaggaaactgtcacttacaagggcattgttctatatgatcatgcagtgcctgggtgctatctgtggagctggtgtggtgaagggattccaaggagataaccgatatgagatgttgggtggagtatttcttgtatatacataacatcttctttattcttaaatctctttttcttcttatcccactttatttttctcttttcctatttactcatcaccaatatattttttcttcatttattctactttctctcatctctcttctaattttc

SEQ ID NO: 18821 - DNA, 322 bp, Gossypium hirsutum
  Clone ID: uC-gsflnu33B023f04b1
tcacgcgtccgcggattagcaattgcaggtcgggttccactactatcacctattacaaaggacaacaagcggtacttggcgaccaaacgagctaaaatgggccatgtatacgacttcactagcagtatgaatagtgttatcattggcggcaatggtaacacaacttcggcagtggatgctgtgtctgaatcttaggatccagtcacttccgacttggctttcaatgctggtaacattccgacatgatcaccttattacatgataattgtatgaataggacatcatgtatgaaaattgggtaaaaatgcaaagatttatgctt

SEQ ID NO: 18822 - DNA, 174 bp, Gossypium hirsutum
  Clone ID: uC-gsflnu33B023f05b1
ctcacgcgtccgattttccttttgctttctgtggtctgtttagataagagagagaaaccagggggaaagctcttaagtgctgaagaagcatcgaaagtggcaatggcggttcctatgcaatgggctttctcttctttagctcttctctttttgtttcttgttggtggatcaaat

SEQ ID NO: 18823 - DNA, 254 bp, Gossypium hirsutum
  Clone ID: uC-gsflnu33B023f08b1
ctcacgcgtccgtgccctgggggttggaaggagtcttttatctcacggaaatatgcccccatcttttatggtgatgagcaatggggattcacgagacgagatctccgacactaatccttcacttgctctttcccttgcattgccttatcctaaggcaggtggtagcggcagcggcaccacattaaaacttgcttcagacatgaagttacccaagtgccaatgaggtgaacactacactgttgctttttggtggc

SEQ ID NO: 18824 - DNA, 434 bp, Gossypium hirsutum
  Clone ID: uC-gsflnu33B023f09b1
tgtattataatcaaaaaaaaaaaaaaaaaaaaaaagaaaatttaataataaaaaattgaaaaaaatataaaaacaaaaaataaaaataaataataatttatttatagtgtcttctctatccttcttctctgcttgtcttggggcgccggtttttgtgtttccccgtcttccttttccttcttgtcctctcttctttttgtctttgtgtttcctcttttttcttttttgggcctttttgttgtcccctcggtttttgggttacccgtcccttcctccttttttgtttcgtcggattcttttccttttttttcattctggtttttcccttttctgttcctttccttctgcccctcttccattttctttcttcttttttgtctttttggcccccctctttcctttcttctcctattctcccttcttttttgtttcct

SEQ ID NO: 18825 - DNA, 444 bp, Gossypium hirsutum
  Clone ID: uC-gsflnu33B023g02b1
ccctcgcttctctcaaaacaaaggaaaaagatggcggaggaagagagaaagaatacgctgtcccctctccctctttccttcttttcttccctttctcttcctcctccctcccctctttccctctccttctctccctctttccccttcctcctttcctctcccccctttcctctctcttccttttcttccttttttctccccttccttcccctctacttttcttctcctttctcttcttttcttctcccccttcttttctcttctttctttatcacccctctttctttctctcctttttttccccttccccctccttctctctcttccttttctcccttcctttcccattctttctcttctcctttctcctccctctttcttcttccttctcttcttttcattcttcttttcactattctccattttcctccctatccctcctct

SEQ ID NO: 18826 - DNA, 501 bp, Gossypium hirsutum
  Clone ID: uC-gsflnu33B023g08b1
tttatatgatccaaaccttcgcttgccactttggccttcagctgatgaggctaggaaacagattttgtccatttgggataaggcagatattgtcaaggttagtgatgtcgagctcgagttcctcaccggtagcaacaaagtcgacgacgaaactgccatgaaactttggcgacccaactttacactgctcttggtcacccttggtgaaaagggtagccgatactacaccaagaatttccgtggggcagtcgatgctttccatgtcaataccgtggacacaactggcgccggtgactcctttgttggtgcattgctatgcaagattgttgaaaacccaaccattcttgaggatgaagcaaaattaagggaagtgttgaaatttgcaaatgcatgtggagccatcacgacgaccaaaaagggagcaatccctgcactaccaaccgtggccgatgcccttgccttaatcaatggagcttagattttagcaacttgaatatttgc

SEQ ID NO: 18827 - DNA, 95 bp, Gossypium hirsutum
  Clone ID: uC-gsflnu33B023g11b1
ctcacgcgtccggttccttaatatatgtttgagattttgttgtattagaacttgttttcaagctatgaatctaaaactacaatttaatggtctgc

SEQ ID NO: 18828 - DNA, 258 bp, Gossypium hirsutum
  Clone ID: uC-gsflnu33B023h03b1
cttgcgaaagccttcagagcatttaccattgacctgtgccggaaaggaaataagaagattttgcttgaccatggctgacaaggcagtgactattaggaccaggaagttcatgaccaacaggcttctttccaggaagcaatttatcattgacgttctacatcctgtaagacccaatgtttccaaggctcacttgatcgtactgccctctctaaatcttctttttccattccctttttcatctttccttttcttctatct

SEQ ID NO: 18829 - DNA, 500 bp, Gossypium hirsutum
  unsure (1)..(500): unsure at all n locations
  Clone ID: uC-gsflnu33B023h05b1
gttaaatggaggcaccaaagacgattcagcacgaaattggaggagtccagaacgacgcgctgcgattcggtctccacggcgttaagagcgacctcgtcggatctcaccctctccaatctgcttacgaatcagcaaagaaaacgcaggaagagatgaagaggaaagtcctggccaatacttatgggacagcaatgccactcaaaatggatctcgataggcaaattctctcgcggtttcagaggccattgctaccatcttcgatgctagggttggaagcgatgacaggaactttagataatttggcttcgaggattatctgaatgatcctcgagattcggagactgttcggccactggacttgcaccacagcagngaagttcgtctcggcctctccaagggaccagtctgccctagttttatgtgagattttcattgactacttcagtgttgtcccatgaagggagtcactgctgaaccttttatttgcccttatgaattag

SEQ ID NO: 18830 - DNA, 242 bp, Gossypium hirsutum
  unsure (1)..(242): unsure at all n locations
  Clone ID: uC-gsflnu33B024a06b1
aaagagatggaacatatgtcacttgagganttcggatgtggtggatacatccacatatagtgttgacgtaggaatgtgatgacccggttattctgcaaggtgcttacagtctttgggtttttggttccttttggttctgcaagtatcttaagctggtcaagttactttattttgcaatccttcacgttgaagattgacccagccgagctcttttttacagttttgatatgcttgatgggaac

SEQ ID NO: 18831 - DNA, 84 bp, Gossypium hirsutum
  Clone ID: uC-gsflnu33B024a07b1
tttctaactttgggatataacgaaatctaaggtcttgaaaatgattatatatgcttggaatagatagggcgattgctatgataa

SEQ ID NO: 18832 - DNA, 222 bp, Gossypium hirsutum
  Clone ID: uC-gsflnu33B024a08b1
ggtaatgtgagcactgcactatccgaagaagcaatgtcaaaatgccttaaaaaaagcatctacgaggcaatatctatggaggatgttgcaaaggtcagctgtgaggttgaaaaggatgatgtgaaatgcagtatatgccaggaagagtatgttgttggagatgaagtagggaggttgctgtgtgatcatttgcaccatgttgtgtcgcattcttgtagtgtc

SEQ ID NO: 18833 - DNA, 264 bp, Gossypium hirsutum
  Clone ID: uC-gsflnu33B024b07b1
tgtacacattaaaggtttgtccaaacttgaatctcttaatatcagatgctgtaaatgtatcacagacttggacttgaaggctatttcagggcttaataatttgaaggagttgcaaatatcaaatagtaacgttacagattttgggctgtcttatttgagaggtttgcacaaacttgttatgttgaatctagaaggatgtaatgttactgctggatgtttggattctcatcttagcttttgtagttttggcatttttaaatctag

SEQ ID NO: 18834 - DNA, 488 bp, Gossypium hirsutum
  Clone ID: uC-gsflnu33B024b10b1
ttggcagcgtttctcaccaaccaaacgctgttaaggaaaaaaacaatgagaaaagcatggccaagaaaggaagggaactacacgaatccatgtttaacgatgcatcagccatgggcttcattgttagtttatgggatcaaacgtatagaaggcaggtcttggcctgctccaatcagaggccgcctttggatacatgctgccggtaaagtcccggatgaatctacgatcaaagcaatggaggatttctatagggaaatttacacattgaatggaattaccgatattaaatttccagaacattaccctatctcaagactgctagggtgtgtcgaaagtggctggcctgttgacatgtgaagaaattgggttcaatgggaggcacttacctgaaggggttaggcttagaagaccaactgatttttggtggctttgtgaacaacccaagaaatttgttgtttcaattcgagatgccaggataccagcgtatt

SEQ ID NO: 18835 - DNA, 67 bp, Gossypium hirsutum
  Clone ID: uC-gsflnu33B024c05b1
acatgtcattgattcaattttcagttttttctttaagaacaataaaattcctattggggaatttata

SEQ ID NO: 18836 - DNA, 481 bp, Gossypium hirsutum
  unsure (1)..(481): unsure at all n locations
  Clone ID: uC-gsflnu33B024d06b1
ttaatggcttgtgctgaagctgttcaacaagataatcttaaactagctgatgcattagtgaaacatattgggttacttgcttcatcacaaactggtgctatgagaaaagttgctacttattttgctgaagctttagctcgaagaatttatagaattttcccaccagattcacttgatccatcatataatgataagttacaaattcccttctatgaaacttgtccttatttgaaatttgctcattttacagccaatcaagccatattggaagctttttcaatggctagtagagttcatgttattgattttgggctaaaacaaggtatgcaatggccagctttaatgcaagcacttgcattaagacccggtggaccaccggcgtttcgattgaccggaaatggaccgcctcaaccggataatactgatgcgttgcaacaagtggngtggaagctagcttaattggccgaacgcatcgggatcg

SEQ ID NO: 18837 - DNA, 375 bp, Gossypium hirsutum
  Clone ID: uC-gsflnu33B024d07b1
atttgggcacatgcctagttacattccgggttatcccggatacgggcacccagcttacgcgtatggaaacccgtatccgcacccacacgggcatggttaccccgggtatgtgccaggttacccggtgtatgttaatccacctcaccagatgtttaacgatgagaacaccaatgcttgtgctatcatgtaaggaggaatggggtttacggtataggtttaggtcaaggaaaatggaaaaaaaaatagtgtaaataggaaatagacaagaaagtttacttggagaagaaaattttcttatatatgttggattccagggttttgaacttgtcatttgttgttaaaaaagttttactgttgtcattttttatataatta

SEQ ID NO: 18838 - DNA, 168 bp, Gossypium hirsutum
  Clone ID: uC-gsflnu33B024f01b1
aggagttaacaaagcttatggaggagaaagagagaattaaagccgaagctaaagctcgagaaattgaagctgcataagcagtcaagacaagtgcaaaagcggcttgcctcatctattactccatcctaagttattctgggaagaaagaagttgaatctgacttcaatc

SEQ ID NO: 18839 - DNA, 150 bp, Gossypium hirsutum
  Clone ID: uC-gsflnu33B024f04b1
ccagaccaacaaagattgatttttgctggaaaacaacttgaagatggaaggactcttgccgattataatatccagaaggagtctactctccatttggttctccgccttcgtggaggtctgcagtatctagtaaagacatctaattcggac

SEQ ID NO: 18840 - DNA, 547 bp, Gossypium hirsutum
  Clone ID: uC-gsflnu33B024f12b1
aaaccagaaacttcaatttaatggttaagaataaggatgcataggctttaacaggttatagtgtttacaattagcaacttggtttgcgctgcccttgtgtgcccaaatataatcccaatctgaagtgtaaaatatttgccggtttgaagtcagtttttgagttctgcccatatccccataaaatgattcctgatggcaggaatagctgtaattgaagggtaatatatggcaatgggggctatatgtgaacacattggctgagaaagaaaaaggataaccccagatacctgcttgaagttttgaattgttttggagaatgattattgattcaagagagaaccattacatgataaggtttttctcgaaagtgtttgatgataaaagactccaggccataatggccattgattttttaggttaaacccgtctgtaatagacacagaagcattttagaggtgaaaatatttttatatagtatgccaagaaaatcgcctgtcccttcagctcattcttgacatgtaattgtactctttagtatagggtcgga

SEQ ID NO: 18841 - DNA, 359 bp, Gossypium hirsutum
  Clone ID: uC-gsflnu33B024g09b1
gcgattgctaacgcgattttgcacctcgctttgggatacgtgacaagtgtgacaatcgatatgggatttctggtggaagcgcagacggagaatgagttgccggaaaagttgatcggtgcggttagggtttgccagatggagatgtcctctgcgactgtggttgacgcacttactccacagattcaaccggcggcggcgcgtgtaatgggttgttcgaaggtaaatcaccataagtccggtgatgacgaggatgatgataaatgataactctttttttcccttaatttaaaattaatattttcaggatgtcaaatggttgtccctttttttagaggggattgatgggtatagaaaataaa

SEQ ID NO: 18842 - DNA, 150 bp, Gossypium hirsutum
  Clone ID: uC-gsflnu33B024g11b1
gctggcttctgcgaggaaaaggcttcaagaaagttacaaggaagctgaaaatgccaaaaagcaaagaacggtacaagtgatggacattcatgagctaccaaaacccaagaatgccttctttgccaaatacaagggaggttctttctactc

SEQ ID NO: 18843 - DNA, 104 bp, Gossypium hirsutum
  Clone ID: uC-gsflnu33B024h04b1
aaattgaaaaaaatgagctccgatgatccgaaccaacccggtctcgtgataactgcgaccgaatccattcgctcgtttcttcatctcagcctccaatgaccatt

SEQ ID NO: 18844 - DNA, 130 bp, Gossypium hirsutum
  Clone ID: uC-gsflnu33B024h06b1
tcatccctttcttctcttctttcaactcaaagaaaactcccaagtaatattagaatcatgggtgttgccacttattactatgatgctacctttccagccgcccctgtcaggcttttctaagctcttacct

SEQ ID NO: 18845 - DNA, 125 bp, Gossypium hirsutum
  Clone ID: uC-gsflnu33B024h07b1
tttgttcaattccttcgttgtgaggaacctagttgagttgtttgtagacatgggatattctttcatttgggcaaggaatgaagaatatgattctagattggaaaccaattccagtaggtatctct

SEQ ID NO: 18846 - DNA, 457 bp, Gossypium hirsutum
  Clone ID: uC-gsflnu33B024h11b1
acaggatgctcgatttggggatgagaagatggtcaacccgccgtctccaaatccgcctcctccttcgtctccgtcatcatcttcaaggaaaggagggtgtattcgggccaattttggtaacaaaccagcagtgagagtggaggggtttgattgttttgcactggcttagaacccatttctatcaacaaaagagtacatagataaaacaagaggagctaccaaaacagagaagggaattttgaaattgtaagtgactgaagagaaaaaagcaaagaaccctttgttagtgtaaatatatggataaaggggttgtttgtatgtaatgaaaaaagaacttggcgacttgtaagtttgcacaatttagttgacttcaaaaatgggagaggctctccattaatctcttaatttgtcttgcctgttttttttttacttctactttcaaaaacttattttttta

SEQ ID NO: 18847 - DNA, 81 bp, Gossypium hirsutum
  Clone ID: uC-gsflnu33B025a01b1
aaaaaaagacccccccccccccccccccccccccccccccccacccccaacaaaaaaaaaaaaaaaaaacaactccccccc

SEQ ID NO: 18848 - DNA, 239 bp, Gossypium hirsutum
  unsure (1)..(239): unsure at all n locations
  Clone ID: uC-gsflnu33B025a04b1
tttantttcaagtctgcaaaacccctagccagccacttccccgccgccgctccgaaccatgggccgagtccgcaccaagacggtaaagaaatcctctcgccaagtgattgagaggtactactctcgcatgacccttgatttccacaccaacaagaagatcatcgaagaagtggctatcatcccttccaagcgctccgaacaagatcgccggcttttcacccatattatgatgccctgcc

SEQ ID NO: 18849 - DNA, 365 bp, Gossypium hirsutum
  Clone ID: uC-gsflnu33B025a07b1
tgggttcaacatatatgttggcggtggcatgggaagaacacatagacaagagactactttcccgcgtttgggtgaacagctcggttaccttcctcatggtgtctcttcttatctttatttatttcttttttatttctcatactgatcttgtttcattttttcttctttcttttttttttctttccttcttattcttttctttctatttattctaaattctcctcttatcttattctctctcttcttctttctctttttcctcctccccctaaaaagataaaaaaaaaaaaaaaaaaccatcccccttttctcttctattatctctcctccctcttttacatcttttctatcttaccttatttttt

SEQ ID NO: 18850 - DNA, 255 bp, Gossypium hirsutum
  Clone ID: uC-gsflnu33B025a08b1
ttccggttccactccaacaaccagacatgggaaacagttacaccattattccgatgcacacttcacagagctcagcaaccagaacatctattgtacctcgatactatccgcaacgcttcgatatcctctctcctattctctttacttatcctcttttcttttcttcttactatatatcccgtttttattcctctaactctcctattaatcctctctttattctcaaattcctgccccccaagggttgccctaccc

SEQ ID NO: 18851 - DNA, 525 bp, Gossypium hirsutum
  Clone ID: uC-gsflnu33B025a12b1
tctttcacgcgtccggggaaaactgctgtttatattgatgatagagcaaccgtgctgcctaggaagttggagtggtcgggattcattttgaattctagtttgctttggaaagacggagataagccggaatggatgaaagatattgatacattggatggggatatcgagagtccattggatttggttaaagacccgtcggtggagggcctcttgaagctgtggacgcgagttatgctttggctggcctctcgagtttgaaagacttcgcattgcttgtattatgtcaaaaagttttttttccccttttcccctttttgctttatttgggggatattttaataatttttttgtggtatacccccccccttaatcccccccttttttttttgggggggctaagtgaaaaatttatccctaaatccctgttgggctttttctctcccccccccaaatttcttccaaattaaaataataatattcctgggtgccccaaataactcctttttttcctctcccaatatattt

SEQ ID NO: 18852 - DNA, 180 bp, Gossypium hirsutum
  Clone ID: uC-gsflnu33B025b07b1
taagaaaaaggtttggaccattggaccggtttctttatgcaacaagatgaacttggacaaatttgaaagaggaaacaaagcatcgatcaaggaacaaaaatgcatgaaatggctcgactcgaaggaaccaaggtcagttatttacgcttgcctgggtagcctatgccgtctagttccagc

SEQ ID NO: 18853 - DNA, 263 bp, Gossypium hirsutum
  unsure (1)..(263): unsure at all n locations
  Clone ID: uC-gsflnu33B025c04b1
cctcactcgtccgctggattagccacggaaaataaagttttgatagcaaagttcaaggtaacatacaaggaccactctattgctcagagccatgagaataagggaaatgtctaagattctcctattccactttatatttcttttttatgtcacttaaactatatttcttatttatttttcttttttttatattaatatttatttgtaattttaaacttttatttcttcaccgcctttttgaaccncctttttcatttattttt

SEQ ID NO: 18854 - DNA, 202 bp, Gossypium hirsutum
  Clone ID: uC-gsflnu33B025d04b1
cctacttcacacgggttgtggcgtagttcaagcagagagggtgcgcaggatacagctattcaccattgcttcaacatgaaggtttgaaataaaaatttgtccctatcagcactgctttgcattgctgatgcaagtgtcatcacatctactcctttttcagctgtgttgaaaggcaccgtattggaacctcacacctctctca

SEQ ID NO: 18855 - DNA, 118 bp, Gossypium hirsutum
  Clone ID: uC-gsflnu33B025d09b1
tccacttgtactaaacaagctgggagagtcaatgatcaaggactgaataaagggaatcctgctcacttcactatattccctggtgatggcaattgttcaggagatgatcaatatttcc

SEQ ID NO: 18856 - DNA, 248 bp, Gossypium hirsutum
  Clone ID: uC-gsflnu33B025d12b1
ttttgggtttttctctctgggtttcaacccagaacctggccaagcaccggtgcacaccagccgtggctccgccatacgcggcggctggaggtgcccaaaatcgggtcttttaatctccttctattcccctttttttttcttttaaaagaccccaaaaaatacttttaaaaaatgttctggttgagaaaatagatgagaaatagcatgcaagagcacggtggcctccacctgttttttgaaccccctcg

SEQ ID NO: 18857 - DNA, 147 bp, Gossypium hirsutum
  Clone ID: uC-gsflnu33B025e07b1
taaaacatcatccctttcgtgataatgaagacagtcttcactattttctcggtacttgtatccaccgtaatctccaccgtcaacggctgccctacgacggaccgcgctgcgctgctagcattcatagcacgcttccacgtgcctcac

SEQ ID NO: 18858 - DNA, 213 bp, Gossypium hirsutum
  Clone ID: uC-gsflnu33B025e11b1
tataaacggagatccacaggcttaatagtcaaaaaaattgacacaatacgcgcagtcgcatgaatccgatgacattacgtccttattgacacctacactcaagacacggcgagataatgaaacatacagattaaagtgctggaacgtcaccacttcccgagaacaggaaactttgacattaggtatctaatacattcagcttttactcagttg

SEQ ID NO: 18859 - DNA, 70 bp, Gossypium hirsutum
  Clone ID: uC-gsflnu33B025f08b1
tatatctttccagtttcaattttctcacaacaaaactgaaaatgtcttgctgctcacgtaaatgcacaag

SEQ ID NO: 18860 - DNA, 197 bp, Gossypium hirsutum
  Clone ID: uC-gsflnu33B025f12b1
tccacgcgtccggctaattggaagagtcttgaaggttaaaaccgaagaaacaaaggctctctctctttgtgaatccaatcaaatcgaagatgttgagagtggcaacgaggcggctcacttcttattcgtctgcgtggaggccgcaccaggccacctccgctatcgcctctcgtcctttcatcgacggcgccgattct

SEQ ID NO: 18861 - DNA, 158 bp, Gossypium hirsutum
  Clone ID: uC-gsflnu33B025g01b1
acattctctacacatcgcacacagagagactgggggggattttaacagaaactgcccccctcccacctcaccttcaggatagctggacccctaagtgagcatcaccggcacaagccaacgcaccataggcactctgaggcgcaacgccctcgacctac

SEQ ID NO: 18862 - DNA, 181 bp, Gossypium hirsutum
  Clone ID: uC-gsflnu33B025g07b1
ctttcctattcttgtacatctcggtgttgaccgtgattggagttgttaaggacaaaaccaagtgtacaactgttgggattcaagggattgcttgggcttttggtggtatgatctttgcccttgtttactgcactgctggtatctcaggtggtcatatcaatccggcggtgacatttgggct

SEQ ID NO: 18863 - DNA, 227 bp, Gossypium hirsutum
  Clone ID: uC-gsflnu33B025g12b1
tgtggacgcgtgggtttgaaccaaagggctgtagcagtggtggtggacccaattcagagtgttaaagggaaagtggtgattgatgcattccgcttgatcaacccacaaaccatgatgcttggccaagaaccacgtcagacaacatctaatctcgggcatcttaataagccatctattcaagctttaatacatgggctaaacagacattactactccttttttgtttt

SEQ ID NO: 18864 - DNA, 109 bp, Gossypium hirsutum
  Clone ID: uC-gsflnu33B025h07b1
tccacgcgtccgaaagataaaaagaaaagagtgcttttaaaaaaaaacctcccaaaacccccccctaacaaactaaaaaaaatcggggcggccccctctggaggatcca

SEQ ID NO: 18865 - DNA, 51 bp, Gossypium hirsutum
  Clone ID: uC-gsflnu33B025h10b1
ttataaaaaacaaaaaaaaaaaaaataaagggaattttttaaaaaaaaata

SEQ ID NO: 18866 - DNA, 162 bp, Gossypium hirsutum
  Clone ID: uC-gsflnu33B025h11b1
tcgtcacgcgttcgctagccgccattggaatgataacgtcggtaatcatatatgaaaagatcctcgtaccaatactaaggaatgcaactggaaacgaacgaggcatcaaaatcctccagaggattggcattgggatgcttttctcaatcgttacaatgatcg

SEQ ID NO: 18867 - DNA, 432 bp, Gossypium hirsutum
  Clone ID: uC-gsflnu33B026a01b1
tttcttgcaacagatgtcgcttccggcggatatatgttcttaggtgatgattttgtaccaaaccggggcatgtcatgggttcctatgcttggaagcccttcaatagaattttaccacacacaacttgtgaaaatcaattacggaagtagctccctcagtttaggtgcaaaagacagtgacaaggcaggagttgtgttcgacagtggcagttcttatacgtacttcacaaaacaagcatatgccgaattggtctcttctcttagtgaggtttccgagctaggatttatccaagatgcatcagatccaacacttccaatctgttggcgggctccatttcctatcagaactattatggatgttaaaaagtacttcaagactttaacccttcagtttgggagcacatggtggattatatccaagaagtttcatatt

SEQ ID NO: 18868 - DNA, 57 bp, Gossypium hirsutum
  Clone ID: uC-gsflnu33B028a01b1
ggtgatttttcgcgaaaagacaacaaaagccagggcggggttatgggaagtctactt

SEQ ID NO: 18869 - DNA, 315 bp, Gossypium hirsutum
  Clone ID: uC-gsflnu33B035a01b1
aggcgttcatgcgttcgggaaaagggaagagtgagaggtggattattataacacatggtgcatcatttattgaaggggaaagctaattatccaatggatgactacgtttttgcggggtgttagcaggccaatggctgtgagttcggctaatttgccatatttgatggccatttgagccatgtttttcccgcttatttgaaggcgaacttggtttacaatatctggaatgagcccgacttttgggcggaacctgagaatgcgatcaggaatgggtatcgttgaacggatacaaatatattggaacatgccattgat

SEQ ID NO: 18870 - DNA, 508 bp, Gossypium hirsutum
  Clone ID: uC-gsflnu33B049a07b1
aatccactctcacattaaatattgttagtgaaacaatggcgtcttcagctctgataagtaagcttgaggcagatgtagagattaaggcttctcctaagcagttccatgaaatgtttgcccacaaaccgcaccatgtgcaccatacttgttatgacaagattcaaggatgcgatttacatgaaggtgaatgggggaaagtcggtaccattgtccattggagttatgtgcatgatggaaaggctaaaaaggcaaaggaagtagtggaagcagtagaccctgataagaatttggtcactttcagagtgatcgaaggagatctaatggaagagtataagagctttgtaatcacgattcaagtttcgcccaagagcgagggtagtggcagcgtaatgcactggactttggaataccagaagctgcacggagggattgcgcatcctgagactctgctgcaattcgtacagatatctttaagacattgcgcccacctcacccaagcagctaacag

SEQ ID NO: 18871 - DNA, 418 bp, Gossypium hirsutum
  Clone ID: uC-gsflnu33B049a08b1
tcggtattgtttagcgacacgcctctctcactcaaaccctattgtttttgccaatttcttggatctagggttttacattctcctttttctcttcaaatcaaccttatttcatttttttgctgctcttagaaataatatcgtcaatgagcaacgaattagttaacttcaacatgttcggtcttggcgatgctcttaatgccgaagcacgagctggtctcgttaacgctctgaagaataaacttcaaagtcttgctggggatcactccgaagtgctggagagcctattaccgattgtcaggaagcgtgtcgaggttcttagggagatccagagccaatatgatgaattggaggctaggatttttgtggagagggctgcccttgtgctaaaattaaaaactatatcaccctttgtttgcaa

SEQ ID NO: 18872 - DNA, 295 bp, Gossypium hirsutum
  unsure (1)..(295): unsure at all n locations
  Clone ID: uC-gsflnu33B049b01b1
atggaccttaaaggaatggaagtatgttcttggagaggctggattcaccagaatcgatgtaaaacccattcatgctgttcaatctgtcattgaagcttatatttagaaattccaccttgcctgctttctttaaactttgtgttaataaatggcttcttttactattaaaccttaaatcctgtcgggtcttttattggccaaatcatatgagatctgttgtgggaaagatgtaattttctttttccatctgtttattattagtttggcttgcnnaaaaaaaaaaaaaaaaaataat

SEQ ID NO: 18873 - DNA, 478 bp, Gossypium hirsutum
  Clone ID: uC-gsflnu33B049b04b1
ttcgttgctatatagttctggtctgctcaacactcttccttatctctaaatctaatactcagatccgcgagtaatttttgtcacagcctattagaatggagacctttctattcacatttgaatcagtgaatgagggtcacccccacaagctctgcaaccagatctctgatgctgtgctggatgcttgccttgcccaggaccccgacagcaaggttgcctgtgaaacatgcaccaagaccaacatggtcatggtctttggagagattaccatcaaagtcaatgtggactatgaaaagattgttcgtgacacatgccgctctatcggatttgtttctgatgatgtgggccttgaagctgaccactgcaaggcctggtcaatttgagcaacagagccccgattttgccagggtggttctgggcacttaactaacgcccaaaaaattggggcttgtgaccaggccaaaagttgggatgccct

SEQ ID NO: 18874 - DNA, 329 bp, Gossypium hirsutum
  Clone ID: uC-gsflnu33B049b10b1
atcaaatctgataatgggtaattagctcgctttggtcatccctatcaactctcgtttcaagttcctcatcaatcaactagtcactatcctagtagaatcttctgatcttctactcaaatagcaagttgaaaagagctatttatcttccaacctcacaatctaaaccagtttgggatgaaggtgttcacagagggccataccaaatttgggttaattcccacattgatgacttcctaagatctcatgtctggtatagtttgttttaatctgcttcctaatcaaaaaaaaaaaaaaaaatttctttccattttactaaatccttgcttctt

SEQ ID NO: 18875 - DNA, 350 bp, Gossypium hirsutum
  Clone ID: uC-gsflnu33B049b12b1
tcgcaggcgagttcttgggatcacggtgaacctgataggttgaagaaagatcgggaaagagatagtgagacgataattgtcgatagggatgattcggctaattttgtgttgagatctgatagaattgatagaattggaggggtattgggctttgcttcgaacccgaatgtaccaccaccacagatgcacttgcaggcgccggcaagggtgccttcacctgtaaggccaccacctgtgaagtcattgaagcagccgaagccaaaggctaaagatctcgacaagagggaaatgagcatgtaagagaagcaaaagttggggattggactacagaagctaccacacgagaagat

SEQ ID NO: 18876 - DNA, 242 bp, Gossypium hirsutum
  Clone ID: uC-gsflnu33B049c02b1
gctctgtatatgtatgtttgtatgtgtgtgggtgatctgagatggatttgcagtcaacaaattgatgttggatatttattgttgcagtaaagttactgtatgtctgatggtctgtgacagattggattacattccccactgagatactaagaaccttcttgattgtattatctttgagtaattattgcaagtttaataagaaaaggcatgatattcatttagtatctcgattttataacatt

SEQ ID NO: 18877 - DNA, 311 bp, Gossypium hirsutum
  Clone ID: uC-gsflnu33B049c04b1
ctgttgtggaggcaatgacttgcgggtagccaacattcgcaacctgtaacggtggactcaggcgagattattgcccatgggaaatctggtttcaacattgatccttaccatggtgatcaagctggtgacatactcggcgatttctttgaaaagtgtaagaaagatccatcttactgggataagatctcccaaggaggcttgaaacgaatagaggagaagtatacatggaagatttactcggagagactatttgaccctgacaggagtgcatggattctggaagcatgtttccaaccttggacgccgtgaga

SEQ ID NO: 18878 - DNA, 212 bp, Gossypium hirsutum
  Clone ID: uC-gsflnu33B049c07b1
gtagcagagacaacctgcgatgccttttactgcttcatattcgaccatcagatcagaggcttagaaattaagagaaacacggaaacggacggacgaaaaacaagatgaggtgagaaaagctcttattccggaaaatgtactggccttgaggatattaggattataactaatgagaatgagcactcgttatgttagaaattggcgtcatgtat

SEQ ID NO: 18879 - DNA, 342 bp, Gossypium hirsutum
  Clone ID: uC-gsflnu33B049c09b1
ttcacgcgtgcggatatgcatgacacatgtaaatccttataggaagagaaatttgagtttggccaacttacatcctgctgccaatgatgtgcctgaaattagaggaagaactatagttcgaatccgatccatagcttgaatccgatgcaatctattaagaatttgacatgtagattgagttgtcagaggatgaatgcttatgatgttgatgaggaggacagagaacagtatattgagcatgacgattctgagtgtttttaaactactctagcttaaagcgcttgcataatcttgtggtttaaagggatttttcaaattgaaaaagtatgtattggtggccat

SEQ ID NO: 18880 - DNA, 441 bp, Gossypium hirsutum
  Clone ID: uC-gsflnu33B049d03b1
ctcactcgtccgaaaaaacatcaaaggcaaatctccttttagcattttctctcaaaactcaacctcccaaatcctctgtacctttttttttcttccaatccagacagcacccaattccatggccacctcttccccacgtgaggataatgtctacatggcgaagctcgccgagcaagccgagcgctacgaggagatggtgaagttcatggagaccgtcgtctccgccgtcccctcctccgacgagctctccgtcgaggaaaggaacctcctctctgtcgcatacaagaacgtcatcggcgcccgacgcgccttctggagggatcgtttcctccatcgagcagaaggaggaaggacgcggcaacgccgaccacgtctccgtcatccgggagtacagggccaagatcgaggctgagtttgccgagatttgcgccggaatcttga

SEQ ID NO: 18881 - DNA, 139 bp, Gossypium hirsutum
  Clone ID: uC-gsflnu33B049d05b1
gtcaatatttttaactatgccaaaattgttagtattttaccaataaattcttttatataaaaaaaaaaaaaaaaaaaaaaataaaaaataaaaaaaaaaaaaaaaaaaaaaaaaaaaaaaataaaaaaaaaaaaattaa

SEQ ID NO: 18882 - DNA, 476 bp, Gossypium hirsutum
  Clone ID: uC-gsflnu33B049d06b1
ccggatatattgaagagaagaaaatttccccttttttttttataaaaaaaatggcgtattcgggtgttctgaaaaccctaatcaggtcatcgcatttgggatctacgactcgtaacttcagccttgttagcagccaaatcagcaatcacactgcgaaatggatgcaggattcaagcaagaaatctcctatggagttgatcaatgaagtccctccaatcaaggttgaaggccggattgtagcttgtgaaggagtaagcatagtgagatcgaggagacatgaaagccctttcacattttcatgtgaagacgatgcctattttgttcatttgacatgtgcaagagagtgcatgcatgcttgatattttgggaacttacttttaagttatactgatattgttttttaagaaggttaattgttcataaaagaaatggaaactattaaaaaggagtttccttccacccaggatactacacca

SEQ ID NO: 18883 - DNA, 355 bp, Gossypium hirsutum
  Clone ID: uC-gsflnu33B049d09b1
tcgttcacgcgtccggtcaccaccaccaccggaacttgctacatgtatagagccacctgcactaccaccatcatgtgtagagtacacgctaatcaccctcaccatgaattcattacacaccatgtacgtgaccttcactcgcacactcaccaatccattaacattcacctccaccaccattacctataaccggttgttgattacgaagggacatttccacgagttatcgcgagttcatacgcataaactcctctgtcacctttgtattgattgttttaagaaatttccgttttaccttgattaaaaaaaaaccttaaaaaagaggagaaatactctttcaggaaattattttata

SEQ ID NO: 18884 - DNA, 383 bp, Gossypium hirsutum
  Clone ID: uC-gsflnu33B049d11b1
tttacgcgtccgcccacgcgtccggcttaaaggagcttcttttttctataggctgtatgtcatagttggcggagtcatactactattatttatgattactatgtcggatgtgggatgatgagggctttctttttctttaatggttgtttttctgctttggggtttgatatttagtattgaacttccttttgggtccaggggtcaacatgctgatggaagaaactataggttttccattttgaagtggtatggatgtatgtatgcatgtgtgcatgcatgcacgcacgtatggttttcggtcccaagagagtctatatgatgagtttgatactggtgtgatgagatgtgatctccatatttgcataataaatatctattttttg

SEQ ID NO: 18885 - DNA, 462 bp, Gossypium hirsutum
  Clone ID: uC-gsflnu33B049d12b1
tcgcggacgcgtgggctgatgaaggggagtgccacccttactctatcatagagtgtgaggctaaacgtgatgccattttactatctgtgatttacattcagaaaatcttgcgccgaagaccttttctgataaagaatcttgaaaatgttatgcgaagactcttgcagtcgttggagcttttcgaggaaaatgagaggaagaagcttgcaattttcacagcacttgctttctcccagaaattatcagggttgccacctgagactgtgttccagccattgctcaaggataatcttgtggcaaaagggctagttctttcattcatgacagacttcttcaaggactatctggtggataatagccttgatgattttaatttctcttctgaagcgagggaaaattgaggatgatctcctgcagattttccccttcacaagcgatctgtgaaggtttctctgagcattt

SEQ ID NO: 18886 - DNA, 504 bp, Gossypium hirsutum
  Clone ID: uC-gsflnu33B049e02b1
ctcactcgtccggaaaaaatcagtctactaggagatggaaggtagcagtgggaaaggctacgcctgggcaatctcagctggtttcaacgctgcgttcgctgccgttgccgctaaattcttgttacatccgcttgaaagctctttcatctcttcaagcaacagttacgaattttgctactaatttcctcacttctgggcttgccggcttcttcttgttcgaggaactattgtcgtttaagtggtttgcaggtgccatgatcattgtaattggtgtacttatcctcagcaagtcaagcgtagagaagagggaaaagaaggattagagttgccattaatggttgctgcatttcagctattataactttttggattcttttggcatgtctttccaacaactaaagagatgttttcagttttagcacttagccgaatccgttggattcgcgattttcatccttctttttttgtgcgtgtgcatgtgtatttgactcggtattatattaa

SEQ ID NO: 18887 - DNA, 495 bp, Gossypium hirsutum
  Clone ID: uC-gsflnu33B049e07b1
tcgctcacgcgtccggtccgcctcagatctccgtctccacatgaatggctaccaagcagccaaatactggcctctttgtgggactgaacaagggacatgttgtaaccaagaaggagttggctcaacgtccctctaatcggaaaggaaaaactagcaaaagagtccattttgtgaggaacttgattagggaagttgctggttttgcaccatatgagaagaggattactgagcttctgaaagttggtaaggacaaacgagcgctcaaggttgctaaaagaaagttgggaactcacaaaagggcaaagaagaagcgtgaggagatggctagtgtgctccgcaagatgagggctcaccctggaggtggagaaaagaagaagtgaagctctctggtgacaagtcaccttgatgatttcattagagaactttgtttagcatatgtttgaccgtattggtttgagactgaaaccttgcactgaatctggttgttaatttata

SEQ ID NO: 18888 - DNA, 503 bp, Gossypium hirsutum
  Clone ID: uC-gsflnu33B049e10b1
gttacgcgtgcgattagatttaaaactgaggctgaccatatggacggattagatccttcaagactaattatcctgcagaaggagcgatcttgacttgaacaatgacgcactgttggtgaacaagtcattccatttgagagaaatttcaagggtgctgatattgagtctggccaccatattacggatcgtactgttgaaatgaaggcggtgaccatcttagccactgctgtagcgaaaggatcttcctcaaggcctgcgaaagaagagacccgtgaatatggcacatgcagagaattcatgagcaacatgagtgctgccatgagagatcaaagtgggctaatatcaaaaccaaaaccggaggagaataacatcaaccttgctcaggtgatattgcttgaagaaggcaagtcacataatgattacctgaagggtggaacatttgttggacttgcctcaacttggcgttcaaagaaatctggttttcaaaatttaaagcaatattg

SEQ ID NO: 18889 - DNA, 132 bp, Gossypium hirsutum
  Clone ID: uC-gsflnu33B049e11b1
ttattttatgcctccgagagggtaaaaaactgaggcggacgattgtgggcagatttgatcctataagacgaattgtcctccgaaaggagcgctcttggcgtgaacagggacgcccagatgcggaacaagtaa

SEQ ID NO: 18890 - DNA, 308 bp, Gossypium hirsutum
  Clone ID: uC-gsflnu33B049f03b1
ataaaatggagcgtgaatctttaagtgatataatttgcctacctagaaagaaccattactacacgcatccaaagcgatgataacatgcttttatgttttaaaaagcccatggggtgaagtccggccctacccaatacgggaactgctaccggatgcttattgggcagcgccgaagattcccacataggagcggacggtaaccaagttggccactacttctccgacgctgacttgggcggttctatcatgagggtcaactcgtaaagtcagctgattgaacgatcctcgagagcctaaaagcagctgct

SEQ ID NO: 18891 - DNA, 512 bp, Gossypium hirsutum
  Clone ID: uC-gsflnu33B049f04b1
ctcagatagcccttatgctggaggtgtgtttttagttactatccatttccctccagattatcctttcaagccttctaaggttgcgtttaggaccaaggtcttccatcccaacatcaacagcaatggaagcatttgtcttgatatcctcaaagaacaatggagccctgcactaaccattttcaaggttctgctctcaatctgctcgttgctgaccgatccaaaccctgatgacccttttgttccggagattgctcacatgtataagaccgatcggtccaagtatgaagccactgcttcgtgctggacccagaagtatgccatgggatgacagtggttggtgctgtaatacctatcagctttcttatgtgaatttgggaaggaggatggtcatttctattttatattcttccttcatctacatatctttatactcttattctatttatctcttacttacattttcatatatttgttactttttgtttatcctctcttactaatttttttttttt

SEQ ID NO: 18892 - DNA, 439 bp, Gossypium hirsutum
  Clone ID: uC-gsflnu33B049f07b1
ctcatttgtttgtttactctgaaggggtgctctgagatcacatagaaaaatggtgaaagcagtggctgtccttagcagcagtgaaggtgttagtggaactgttttcttcactcaagagggagatggcccaactacagtgacgggcaacatttctggtcttaagcctggcctccatgggttccatgttcatgccctaggggacacaacaaatggttgcatgtcaacaggacctcacttcaatcctgctggaaaagaccatggtgctcctgaagatgtgaatcgccatgctgttgatctaggaaaatgtcactgttgatgcttgtggctttgctagtttttttatttgaagactaatagattctctgtttccggcccacacttcataattggaggagccgatttttgtatcgttctgactttgttgcccttgtttgggggg

SEQ ID NO: 18893 - DNA, 480 bp, Gossypium hirsutum
  Clone ID: uC-gsflnu33B049f09b1
tcgttcacgcgttcgcccacgcgtacgtccacgcgtccgtccacgcgtccgctcgaggatgagagttctgacaccatcgataatgtaaagtttaaaattcaagacaaggaaggcattccaccagaccagcagcgtttcatcttcgtcggcaaacagcttgaggacggccgtaccttggccgattacaacattcagaaggaatccaccctccaccttgtcctccgtcttcgtgggggttatgcagatctttgttaaaaccttaaccggtatgaccattaccctcgaaggcgagagcttcgacaccattgataatgtgaagtcttaaaaattcaagcaaggaaggcattctaccagaccagcagctgttttatcttcgccggaaaacagcttcgagatggccgtaccttggtccattacaacatccataaggatttcaccctcaacctaggccttcgttttcatgggggtatgcctatcttc

SEQ ID NO: 18894 - DNA, 408 bp, Gossypium hirsutum
  Clone ID: uC-gsflnu33B049f11b1
tcgcgtggagagccttttttttgtgtagcgattctcagttagtcttttctttaagcttacagcttctctccagagttttataatgggtaaggagaaggctcacatcaaccttgttgtcattggccatgtcgactctggcaagtcgaccactactggtcatttgatctacaagctaggtggtattgacaagcgtgtgattgagaggttcgagaaggacgctgctgaaatgaacaaaaggtcattcaagtatgcttgggtgcttgacaagcttaaggctgagcgtgaacgtggtatcaccattgatattgccctggggaagtttgagactcccaaatactattgcaccgttattgatgcacctggacaccgtgactttatcaagaacatgattaccggttcctcacaggc

SEQ ID NO: 18895 - DNA, 215 bp, Gossypium hirsutum
  unsure (1)..(215): unsure at all n locations
  Clone ID: uC-gsflnu33B049g01b1
gcgggtagcttgaggacgcatcggtcttggctaccctgtgtcttatttaatcaaattgtaaattattgtggtnaaagggagagcgtttagaatgatgccaccacaagaggcatgtaccaatgcatagaaaaagtggcaaaacgacaggtcattgatcccaacccgacctcggaaggagaaaaaaaaagaaggggggggccccttctagagggccc

SEQ ID NO: 18896 - DNA, 440 bp, Gossypium hirsutum
  Clone ID: uC-gsflnu33B049g03b1
cccacgcgtccgggcagaacaaaggaccccctttcaagttcctagtccctttagtctatgcccctgttctccctttaattcgactttctttgaggaagaacccagttttaagggaccgactgtttactattgtgttggctggggcttttattcatggttcttatttggtttcggatctatatgatgctgagagcaagtgaacattgcagagtctggcttgaggaactgattacccctctaataattattcttctattatgccttagaacaagtttgaattgtattcttctcattcctttcgatgtgggatgataatttgtatctcacagttgtaatcaagttaggcgtaagatttaaagcttcatattacggaattagtttcaattttaaagagaaataagattgagtgaaaaccaaatatccaatatatactaataccc

SEQ ID NO: 18897 - DNA, 472 bp, Gossypium hirsutum
  unsure (1)..(472): unsure at all n locations
  Clone ID: uC-gsflnu33B049g05b1
ctgatggtccccatatcagcggctacatagcctggaaatccccgaacgcttctcctagtacaggttcactaagcggagcttctagtgttgagacctcagccgaaaaaacaaaaaagccactgtttcagcctgatctgaacaagtcaatcggtaaaatcattgaactgattgaaggaattggactaacatcttccgattcttctgacagttgtctagagaaaaatcaaactcccaaacaatcaccagctcatgcagactactttgttcgtgtttttcaatggaaaagttctgaaataagcaccgntctacaacattttattcgtgcatgtaacaatatgttgaataaagggcttgtcttgaaacttttgctgaagaactcttatttacctttggctgggattgggaactattgcgttaactctaaaggagcttctagtgtaaggataagatcaaaagacattttggtggaatg

SEQ ID NO: 18898 - DNA, 493 bp, Gossypium hirsutum
  Clone ID: uC-gsflnu33B049g08b1
ttgtttacgcgtccgcccacgcgttcgaaaaaaaaaaaaaaatataaaattaaaaaaaaaaataataataaaaaataaataataaaaaaatatatgtaaaaactaaattttaaggggccgtctgtttacataatccatgtttacgtactttttaattcaaattattatctttttattagctatatttaattttaatgtattggcctttttttaactctgttttgtgtggtaaattccttgctctaataaatattatttggtttgaaattaattcctttttggctagtttttttaaaatttatttggttgttactttattttttttttaataatatttatatttaattggcaaatgtatcttttccttgttatgtttactaaaatctttgcaatttttatagtatatattaatttgtttcttattactattttatatattttatctctatttttttgttttttttatttttttttagttattatctttcttttt

SEQ ID NO: 18899 - DNA, 425 bp, Gossypium hirsutum
  Clone ID: uC-gsflnu33B049h01b1
gtgcgacgaaaatgcaaacaaggaaaccatctctatgtgtagagtttttcttgttccgagtgacgaaatgcaggagaaagtgtctagtgctcgtattggcactgaaaatcatttaccacaacctcctattctggaggctaactgcggtacgggaataggttcctcgagcaaccatcaggtgaacaagcatgatgagaaagaaggattggctgttgcagggaccattcccgttccagagcatcaagatgaaaatgatgttggaatggattgtttcacagatgcttatattgattctttttcacgtggtgacttttttgaaatgaacgatctctccaaccatgtatttttttcgagatccggtaatttaagcgcttcaagcatggcgtcagatgaatgttttaactaatggctttcttacaagatct

SEQ ID NO: 18900 - DNA, 454 bp, Gossypium hirsutum
  Clone ID: uC-gsflnu33B049h02b1
gtggtttgaaagtttgatggcattgatcgttgggcactatgatgaggcagatgagatttgtggtgtagctgccagtgtacgccaaaggcacgacaaacttgcatagaggaccaagactgcagcaaatgaggctgctcagatgggtattggaaggaagtggaaggagatcattgccatcaatgcaaaaatcacatatagcttccatgacgactctcgaagggaaagatcagcaaaaggacgatacaatgtttgaaccatttgcaggtttctttgttcagcagtgtactctttatttgttacctattttgcatgtgagtttatgttatgtgataccaccaacaatcaagttccatgttagagacagccttgatattttaacacattgagaattttaccctattccttggatacttaatttgttgaacccataacatatgatgattctgggggccat

SEQ ID NO: 18901 - DNA, 490 bp, Gossypium hirsutum
  Clone ID: uC-gsflnu33B049h05b1
cattcttaggtttcttagagttctacccttgacatcagaaatgaaaagaacagcaggtgtctttgctgaaactgcatgggctggagctgcatattatttgctattatatatgctttgcagtcatatagtaggggcattctggtacttggtagctgtagagcgaaatgatacatgctggcagaatgcatgcaaggatattggtagtgactgcaataaagatttcttgtattgtgggaatcagcaaatgaaaggttacaacatatggaagggcatgcgagattctgttcttaatgaaaagtgcccagctgatgaaaatgatgataatcctccatttgattttggaatcttcacccaggctttatcatctggcattgtttcatcaacgaaaatttttcccaaatacttttactgtttgtggtggggtttacaagaatttgaggtgtgtaaacatattcctcctaactgctgttaaggagatccaaattaataa

SEQ ID NO: 18902 - DNA, 389 bp, Gossypium hirsutum
  Clone ID: uC-gsflnu33B049h06b1
tttattcgttcgggagttcccattcggtcacaatcactcttacactcatcaccacagaaatgatgatgaggaaaaccattaaagaccctcaccaccacattttcaccaccttgaatttacttccgtcgaaccttccaccaccaagctaccagcagtcactctggctttgatggaccctattctccgccacctccatcatcatacttgcaccaacctggctttgatggtccacccccaccatcttacttttaagaacctggattttcaccatccccaccacaccaaccaccgtcataatcagaaccaacagccaccccatgtgacttatgttcaccgacagcctgaaaacagtccatcgaactactcttcaccaccagcatctgtttcaa

SEQ ID NO: 18903 - DNA, 479 bp, Gossypium hirsutum
  Clone ID: uC-gsflnu33B049h12b1
ctttcatacaagtttcaagcaagtcctacagtgaagctaagagaagagaaattgaaatccttgaggcggcggtccaatggcggagaaacctcaaccggtcgtcgttcaatactgtcaagtctgcggtttgcccgccgaatactgcgagttcggatccgaattcgataaatgcaagccctggttgatccaaaacgcgcccgacctgtacccggatctcctcaaagaagcgaatgctaaagaagctgataaagttgctgatcaattacaatccactggcatctcttctgctgattcaggtaggtagttcagaagctaagcaagaggaagttaaacgtcttcctggtgggaaaattaaaaagaaagagaaaaagaagttgtaattgaaaggttgtgcggaacatacgcaaaggataactactgaaaaggcctggaacttttggtgtaaaattaacgatgcttcaaagaacttgaaagaagtt

SEQ ID NO: 18904 - DNA, 397 bp, Gossypium hirsutum
  Clone ID: uC-gsflnu33B050a02b1
ttcgatggcaacaacgacggagaagcaagccatggttgttggaatcgactacagcgagcacagtacgtacgcgctgcagtggatcctcgatcacttctttgctcctttagctttcaatcctcctttcaagctcgtcatcgttcatgccaagcctactgcttcttctgctgttggtctcgccggacctggagctgctgatgtattgccctatgtggatgcggatttgaggaagatcgctgccagggttgttgagaaagccaaggaactctgccttagcaaatcggtacatgatgccgtagttgaagtggtggaaggtgatgcaaggaatgttctctgtgacgctgtagaaaaacaccatgcctccgttctcgctgttggtagccatggttatggagct

SEQ ID NO: 18905 - DNA, 145 bp, Gossypium hirsutum
  Clone ID: uC-gsflnu33B050a05b1
tctaaaaaaaaaaaaccaccagaaatagttgtttgttgtgctatgttaaaactgttcctcttcgggttaagaaacctgaacgttattatattgatttttataaaaaaaaaaattaaataaactcggatacagagacattaaaaat

SEQ ID NO: 18906 - DNA, 327 bp, Gossypium hirsutum
  Clone ID: uC-gsflnu33B050a06b1
ttccacgcgtccgcccacgcgtccgctccagtgcaagaggtgcacatgaatgaagatatgaaagtggtggtggaagtagcaaagatgatggccatactagctatgcccgttgaaagcaccttaccatcactagtactctacactaagattatgaattttcttaccgcaagtaataacaaaaataaggttaatttaggtaagaaaatcaaaatgctcaaaagcattgctagagattattgaagtcaaatgaatggctttaggaattgtatgaaatgaaattcataattctataccatataaatatatatatatatctaaagttcatat

SEQ ID NO: 18907 - DNA, 421 bp, Gossypium hirsutum
  Clone ID: uC-gsflnu33B050a07b1
tttcaatcctgacctcccttgcttccttcgtctccggccagtagcagtcatccctcaggtttataggggtgttaaggtcatcttctcagctgtgtaacttttcttctaaaggaaaccattcaaaggcgtaggaactcaaagttggttattgtgccacaacatgatgagttcaatgtcgcaacatacggagtagaatgctaaaattgctatatctataacactcctaacccgtatccgacgtccaaacaggcttacagagtgttacaagtaatcggtacatacagaacatttacagattaatcataacataactattttctttctgagatcattatattcatataacgacctttatttgagccatttaatcctcaacatatattttaaaattcaattataaactcactcgatttttctaaac

SEQ ID NO: 18908 - DNA, 397 bp, Gossypium hirsutum
  Clone ID: uC-gsflnu33B050a11b1
tttcacgcgtccgcactttgttctttttcttctctcttcaaaatctaacctcgaaagctttagagattctcattttgctaagcgtattttagatcgggagtttagaggttattcattaatggcggatacagagacatttgctttccaagctgagatcaatcagcttcttagcttgatcatcaacactttctacagcaacaaagagatctttcttcgtgagctcatcagcaacgcatccgatgctttggataagatcagatttgagagcttaacagacaagagcaagctagatgctcaacctgagctcttcatccacattattccagacaagactaacaatacactgaccattattgacagtggtattggcatgactaaggctgatttggggaacaat

SEQ ID NO: 18909 - DNA, 449 bp, Gossypium hirsutum
  Clone ID: uC-gsflnu33B050b01b1
taaaaatggggttaattcccatgagaaacatacacattcttcttgtttttacggtgacaatagtactccttgaaacaaatggttgcaaagctgcttttctagtgaagagcaacttcagctacaagtgcaaaggccgtctcaacgaatgcaggatcgctgaggctttggactcggagctagagttggagttggacatggtgatgaattctaacgttgttagaatccttcagagcagtaacacgccggtaaccagtaacacgggaaaccggaatacgccggtgcaacagacttgcccgagtcctcagtatgctagttgtcttgccacaggaggtagagctaattgtaggggaacttactgccgcggctaatccatcttttgtatcattcctcttggtattatatgggcaaatgctaaatgagccaagaatgatccaaaatcatgcgtagtt

SEQ ID NO: 18910 - DNA, 235 bp, Gossypium hirsutum
  Clone ID: uC-gsflnu33B050b02b1
gttcaaacaaaaaaaaaaaaaaaaaaaaagaaaacaaataaaaaaaaaaaacagagaaaaaatggcaagatattgggacagatggttttgtaggtgccgttttcgcgtcccgctcctttcttctgggggcgcttattccggggtcccggggtgtcgtttttgtggcccggggttctttcccccctcctgggttcccaccctttttgtctggtggctcctccggcttgctcccctt

SEQ ID NO: 18911 - DNA, 391 bp, Gossypium hirsutum
  Clone ID: uC-gsflnu33B050b04b1
tgaatttcttctttccccactacctgtgtaatcttgagtcttcacctgtatattcgcttagatctcatttcacttgaatttatgcaaaatatagctctctgagcctcagtaataatctaaataattgatatctgctgtcaaaaaaaaaaaaaaaaaaaaaaaaaaaaaaaaaaaaaaaaaaaaaaaaaaaaaaaaagcaaaaaaaaaaaaaaaagcaagccaacttaatgaatccaaaaccgaagccaacgtaagcaaatggggagcaaatactcaacctacatccgcgaatggtagtgggcttgctatgtccaatcattggcggggcgactataccctgcccaacgcgctatcacattttcacccagcttccctgtttccgccatgacca

SEQ ID NO: 18912 - DNA, 449 bp, Gossypium hirsutum
  Clone ID: uC-gsflnu33B050c01b1
taaatattcgtttccccactttcaatgccctcttttctctttcggattttcttgctatacaatctcctcctcgactatttggtccccagaaagctcaaatctttcctctctccttcttgtactatcaccactccctttgtttctgtcggaggtgaaaccgaaaagaacccatctccggcagttgcattggcatcggtctcccctcgttgtcctctaaaaagaatggacgctgctgagttgaagagagtgttccaattgttcgacaagaacggagatgggtccatctccaagaaagagttgaacgattcgttggagaatatgggtatctgcatccctgatcctgaattaacccaaatgatcgaaaagattgatgtcaacggcgataagtgcatcgatatcgacgagttcagtgagctgtaccgatccattatggataataaggatgaaga

SEQ ID NO: 18913 - DNA, 219 bp, Gossypium hirsutum
  Clone ID: uC-gsflnu33B050c02b1
gagatagaaacaacaacagacggcatttacattattaaggccacactgatggaaaagtgtaaagctcttttcagtatacacaagttttcaagccctttgacacttaaattaatggaaatctgtttgaaatttttgcacattcacaactggttgtaactgtctactctgaaccctgttggaaaggagttgggactaaccctgttgggggagttgcctttg

SEQ ID NO: 18914 - DNA, 390 bp, Gossypium hirsutum
  Clone ID: uC-gsflnu33B050c08b1
gtagaaactggatgctattggacattacttaatcttggtgatccactagtgcttttggtggcgtgagtctcacatagcacctgacggatctgagagcggaagcgcaaagattggggcctgctggccttgctttgcactatgcaaatataattatgcaagttgatactcttgttgctcgatcaagttctattcctgcaaatacaagggaggcattataccagaacttgccaccctgcataaaatcagctctacgcccgaaattacgatcttttcatgtcaaagaagagcttactgttaccagaagtcaaagatgagatggagaagactttgcagtggcttgttccacttgccgctaacacaaccaaagcccatcatggttttggttgggtt

SEQ ID NO: 18915 - DNA, 419 bp, Gossypium hirsutum
  unsure (1)..(419): unsure at all n locations
  Clone ID: uC-gsflnu33B050d04b1
ttccacgcgtccgtgatcattgtacttttaattctactcaaaaagcttttggcattgatgatttccggaaaattcccaatggtgtcaatgggattgaggagaggatgcacctagtttgggatacaatggtggaatctggccaaatttccgtcactgattttgtccggattacaagcactgaatgtgccagaatcttcaatatttatccaagaaaaggagcaattcttgttggatcagatgcagatattattatatttaatcccaactctagctttgaaataagtgcgagcatgcaccactccagaactgacacaaatgtctatgatggtaggaaaggaaagggaaagtnttgaagtgacaatagttggaggatgagttgtttggcaagatgaccagctaaaagttggtccttggttctg

SEQ ID NO: 18916 - DNA, 380 bp, Gossypium hirsutum
  Clone ID: uC-gsflnu33B050d06b1
ttccacgcgtccgcccacgcgtccgctttgttaacgaataaggatcttttaagatacgccggatccgctaaaatacgccgatccccgttcgtcttccgatcatatggggctgcttgaccagttgtgggatgataccgttgcgggtccccgacccgataatggtctcggcaagctccgaaagcactccactttcactttccggcctaactctgccaaggaatcggatggcgggagtgtaagatcgtacggtgatgaagcgccggaggaagcgacgagagtgacacgtagtattatgatcgtaaaaccgcctgggtaccagagcggatcgccttcggtttcgccggccggatcgacccctccggtatctgcttttttcgaga

SEQ ID NO: 18917 - DNA, 394 bp, Gossypium hirsutum
  Clone ID: uC-gsflnu33B050d12b1
cttctatggcacgcgggattgaaagaaaagaacatcgaagatatcaataacatgatcactttctggttgggacaggagattcttcataccagtggtgacagatgatatataggggaatgaaacagcataagtgactggttggcgttgactcacattcgaggaaacatgaaaaacaataagctatggaaaggatacaactttaagctttccagactgaatttgcctgatactaagatcgcccaatcctaagatcggacggcgatgaagcgccggaggaagcgactagagtgacacgtagtattatgatcgtaaaaccggctggctaccagagcggggcgcctaaggtttcggcgggcggatcgacccttccggtatctcctttttccgagaatat

SEQ ID NO: 18918 - DNA, 387 bp, Gossypium hirsutum
  Clone ID: uC-gsflnu33B050e10b1
ctatctattcaatctgaggtatgtcgacggccgtggcagccaccgagaccagcaaagacccaacccaacctacccccgaagtcaagcttttcaatcgctggtcttttgaggatgttcaggttactgatatctctttgagtgactacattggtgtccaagcttcgaagcatgcaacctatgtgccgcacactgctggaaggtactcagtgaagcgtttccggaaggctcaatgcccaattgttgagaggcttacgaactcactgatgatgcacggccgaaacaatgggaagaaacttatggcagttaggattgtgaagcttgccatggtaaatgtttttcctcctgactgatcagaacccaatttaagtcattgcttatgcttttatt

SEQ ID NO: 18919 - DNA, 429 bp, Gossypium hirsutum
  Clone ID: uC-gsflnu33B050e11b1
ttccacgcgtccgggggactccatccttgattcattctctttaagccctttgccttatcctgttctgttaatcctagcagtgacatcaatatttcttgggatatcatggtatgtgaactatgaatcagttctggaaaccactgaagagcaactgagttgggttcttttcgccacaccagttgtgttgatactcttggctcgttgggtgtcatctatggatacttccgatatgttatttggttcatcgccatgggaacgtcgccgccagactcaccagcgtccttccgagggtagctcaccttggattgtggctgctttcattgtgctgctgctgattttggtacagtatcagtcagtttttcgcgagagctggctggtatgatactgtatatgtgtttagatacatgataaaaactagttgtgaatttc

SEQ ID NO: 18920 - DNA, 447 bp, Gossypium hirsutum
  Clone ID: uC-gsflnu33B050f03b1
tccacgcgtccggtttgtttcggacgctggagggtatatcgctgttcggttcatgatcggcttctccctagctacatttgtgtcttgccagtactggatgagcacgatgtttaatagcaagatcattgggctggtcaatggaactgcagccggatggggtaacatgggaggaggtgcaactcagttgttgatgcccttagtttatgacattattcgtcatgctggagcaactccattcactgcttggagaatcgctttcttcattcctggatgtcttcatatcatcatggggatcctggtcttaacacttggccaggacttgcccgatgggaacctaagcagtctacaaaagaagggtgatgttgctaaagataaattcggcaaggtgctatggtatgccgtcacaaattacaagacctggatttttgtccttctttatggctactc

SEQ ID NO: 18921 - DNA, 361 bp, Gossypium hirsutum
  Clone ID: uC-gsflnu33B050f07b1
tctacccagcctttgtccatcaaagatgaaggagaaaagaaaaagtaccagaggtcgttgtcgctgccgaatagtccagtgtcaggtccgacacccgtgacaccgacgactccgacggcgcgtaaggagaacgtgtggaggagtgtgttccatccgggtagcaacctagccaccaaaagtataggttctgatgttttcgacaagccacaacccaactcttctaccgtctatgactggctttacagtggggagaccaggagcaagcattgctgagagggtggcgactgacaggcggcttgcaggctgctctcgtgagccagggctgcatggtaatagtgcgccttccattttcttttttttt

SEQ ID NO: 18922 - DNA, 422 bp, Gossypium hirsutum
  Clone ID: uC-gsflnu33B050g06b1
tgggcttcggctcaaacattgaaaggcggagaccaactggttttcaagtactcatcagggatacacagtgtagttgagcttggaagcgagacagcttacaaaaactgcgacctgggaacatcattggattctaaaaatacaggcaacgatgtggtgaaactcaacaaagtgggcactcgttatttggcttgtggaacattaggccattgcgatcagggcatgaagatgaagatcactacggtcgtcggcaatggtactttcacgccggctttcgattctgatactttggcggcggctttttttccacgatcttttactacatttcttctgttttctccattgttgatgccttattttctgctttaaaactgtattgcaagctttggccatagcctattttaatatttcggtgtggggatttg

SEQ ID NO: 18923 - DNA, 324 bp, Gossypium hirsutum
  Clone ID: uC-gsflnu33B050g11b1
ttcacgcgtccgcccacgcgtccgaatcgaggagctcttttcactgctctggtcgtcatttatgcccttacatctggcattgctgggtacactgcagcttctttctattgccagctagaaggaacaaattgggtgagaaacttattactaaccggaagcttgttttgcggacctctttttgtcacattttgctttcttaatactgacgcaattgcttataaagccacagcagcattgccatttggaaccattgtggtgatttttctcatatgggctctggtcacttcacctttattagtattaggcggtattgctggaaagaat

SEQ ID NO: 18924 - DNA, 458 bp, Gossypium hirsutum
  Clone ID: uC-gsflnu33B050h02b1
ttcacgcgtccgcccacgcgtccgcccacgcgtccgattacccgctgagttaaagcatacccttttgtttacaacctgggagctagagaccacagtgagatcagctaaagaggagattactaagagagaacttgaactgtttcatttcaaagatgttttaaccaagacaatgaaagagagagatgaagctcaatgtagatgccagaagcttatggtggagaaattcatgcttgagcaacaattgcaacacaaagagcagccaaaacagcaacaaaaccagcaggacactgcttcactgtctggtgtttctagcagtgaagatgaatccaattccaacataagtttagtttcatctccaggtttggactcattgccacaaccatctcttcctcaagaagccttgaaactagcagctaataggccactacctgagaaagggaggctgcttcaggccgtga

SEQ ID NO: 18925 - DNA, 432 bp, Gossypium hirsutum
  Clone ID: uC-gsflnu33B050h04b1
taaaaaaatcacggtggtcacagacggctatggctaaaaagcttgcattctttgttctttttaacatacggctatttgtgggttacttaacgccaacatcgataaagcgacaatccaatggcaattatggatgtcggaggacaagggacggacattgccgcaagatggcagaatgggatggaagagatcctgcatcggcatgaggggctaacgcgtgatttttaacagggcaaggggtgagagaacaacgggtagcaaacctgagtcaccagcggaagctgatgctgacggcaaacctggaccggatcctaacagaccccaaagaaagaaatggcttcgctgcgttaaagccacaccggctgaatattgacgaagtccggaacgaataccagcttatacaggaccatgcaagccactaaccatggattgtta

SEQ ID NO: 18926 - DNA, 442 bp, Gossypium hirsutum
  Clone ID: uC-gsflnu33B050h06b1
tgcttaacaggagtttcaccgggggaaggtacgggggcaacaatgtcagatgatgatgaagaccaagtggagagtgatgcaaatatgtttgatgcaagtttcgacggtcctgattcaatgggatttggccctctcatcccgacagagactgaaaggtctttgatggagcgtgtgagacgggaactcaaacacgaactcaaacagggttacaaagagaagattgttgacataagggaggaaattttacgtaagagaagggcaggaaagcttccaggggatacgacgtcggttttaaaagcttggtggcaggcacattccaagtggccataccctactgaggaagataaggcaaggttggttcaagaaacagggttacaattaaaacagataaacaattggttcatcaatcaaggaagagaaacttgcttactaatccatctac

SEQ ID NO: 18927 - DNA, 414 bp, Gossypium hirsutum
  Clone ID: uC-gsflnu33B050h08b1
tattcttcttcatttctctttctatttttctctagttaacatggcagagttagaataccaagctaataccaaaaccaacagcgccactactgcacgtctaaagctcttcggcttcaacgtctcggaagatgatgatgttttggaatccagaaccaccaaagatccatcatcagggtcttcagagccaggtggcttccctgctcctggtgaccgcaaatacgagtgtcagtattgttgccgtgagtttgccaactctcaagctttaggaggtcaccagaacgctcataagaaggaaaggcaacagctcaagcgtgctcaacttcaagccactcgaagcgccgcggtttcgtttgctaggaaccctatcatctctgcttttgctcctccaccgcatctcttagcgtcggctacacc

SEQ ID NO: 18928 - DNA, 402 bp, Gossypium hirsutum
  Clone ID: uC-gsflnu33B051a03b1
tcggtttcaggcactcaaagtttatgttccagcatatgagagctatggaagaatgtggcctcatgcaaatccgaattattagtgccctgttcttataccaagttaccatgttgggttactttggggtgatgagattctactatactcccatcctgggtccgctcccgatattatctcttgtcttcgtctttgtctgtaggaagaaattctatggggctttttgtcacacggtgctagaggtcgcttgccatgaactgaaagaaactccttacatggaacagattttctattcctttatcccacccaagcttgatctctgagaaacaagaagatgagctttttgaagatgctttgtcttaagttttaagatctgaattttttgtttcatgtcttttattcgtt

SEQ ID NO: 18929 - DNA, 96 bp, Gossypium hirsutum
  Clone ID: uC-gsflnu33B051a06b1
gcgtttatgtgttcaattcatcgtcatctacgaggagctgacacatccatgggtcacagcagtgttctgcgaacctatgataagacctttgagaat

SEQ ID NO: 18930 - DNA, 351 bp, Gossypium hirsutum
  Clone ID: uC-gsflnu33B051a10b1
ttgtttacgacagtgatgaagatgatgaagagactctttaccacacaccgatataaggcccgccaccataagcagccatgatgactatgacgactagttagactggccgatccctctacaaatggaaatctgcagtaatagctattaaataaatgatcgaggcatgccacctttgatcgtttcttctaccatttccgtgtgttttttgtgtgtgtgtcagtgttagatcgtcattaaaatgcctgaccaattatggttttgcgcatctttcttgttttattactaatcatatctatcatatcttatttaggtcgttctattttttagatctaatgttatctttatcttttc

SEQ ID NO: 18931 - DNA, 270 bp, Gossypium hirsutum
  Clone ID: uC-gsflnu33B051a11b1
tttacgcgtgcgaaaaacttgaagctgcatcatcgaaaatatttggcggcgacaaatctaggattcacaagatagaggaactgaaagaaactataagggttactgaagacgcaaaaaatgttgccataagagaatatgagaggatcaaggaaaataacaagtgtgaacttgaaaggcttgacaaggaaagacgcgttgacttcttgaacatgttgaaggggtttgttgtaaattaggtatggatattctcagtataacttatttttttta

SEQ ID NO: 18932 - DNA, 449 bp, Gossypium hirsutum
  Clone ID: uC-gsflnu33B051b02b1
gttatgtgagacagaactcgtacgggttgacacactgatagctgatgctcgatgcgtgagctgttgctgcatggccacgtttatgcgatcaggaaggtgtggatgggtacccctaaacagaaatggacagtagaagaggaagctgcctataaggcaggagttctcaagcactggaccggaaaagggcgcattgtactttaagataccgaggttagaggggatctgaggtctggcatgaatgtggatcttaaggataaaaggcgaaatataaatgccacggccatgtggggatcaagacagaaagctaagcttggtcttaaaagaaattagatagccgttgaacacgatgataagcccatggcgctaatcaccgggccttccattgaagaagtcagtgatcctaaggcgcttgccatttctaggaaaacactaagggtaactgggcccaa

SEQ ID NO: 18933 - DNA, 249 bp, Gossypium hirsutum
  Clone ID: uC-gsflnu33B051b05b1
gctcggccccgatgagtaggagggagcggcagcgtctgaacaagctacatggcaagattcacaactgagagttatgtgcctaccattcccacgtggtgagggaccgatgccggacgctcaggaggaaacctgaccggcaagatcgttttattagacggatacactgtcaagggcactgaaaggaacctggacaggcccataaattggaatttgagaggagctgctcgtgtctatggaaagggtattttt

SEQ ID NO: 18934 - DNA, 124 bp, Gossypium hirsutum
  Clone ID: uC-gsflnu33B051b07b1
tacctcgccggatcttctatagaaaacaacgattccgatttcgtacatactttgaataacaatcagttgactaggatcggtgaagatcatgaacttgaagaggaaactaactcctttagctata

SEQ ID NO: 18935 - DNA, 162 bp, Gossypium hirsutum
  Clone ID: uC-gsflnu33B051c08b1
tttttccttcaatccaatccaggtaagggctaaggcaagagggagtgaaaatggttgagaaatcatgaggaagaatggcagaggtggttgccaggctttacaccatcacccttcacatgctcctttatgcttttacatttaagattgatgcttccaaggcta

SEQ ID NO: 18936 - DNA, 301 bp, Gossypium hirsutum
  Clone ID: uC-gsflnu33B051c12b1
tgttagttttgactgatatcggaaccaatgagtggaggagtgttgaggacattgactggaaacatataggctgctgctggtgggaacaacaatgtgacgttgtggaaagaagcttgagatggggaatggcaacaggtgactgttgttgagccataatcttctaaatgggtttattgttaaatcatgcaatgattattacacgctgtcatggttgaatcggttatgcctggaaattctagaaccgtattatttcatactcgaacttttttatatggatgtagtattgcagacccattcatgt

SEQ ID NO: 18937 - DNA, 455 bp, Gossypium hirsutum
  Clone ID: uC-gsflnu33B051d01b1
ctcactcgtccgttctcttcgtaatctcccaaatatctttcctttgtctcatcgaatatgatgcaacaaccagcagctggtggcgtggctccgccaccttccatggcggctgatcagtctcaggctcatcagtaccagcaacaaccgcagtcgcagccttggatgatgatgtctcaacaacagcagggtggtcagccggttcctccacctaccggttggacgccgcaacctgttcctccgcccactcagatgcagcagtactccgccggttctgctgctgctggctccggtgagattcgatctctttggatcggagatcttcagccgtggatggatgagaattacctcatcaatatctttgctcaaactggagaggtggtttcggttaaggtgattaggaataagcaattcggttttacctgaaggatatgggttttatcgaatttgtgtcccgt

SEQ ID NO: 18938 - DNA, 172 bp, Gossypium hirsutum
  Clone ID: uC-gsflnu33B051d02b1
ccctcgcgtccggtgccagcacccaagtgagaattggttatgcttgtcctgcaaagttgtgctttgtagccgatatgtgaataagcatatgcttgagcattatcagctaacaacccatctcatagcgctcagttttagcgacctgtcagtttggtgtttttgcttgctaatt

SEQ ID NO: 18939 - DNA, 194 bp, Gossypium hirsutum
  Clone ID: uC-gsflnu33B051d03b1
ttttgtgggaaggcacctggccagtctaaatttggaggaggtctattttcaacgcgcactgtaagcgttccacctgcctcaaactcaagactttcaccactacctcctgaacctgctggttttagttatgagcgtgaggcaacagttgatatccctgttgatacagctttaggaggatcacgcaatgaggattt

SEQ ID NO: 18940 - DNA, 293 bp, Gossypium hirsutum
  Clone ID: uC-gsflnu33B051d07b1
ttgctctgggttaagtaaaccctattttgtcaccctaccttttccagctgtagttgcagtcgaagtcgcggcatatccagtttaatactcctaccgtaaagatgaacaaggaaaggctcatgaaaatggctggtgcagtccgcactggtgggaagggtagcatgagaagaaagaagaaggctgtccacaagacaaccaccaccgacgacaaacgattgcagagcacccttaaaagaataggagtgaatgctattcctgcaattgaggaagtcaacatattcaaggttgatgtt

SEQ ID NO: 18941 - DNA, 440 bp, Gossypium hirsutum
  Clone ID: uC-gsflnu33B051e03b1
gataacactgacagaacttttaaaactcatgcaccaaatctaattaacggtaagaaaagtcagttatctaaatgagaagcaaaaattctgaaattgtactgggtgtgtggcgtaatgaccagcttattcccatattctctcctatttttcctttatttctaacgttcttttctcctttattagctactcttttccccttctttgcaaatatttttccttctctcttggtttttcttctctcggccttctttctgtgttttcttcaatctatggctctcccattcattcgccgactctctctctctctctatatatatatcccttcaatttttttcctcaaatttttttagctttgggtaaccaaattccggtttttgtttttttgctgtctctttttttttaatttttgaaacccttacttcattgaagaattgttttta

SEQ ID NO: 18942 - DNA, 225 bp, Gossypium hirsutum
  Clone ID: uC-gsflnu33B051e09b1
tctgctaaactaaagaaaaaaaaaaaaaaaaaagagaagaaaaaaaaaaaaaaaaaaacaaaatatcagaaacaccactaaccagtgactgaaactcaaacccatatctttagaggatcctaaatgtggaatccctggcccggctgtaagttcccagccgactgctttgacgtagaggtgtctccacctgaagggtgtgcggccctttccctttcccccccggtg

SEQ ID NO: 18943 - DNA, 334 bp, Gossypium hirsutum
  Clone ID: uC-gsflnu33B051f01b1
ctcactcgtgcgaaaatataatatataaggtatgttaagctgaaacatattatgtaatcgaggaataatgtgacagaacctagtccaggctaacttcactagcctgcatatggatagggttgtgacagaaccaagtccaagctaacactttgatgatgagtaatcatgttgcagcatgcttctccagctgcatcactaggcccactgccataggctattgcatcaccaccctcggcgataccaaagaagtcggcttctctgtctggtttggccatacagggcgagaggagtgagggttcacccgtgtcagtacccttgggaatgcccaagcact

SEQ ID NO: 18944 - DNA, 479 bp, Gossypium hirsutum
  Clone ID: uC-gsflnu33B051f06b1
cccactcgtccgagccactagggttttaagagaagatcaaaatggcttcaaaaaaattagcttccatggccttctttttggcactcaacattctcttcttttccctagtcagtgcttgtggctcttgctcttcacccacccctaaaccaaggccaaacccaaaacccaacacccccacccctactgcatccgcacgaggcaggtgccctagagatgccctcaaattaggtgtatgtgccaatgtgcttaacttagtcaatggcacccgtggttcacctccagggatgccatgctggtcccttctcaatggccttgtcgacctcgaagctgctgcttgcctttggactcggtttaaagctaacatcttaggcatcaaccttaacatcccagtttctcttaacttgctcctcaacgattgttcaaggaaatgtccaactggctttccatgctattaaggcatcactttccctccattcttt

SEQ ID NO: 18945 - DNA, 173 bp, Gossypium hirsutum
  Clone ID: uC-gsflnu33B051f09b1
ctaaatctcaacaaaaagggtaggctcttctttggctcctttctgtaatttgtcttcactgttatttcattgttgtttgtaagagaaaatttgaatcgagtaatgatgaatctatttcttcgtaagatggttcgatatgtatgaagttgtagaggtttattaattcttttctt

SEQ ID NO: 18946 - DNA, 449 bp, Gossypium hirsutum
  Clone ID: uC-gsflnu33B051f12b1
gtaaatacaacaagaaaatccttcaaaaagaccccagatgtctttcacacatgtttgctgctgagatttacatgcacaggttccttttatctagtcctgttcgaaccctcaatccagaggaagctgattggttttatacccctatctatgccacttgtgatcttacacctactggtttgccattgcccttcaagtctccacggatggtgagaagtgctatacagcttatttcctcaagctggccttactggaatagaacagagggtgctgatcatttctttgttgtaccccatgattttggagcatgctttcattatcaggaagagaaagcaattgagagggggatccttccaatcctgcagcgtgctaccttggttcagacatttggacaacggaaccatgtgtgcttgaacgagggttcaatcacaattccttcctatgcttcccct

SEQ ID NO: 18947 - DNA, 441 bp, Gossypium hirsutum
  Clone ID: uC-gsflnu33B051g05b1
cccacgcgtccggctggttctactcatggaaacgaagaattcgtgagcatggcagaaatcgtacaccaggaagatactgacaggaaaagagtccatataggatacgggttgtcaaaagatctctctcttccaggtttccgggttggtgttatctacacttttaatgaggatgttcaggccgctgctagaaagtcatcgaggatatcagccacctaagctgcaacccagtgtgtgctcatctccatgctatctgctacaaaattggtcagagcattcattaccacaaacagggagaggctaaagaggatgtatgggcagcttgcggcagcggagtgaaaaatgtccttaacgtccataaaaagcatcgtggggacatcactgcgtgactgactgagccgatttatgaggtcttacagagagaaaggaaaattaaagtcttgg

SEQ ID NO: 18948 - DNA, 293 bp, Gossypium hirsutum
  Clone ID: uC-gsflnu33B051g08b1
tcgttcacgcgtccgcacaaacccaaatctccaattgatctgtttcatttttcagcaaagctagaaaaacaatgactaaggatatcgagactgcagagcaacatggaggggagttctcggccaaggactaccatgatccaccacctgctccattgattgatgctgaagagttaaccaaatggtctgtttacagggcagtgattgccgagtacattgctacacttctcttcctgaatgttactgagttgactcggattggtttcaaggtcctaaccgaccctgttaagaacact

SEQ ID NO: 18949 - DNA, 237 bp, Gossypium hirsutum
  Clone ID: uC-gsflnu33B051g12b1
ttatgacgccggctttaacacgcaaggggtcgggccagatgatttatgcttactcacgcgggtttcccacggcaaatcagttaggtagtgtgacctctatacaaatacagtgacctgggaacttcattggtgtggttgtaaacagcctaggaggtcccgaaacaaaacatattgggcacataactctttctgtagggtcatattattgtctttgcggtctggtcctgacgctgtttt

SEQ ID NO: 18950 - DNA, 92 bp, Gossypium hirsutum
  Clone ID: uC-gsflnu33B051h07b1
taattaaaaaaaaaaaaaaaaaaaaaaaaaaaaaaaaaaaaaaaaaaaaaaaaaaaaaaaaaaaaaaaaaaaaaaaaaaaaaaaaatataaa

SEQ ID NO: 18951 - DNA, 478 bp, Gossypium hirsutum
  unsure (1)..(478): unsure at all n locations
  Clone ID: uC-gsflnu33B055a02b1
cgcgtcttcgtttacgcacatttacaacaagcagaatacactctctccatttgctggtttggcttttcacccagtggacggaatactgcaggcagtacctcatgtgatagcactctccattataccaactcattttacaacacatgtcggactgctgttcctcgaggccgtctggacggcaaacattcacgattgcatgcatggcaaactatggcctgtgatgggtgctgggtaccacactattcaccacactacgtatcgccataactatggccattacaccatttggatggattggatgcttggaaccctacgtgaccctagtgacgaagaaggcaagaaggtcatgtaattccctttgtgctcatcttgacattatctgttttgtcgnttgagagactctgtttttggataggtccgcatgttaatggagtctgagatgttgtcgtagcctgtgttggtcgaggtttttaaatca

SEQ ID NO: 18952 - DNA, 365 bp, Gossypium hirsutum
  Clone ID: uC-gsflnu33B055a07b1
catacagcttccattgtttttcagtagtgaagagctaaaattgaagggaaatcaacggaggggaaagaagatgatgttagattgggagccaacaagttcccagagaggccacctattgggacagcagctcagtcccaagatgataaggattacactgagccaccaccagcacccttgtttgagcctagtgagttgacctcatggtctttttaccgagccggaatcgctgagttcattgctactttgctttacttgcatatctcgttatcgactgtgatggtagttgttcaggaccttatcatgtgtacatctgtacggctttcaggtattgcttgggctattcaaagactgcttcttttgcccta

SEQ ID NO: 18953 - DNA, 341 bp, Gossypium hirsutum
  unsure (1)..(341): unsure at all n locations
  Clone ID: uC-gsflnu33B055a10b1
tcgaatactaaccctaatctccccaaacgtcacaaactcatttaatggcgagcagattccaaattataacccatctaaaccccattacactcccttcattcacgagcccaaggcgcctcattggaacatgccaggcncacgataggcaccgccactactacagagctggagcctgtcttcacctccgacaagtccttcgctcccgccacggtagccaatctgggcccaggttttgacttcctcggcgctgccggtgatggtctaggccacattgcttgccttagaatcgacccttctgtcagccccgggcatgacacccatctctgagatctctgtgttct

SEQ ID NO: 18954 - DNA, 90 bp, Gossypium hirsutum
  Clone ID: uC-gsflnu33B055b01b1
atgcgaattttttaaagaattgaatagcttaaaaagcatgttgagtctttatgttatcgaaatgtattgcagtgcccgcctctttgattc

SEQ ID NO: 18955 - DNA, 317 bp, Gossypium hirsutum
  Clone ID: uC-gsflnu33B055b03b1
atttcatatttgcttttctatttcaagtcaagttaattagtattttgttaaatgcagtcaagtttgtcacatgaaactattctccaggtatatgtataatttgatgatgcaaatgactacactaattttgtgcttcacaaacgattaatgagtctgatagaagatgttgaagacttcagccctaacttaatgcatagaagaagtacaaaagatcaagaagcagagccttactcaataaaaggtatgtcttacggtggggggggcattccaaggtagcacaaggttcctcctccttgaaatttaaaattttttttttt

SEQ ID NO: 18956 - DNA, 425 bp, Gossypium hirsutum
  Clone ID: uC-gsflnu33B055b04b1
tatattgttgattctggcatgggttcgtgaggctttagtgattaattgacttgcgcgagcggagagtctgccgtctagtatctccgcccggcatggaaccacgtcaaaatctgagtccagcttcaccagcaggtgtacagcctgggtcaagaacaatgggtatgcggcacactcatgtgtgacattgatcctaagcgcgggtgactcgtttcctctaataggttcacaagcaatgtacaaagtttgctgctacaggcagcctgattttcagcttgacggaatctcacttgattttactcgtcgacaagagcggtggtttggtccgatattttgtagcttttgataagaccgaaactcaacgattttctacctgtatcccattcgggtacccattttaatttcttccaattttgaaccacctttta

SEQ ID NO: 18957 - DNA, 421 bp, Gossypium hirsutum
  Clone ID: uC-gsflnu33B055b08b1
tgcttgctgaagaggcccaaggccatcgaaccccagagtccctcaggcaacaggaatcatcagtagcttttcagagcttcaggaatcaaagtcagctaaatccaacaagctcgattgcacagtcatctgtatcatccaacgtttctgtgtctgatagtagtgtcgagtactccagccctaacttaatgcagagaagaagtacaaaagttcaagaagcagagctttctcaataaaagctagtcttccggtgtagaatgtataccaagttagttcaagtgctacctcatgcaacttaaaatcttctttgggatgaaaaatggggatatataatatatggagagtcttttacatatgtaacaaaggatgcaggacttggatgtgctctatatgttcaatgagtctgccaaagttaccagtgaga

SEQ ID NO: 18958 - DNA, 185 bp, Gossypium hirsutum
  unsure (1)..(185): unsure at all n locations
  Clone ID: uC-gsflnu33B055b12b1
ctgngtattgtgattaaaaattacaaacagtggcacgtgctattttatgcaaaaataaaatccaaaatcaaaatcccccaaaaatagcccagacattcgcgtttgggtccacgtgacgtcttaaatgttgagcaaagctagctctttggatagagtcatccgtttgccttatcgggctggatttt

SEQ ID NO: 18959 - DNA, 253 bp, Gossypium hirsutum
  Clone ID: uC-gsflnu33B055c04b1
gcgtctcgtttgcgagaacaactcgtgctactcctttaggttcttcttgtattacttgctgcaaacatctcacgactttttgtttcgattataagggataaacgggaccatgaagcagaagatggtagtgaaggttaccatgatggacgagaaattccggtctaaggcggtgaaaattgttgttggtctctaacgggtggtgttcattagagaaacaggttacaacgcgtatcgtctatcattgactgggttt

SEQ ID NO: 18960 - DNA, 498 bp, Gossypium hirsutum
  Clone ID: uC-gsflnu33B055c07b1
tttcctacgcgtccgtgaattctttccctcactttctcgaaaaataaaaatgtcttcaggttgcaattgcggatctaactgcagctgcggtgacatctgctcatgcagcaggaaccttaaccttggatattcggagaagacaaccagcactcagaccatcatctacggagttgcgccagtgtggatgatcttggagtgaccaggtatgaacgctactgaatcatgtctggaatgcaagatgggaacaaatcttctaatgtcttccattccactgttttatagcacttcctctgcattttattactttctttaatttttttttgtttcttcattttttgagttttgaaagtgatatttggaaactttaccgcattttcttactcattgtgttgaatttgtatttagagctatttttaatccctctttcattggatcttttgagatttgctttttggtttttagttccagattcttggtctcaatctttagttaaaaatt

SEQ ID NO: 18961 - DNA, 297 bp, Gossypium hirsutum
  Clone ID: uC-gsflnu33B055c09b1
gttgactactcaaccgcggcacaaaacgaccccagagggagcacctttaggaggaggaccccttgtatcccctcgcgcatgaagctaaatatatccaaggaaagtaccacacaaacccacacgtgcgactgtcattcagaggggaggagagaaaaaccaagcgtgctaagaacagcaaagatcccagatgggcacaagaaactcagcccatggtggatgaaccaccccacgaatgataaaaatcacattaaagcgttcagcacaacctacaaggaataggctacctgcatcccaagg

SEQ ID NO: 18962 - DNA, 518 bp, Gossypium hirsutum
  Clone ID: uC-gsflnu33B055d09b1
tttggtctctgatggtaacagcagtagcgatcaccaatcagtccagctaagtctggatgagaaagcatttcagagcacctcttctaaagtaatttctcctgtcaatgcaaagaagccacagcggaaatcacttcccaaactgccttctcagaagactagtctgtctggttcaacaaatgacgaaaagacatctaatacgtccagccagaaaaaggtaaatgcacctaaagcatctaccgagggaaagatagccttgcctaaagcaataaatgaagaattatctccaacccaactgcagccagcagtttctgctgctggttcagatgaaagtcagcgagacattgatcaagtggacttggttcaagagccgattgcactggagcattaagcatggcaatggtttcaagtggatgttcatatacaaagttcttgacctgaatttgcctaaataaggacgtctaagactgaattatttgatgatcaaggcataaaaaagattatacattacccgttatgat

SEQ ID NO: 18963 - DNA, 398 bp, Gossypium hirsutum
  Clone ID: uC-gsflnu33B055d10b1
tcgaatataaatgtcgtcgtcggggaggaagatcacccttaagagctcggacggcgaatcattcgaggttgatgaagcggtggcgttggagtcgcagacgattaagcatatgatcgaggacgattgcgctgataacgggataccgttgcctaatgttacgagcaagatcttagcgaaggtgatcgagtactgcaagaaacacgtcgaggctcctaagacagacgatcgatccgccgatgacgagctcaagagttgggacgctgactttgtcaaggtcgatcaagccactctctttgatctcattctggcagcgaactatttgaacatcaagggtttgctggatcttacttgacaaactgatgctggcatgatcaagggaaagaccccagaagagatca

SEQ ID NO: 18964 - DNA, 215 bp, Gossypium hirsutum
  Clone ID: uC-gsflnu33B055e04b1
gctttgtataacagaaaatacaatgaacttcagctacagcttcagtctatgatgactatgttccagcaatttcaaaatccgccatcttagacatttattttcttgtaacttttaacactattgtaagaatattttgaatattcatttacaatttatataatatatttttcgtatgaaaagaaaaaaaactactatgaacataaattaaaaaagaa

SEQ ID NO: 18965 - DNA, 218 bp, Gossypium hirsutum
  Clone ID: uC-gsflnu33B055e06b1
gacgttatagttataatatagagccacctagataccattgactgaccggcggacaacaacgttgtgactgtaaagacccactcgtgtcccaacttattcgccgagatggacattggcccttctacagatggcgtaattgcgaagagggccacaccgagcgccaatacgagcagttgtgcagccagaatggctaatgggacaccccctgtagcggatgc

SEQ ID NO: 18966 - DNA, 348 bp, Gossypium hirsutum
  Clone ID: uC-gsflnu33B055f03b1
gttccatttggctctgcagaggttcgggctattttcagcagtggtagtggccgtgttactggatgtatgggaacagagggaaagatagtggatgattgtcgcatccgtgtcaattgaaatggtcgcacagtccatgtcggcgttcttgattcattcgcgaagggctagcgggattgctaacagagggatgcaagaaagcttccttcgtgtgacacaaaagggacaaccttgagaagctgtcataccaggaaaggaaggcgaacgttgacgaatggttgaatggctttcatacacttggcctagttttcaaacctatgccgctgcttattgcactgtattacttttggg

SEQ ID NO: 18967 - DNA, 317 bp, Gossypium hirsutum
  Clone ID: uC-gsflnu33B055g08b1
tttaattgctcttccaaagatcatcaagactggtttctctgcaattaatctcatatatttcttcacagcaggaccagatgaggttaaatgctggcaaattagacggcaatccaaggctcctcaagctgcaggagccattcatactgattttgagagaggatttatatgtgctgagaattcatttgagtgcagttattctaccatttgagtttaaacataactgaaaggacactatttgtttttacgtcatgaaatttgaagatctgaaggagcttggcagtgagtcagctttcatggttgatggaaaatttttgctc

SEQ ID NO: 18968 - DNA, 377 bp, Gossypium hirsutum
  Clone ID: uC-gsflnu33B055h01b1
cctacgctaccgcccacgcgtccgaaaaaaaaaggagcgggaaaaattaaaaaaaccataccataaaccaaccccaaaaaagaaacacaaaacaacccaacaaacaaaaaaagggccgccccccaaggaaaccccaagttaccccccccaacaaacaacgccaaaaccccacaaaagggggccccaaataaaaccgacccgcccagccccccccacttttccacacaggaaacccccccgggagaccccacaaaaacaccaaagaggccctcccccctcccccccaccgggcaaaaacccccagggcccccccacgaaaaacctccccacacacgtccccacccaaacgccgaaagggaacccccccctacaccccc

SEQ ID NO: 18969 - DNA, 468 bp, Gossypium hirsutum
  Clone ID: uC-gsflnu33B055h02b1
cttctttttagactctatacagagagaaatcgcgagagactctcattgtactttgatgtccttcgctcagctctataatgtctgcaaatctcctcagtacctctcctactctatcttctttgtttgcaggtggcctttgcgtttcttgcgctcataggtgctagcagatgagtgatctcttggggcatcctactcaggaagcttgatgggtagcagattcccatctcatcaactgagcagtgggctttatgtgtcaggcaggaaagagcatgctaaagaaaggactcctaccatgagctcagtagcaatgccctatactggtggagatattaaaaaggcgtgagaactgaggaaaatgagcgatatccctgtggatggttctaaggcaaggaaatctgggcctataagcagtgctccttcaaggactgggtcttttggggttgctgcttcgcattctggaccgatcat

SEQ ID NO: 18970 - DNA, 96 bp, Gossypium hirsutum
  Clone ID: uC-gsflnu33B055h03b1
gcttcgtctccacatcttcagagaagagagtaaagggggataaaagcactggtgcagttgcttactgaggcagaacgccctgtcttgatctacgaa

SEQ ID NO: 18971 - DNA, 459 bp, Gossypium hirsutum
  Clone ID: uC-gsflnu33B055h04b1
tctatttcccgtccgcttgatttccatcagacggtgataaccatgccgatccgaaacatagccgtgggccgacccgaagaggcgactcaaccggacgcactcaaagcagctttggctgagttcatctccacactgatcttcgttttcgccgggtcaggctccggcatggcctttaacaagttgaccgacaacggagccaccactcccggccggcttggtggccgtttttatagttaacggttaaggactttcggcggttgaatccgtcggcgctaacatctccggcggtcacgtcaatcccgccgtcactttcggcgctttcgtcggcgggaacatcagtcttttacgcggcatcctctattggatcgctcaactacttggctcaaccgtcgcttgcctcttgctcaagttcgctactagtgacatgaccgtaccggctttcggacttttatcgggaga

SEQ ID NO: 18972 - DNA, 465 bp, Gossypium hirsutum
  Clone ID: uC-gsflnu33B055h08b1
tttttactgttttcttctcccaagaaggagatggtgcaactactgtgactgggaacctttctggtcttaagccgggactccatggcttccatgttcatgcccttggggacacaactaacgggtgcatgtcaactggaccccattttaatcctgctggcaaagagcatggtgctccagaagatgagaaccgccatgctggtgatctagggaatgtcactgttggtgatgatggctgtgcaagcttctccatcaccgacaaacagattcctctcacaggcccaaactccattatcggaagagctgtagttgtccatgcagatcccgatgacctttggcagggcggccatgagctcagcaaaagcacaggaaatgctggcggcagagtaacttgcggtattattggtctgcaaggctaaaatctggaccaagattccggtggaggatgcaatgggttttgagaacttt

SEQ ID NO: 18973 - DNA, 102 bp, Gossypium hirsutum
  Clone ID: uC-gsflnu33B055h11b1
tttccttcgcgtccgcccacgcgtccgcccacgcgtgcgttatttaaaaaaaaaaaaaaaaaaaaaaaaaaaaaaaaaaaaaaaagagaataaaatttaaat

SEQ ID NO: 18974 - DNA, 422 bp, Gossypium hirsutum
  unsure (1)..(422): unsure at all n locations
  Clone ID: uC-gsflnu33B056a02b1
cgtccttcttcgcgtncgaagaagaagaagaagcagaaccaaaccgggttttgttttggttctctcttccaatggcttccaccattttcatccaaccttcgtttacgtcaaagtctttgaataaatccctgaatacccatttcgtcccttccttcaaactccccggtttggtctctttcaagccccgaacggtttcccagttgtcggttcgagccgggttgatcgagccggacggtgggaagctcgtggacctccacgtggcggagccggagcgggggttgaagaagcgagaagcggctctgttgcccagggtgaagctgaccaggatcgacttgcaatgggtccatgttttgagtgaaggctgggcaagccccctcaccgggttcatgagagaatacgagttccttcaaactcttcatttt

SEQ ID NO: 18975 - DNA, 516 bp, Gossypium hirsutum
  unsure (1)..(516): unsure at all n locations
  Clone ID: uC-gsflnu33B056a07b1
tgncgttcccccatggttctcacactctgcttccctatccattacaacactttctagctcgacccgactttgtattttcagtcatctcaacaagcaagtactataaaaatgagtgtctctggactgattgccagtccctcaagatgttgccttcggctatctgactgcaatcaagggttggtgtgcaggcaagttccatctattccaattgccagcaaacctaaggcgaaatttggcaagcttcatcttgaaagaagtaggttgacagtttctttcagaaggtggaagatgcagaaaactcatctgatcaaatgtgcaatggatgcttcctatggcgatatggctagtgaatcaggagcagctatgtttcctagaattaatgttcgggacccatacaaacggctaggaataagcagggaggcttcagaagatgaaattcaagcagcacggaacttccttattagtaaatatggngggcacaaaccaagtgtggatgcaattgaagcagcccatgac

SEQ ID NO: 18976 - DNA, 360 bp, Gossypium hirsutum
  Clone ID: uC-gsflnu33B056a12b1
ttccttgcgtccgggaaaagatggctatggcaaactccttcaatgctgccagactactgacacttggctataactcttcaatttgcaaatcaaaatgggacaagtctccttctttccctgccggtgattatgagtatatagatgtggttatggaaggggagagaatgttgatcgacgttgatttcagatcggagtttgagatggcgcgatcaaccgggacttacaaagcgatcgtccaatcactggcgatcattttcgtcggaaaaccggaccgtctcgaccggattgttacgatcgtatcggaagcggccgaacagagcttgaaaaacaaaggcatgcacctaccttcttggaaggaaa

SEQ ID NO: 18977 - DNA, 349 bp, Gossypium hirsutum
  Clone ID: uC-gsflnu33B056b02b1
gatcaactcacagcaactgcaaccactaatcacagggctgtaaagtggtggtcaaggatcctgccgctagccttttaccaaaaatatgtttgtcccccgtttttttcccctcgcttaagttgttattggcattattaatattttttttagtttgggattcttgagttatgtggtgtattgtatgtgcatactggatggaaacgtacggatataagaggtataaaaaagaagaagctatggctaaattctaaataccaagattattgtggtcatgcctatgataaaagaattgatgttttcaaatgaaagaagaggggttacttttgcttcacatattgacatcatgtac

SEQ ID NO: 18978 - DNA, 459 bp, Gossypium hirsutum
  Clone ID: uC-gsflnu33B056b05b1
tttaaggccagacgacgacatggggaggagacctgcaaggtgttatcgccaaatcaagaacaagccatacccaaaatctcgatattgccgtggtgttccggatcctaagatcagaatttatgatgttgggatgaagaaaaaaggtgttgacgagttccctttctgtgtccatcttgtcagttgggagaaagagaatgtctcaagtgaggcgttggaggctgctcgcattgcctgcaacaagtacatggccaaatttgctggaaaggatgcgttccatttgagggtaagggttcatcccttccatgttctgcggatcaacaagatgctttcatgtgctggtgctgataggcttcagactggaatgaggggtgcttttgggaagccttagggaacatgtgcaagagttgacattggtcaggtcctgctttcagttcggtgaaggacagcacagccaccatg

SEQ ID NO: 18979 - DNA, 338 bp, Gossypium hirsutum
  Clone ID: uC-gsflnu33B056b06b1
tttatttaattggccttcggtgtccgctcctataccaaaacaccagcttcatcttaagcattgagactccccaagagataatttgaacaatcttcacaataagattatgctagtttaaatttgtttggaattttcacatactgcagggtggtaaatggttggatatttttattcaaacatttgctccaatgcagttgaacaaactcagattcgcctccgattgtgataatttgataattgtctttcccagttttcaccatgtgtttgttcaatgctccctttctttgataaaaaaacttgttcatttactcaaaaaaaaaaaaaaaaaacaattttcg

SEQ ID NO: 18980 - DNA, 395 bp, Gossypium hirsutum
  Clone ID: uC-gsflnu33B056b08b1
ttttcacaaaaaagaaaagaaaaaatgcagtgaaaatggcaacccttaaggtgccagctcatgtacctgcccttattgaggatgctgagcaacttcataaagcttgtgaaggatggggtacaaatgagcaattgattatcgacatattggctcacaggaatgcaggtcagggcaatttgattcgcaaaacttatcgggaagcttatggggaagatctccttaagtctgtggatgaggaactttcacgcgactttgagcgagctgtggtgctggttactttggaccctgcagagcgtgatgcatttctggctcatgaagctgcaaagaggttcacataaagccattgggctctcatggaaattgattgcactaggatttgacatgaagctgtcaat

SEQ ID NO: 18981 - DNA, 535 bp, Gossypium hirsutum
  Clone ID: uC-gsflnu33B056b10b1
taacgatcagttgcagaggaacgagctggccggaagcttggtggtcttagggtcgtgaactcttattggatcaatgaggattcaacttacaaatactttgaagtcatcttagtcgatcctgcccacaacgctatccgcaatgacccaagaatcaactggatctgcaatccggttcacaagcacagggaactccgaggactgacctctgctggcaagaaatacaggggtcttcgtggcaaggggcacttgcaccacaaggctcgaccttcaaggagggcaacctggaagagaaacaacacactctcccttcgccgctaccgttgatcccctggaccgtacttggtgattttgttcctgctatcttggcttcattactattgtagggtttataagaattttgagacagttatattgtgtgtgggacatcttgaaaatcttctatgttagaggctattgagatttatgtgctcactgaaaatgtccaatgctattgtcatattgaggttgtgtttaaaaaaaaaaaaaaaaataaaaa

SEQ ID NO: 18982 - DNA, 404 bp, Gossypium hirsutum
  Clone ID: uC-gsflnu33B056c04b1
taaggaactcagaattttctgatgtgaagccattattattacaagaaccatcacaaaagccaattgttgtttcaatggcagcctgtaaacaagaagatattgactccgaccatatcccacaatattacagtgatgagtttcattcttcactgttggaggctgctgattcatcttaccctttcgaaccagaccagtctgatttatcacaagatgaagaagatagcttacatcctcctgcaagttcgtctaattttggtttccctgttgaaggtcatcctttctggtcttggacttattaagttatatatctacaatgcaatccatatgtgtgtatgtgtgtatatgtatatatataaattgagagatcaatcaatggcaccccaatcgaaaagtatgtagcaagt

SEQ ID NO: 18983 - DNA, 483 bp, Gossypium hirsutum
  Clone ID: uC-gsflnu33B056c05b1
ttgtccatgttccacacatactccataaatgccctgatcagatcccagaccccaaggccgtccagtatgtgagaaacgaccgtgggacacccatggttttggataacaactactacaggaacatactggacaacaagggtttgttgattgtggatcaccaactggcgtacgacaaaaggaccagaccttatgtgaagaaaatggccaagagccaagactatttcttcaaggagttctcaagggccattactctcctctctgagaacaatcctctcactggtagcaagggtgagatcaggaagcaatgcaatcttgcaaacaagcttcactaaaatgcctcgccaaagagaaagccgagtgtggccgaaaaaatgtttgtttactcagtttcttttccagagacgagtttgttaatgtgcaggtgagtaatggtgcaatggtactggtttgtaacgatcgatccattgcattttctttagcata

SEQ ID NO: 18984 - DNA, 430 bp, Gossypium hirsutum
  Clone ID: uC-gsflnu33B056c08b1
cccacgcgtccggtccatcgaaggtgtttacgaaaagggtcaagcttgtttggtggtggaagacctcgtaacgtccggtgcatcggttctcgaaacggcggcaccgcttcggtctttgggtatcaacgtaacggatgccgtcgtggttatagatagggagcaaggcgggagggaaacgctggaggagaatgggattaaacttcatgcactttttactttaactgagatggtcaaggttttaagagctaaagggaagctggaggaagagatggaaagtttggttatgaagtttttggaggagaataagaaagtacccgtgcctaaggttgagaaagtgaggattaagtgtctggggtatcaagaaagggctaagatttctaagaatccaactgggaaaaagctggttgagattatggttaagaaagagagt

SEQ ID NO: 18985 - DNA, 423 bp, Gossypium hirsutum
  Clone ID: uC-gsflnu33B056c10b1
gcttcagctcctcttccaattcccaatcccactgctctttctctcttcactttcatttctatcgcctcttttaactcattacatttttttacctttttctcttactagactgcattttttgtgttcgattccaaatgggtttctctttttagttttataaacttgaaggaaaccccactctgctgcagaaagagatctgtttttgtttgaacttgaaacttgaattgtgtcttttgataagtttgaatgtacatggagaagttgatgaggctgattgaaatgactcctttacttctgctgctttttcttcctttagtttttgctggacatgactataaccaagctctgagcaagagcattctgttctttgaagctcatacatctggttaccttcctcataaccagatagttacgtggagagcc

SEQ ID NO: 18986 - DNA, 474 bp, Gossypium hirsutum
  Clone ID: uC-gsflnu33B056d03b1
tctatgcgttcgtccacgcgttcgggaaaagtgcatgccagaattctcggtgaatattggactcccttcatttaagggatccagttgtttttttgacacagttatttatttagttaattgaacttgtgaaagttctgatgcgtctttaattgaacctaacataccttaagtggcatttcaaagtccataaacttgttgtctacatatacatgggggagagcgatgaccggcttactcttgcggccaaggtctcggtacaggttagaggtcaaaccccattcttatccaaggatagatacactgtgagaggttttggactatggcgtaatgagaagattgcttgttatgtgactgtgaggggggagaaagctatgcgacatattgagagtggatggcaggtaaagaatatgaacttatgagggaggacttaagtgatactgtctgcttggatttggattcaagacacattgtctt

SEQ ID NO: 18987 - DNA, 233 bp, Gossypium hirsutum
  Clone ID: uC-gsflnu33B056d07b1
ttccacgcgtccgcccacgcgtccgcccacgcgtccggggagtggtggtggttacatgggaagtgggtatggtgatgtaaatggaagtttaccatatggaattgcatggttttattatattttatccaaagtattactaaaccttccatttagtttatgacttgtttaggatgttttaaaaggatcttttgcattgatctattaataaattatgggtgtatttataatttttt

SEQ ID NO: 18988 - DNA, 532 bp, Gossypium hirsutum
  unsure (1)..(532): unsure at all n locations
  Clone ID: uC-gsflnu33B056d09b1
caccgctgctctcaatcccttccacttcgccatggtagctctcattctctctttttcaatctagtctcttcattcaaacgtcatttctcttacgttaattcatgcttcagtaacttttttttttaaaattacgaaaggcatcagagaagaagctttcgaacccaatgagggagatcaaagtccagaaacttgtcctcaacatctccgttggtgagagcggcgatcgtcttacacgtgcggccaaggtcttggaacagctcagtggtcaaaccccagtcttctccaaggctagatacactgtgagatcttttggaattcggcgtaatgagaagattgcttgttatgtgactgtgaggggggagaaagctatgcagcttcttgagagtggtttgaaggttaaggaatatgagcttttgaggaggaacttcagtgatactggctgctntggatttggtatccaagagcacattgatcttggtatcaagtatgacccttcaactggtatctatggtatggacttctatgttgttct

SEQ ID NO: 18989 - DNA, 222 bp, Gossypium hirsutum
  Clone ID: uC-gsflnu33B056d11b1
tttggaaacagagaaggtgaaaactgcaaaaaggcatagaggaaagcaaagaaaaggtaagccgaagagaagagaagagaagcgaatggaagaggagagaattatagaaaatcgtttcttcgcttcttcagccttctctttcttttttgcttcttttctccaattcctttctctatctctttctcctttgcttcttattagcaaagaagagaacggtcgagt

SEQ ID NO: 18990 - DNA, 498 bp, Gossypium hirsutum
  Clone ID: uC-gsflnu33B056e01b1
ttcctcgcgtccggtcctttttcatccttctgcccattctatcgcctaatcaaaaatcaatcatggctgtgaccatcaagcgagcggccctcatcgttgccagtcttggcgtcttatcttttatctttggagtcattgccgaaaacaagaagcctgcagctggaactccaatttctggaaaagatgtggttatttgtaagtatccatcggatccttcgggggttctgggctacctatcgggtgcatttctgatactatctactctcactggctattggtccctgttttacccctacaaaggaaaatctgttccacaggctgttctcttccgaaacactagtttcttcgtcttcttcaacattgccttgtttacaggtggcttagcagccactctgctcttgtggccgacgatcacagagcacctgcacttgattcgtaatgttcatcacaatctctccacggaatgtcctactgctaagactggactccttggtggtg

SEQ ID NO: 18991 - DNA, 370 bp, Gossypium hirsutum
  Clone ID: uC-gsflnu33B056f01b1
ttttgcacttatggctgaatttaatggtgcaccagtcccatctgattcactctcttagtagcttgttattgaacaaatgcaggtattgtagcatagcaatttcttgagacacttgaagttaaaaggggttgcagtttcggggtttccgacattaataagggtggttgtccacattttttttatttgtttggtttttctttttcagttaatcagcatgcttgtattaatccagatgcaacagcagttggatgatgaatgatataattgactcgttcaagcttttgatggtttttgaaccatgaacaataagaaatgaatcagatatgttgatgaagaattgcaaaaaaaaaaaaaaaaaaaaataaaaata

SEQ ID NO: 18992 - DNA, 264 bp, Gossypium hirsutum
  Clone ID: uC-gsflnu33B056f02b1
tataaaaaaagaaagaaaaaaaaaaacaaaaatagaaatataaaaacaaagtaaaagcgaatcgctcacaactgacgctcaaagcatgggcagcagttagcttcaggtttgatggcatgcaaaaccaagcagttgaccccttcccaaccatctcactccccggcaacttggtgactaacgcctttacctgggcttacccgccttgcccctgattatataagacctccaagctgacgcctttcctcggttggggcccaaacctag

SEQ ID NO: 18993 - DNA, 533 bp, Gossypium hirsutum
  Clone ID: uC-gsflnu33B056f03b1
tctttctctctctctctctctctctctctctcatggattctctttctctcttctgtaccggggctcttttagccggcggtctgtactggttcgtttgcgttttaggccccgcagagcagaagggcaagcgagctgtcgatctctccggcggttccatttccgctgaaaaggttcgagacaactacaagcagtattggtctttcttccgccgcccaaaggagatcgaaaccgccgagaaagtcccggacttcgtcgacactttttacaatctagtcaccgatatatacgaatggggctggggtcaatcctttcatttctctccttccatccccgggaaatctcaccgtgacgcgacgcgtctccacgaagagatggccgtcgatctcatcgacgtcaaacccggagaccgaatcctcgacgtaggatgcggggtaggcggacctatgcgtgccattgcggctcactcgcgtgctaaagtcgtgggcatcacgatcaacgattaccaagtgaaccgcgcccggatgcacaacaag

SEQ ID NO: 18994 - DNA, 516 bp, Gossypium hirsutum
  unsure (1)..(516): unsure at all n locations
  Clone ID: uC-gsflnu33B056f10b1
tctttcctcctagccaaaaaaaaaaaaaaaagcctctttcctgtctctcgttctttttcctgttcaatcatgtcttgcttcattagcaaatatgctgatgagttggctaaaaacgctgcttacattggaacccctggaaagggtatccttgctgctgatgaatccactggcaccatcggcaagcgtctttcaagtattaatgtagagaatgttgaagacaacaggcgtgctctccgtgagctcctattcacaactcctggagctcttcagcacctcagtggtgttattctctttgaggaaaccctttatcaaaaaaccgcttcgggcaagcccttcgttgatgttttgaaggaaggtggtgtcctccctggcatcaaggttgacaagggtacggttgagcttaatggaacccatggcgaaactttcacccagggtctagatggcctngcacagcgatgccagaagtactatgaagctggtgcccgctttgctaaatggcgtgctgtccttaagata

SEQ ID NO: 18995 - DNA, 491 bp, Gossypium hirsutum
  Clone ID: uC-gsflnu33B056f11b1
taataagtatctctacttgtgtgggagagtggacatgaggcaagttgagaagaccatccagtatttgatcggttcaggaatggatccgggtacggagaatagtccttatctgggattcatctacacaacattccaagaaagggcaacttttatctcacatgggaatacagctaggctagccaaggtgcatggtgacatgaattgggctcagttatgtggttcaattgcggcggacgaaaagcgccacgagacagcatacactaaaattcttgaaaagctctttgagatcgatcctgatgggtcagtcttggcatttgctgacatgatgaggaagaaaatctacatgccagcccacttgatgtatgatggccgagacgaaaaccttttcgaccactactcgtctgttgcacatagaataggtgattacactgaacgtgactatgctgatatagctgcatatctggatgaccgatggaagtttgaggaactca

SEQ ID NO: 18996 - DNA, 527 bp, Gossypium hirsutum
  unsure (1)..(527): unsure at all n locations
  Clone ID: uC-gsflnu33B056g02b1
tccacgcgtccgcaggatttgcattcgcagcgacaggctctcttgcatgccaataacacgcttcatggagtggatgacaacattggcaagagcaagagaattttgacagccatgtcaaggaggatgaaccggaacaagtggatcattggcatcattattgcagttcttatcatcactattgccgctgttttatacttcaaacgtgttaaataggtagtggcattctgcatcttcaccatcttggctctgggtgtttctgagagtgataagtttattttgtccttgcaatgtgcttcattaatccacagactcggttttattcattcattcatttcaattctatgtggtgaacgttaagaaagaggttgacttcagtccttggatttgggacttccttttaaagattttatcatttatttggaggataatgtggtgtcagacatacaaagaaataaatgttgtttatatacaatattgnggtgagggtaaaatgggttgatttgtgtcaagtgtttgacaaaaatttt

SEQ ID NO: 18997 - DNA, 539 bp, Gossypium hirsutum
  Clone ID: uC-gsflnu33B056g07b1
tcttaaacaaaccatttatttttcttcagctctatttgactagatcaatggttgacttcaagaaagccactgctgtgattcttacagaggctctgcttgtgaatctcggtctaatgggtgatgctgatggcgatgatgataagaagattcgagtcacgaaacataaaggtgagaaggagtgtatacatggggggcaatggacctactgatccaaatattgttgcaaccaaactattccagatgtgttacaggtttatcaatgctgaggacctgtttgctcaaacgaattcggcggtggctgacgctgctggattctgggattaccattcttttatttgggctgcttgcatgtaggagcctttgaggtttgggactactgatgcgaagcatatgcaaatgaaggaagtcgcggcttttattgctcatgtcggcgccaagacatcttggggagatcgtgacatagacggaggaccgtggctcgaggtctttgcttcatgagagaaatgagtactagccaggattactgcgatgattactac

SEQ ID NO: 18998 - DNA, 305 bp, Gossypium hirsutum
  Clone ID: uC-gsflnu33B056g10b1
gccgagcggacgccaacgcgggcggacgaacctgctttatatgatatcagattctgggtctgggatgaccgcaaaagcaaaagcatgggggtggatggtaacattgaccgataggaagaggctgagacgcagtggatcacattgatttatggaggactggtcataatcatgcccatagaggaatctatgtaggaagcaatacaggcatgcatattaaggacgcggccactaatgtgtttcaggagctgaggtggatctcatactggcaagcgctgggccggattacatggatctgaattgccgta

SEQ ID NO: 18999 - DNA, 380 bp, Gossypium hirsutum
  unsure (1)..(380): unsure at all n locations
  Clone ID: uC-gsflnu33B056h04b1
tccacgcgtccggtgttcctgatgactatgaatgtgaggttatcgaaaatgatgctcctattcccaagcatgttcctcagcaccgacctggtcctcttccagaggagttttacaagacgctagaagctctttcaaagaaagacgagcctaaagtcacctccggagatccaaagataaaggagtaatgtgacgcagacggttggctgaaatttgcattgttctttcgttcttgtttgttgatcttgtattgtgcctgtttccgttgatggaattgagctttaacctatgataaaaagctggaccggaacctttagttgcataataatattgaatgccagtggttattaaaaaaaaaaaataaaaaaaaaaaaaanaaaata

SEQ ID NO: 19000 - DNA, 477 bp, Gossypium hirsutum
  Clone ID: uC-gsflnu33B056h11b1
ttccacgcgtccgcccacgcgtccgcttttttacagttgaacaatgatgggttcgagaatcaaaatctcagctctgggtgttactatgcttctgctgttgattgccccaacttccaacgctgccatttcgtgcagagttgtgataaaggacctgaggccttgcgtgaactatcttacgaaggggagcggaaaaccaccgtccgcttgttgtgcgggagccttcgctctggcatccgccacctcgtcgtctgccgacaatatggctgcttgtgaatgcatcaaatcagcgtctaagaatattaaacccaataaccagctagctcaggctcttccttctaattgtggaatcactttgcccgtcaccatttcaccaaatgtcgattgttccaaggttggttgagagcttggaagctgaaactgggagtgcttggatgggcatgaagctataacaaactccattgagaagctcaattgttt

SEQ ID NO: 19001 - DNA, 375 bp, Gossypium hirsutum
  Clone ID: uC-gsflnu33B057a07b1
gctgttggatgagcctcggtttttcatgacacttatggaattggagcttgttttagtattgccgcttgctatacttaacacttatggcttgttgacctccaagccctggttcaacaccacctgcctcatcttcggatctgctcttgttacctccacgacagctatggtgggagacatgctgggatccgacaaaccattagcaggtaaactggcgtcgatgtactcgccttttataggatctgggtccctagccatactgcgaggtctgtttttggaatcctccaacgcttccaaaacttttggcctacggaccaacgtcggttttgaaaaacaatgcctgaagccgacacatgaattataacacatcatcttttt

SEQ ID NO: 19002 - DNA, 381 bp, Gossypium hirsutum
  Clone ID: uC-gsflnu33B057a08b1
tcttccacgcgtccgcggacgcgtgggtgggcgcagctacgaacagtgtgatgcacaacttgattcatggaggtcttctcacttaaatggccatcagaagctaacaaaggttcgttcacttgtggacgtacgcagcaaattgttgcaccaaatggtcatggcagagataaacaagaggcgcttattcaagaccgttggagcagtggagaacattggatatcaagagctgggagaagtttcaggcaagatatcttgaatatgtaggaaacggaaggatttgaagatcatgacgaagatttcacgggagatttaggtggtaaaggtcccatcaatctctgtgttaatatgcttttagactttcagttgtgatggtgtacaaaa

SEQ ID NO: 19003 - DNA, 366 bp, Gossypium hirsutum
  Clone ID: uC-gsflnu33B057a12b1
cttcacttgcttacgctcctcgctgtggaaagaaaaaaaaaagttctctatcagatcaagtattagattgatatagtaaagatgtcgccaaccgaatcatcacgagaggaaaatgtttacatggccaagctggctgagcaggccgagcgctatgaggaaatggttgagttcatggaaaatgtagcaaaaactgtagatgttggtgagctgactgtggaggaaaggaaccttctttctgtagcttacaaaaatgtgattggggctaggagggcttcttggaggattatctcttctattgagcagaaagaagagagcagaggaaatgaggatcatgttggcaccatcaaggagtataggagccaggat

SEQ ID NO: 19004 - DNA, 284 bp, Gossypium hirsutum
  Clone ID: uC-gsflnu33B057b01b1
aatgttacaaataataaattgagtcctatactcgagatctacgttctcgaactgtattaccatgttatattttgttataattgtgtactactaaatctactatgttgagtaatgttggttttatgaaatcaataagattgcagttcatggactggataactcttaaagatggaacagtacgttgctctaaccgaatttaaagatggagatgaacttataaagttagaataaaataatattaataaaattcaaaatcaatataagggttctcaagtttgcacatt

SEQ ID NO: 19005 - DNA, 481 bp, Gossypium hirsutum
  Clone ID: uC-gsflnu33B057b05b1
tgaaaaatagaagaagcctttgtttggggttctggaacttagctttccatatattcatccatggcttctaagcttcttttgattgctgtatttgttcttgatctcattgcttttggtttagctgttgcagctgagcaaagaagaagcactgccaagattgtgcaggataatgcaattcaatacaactattgtgtgtataactcagacatagcaactggctatggtgttggtgcatttttgttcctcatggctagccaagtccttataatggttgccagccgatgcttttgctgtggaaaggctttgaaccctagtggttcaagggcttgggcagtcatccttttcattgtttgctggctatttttcctaatagccgagatatgtttgttggccggatcagtacggaatgcataccaaacaaaataccggaccatcttcagcgagcagccacccgcttgtgaaccttgaggaagggagtgtt

SEQ ID NO: 19006 - DNA, 94 bp, Gossypium hirsutum
  Clone ID: uC-gsflnu33B057c01b1
ttttaaaacgcagagaaaacacaaaaaaaaaaggggaaaaaaaaaaaatgtagacggaaaaaaaacaaaaaaaataaaaaaaaaaaaaataaag

SEQ ID NO: 19007 - DNA, 483 bp, Gossypium hirsutum
  Clone ID: uC-gsflnu33B057c03b1
taatgaatactaatctagttcagtctagtggcctgcatagtggtgggatgggaatagttggtttaccatctcctgcaagccatatatctccagatgtgatttcaaagaatagtgtagatacaactttatcaccggttccttatgtgcttggccggggaagaaaacgcagtgcagcattggagaaagtagttgagagaaggcaaaggagaatgattaagaacagagagtcagctgcaagatcacgagctcgcaagcaggcttatacatcggaacttgaagctgaagttgcaaaacttaaagaaatgaatgaagaattgctgaggaaacaggaagaagtgatggaaatgcagaaaaatcagatgctagaaacacttaatccagcatggggaggtaaaagacaatgcttaagaagaacactgacaggcccttggtagagtttgaggaactgctgattgaaaaatgttgctttgatacacaatcttg

SEQ ID NO: 19008 - DNA, 281 bp, Gossypium hirsutum
  Clone ID: uC-gsflnu33B057c05b1
tcttttcgcgtggggttctagatcgcgagcggaggaactttttaaattttttgggtgttaaaagattagatcttttatatgttctgtttgtgattactgttttctgttttattcataaaaatgtggtttggattgatatgtaattaaatgaatctgtaaatgttttactattttgggttatgatgatgagatatatttttatgatgacctatagttaatttttttgtttcacactttttaaaacacttttctttgtgtgaaacctttgggttttcccaatt

SEQ ID NO: 19009 - DNA, 488 bp, Gossypium hirsutum
  Clone ID: uC-gsflnu33B057d01b1
tggttgtaaaagggctctaagcctcgtccgcgttttcctcttttccctttactcgttgaccgaaatttctcgactcaccgtgttcacaacctctagatctgttacttacaaggcccgatttcataatttcaagatctgcttccagcatctaaacgcgaccgttttcggaactcaactcggagcttcaatttttaaggtttggaatttggatgtgcttgtcttttatttggtctactggaaatgtcggttttgcccaaaggtgattcagttcatattcgagaagtttggaacgataatctagaagaagagtttgctttgatccgtgaaattgttgatacctataattatgtagctatggatactgagttcccgggtgtagttctacgttctgttggttctttcaagattatcagtgattataactaccaaactttgaaagataacgtggatatgttgaagttgatccaattgggctcactttctcggat

SEQ ID NO: 19010 - DNA, 351 bp, Gossypium hirsutum
  Clone ID: uC-gsflnu33B057d07b1
tattttcagcaattttctgcaaaaagacaaagaagcgtgttcgacatactaacgcaacccaccatggtcgtcgtaagggcaaaagggggcacacagacaagtagactgcgtgtatttaggttttggtctcttaatgttgggaaatattagaggctaactggacgtgtgtttttacttttgaggggctctaggtgatcatgttgggtatgcagctgaggtgtcgcaattggaagtatctaatcttctattacatctgaaggaccctggttttaatactattattattgtttggagatgatgctggatgtgctaaggattattagaaaggcgtaatgttatggtgtttttgga

SEQ ID NO: 19011 - DNA, 467 bp, Gossypium hirsutum
  Clone ID: uC-gsflnu33B057d08b1
tataaaaaaaaaataaataaaaaataaggagggtttttttaaaaaaaaagagggtaatatatatatatagattttttaattttttttttttgtgtggttccctgtggtggccccctttctggtcctcccttgttccccccctcttgccccctcttttgggtttgttttgtgtgtttctttgtgtctttttcgggcctttcctttttggctcccccttgtgtttccccttgtttttctcccttttttgcggttcgggtttcccccctgtttctctcctcggcggtttccctttctgccgcgccttcccttcctcttccttccctgtggcttcttgttggtgtctttttttgcgcttcttttgtggggttttcccttggggggccctcttcttttgcccgctcctttttcccttttttcttttccccctttttctctcccttgctctttccctttttcgtttttttttt

SEQ ID NO: 19012 - DNA, 313 bp, Gossypium hirsutum
  Clone ID: uC-gsflnu33B057e04b1
cccacgcgtccgcccacgcgtccgggtggctgctcttcaccttggaaagcttggggctaacctcaccaagctcaccaaggatcaggctgactacattagcgtccccattgagggtccttacaagcctcctcactacaggtactgaggagagaatacgagagagagagagggagagagttggactagaaaaaggaaccatacaacgggatggtttgattgtttgtttttactaaaatttattgatgatttgtggttagatggttagatttctgattttgataggagtttgcgtgtgggatggatgggcaagttt

SEQ ID NO: 19013 - DNA, 532 bp, Gossypium hirsutum
  Clone ID: uC-gsflnu33B057e05b1
ggggctgctcgcctgcctgcacgcgcccggacttaactggctgggccgacccacccgtccacgcgttacggccagcgtgcgaccacgcgggggggcttggagaagagacgaaattgtagttgaccctttaaccatttatttcttataaaccgaatcactccttcggagattttgataattcccccatctccctagatctcctacatttcggagatggcggacgcgcaatccagatacgttaagctgacaaaagatcaggtacctttagaggatatccaacctggtgaacttaatcagcccattgatgttcctcagttgcatgtccgaaagtgcaatgaatgtggacagcctttacctgaaaattttgaacctcctgctgttgaaccttggacaactggaatttttggctgtgctgaagatacagaaagttgctggacgggactattttgtccatgtgttctatttgggcgtaatattgagagcttgagagatgatacgccctggactacaccatgcatttgtcatgctattt

SEQ ID NO: 19014 - DNA, 275 bp, Gossypium hirsutum
  Clone ID: uC-gsflnu33B057e07b1
tgttttgacgcagctgctatttcttttttgtggttttcagcagcagcttgtatttggaagaatggtgagggtgagcgttttgaatgatgcactcaagagcatgtacaatgcagagaagaggggcaaacgacaggtcatgatccgaccgtcctcgaaggtgatcattaagttccttttggtcatgcagaaacatggttatattggggagtttgagtatgttgaatgatcatagatctggtaaaattgtggatgaattgaatgggaggttgaaacaa

SEQ ID NO: 19015 - DNA, 455 bp, Gossypium hirsutum
  Clone ID: uC-gsflnu33B057f04b1
cccacgcgtccggtcgttattgactactttactaagtgggtagaggctacttcttacgccaacgttacaaagtcagcagtcagcagattcctaaaaaatgagatcatatgtcggtataggatggtagaaaggattatatccgataatgcattgaacctgaacaacaacatgatagtaacggtctataatcaattcaagatcaaacaccacaaatcatcaccatatcgcctaaaaatgaatggcgcggtagaagcggccaataaaaacatcaagaagatcgtagggaagatgactgaaacttataaggattggcatgagaagttaccatttgccctttctgcctatcgaacgtctatcagaacctctatcggggcaacaactttttcattagtgtatggaatggagggcagttttgcccattggaggagagattcctttccttccggttttattag

SEQ ID NO: 19016 - DNA, 386 bp, Gossypium hirsutum
  Clone ID: uC-gsflnu33B057g01b1
tctttccaaactcggaagcgcgaggttgttcctggggggttgtttgtaaatctccatggactgccggacttggctgggacaagataggaggggaaactgataagataggacggattttagtcaatgacagatttgctacaaatgtggccggagtttatgccatgggagatgtaattccagggcctatgctagcccacaaagcagaagaagatggtggttagtgtgtctagtttatagctggtaagtatggccatgttgattatgactaaggcaattggggttgaggtacactaaatcccggaggtggtatatgaccgggaagaccgaggagcatggttaagggcacttggtgttgattacccgtggagggaagatcccttttttgg

SEQ ID NO: 19017 - DNA, 353 bp, Gossypium hirsutum
  Clone ID: uC-gsflnu33B057g02b1
tttttaaaaacatacaaaaagaataaaaagggggggagattttaaacaaggtgtttatatacaaaaaaacgaaagaaatgaaatcacagcaattgtggcatggtgtctgtccctgcctcatgtttgtagatgacctttaaaccggggggggggggttttggggggcccagttttcatcctgggtgttgcgcggtgtttattcttttttaggggggccccaaattcgaacacctgggccgttgttttcacaccggtggtggggggaaacctggggggtaccccatttaagtcctttggggggcgctttcctttctttccccaggttggggtaatataataggggcctctccttt

SEQ ID NO: 19018 - DNA, 339 bp, Gossypium hirsutum
  Clone ID: uC-gsflnu33B057g03b1
ttccacgcgtccgcccacgcgtccgcccacgcgtgcgctccacgcgtccggttgtctccaattctttctataaaaaaaaaaatctaggaaagcatcaagaatggaggcattgaggatggaagtattttgggtgatgctgattgtgttggttgccgtatttaaggtccaaaatgtggcggcagctgaagctccggcccctagtcccaccttcgatgccacaatcttcctgccgacggcgcttgcttcccttgttgatcttgcttttgggctttctttttaaaatgttcgtcgtttatgagcaccataatcttcctccaaattctctttcattttcctcct

SEQ ID NO: 19019 - DNA, 438 bp, Gossypium hirsutum
  Clone ID: uC-gsflnu33B057g06b1
tgttagatattgtaacaccagaaacctttagatgggcagccaatgaccctaagatcattcaagcttctacaattatttgtaggtttatggatgatgttgctgaacacaagttcaaacataggagagaagacgattgctcagcaattgagtgttacatggaagaatatggtgtaacagcacaagaggcatatgatgtattcaacaagcatgttgaaagtgcttggaaggatgtgaataaagagttcctgaaaccaacagaaatgccaacagaagttttgaatcgtagcctaaaccttgcaagggtgatggatgtactttacagagaaggtgatggctacacatatgttggaaaagctgctaagggtggaatcactttattactcattgaaccaagtgcactttgaaatcaatataaattttccatttctgtttctaagg

SEQ ID NO: 19020 - DNA, 269 bp, Gossypium hirsutum
  Clone ID: uC-gsflnu33B057g07b1
tcccacgcgtccggggagataagaaaatggggtggttttaacacatgcactgttacatgtatgacagaagattaccgaaaacttaattctaaaactatctgcatatgcatcatgctaatgatgaatgatatgccgaccattaaagtttcggtactgattgtctaaatgcaagtatgactttaatatagagtttcataccgaaaagtatggatagctaaatatatagcaatggagcagttgtacggagattgggatgcatcctacaatga

SEQ ID NO: 19021 - DNA, 86 bp, Gossypium hirsutum
  Clone ID: uC-gsflnu33B057g10b1
tttcttgtgttcttggaaggtttgtatgtttatgaaatttcatgactatttttagtgttaaatgaagaaattatatttttgatatg

SEQ ID NO: 19022 - DNA, 477 bp, Gossypium hirsutum
  Clone ID: uC-gsflnu33B057h07b1
ttcttgttcaagaggatcccacctgtggtccgttggtggatgcggttgctattaaggagcttgtccgtcccagagctaccagatataatctggtgaagaacagtggctttgaagagggtcctcatcgcctagtcaactccaccaatggtgtcttgcttccccctcggcaagaggatttcacatccccactcccgggctggatcattgaatcacttaaagccgtaaaattcatcgatgcaaagcacttcaacgtcccggccggacactccgcagtcgagctggttgccgggagagaaagtgccatcgcccagatcctcaggaccatccccaacaaatcatacaacatgacattcgtcatcggggacgctcgcaacggctgcaacggagaaatgatggtggaggcattcgctgccaaacatacagtcaaagtttcctttacatcacgtggaaaaggtgaattcaggctgccagtttatg

SEQ ID NO: 19023 - DNA, 483 bp, Gossypium hirsutum
  Clone ID: uC-gsflnu33B058a01b1
cttgtcgtgtgggcttccccttccccttccccttgcccttccccttcttctcttccttctacttcttacctttctttctcttcttccgaaacacaacctaatttttacccagatagctgttgttacccttaccctacaccaatggactcagtatcatgtccccaacagcctcaaactggttcaacaattgggctaaatagcttgacacaagctcagatccatcagatccagcttcaattccacctccacaacaaccaaccaagctacctttgccaaagtccccaacccaacaccatcagcgccaatagtaacccgatggttagctttctttgccctaaacctgtcccaatgaaacacgtgggtgcgccattcaaacccaccaaactttacagaggagttaggcaacgcccctgggggaaatgggtcgctgagatccgggtacctagaaaccggacacggtttttgttaggcacttttgacact

SEQ ID NO: 19024 - DNA, 152 bp, Gossypium hirsutum
  Clone ID: uC-gsflnu33B058a02b1
cctacgtttccgcccacgcgtccggaaaactagtgaagatgatttgtttgctttttaagattggtggggagaggaagtatcggatattgtcgatgttgaaggcatctatgggactgatgagaggacaaaacataaacaaaacggcattaaac

SEQ ID NO: 19025 - DNA, 275 bp, Gossypium hirsutum
  Clone ID: uC-gsflnu33B058a03b1
ccctcgtttccgcaaaaacgaaaggaacgctcggagggtttgcatcaatgggtctttcaaaggctgctctaatccttgttctcgacgttgtttgtactctcatgggttcagccatcgctgctgaatccccagcaccgagtaccacctcaggaaccggctccatctccccctcattcgtctctgctttctttgccgctgtcacggctctgatttttggctctactcacaggatctgaatggtgctggctattgatggtgtagagagggtcgtttga

SEQ ID NO: 19026 - DNA, 344 bp, Gossypium hirsutum
  Clone ID: uC-gsflnu33B058a04b1
gttacgtgttcgcccacgcgtccgaccactcgggcgtgcactcgtccgggagggcgcacgctgttcatcctcttactgcaggacaacttgagtggtcgctctggactcgtgatgatgaggaagaaataattcccctttgcagggaactaggaatcgggattgttccatatagaccacttgagcgaggtttctttgccaggagagcgaataaagatacctctaatacgcctgtgagaatgttcacaaggttgagtggagaaaacttggagaaaaagaggatcctatattcgaaagtagagaagttggctgaaaagcatggatgtacagctgcacaacttgcactt

SEQ ID NO: 19027 - DNA, 367 bp, Gossypium hirsutum
  Clone ID: uC-gsflnu33B058a05b1
gttatgttaacttttccgatccgaatccaagtgccgttccacagcatgagtgtgtgtcgaagaatgcccaaaagaagctgttgaagcatccgaagtacgaggcgagtaaagccgcgaagaaagcacaaatgagagagcacacacagagggatgcggagaggaagcgaagagaatgggaggagaaactggccgtcctacccgaagactaaaggcttaagctcatatattcaagaaaagaactgcggagagagagggtggaaaaatggtccgaggaaagaggcccgaaaattcagagactgaaccatgtcaaggggtcggggcaaaacattggcgtagaccgtgtatggtctcatatcaagacccactc

SEQ ID NO: 19028 - DNA, 51 bp, Gossypium hirsutum
  Clone ID: uC-gsflnu33B058a07b1
tctgcctacgcgtccgaaaaaaaaaaaaaaaaggggggaatatatatatat

SEQ ID NO: 19029 - DNA, 367 bp, Gossypium hirsutum
  unsure (1)..(367): unsure at all n locations
  Clone ID: uC-gsflnu33B058a11b1
tcggtgaatttgatgaaattgactctgtttaggcagtattacgttgtggtgatctgttatatttacttcactcgtgttgtggtttatgctttggagacgattacttcgtataagtatctatggaccgctgtgttggccggagaattggccactcttgccttttatgtgtttactgggtataaattcaagccagaggcgcataacccatattttgccatcgatgatgaagaggaagaggctgctgcagagcagttgaagcttgaagatgagtttgaattgtgaaaccaatcatcgagaacaatataaaatgattgaagttagcaaatacaattgggacattgaggttnaaaaaaaaaaaaaaatttaa

SEQ ID NO: 19030 - DNA, 500 bp, Gossypium hirsutum
  Clone ID: uC-gsflnu33B058b03b1
tttttgttggccttcgcgactatcaagatgacaaggccgatgtgatccttaagtacatgcctgactaatcaaggctattgaaggcctatggagagcttccggagaacacccgtctcaatgaaggcattgttgatggggaagacgaaggcggtgtagatgaatatgtcgagttcgaagatgaagatatagatcaaatgtaaggtaactatgatggggtcatgcttgaagccttgtgtttaaactgttagaaacagagagatatactggatgctgtggagatatatgactacaggaagtgagatacctgccataagttataagttagacaatctataaatggtgaaggtgacattgttagatgggactgttgctaacttcattgaaactgaaagtgtgtgtgaaatcttacaattaattgtgatggcgacagtgtaagcttattgtctgcaccattattaaagaagagctttttaggttgctcgcacactaggacctacaac

SEQ ID NO: 19031 - DNA, 455 bp, Gossypium hirsutum
  Clone ID: uC-gsflnu33B058b08b1
cctacgcgtccggtgggatgaccaaatccaggttgtttggctatgggtcagtcactcgaggaagctaatatgcatcggccatcagtacattaattgaagagatgaatgctaagcatgtcgagcaaatacaaacaattcaagctgaacaagcagttcgagagaaaactctactcgaggaagcaaaatctcgatttcgtatggaggttgcagagcgagaagctcgtttgatagctgaggcagaagaaagatttatgaaattaactgaaattcgagaggcaaagctcatggatatgtttgatgctcgtgagaaaaagtatgaggctctcatcaatgagtgtatggcaaaaggaatgccaattgaatttcaaagtagccgacatgaagataaagccttcagttcgaatgatgatgaatgaggcttgctgcatattatgcattacatatatatgttatag

SEQ ID NO: 19032 - DNA, 520 bp, Gossypium hirsutum
  unsure (1)..(520): unsure at all n locations
  Clone ID: uC-gsflnu33B058c03b1
cctacgcgtccggcaagatgatttacgccagctccaaagacagattcaagcgagaactggacggaattcaggtggaattgcaagcaacagatccaactgagatgggtctcgatgtgttcaaaagccgtgctaactgaatacggttcttttaggcatctgcaaccgggaagcttccttccttcctacctacagtatgtctttacttaagtgaaatgtttataggtttcgaaacggcaaactcgggatttccgagttatgccataagacttttatcagtctcgatgatgataaacccgtagtttcgggtatatgtgatttgttatctatagaacctatgtgttgagtgcctttgtgtagtctttatctctttcaacgctaaatgcaactgtttgtgagggttagacgacacatttagttcgttttcaagtttttttntttttaattttctttgaatattgacccttggttattgtttcggagtgttaaagagggcatgcttttatgtctttcacgtcaaaaa

SEQ ID NO: 19033 - DNA, 280 bp, Gossypium hirsutum
  Clone ID: uC-gsflnu33B058c04b1
cttgtttgtcaagcggaatccggtgtttggaggcaccactactgcgctctatggagatcgagtctggggactatgacacgttgtgaccatgatcaacatggtccgtcattaccttctttacgatgacctactggcagatgtgagagaggacgccagaccatatggagggctgacatgcgaagaacaaaatattatcactgcatccacgtcttatgcatgatcctcgacgagatatcgacctggacatggatcggatgctgcacgatgcaacgcttaataa

SEQ ID NO: 19034 - DNA, 528 bp, Gossypium hirsutum
  Clone ID: uC-gsflnu33B058c06b1
cttacgtgtccggggaaatccgttagcgggatgaactactacgcctgtctatctttgttgtctcttgtaattctcacaccttttgcaattgctgtagagggaccgcagatgtgggctgcaggatgggaaacggccttatctcaaattggaccacagtttatctggtgggtagcggcccaaagtattttctatcatctctacaaccaggtctcatacatgtcccttgatgagatatctcccttgacatttagcgttggcaacaccatgaaacgtatatcagttatagtctcttccatcatcatcttccacacgcctgtccagccaatcaatgctctaggagctgccatcgctatcctcggaaccttcttgtattctcaggcaaaagcgtgagaaaaaccaggggttcgagaattttgattcatcatacaacatagatgatgaaagacaaaatcggtctccgaaagatttagcttagatgagtcttatagatactactgcttttagattgataatgctggattggaagat

SEQ ID NO: 19035 - DNA, 554 bp, Gossypium hirsutum
  Clone ID: uC-gsflnu33B058c09b1
tttctcacgcgtccgcaactttcttcttaagctcactgtagttactctctacctgccacagccgcatcatggccgattccgccaccgcgtcttcccccctaaaagtcatcgccggagctgattcttttggcgccgagctaaaagacgccatggtatcccacctccgctccctcaacatagaagtcgaagatctcggaatcacctcctactacaacatcggtgctgaagtcggccgtcgagtatcttccgccaccacctcgccctccttggagacccgtggcctccttgcttgcggaacgggcgttggagtcgggatcttcgccaacaaattccccggcgtgttcgccaccacatgtctcactccggacgaagctcgcaacaatcgctccgtcaataactgcaacgtcttggcactctccggcatgtaaacgttcgacgataccgctaaggaacatgtcgacacttgggtcaacactacttttacagcgccgtgtccggtctgtaaggcccagctctggccggtggtaatctcaaattttttcgatgaatcgatg

SEQ ID NO: 19036 - DNA, 471 bp, Gossypium hirsutum
  Clone ID: uC-gsflnu33B058d04b1
ttttggtttttggaaaagtcaagcagttattaaagactctgactgctttctatgttctgtcatataacctataggctatagtattcaattgtacttaactaattgcttgtgtgcgtgtatattgtaaagttcacccctatttcctctcatattacttcatgatcaataagatctaagaaagatggtttattaaaaaaaaaaaaaaaaacgtggatgaattgacacatgaatgaggacctttattatctaattatctcttaaatgccatttggagctcactggtgttcatttggaagcttatcccgactcccttcatttgaggtaggagagttttcatcaatctcatatatgagttactggttcaagaagctatttttgctgaacattcagcatttgctggtcatccatgtccgtatgtaggttactatggaccaacggtttattcccttattctaaaattcctgtggaagt

SEQ ID NO: 19037 - DNA, 334 bp, Gossypium hirsutum
  Clone ID: uC-gsflnu33B058d05b1
cttacgtgtacttttactttgagctacaatggtgtccaacggtcaagagaccttttgatgtgtttgccgaagagcttggttctgctgaacgtttcatgaaagagtcgcagtttttgatttatggaaatggcaaagataagccttctacagggctcatgtttgagaaacagctgatgaaagggttatatttcaatcaatcgccaacaaaggatgttgctttggccatggtgtacatgagatccaccccactaggtcctatcatggaggaactgtcattgacccccgagaagttcggaactgggtggcggttctacgttcaaacattggaagatcg

SEQ ID NO: 19038 - DNA, 219 bp, Gossypium hirsutum
  Clone ID: uC-gsflnu33B058e06b1
gtttcttttccgaaaaagcaaacaacgataacgggggggggttattctaaaaacgacgaggaccaaaacagacgagggacgcaaatttatgtgggacttaagaagggcctactaagacgaaaagaagcccaatcttgacacagccaaatgctccactgacaaaaagaacaacacacagatggagcagcgcacaggaggatccacggattaaaggccctt

SEQ ID NO: 19039 - DNA, 536 bp, Gossypium hirsutum
  Clone ID: uC-gsflnu33B058e08b1
tcggaaaaatctcctttcttggagaggcttaagaagaaaaattatgaggtaattttcttcactgatcctgttgatgagtacctgatgcaataccttatggattatgagggaaagcagttccaaaatgtatccaaggagggcctgaaaatcgggaaagaaaagaacaaagaactcaaggagtcatttaaggaactaactaaatggtggaagaacgcacttgctagtgataatgttgatgaagtgaaaataagcaaccgtttggacaacactccttgtgtggtcgttacatcaaaatacggatggagtgctaatatggagagaatcatgcaatctcaaaccctatctgattctagcaagcaagcttacatgcgtggcaagaggatcctagagattaacccaagacacccaatcatcaaggagcttcgtgagagagttgccaaggactctgaggatgagggtgtgatgcaaacggctctggttattaccagacagcttgtatggaagtggtttaatctaccgatcccaagactttgttt

SEQ ID NO: 19040 - DNA, 444 bp, Gossypium hirsutum
  Clone ID: uC-gsflnu33B058e09b1
ttcggtcaagctggagaagatgcgccgccgccaggaagccgctgccttggcctcagcggcttcttctctctccgtcgaggaggaggactcctattcctccaactacggtgacgtcaccctcccggagctcaaatcttgctccaaaccagatgctggcaattggagcatagcaatttcttccatggactggactcgcgtcggagcccttaccgaggagctgaaggagaaggaggtgcttataaggggacgagtccacacaacgcgaccagtgtcgaagaatatggcgttcgtggtggtgagggagagggggatttcactgcgcagtgcttgggtgctacgcatgaagcgggagtgagtagtcagaaggtgaagtttgtagctgcactcaatcgagaatcccataattgctgcacctttgaatggcatctagccctgggattccca

SEQ ID NO: 19041 - DNA, 313 bp, Gossypium hirsutum
  Clone ID: uC-gsflnu33B058e10b1
tcggttcgcattatgtttatattgtcaacttcaggttcatttgttgaaacgccagccttgtagggcggaggccgacaaaacaaaactaattgaaagtgtggaatggtgattttaagaagctactgactgattggttctaagtaatttaaagattggctcattgtactgctagggcacatctctggattctactcttctaatgtacaggttgtaaattgatattctgctgaatgcaaaagatttgtgaagacatgttctttcaaaaaaaaaaaaaaaaaaaaaaaaaaaaaaaaaaaaataaataaaataaaat

SEQ ID NO: 19042 - DNA, 216 bp, Gossypium hirsutum
  Clone ID: uC-gsflnu33B058e11b1
ggtgtctgatatgtaatgggttttaaattttgggctatttaattatttatttgtttgggttttattttttgttttattgattcgggccaaaattggctattacaagtaaaatatgtaatatgctatgtttaatctgaagaaaacattatgttaaaaaaaaaaaaaaaaaaaaaaaaaaaaaaaaaaataataaactaaaaaatcaaaaaaaaaaca

SEQ ID NO: 19043 - DNA, 508 bp, Gossypium hirsutum
  Clone ID: uC-gsflnu33B058f06b1
gttcgcatcggggttgcccgggttctcccctctgctgtggtgtggtgtttcccgctcttttatttttttttctttctcttttctcgctttccactgtttttcctttgatactctgcaccattcgggatggattcatgatccaattcatcatcaccatcatcatggtctacatggaataagctcatgatctccaaaccatcgatcgcaaggccaaggtattctttacatatttaaaaccaaaatttgccctatctaattttacttttaaaatttaaatatgttttctaatctaactattgtcattacttttcaacatatttttttcttattaaaaatcactcataaatttttttgaaaggaattcactaattatttaattaaaaataaatccatttataattatatttactatctttgaaaaaaagtaccaagttaatttaatactatattaattgttttctttagagtgttattgggatgaagagccaatggttttatttctggcttt

SEQ ID NO: 19044 - DNA, 380 bp, Gossypium hirsutum
  Clone ID: uC-gsflnu33B058f08b1
tcgcctcacgcgtccggaagaatgctaagttgcgtgaattggttaaccttgtagttgtcggtggagatcggagaaaagagtccaaggatttggaagagaaggctgagatgaagaagatgttcgagctcattgagaagtacaagctgaacggtcagttcagatggatattatcccaaatgaacagagttaggaacggtgaactttaccgttacatttgtgacacatagggtgccttcgtacaacccgcattatatgaagcctctgggttgtctgtctcttgaggccattgacttgtggtttgccgacatttgtaacttgcacttttggacctgtcatgatcatttgttccacggtaaatttcctcttcaacatttgatcct

SEQ ID NO: 19045 - DNA, 434 bp, Gossypium hirsutum
  Clone ID: uC-gsflnu33B058g06b1
gtttgactgaatcaggtgctgggtattttcaacatgcttgtctcatctgctagctcagatgaacaaggcttctatgtcttgaacactgtgattgagaatcttgagtatggtgtcatatctccatatatgggtaatatttggaatgtcctctttatgcgcctccaaaacaaccgtacagtaaagtttcagaagtctctggtgattttcatgtcactcttcttaatcaagcatggggctacaaatctagtggacacaatgaatgcagttcaggacaacattatcttggttattttggagcagttttggattcccaatcttaagctgattactggagccattgagcttaagttaacggcagttgctttaaccagactcatatgtgaatctccggtacttttggatcctgcagttgctagactttggggcaagatgct

SEQ ID NO: 19046 - DNA, 222 bp, Gossypium hirsutum
  Clone ID: uC-gsflnu33B058g10b1
ttgtgtctccttgataacaacacacaaaatggaaggccaagattctctgagcagatgaaattggacacagagacttctggttttttttcaggacatcgaggtggacgtggtggtcgctttgggggtggttatcatggaagagggtatgggcatgtggggaggggtagagtactagatatgtctatgctagctacataggtgagtgggaaatttctaactgtt

SEQ ID NO: 19047 - DNA, 499 bp, Gossypium hirsutum
  unsure (1)..(499): unsure at all n locations
  Clone ID: uC-gsflnu33B058g11b1
gatcattgaagcttttcaaacttcaatagtccatggcgttgtcaaattccctttcctttccttcttctaacgccgtcgacctccgacgttccacggttcccgattccggcatcgccccttttttcacttcttttgactgttctagattccgctgcaacttttctcagtgcggcattaggcccaatttctctgcaagaaaacgcattgtttctgctgctaacaatggtttcaacacggttaattcaacttcatttgggactggccaagataaagatgattatattccaatgccaattgttttgattgatcaagattcagattcagaagcaacagttgtgcagctgagttttggagatcggttgggtgctctcattgacacgatgagagcattgaaagatttgggattggatgttgcanagggaactgttgccactgaaggaccagtcaaacaaacaaaatttttcatcacacgattagacaatgggcgccaagttgaaga

SEQ ID NO: 19048 - DNA, 412 bp, Gossypium hirsutum
  Clone ID: uC-gsflnu33B058h04b1
tttttattcaaaccttgtgcgaccgagttacggggctggagtctaaattcgaccgtctcgttaacgggaggaactccggaggggacaggaagtacacgtggactgcggagatcaaggggccggttgagaggaagtacaaatgggtagcggagatcaaggatgggaagaagacagaagaggtgaaagagaaaaagtataaatggacgactgagattgaaggaaagggaattgatgggcctatctcgagaaagtacgtgttctcagcatccactggtggcgatgcaagtgaatgtagcaaatcggagaaaaaggaaaagaatgagaagaagcatcagaaaaaggacaagaaaggagagaatgttccgcgtgtagtggagatcgaagagccgtcagatcacggagctgtcgtttt

SEQ ID NO: 19049 - DNA, 434 bp, Gossypium hirsutum
  Clone ID: uC-gsflnu33B058h06b1
gtttgttttcacactgtctgtatatgtgtatctgttggattacgagaagggggagatgtttcaagaatacagtgacggaaacgggtcagcctctaccaaaaatggggggatgggtcgacaatgatccaacgtaaactgagggaatgactgtgatctttaacactgagagcctccacatgaaaactatactgatacaccaacaaccatcacgaggtgatacggaggttatgccgggagcggatcccaacaaaacctaagctaagaaatgactttggtgcatgcacgcccctcctgctgaatcttgaagtgatcctgcccgtataaaagctggtccacaagtgtggacaaaacgccaccaacctaaacaagatagaacctatggcgctgaaatgacgcttctatatatatatattactaattttcatatctaattt

SEQ ID NO: 19050 - DNA, 526 bp, Gossypium hirsutum
  unsure (1)..(526): unsure at all n locations
  Clone ID: uC-gsflnu33B059a01b1
cctacgcgttcgagaaagaggggcacgggctatgagtgactgcatagtccctgacagagcccagaggggagatgatcactttcctcggcgttacaaaaacgaaagaagccggtgcccaggggcccatgttgggtttggctcctaatgagacccttgaccttatgcccctaagccatgtcctcgcaactaaccttggaggtcgtcttactgatgttaggaagaatggtacttgcccttggtaaggcctgatggtnaaacccaggttactgttgagtacaacaacgataatggagctatggttccggttcgtgtcacactgtcctcatctccacccagcacgacgagactgttactaacgatgaaattgctgctgacctcaaagagcatgttatcaagcctgtcatccctggaaagcacctcgatgagaagacaatcttccaccttaacccatctgggcggtgtgtcattggtggccctcacggtgatgctggtcttactggacgtaagatcatcattgacacttatg

SEQ ID NO: 19051 - DNA, 409 bp, Gossypium hirsutum
  Clone ID: uC-gsflnu33B060a04b1
ggcacgcgcccggacggaacttgttggaccgacccacgcgtcctgtcgaccgaatgaatgaagctcctgttttttttatagctgacataacgacgagctgtggctgaagcaactgatgcagcaccgagtgcttctgacaatgagcttactgaacctgcacttaatgacataatcagggctggcttgaccagtccagccatttttcaaaggaagaaaaattacactatgaatgcattttgcatcacgatccctattgtgtggggaatgatgctgccggccataatgtggaaaaaccactgtccaccattcatggtgcttaatattggtatcctcaatgagggtaccatgatgacgatatccaaagatagggccaaaccatcacctctaccagatagctggaagctggctg

SEQ ID NO: 19052 - DNA, 464 bp, Gossypium hirsutum
  unsure (1)..(464): unsure at all n locations
  Clone ID: uC-gsflnu33B060a06b1
tttttcgtgtttgtctattgaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatngcctgcaggtctataattatgtctctgtctgtgtcttgtggaaatagaagctttgtttgtggtgaaaataatgtataagccatttggttgggagcaaa

SEQ ID NO: 19053 - DNA, 97 bp, Gossypium hirsutum
  Clone ID: uC-gsflnu33B060a10b1
tctgaggagcggaagaagaaaaaagcgaggcggctgtgcaaaaagcagccggcgggcccgccaccacccacaaaaagacaccgaccgccggaccccc

SEQ ID NO: 19054 - DNA, 418 bp, Gossypium hirsutum
  Clone ID: uC-gsflnu33B060b02b1
gggtaacatcggcatcatcgcacccattgccattggttttatcgtgggtgccaatatcttagccggtggtgccttcgacggtgcgtccatgaaccccgcggtctcattcggtccggccgtggttagttggacgtgggacaaccattgggtctattggcttggtccgttcattggctcagccattgcagccattgtatacgaggttttctttattgccccaagtacatatgaagagcttcctagtgcagatttttaaaatattttggggtcttttcttttaggtccttttgtggttttcaattaaaatgggttgaaatttgggtgggtcgatttggtttttttttttctttttaattattgtttatttggctggagtaccttgagatgcccgaagagaaagaagaagatgagctggcag

SEQ ID NO: 19055 - DNA, 245 bp, Gossypium hirsutum
  Clone ID: uC-gsflnu33B060b04b1
ttcttctgcaaatgaggggaaaaaaaccaccaggtttttttaactggaaacggaggtgataccacagatgacatcatcgttaaataaaggagaagtgattaacaattccaggtgtagttctctatgactctacctgcgatgatatcatagagttgcaatgagcttccctctcttattgtacatgcactagcccttcgtcgaaacctgattccacctttaccaccaccgtcaacggaaaaaccgga

SEQ ID NO: 19056 - DNA, 457 bp, Gossypium hirsutum
  Clone ID: uC-gsflnu33B060b10b1
tcggatgaaaatgagggaaacaaacgctccaagtttcagtaactggcaagggaggtgaaaccgcagatggcgtcatcgaaacataaaggagtagagataacaattccaggactacttctctatgtctctacacgacagtatattcatattgttgctatgatcttccctctcttattctccactcactagccctccctcgacacctgattccatctttaccaccaccgtcaacggaataaccggaaggcaagtgatggaagaaggaagctatcaattaatgatacagatgagcaagaacatatcatgacattaaacaacttcttactacagaggcgcacaaggggtcattatgggttatgatgtaacacgaagggagacattcactaacttttctgaaggctgggccaaggaaattgaactctacttaacacatcaagactgcataaagatgcttgtt

SEQ ID NO: 19057 - DNA, 508 bp, Gossypium hirsutum
  Clone ID: uC-gsflnu33B060c02b1
tttcttttcctctttgaactccaagtctgaattaacattaaaatcatgggtgttttcagttatgaccatgaaactacctccccagtcgccccagctaggcttttcaaggcttttactgttgaagccccaaaggtttggcccgcggctgctcctaatgcagtcaagagtattgaggttgaagctaatcctagttccggaagtatcgtaaaaatcaactttgttgaaggctttccattccaatatatgaagcaccagattggaagacatgatgaaaataatttttcatacagttacagtttaattgaaggtgggcctttgggggataagcttgaaaagattagctatgagaacaagtttgaggcagctgcaggtggaggaagtatttgcaagagctcaatgaaattctacactgttggagataatgttataacggaagatgaaatcaaggctcgaattaaagggagtgagacagtttacaagccccttgaagcttacctcttggcttaat

SEQ ID NO: 19058 - DNA, 257 bp, Gossypium hirsutum
  Clone ID: uC-gsflnu33B060c03b1
gtacttaggcaattcttgcctttgttttaactcgatcgttcatgtactcagttttttgcttcttttctttttttaaattttattttagcttctttgtgcccctgaatgctctctactatctgctctgagcatatatctgcttttattcttcacattgtggaatggaaatgaatgattcggaagtcacaatgggaaattgggaatttactgctcaaaaaaaaaaaaccaaaaatcaaaaaatttatatacaacaacat

SEQ ID NO: 19059 - DNA, 406 bp, Gossypium hirsutum
  Clone ID: uC-gsflnu33B060d01b1
ttatgttataacaaaaccctccaaaaaagactttgtacggaatgtcgcagttgttggagaaggcgaaggacttcgtggtggataaggtggccaacataaagaagctcggaggcttagtgtcctcggactgttgattctgaatacatcgtgacgcgcgtgatgtgcagtcgcagctttatgacctatggaactttgtttaccacctctctatccattcgcttaacatctatgggttgttatactctaagccctggttcaacaccacctgtgtactctttgctgcctctatcgctgcctctactacagctatggtgggagacattctcaattcccagaaggcatcaaccaatttgatggccatgtattttccaccgttttttccattaagggttctggctatagtgcg

SEQ ID NO: 19060 - DNA, 84 bp, Gossypium hirsutum
  unsure (1)..(84): unsure at all n locations
  Clone ID: uC-gsflnu33B060d03b1
tcntttacttaactcggcccaagcaatgcccaaagacttttatgccttttttggctggaccaacacaacccgagattacagaaa

SEQ ID NO: 19061 - DNA, 444 bp, Gossypium hirsutum
  Clone ID: uC-gsflnu33B060d04b1
tatgggttgacattcgttgaagtggaaagatggggtttggggaagcagatgggttacttaccgccgtctcgaggataagaacgagcacgcctagaaagtatatcctggagctaactacgttatccatctaagccgtgattcagtcggggaggccaagaacaaagcagaatccgttccactctatgtgaatgttgatgggaagaaacttattctgggaaccctttcccaccagagttgccctcaattatctatcgattcagaattcgacgaagagtttgagctctcccacaactggaaaaacgggagcgtatatttcctcggttacaaaactttcataccagaggaaggcgatgattttggtatgtctagcgaagaacaaagcgaggaggaagaagaggaggagcttcctgttgctgctgctgctgctgcagtaaatggaaaagc

SEQ ID NO: 19062 - DNA, 206 bp, Gossypium hirsutum
  unsure (1)..(206): unsure at all n locations
  Clone ID: uC-gsflnu33B060d06b1
gtacagcactttgataatgcaactccttcgtggtaatctcaccttatggacttcagatatgcaggacaatgcaaccaacgagatcaaagaagctcccaaacccnaggaagagaaacaagagtgaaatngccaatcttcacggtacgattttacttctctggttatttttgtatggagaagccgcttggctcctgctcacccttgat

SEQ ID NO: 19063 - DNA, 320 bp, Gossypium hirsutum
  Clone ID: uC-gsflnu33B060d07b1
aggaccggccggatttttcgggtcacccacgcgctgcgaaagcagaacccaatccgccggctgctgttttcttgctgacgcatcctttcaattctcaatggacccagtattccacgttgaagtcgcccctactctttccttcgccctccgcgcctccgcctcaagatcccctccgctcccttccttccccatgaccgtcttttctctcgcctcctacttacttatggtggtctccggctttgtctccacctcctcctggagtcccctggcattggttctacccacgatcctgcctctggcccccgccactactgttctct

SEQ ID NO: 19064 - DNA, 391 bp, Gossypium hirsutum
  Clone ID: uC-gsflnu33B060d09b1
tgagatgtgaaccaagagtaaacagaggttgtatggataaaaccagaggagtggacagcgatatgaagcgtataagggaggcaaggatgtaaaaggagggcgtacaccttgttcaccattggagaaggacgaagacatcgcccgatgcatgaagaccggcctcaaggcgcggaaatgatgacaacggatggcaagggggaagtggaccataggtaaccaaacctggggtccagtattaagctaagagtgagagaatgactaatatgaagtgttccagactagagtgtgtttagcaagcgttgtagtttgtggctcgagacattaaaacaatcatacagtcgataccacccactcaaagcacataagaacttttccagacctgatctttaat

SEQ ID NO: 19065 - DNA, 218 bp, Gossypium hirsutum
  Clone ID: uC-gsflnu33B060e03b1
ccggcccggaattacttgctcgacccacccacgctttttctcaacttaaaaacgccaagttttcacattttaaacatattaccgcacatgcaccatgtctggcacgtgcggcaactgagactgacctgaccgtatacaatgcacgaagaagggtaacagaagcaccttgatcgctgggactgacaggagctacatcagcactgatgacatggatgctt

SEQ ID NO: 19066 - DNA, 337 bp, Gossypium hirsutum
  Clone ID: uC-gsflnu33B060f01b1
ttctacaataacaggtgcgttttttttttttgagttagattattggagattattggccttttaatgggtgatatgaaaattgtatcgtggaatattaggggactaggtttagatgttaaagtagccatggtaaatagattagttaaaatacacagggtgaatatatgtttcttacgggaaataaagttagaggaagtgtcaggggatttagttagaagaatttggggtgacaataattttgattttagatttgtagctgttgtaggttgtttgggagggctaattaccatttgggataatcgttttttctggtgaaaaaggattattgtgttaatcg

SEQ ID NO: 19067 - DNA, 142 bp, Gossypium hirsutum
  Clone ID: uC-gsflnu33B060f03b1
ctacgcgtccgcttacgccgaatatctgcttcaacagctatttcgtgcgaagaatatacatttaagggagggggaaacttttaagggagtagtagaaaatcatttggtttttgaagagcccttataagagcaaattgatggg

SEQ ID NO: 19068 - DNA, 489 bp, Gossypium hirsutum
  Clone ID: uC-gsflnu33B060f06b1
ttccttcaaagacccaacttctcatttctccatcttttcggactctctctgtttctctgaaccaagagggaaagaaacccaaacccccgaaaagatgcatcgatcatctagcagttctcgagtgtccgatgagttcttcctcaacgcatccccaccccaatctgtgggttccaagcaaccatcctcggagacggttcccctgaatccgcaagaactgcctatgtacaaccccctctcagccgccgccaagaaagaaaggtctcgactcagatctgccgagaacgccatccacatcatccctctcgttctcgttctttgtgctatcattctttggttcttttccagcccagaatcaagggtttgaagattgattgcaaaagctaaggtctttaatggagctgaatgaggagttttaattccataaaacaaaacatgacagagtgtgcttaacctatgacattatcaaagaagggcatctaacttgtttcg

SEQ ID NO: 19069 - DNA, 213 bp, Gossypium hirsutum
  unsure (1)..(213): unsure at all n locations
  Clone ID: uC-gsflnu33B060f08b1
ttgctatcatcagcagcagacctggaaacctcgagctaatttnttgacatagttaaccgattttggacatggccgggacagctgtatcagctacacaaagtggcagcactgaattgatagaatgaaatcaagtgcaagtgaggatgactcagggccagacattcatgttccagcagatatagatcggcatacgcttgataaaatccaagacct

SEQ ID NO: 19070 - DNA, 102 bp, Gossypium hirsutum
  Clone ID: uC-gsflnu33B060f09b1
tctagtaccaatctccagctcccaagggagagatatgccgatcagaaacatagccggtagacccccccggcaaggcgacaaaccccaagggcacacaaggaa

SEQ ID NO: 19071 - DNA, 414 bp, Gossypium hirsutum
  Clone ID: uC-gsflnu33B060f10b1
tacaatatcgaatttggagatggagttaggctctacttgggcagtgcaagaatcaataattaacggttctcccatttccgacgacctgaaaatccccgaaacaaatgggaaacggaaatacttaatggttgtaggcatcaataccgcttttagtagcagaaaacgaagagattcagtccgtgctacttggatgcctcaaggagaagaaagaaagaagcttgaagaggagaagggaatcgtaatgcgattcgtaatcggccatagtgctacctccgggggtatcctcgatagagctattgaagcagaagaccgaaagcatggggactttctgcggctggagcacgttgagggttatctcgaattatcagccaagacaaagacatacttcgccactgctgttgtttgtgggatgcc

SEQ ID NO: 19072 - DNA, 492 bp, Gossypium hirsutum
  Clone ID: uC-gsflnu33B060g02b1
acggcaccggcccggacttcctttttcgacccacccacccttcctctcacccgcccacgcgtacgaggtcacgttctttttctagaaaaaaggacaagcactagaattgatttaagaggagagcaaaaagaaggtttcttcttatcccgatcaaatgcatcgagcacgcactacatagaatttggatttaataccggtaagtttaacggcagctctctaagcgtattttcaaggggagaaccagggcttgcggtggtcggaggaagaggaccattcatgatggcaaaagggactgcactatttaaccctatccttataaatgccaccaatgtcattatggaatctaactttactgtagctcattactaaggtgtcatttacagactcaattctcttggattgtgaaaaaggttgcatgattcccctccactcggatagaataagtgtttgagattgacattctcatactcaatcatgcaccttattatttta

SEQ ID NO: 19073 - DNA, 234 bp, Gossypium hirsutum
  Clone ID: uC-gsflnu33B060g03b1
ttccttgcgtccgcaagtctcttcagtgaatactttgacactcacacaaaaaaaaaaaaaatggcttctttcaattacatgttcttgagctttggcctggctctgtcatttgcaagctatgatgatggaggtgttgacagacatcatctaggacatgactaagcccccccttcgccgattggctcaactttgaggaggccagaggatcagaggttggctctatcaaaacactat

SEQ ID NO: 19074 - DNA, 407 bp, Gossypium hirsutum
  Clone ID: uC-gsflnu33B060g04b1
agtcctcctcgcgtccgcccacgcgtccgggttaatgaagttagcgcattgcagaaagataacactcagatctccgaaaagatcaacgtcacaactcagcgctacgcgctgatggaatgagccaacaacgtgttgagagctcaagcaatggaaacgaccgagcgattgctggcccagaactcggtgtctatcaacagatgattaagcccgaaaacttcgtgtttggacaatcacgggccggcaacaactgggctaaaggtcattataccgaacgagctgagatgaatgattctgctcttgatggtggaccgataaagaggctgaaaattgagattgcttgcaaggctttcagggatgccattcacttggaggaggtacagggcttaggcatgggaacttttctaata

SEQ ID NO: 19075 - DNA, 215 bp, Gossypium hirsutum
  Clone ID: uC-gsflnu33B060h01b1
tttatttgatgtaaagggtcgtcgttgatttcgggcgtgtattttaggtcacagagggggttagataagcatcaaacattgcaatcgttggggaatatgagtgtggattctactggttctatgcctgctacgatgggaagaaagccatttaatagatttgtgtgatttgatgttcaatttggttatttttttaaaaattgagtgaatgatgatat

SEQ ID NO: 19076 - DNA, 419 bp, Gossypium hirsutum
  Clone ID: uC-gsflnu33B060h06b1
tttttactttcaaaaaacttcccacattcaccatgtttggcacgtgcggcaactgtgactgcgctgaccgcagccaatgcacgaagaagggaaacagcaacaccatgatcgttgagactgagaagagctacatcaacaatgttgagatggatgctccagctgagaacgatggcaagtgcaattgcggtactggctgcagctgcacagactgcacctgtggccactaagccaacatacaatggtcatgcttcagatcatggcatatatagggatctaaataatgaatttaaggttgaataatttgtgtctgttggagtttgtgtggtgacttatatctgtcagttaacctttctctcctttactatgatgtaatggctatgcttatggccttatctggttaatgaagtatccttactatt

SEQ ID NO: 19077 - DNA, 256 bp, Gossypium hirsutum
  unsure (1)..(256): unsure at all n locations
  Clone ID: uC-gsflnu33B060h07b1
tttcttctccccaacgcatttctacagcaagggagtttaatttcagtcgnggtgctcttttccagacactcagcatttgtgtttataggcacaacaccgacgttgtggatgctagtgatgtgataatactatctgggaaaccccaagtagttaaaactgtggacttgcagctgaagccgttactttcaaagaaaaagcatcttgggttcaattgctgcaggagtaaaactgcacgatctggaagaatgggctggcc

SEQ ID NO: 19078 - DNA, 363 bp, Gossypium hirsutum
  Clone ID: uC-gsflnu33B060h12b1
tctattaaatggcggcttctatcggcagtgtttttttctttctaaaccattctggaggtatccccatgtactacatcgcatttcacaagtatgcgaatcaaggattctacaagaatgaatttgaaggattaagtttccccggcaatcaagttgggggacctcccaccattactggtgatgaagtcttgagaagcttttggcaagctgaaatgggatactctaaatggattgaacttgcaatcttgtttggcaatggtggttgtataccgtctcatgttctggggaattattattacagtttaaaagattaagccttttatcaaagattatatggcggccgccccttttttttttttttgttaa

SEQ ID NO: 19079 - DNA, 284 bp, Gossypium hirsutum
  Clone ID: uC-gsflnu33B061a03b1
ggaccggcccgaattcccgggcgctcacgcgtcctggtaacccaatccgataaggaccgaaagcagcttattaaaccaaccaggcctttccaaccaatggggggggcaaaaacgcgcgacctagaccccgccgtcggggcaagggccaggccccgatgagtaggagggggcggaggccgacgcaaaacccggggcgcgagcccgggcggagcggtcataggggcaaaactcgggaggagaaacaaaaatgggaacgagaactacgaaggccgcaccggggaaag

SEQ ID NO: 19080 - DNA, 357 bp, Gossypium hirsutum
  Clone ID: uC-gsflnu33B061a07b1
cttatcgcgtccggccacgcgtgcgatttagggaaattttaaattaattttaatttttttttgcttgcagtccaaggtatttcactatggatcaatatgtttgatcgtggagccatgcagatcagctcatttaaaggcaatggaagtagccaaaggagctggtgcattgctctcatatgatccaaaccttcgcttggcactttggccttcagctgatgaggctaggaaacagattttgtccatttgtgctcaggcagatattgacaaggttagtgatgtcgagctcgagttcctcaccggtagcaacaaaggcgacgaccaaactgacattgaacttttgcgacccaactttacact

SEQ ID NO: 19081 - DNA, 165 bp, Gossypium hirsutum
  Clone ID: uC-gsflnu33B061a12b1
caaccccggtgtattaatccaagtttacgaaggtgaacgaacaagaacaagagataacaacttattaggcaaattcgaactcttcggtattccacctgttggtcttgttttctccttatcccctttttgtttttttattttctcttttctttttttttttctttt

SEQ ID NO: 19082 - DNA, 220 bp, Gossypium hirsutum
  unsure (1)..(220): unsure at all n locations
  Clone ID: uC-gsflnu33B061b04b1
tcgtacggtttaaaacaacattcctttaacctaaaaggctctctccttttctggttttggcggaaagaaaatgaatcccgctgataacactgaccaccctcagcttccaactatcaagatccaccacccatcatcccctcaccaccctacctctgctgctacccccaccccaacatccggtgcccgacgtaagatcggngtagccgtcgacctctccgat

SEQ ID NO: 19083 - DNA, 386 bp, Gossypium hirsutum
  Clone ID: uC-gsflnu33B061b08b1
tgttcgcttggtcccaggggagcacacgtatggaatggagaggtttgggcgctttattatcccgactaaaggggtgcatgatgctaactgagggggtggccggtgggcttaaatgacaagtccatgatttgaaagtctgatctgatatacaatcactgtagtgtaccatacatggctcaccatatgaagaatacgttgacactttcactttcaagctacaggacaattgtgcgagagggcatcctggatggaattgacaggccgttcgtttcacaacgtgattcactgggaaacacgtggcgttaccccacttgttaaaattgccgctcgtaccatttctttcagtacgtgttgcttgatagagcgtatgaatatcactcccttcc

SEQ ID NO: 19084 - DNA, 498 bp, Gossypium hirsutum
  Clone ID: uC-gsflnu33B061c03b1
tcggacgcgtgggttcgaaagtagttcgtttaaaggtcgatttttactgccctgactgctaactgttgtttctcagatttctctccgtttgttctaatccgcgacttgatctccttctccaaatcttcaaaggtattgaaatggcagaatcaaagacattgagaaagcctattttcaccaaggtggaccaacttcgcccggggactagtggtcatactcttacgatcaaggttgtcaatacaaagatggtatttcagaagggtcgtcctgatggtcctcaagttcgtcaaattcggattgctgaaagcttggtcggagacgagacaggaatgattatctttacagcaagaaatgaacaagttgacttcatgaaagaaggtgctaccctaactcttcgaaacgcaaaaattgacatgtttaaggcgtcgatgaggcttgcagtggacaagtggggtcagtgtgaggtcgctgaacccgatcgtccacggtgaaggaaga

SEQ ID NO: 19085 - DNA, 185 bp, Gossypium hirsutum
  Clone ID: uC-gsflnu33B061c11b1
tcctacgcgtccgcccacgcgtccgcaaggctggcccttggatggaggatcagattgactcaacatttgctgaagaactacttaagaaataatgcattttaccaggtctttcacatgtcaagcaaaaatattgatgcggatcaaagaataactcatgatcttgaaaagttaactactgacttatc

SEQ ID NO: 19086 - DNA, 467 bp, Gossypium hirsutum
  Clone ID: uC-gsflnu33B061d02b1
gtaccctttacattttccctttatttcctttgccgcccctagggttttattacattccccacatggcttctgcagatgtcgagtaccagtgcttcgtcggaggtctcgcatggaccatcaacgaccgtgctctcgaagaagccttcagtgcttacggcgagatcgtcgattcgaagatcattaacgatcgtgagactggaagatccagaggctttggcttcgttactttccgtgatgagaaatctatgaaagatgctattgaaggaatgaacggtcggagtctcgatggaaggaatataaccgtcaacgaagcacaatctcgccgaagcggcggcggcggtggtggtggaggatttggaggaaacggtgggtacaaccgtggaggcggtggatatgggtggtcgccgtgaaggtggataggaggggtgggttaccgaggtggtcgccgcgatcgtggtggatacggt

SEQ ID NO: 19087 - DNA, 510 bp, Gossypium hirsutum
  unsure (1)..(510): unsure at all n locations
  Clone ID: uC-gsflnu33B061d05b1
gcccttgactatgaacaggagctagagacctcaaaaacaagctcatcagtagagaagagctatgagttacctgatggtcaggttattaccattggtgctgaacgtttcagatgccccgaagtgcttttccaaccatccttgattggtatggaagctgcaggcatccatgagactacatacaattcaataatgaagtgcgatgtggatatcaggaaggacttgtatggtaacattgtccttagtggtggtacaaccatgttcccgggtattgccgacagaatgagcaaggagctttcggcactcgctccgagcagcatgaagatcaaggttgtcgctccacctgagcgaaagtacagtgtctggatcggaggctcgatcttggcttccctcagcaccttccaacaaatgtggattgcaaaggccgagtatgatgaatcaggtccagcgatcgtccacaggaaatgcttctaaatgttattggtatggngataggatgaaagagagaagtac

SEQ ID NO: 19088 - DNA, 508 bp, Gossypium hirsutum
  Clone ID: uC-gsflnu33B061d09b1
tgaacgtttctcgtgggccgatgtctccgtggcattctccctcttgcctgccttccaacatgctctcggcgagggtgagcgcacgaagttcacccatgtcacacgctggttcaacactgttgtgcaccaagagaacgtcaaggcagtcgtaggagaagtccaacttccggcaaaggcttcaactttcgacgccgcaaagttcaagcaactttccgctaaggctcaagcccagaagaagcatgatcaaccgaagaaagagcagaaacaaccggagccaaagaaggaaaagcctaagaaaaaggaagaggaagatgaggcggatgagcccgcggttcaagagccaaaattcgttgatccgtttgcgtcgatgccggctggaacgttgaacatggacaactggaagcgtgtttactcgaatgaggatactgcgaccaaggctattccgtggttctgggagaatttcgatcccgaaaactattcgatatggtacggggaatataagtaccca

SEQ ID NO: 19089 - DNA, 513 bp, Gossypium hirsutum
  Clone ID: uC-gsflnu33B061e05b1
tcccacgcgtccgcccacgcgtccgaatccaccttatcgtacggtgaaaaggagagaatatctgcgaaatggaatccactactgtaacgaatccattgccgaactcgaattccgaccgtgtcagaaggaagaagaaaaagaaaacatcagcagcggcggcaacggcgacgttgaagacgaatcagcagcggcagaaccaaaaccagagcaacaatcacaccagatggaaatccgaggcgcagcaacaaatctactcttcgaagctgattcaagctttgagtcaagtcaatctcaacggtaaccattcttctccttcggctccgcgtcgtggacgagccgttcgtgaagctgctgatagagctttggctgtagcggctaaagggaggacgaggtggagccgtgctattttgacgagccgtgttaagctgaagtttaggaaggagaagggacagagaagtggatctatttctgctgcgacggtgactggcgttatcggtagaaaccggtcgagga

SEQ ID NO: 19090 - DNA, 452 bp, Gossypium hirsutum
  Clone ID: uC-gsflnu33B061f03b1
cccacgcgtccgcccacgcgtccgcatcaaattattactctgatagctccgcagtagttctaagcaatgtgggttcctcttcatcttcttcaacagttttggagtcagctccagttgcaggtggagaactgggttactggaatccctcattttcatcatcatggtctgatctcccaacaactaatggtgcatatccgtaaagaacccttttccccccctttcattttatctcagcttttaattaatatgctagtggtcgttgcagtgcattctggtatatggatatatatatatatgtggctgtagggtagctgcggtttgttttataacgtacgcttgccaattcagtgttgtctatgtctgcgaacagagatttgaggttgtgcctaattaacttattagaatgtatcaaggttgaagatgaagtatcataggttggacaaatgttagtt

SEQ ID NO: 19091 - DNA, 511 bp, Gossypium hirsutum
  Clone ID: uC-gsflnu33B061g05b1
tttcgcaagcaactgccaacacccaatccccttgtttctctccgctaaatgctaatggcagcagcaaccttcaactctctcaccctccccttctcaaaaccagaattcccattctcctccattgcaagaacccatattcccaccgccactctcaacctttctcggttcaggcctactggcttccttctatgctccctttcaagtgatcaccccacaaccgccgcgggtggtcaacttcaccataagaccaacaccaatagcaccgacccccagcctcaaattcatacttgtacatggaactggaagggctattctattcgctatcagtgttctgggagtagcggtcctgccttggttttagtacatggttctggagcaaacagtaatcattggaggaaaaatattcctgttctagcaaaatcacatagggtatacgcaattgatcttattggctatggatattcggacataccgaatcctcgtgaagttggggactcattctatacattcg

SEQ ID NO: 19092 - DNA, 279 bp, Gossypium hirsutum
  Clone ID: uC-gsflnu33B061g06b1
tgaaaaaaaaaaaaaaaaaaaaaaaaaaggggaaaataaaaaaaaaaaagggtaaaaaaaaaaaaaaaaaaaaaaaaaaaagggagaaaaaaaaaaaagaaaaaaagaaaaaaggcaaaaaaaatgcaaagaaatagagaaaaaaaaaagaaaaaagggggggttcttttgggggtggcggtacgccggtcctgggtgggataacgatggcgtttctgattggggtctccttttataacatcctcctctcgctggcacacggtttaggggttaggcccc

SEQ ID NO: 19093 - DNA, 472 bp, Gossypium hirsutum
  Clone ID: uC-gsflnu33B061g08b1
tatttcatatgcctcactttagcaacaaaaggcacgaagagactacaccaacaaatggaggcacttgaggatgcgactatttttggctatgatggtggaggagatggccccgtcggctgtccaatatgttgcgggagatgatgcaccgtgccctactgctacactaagatgctaccgcattcgtgccgactgcgtgagctaccgttgacgctcttgcggaaggtctcctgtttgaaaaaggatgaaatgaattggttgttgataataacaatcgtgagatgtatagaacgaaggccaggaacaatggttactcgaatcattgccatgcggacgtgccagagggcaacaccatggatgaaacttgatacattgaggaagcggtgatgcgatgtaatctcaagtcattagccgatgtttcatagaggatggctgtgctggaccacacacaacctatcaacgggtactaattgat

SEQ ID NO: 19094 - DNA, 504 bp, Gossypium hirsutum
  Clone ID: uC-gsflnu33B061h10b1
tctctctgctagggttatgaaccctaaccttggcgccgtcagcccgtcgatcgagaggaaaaaaggctctcctctcctccttttgggtctgacttcagcaacggagagagtctccggcgacacaatcacagggattccaggtgtcagaggcacgtggaggcaagccaagcggtggtggcgcgcgtggtggccttgctggcgaggagcgacggctgaaggcttggcggctaggtttttttgtctgccgaaaattttgaagatagtgggctgggatccgggctagggtgtataaaatatgggtagggtctaggacaaaccatgctcatggcctttgtttctagcacggatgctgcttgcataccttgtaatggctgcattgcctgcactttttaggttttaaacacttggtaatcccccactttcaacacccatggcggccatgcagctcattgcaagcatgaaccaaataccacttgctgtcgcctctcgagcatatttaacatg

SEQ ID NO: 19095 - DNA, 517 bp, Gossypium hirsutum
  Clone ID: uC-gsflnu33B061h11b1
tcccacgcgtccgaattttttgtctagttttgctcttcatttcggtagcaaaaggcctgaatcccaaatgtgacatccaagaccatggctcaaccctccaagtgttccacatttacagtcaatgctcacccctcaaaccctcaaagccactctcatgggaagaggatatgttgtcaatgctagccaaggaccaggccaggctgcaatatttgtccagcctggtggctgggaaatctgtggtgccagtagcttcaggcaggcagattgtgcaaagtccaacctatattgtgaggattaaaataggaaccccaccacaaaccatgctcatggccatggatactagcaatgatgctgcttggataccttgtaatggctgcattggctgctcttctaaggtttttaacactgctaaatccaccactttcaacacccttggctgccatgcagctcaatgcatgcaggtaccaaatcccacttgcggtcgcagcgcgtgcatattcaacatgacgtacggcag

SEQ ID NO: 19096 - DNA, 445 bp, Gossypium hirsutum
  unsure (1)..(445): unsure at all n locations
  Clone ID: uC-gsflnu33B062a02b1
cccacgcgtccgcccacgcgtccgtaaaagctactttgaatttgataaaagaagacaaagtggtttttaaaatggctttactcatagcagtactgaccttagttttgcttgtgtctgcgtcgacttcaccagccattgctcttagcttgaatcattatgaaaaaacctgtcctgatgttgagtcgatagttgcaaaagctgtcgagcgtgccaccatgaaggataagacggtccctgcagcccttcttcgaatgcattttcatgattgttttataaggggttgtgatgcttctgtgctgttgtactcaaagggaaacaataaagctgaaaaagatgggcctgcaaatctttctttgcatggattttatgttatagaaaatgcaaagaaagaagtcgaagcanncgtgccgggntgtagtcttcgtgtgctgatattttggctttt

SEQ ID NO: 19097 - DNA, 414 bp, Gossypium hirsutum
  unsure (1)..(414): unsure at all n locations
  Clone ID: uC-gsflnu33B062a06b1
ccggaattacccacgcgttcttctcgttttgaaaaagttgcaggttacggagggttgattacctgcaccctggtctcaaaacgggaaagatgactccccatgaacagcgcctcgtccttgaacttactgccaagcggggacacacgtactactgaattgctctttcatggcggacagcaactgacaacgagattaagaactattggagaacccatatgagatatacggctcctgaagagagacaggccatccccatctgaccatcttgatgatctagccattgtcattcatcatcatcaactgttactgcagtcgattccttgccctcctctggtactggaaatattgtaagctntttatgacactggnggccttgacatggcaggaaagaaaaacagtccatagtttgaaaat

SEQ ID NO: 19098 - DNA, 505 bp, Gossypium hirsutum
  Clone ID: uC-gsflnu33B062a07b1
cggtccgcaattccggaattgcccgatgcacctacgcgttcgaccacgcgtccgcccacgcggccgtggagagctacggttgatattactgccaaatattctgcatatctaccggtccaagaggccatacattcacataatctaacatgtataagaagttggtatagttcctgggttaagggaggaatttatgattatcggtgaaaacgaggctgatgatagcttaattttgagcttaaggtccatccaatatgaacttgcctgggaaagatgcacgcaacttcaagctgaggatgctgtctcgaaaggcaaggatgaggggtgcaaacaacggcggagctagtggcattggaggagggccttcgagggtatgttcctttctcacagatatcatcgatagccactgcagaagagctttaaaatgaagagctccctttgaaggttgtataagttgacgaggaacagtctcagctagtcttcagtaacccgaaagccatggctgata

SEQ ID NO: 19099 - DNA, 355 bp, Gossypium hirsutum
  unsure (1)..(355): unsure at all n locations
  Clone ID: uC-gsflnu33B062a10b1
cgaaggttgacctcagcaaacttgagatggctgctttgtggagatattggcgacacttcaatcttgtggatgccattcccaatccatcaaaagagcaactagtcgatgttgtccaaaggcattttgtgtcacagcaaatggatgagcttcaggtcattgtgggatttgttcaggctgcaaagagattgaagaccgtctgcaaatgaccccgataagaatgttcagacgggttttgagttgggttgtcaatgctaacagaaacttggtatcctaatgtgcttgtcccctagtagctatatctgnaatatatatatatatgtagtgtatgtacttgtggcttggttatctttgcact

SEQ ID NO: 19100 - DNA, 233 bp, Gossypium hirsutum
  Clone ID: uC-gsflnu33B062a12b1
cggaatgacccaggtcgacccactcgatgcaccagagagacagtgcagccatttgaatagcaccgcacgtggtgtaatgggcggttcgactgacactgatcacgcaaataccgtggatcttatgacaaacgtgctcggtcctacttactactgcataaggtttccatggaagaacatgctactgtgaatggtacaatggaagctagggaagacggcgaaatggatccgggacc

SEQ ID NO: 19101 - DNA, 431 bp, Gossypium hirsutum
  Clone ID: uC-gsflnu33B062b04b1
cttcttcattctcattctctctccactgaactcttgctaaacggtatcgttttagtcagtctttcatcaatggcgaaagaaccagttcgcgtcctcgttactggagctgcaggacaaatcgggtatgctcttgtacccatgattgctaggggagtcatgttgggtgctgaccagcccgtgatccttcacatgcttgatatcccacctgctgcggaggctttgaatggtgtcaaaatggagttggtggatgctgcatttcctcttctaaagggtgttgttgctacaactgatgctgttgaggcatgcactggagtcaatgttgctgtcatggttggtggtttcccaaggaaggaaggaatggagaggaaagatgttatgtcaaagaatgtgtctatttacaagtctcaggcttctgccttggaacagcatgc

SEQ ID NO: 19102 - DNA, 378 bp, Gossypium hirsutum
  Clone ID: uC-gsflnu33B062b11b1
gtggtctgtctctctctgtctgacattacgagaaggggtttttatttcaagaattcatgatgcaaaaaggggggcctctgccaaaagttgtccaatgggctgacacagagccggcatctgctgggatattactgggatccttaacaaggactggactgggctgcaaacatgagggaaacctgaagcaccatcaggaggtgctccttatgttaaggctggagcggattcgggccgaacccatgctgactaatggctgtgctgcatgcacgccccgactgcggattcttgaagtgatcctgcctcggtaagagctgagccacacgtctgtgcaaaaccccaccaacctgcacaagatacacactatggggcttgataaac

SEQ ID NO: 19103 - DNA, 173 bp, Gossypium hirsutum
  Clone ID: uC-gsflnu33B062b12b1
ttgcgaagttatccgtcaggatagctggatcccttagctagttctatcgggcaaagccaatgattagaggcatcgggggcgcaacgccctccacctattctcaaactttatataggtaggacggttcatccaatttcaagcttcattagacccgggtttcttcttcctttttt

SEQ ID NO: 19104 - DNA, 397 bp, Gossypium hirsutum
  Clone ID: uC-gsflnu33B062c03b1
ctccttccatcttcttgaaaatattacatgaccatccataacgtcgctcttattgaaacccttaccgtcctgggagctgaagaacgccggtgctcttgcaagattttctgtactcgagatcacgctggcgatgacatcgctcgtgactacgccgatagattggtttggaacggggagaccctgcaggaatactggaggtgcactgagagagctcttgagtggggcactactggtggacctgatctgatcgtcgatgatggtggagatgctactttgctgatccacgaaggtgttaaagctgaggaagtttatgagaaaactggtcaactcccagatccggcttcgactgataacgctgagtttcagattgttttaaccattatcagagatgggttga

SEQ ID NO: 19105 - DNA, 489 bp, Gossypium hirsutum
  Clone ID: uC-gsflnu33B062c04b1
tttcccacgcgttcgggatgttgtctccgaggctgatatatttgtcaccaccactggtaacacggacattattatggttaaccacatgaggaagatgaagaacaatgccattgtttgcaacatcgggcacttggacattgaaaatgacatgttgggtctcgagaattatcctggggtcaagcgcattaccatcaagccttaaaccgataggagggtcttccctgaaaccaacaccggcatcattgtgttggctgaaggacgtgttatgaacttgggttgtgctactggccaccctagctttgtcatgtcatgctctttcaccaaccaggtgatcgcccagatcgagctgtggaaggagaaagccaccggcgagtaccagaagaaggagctcgtttagcctaagcacctggatgagaaggtggctgctcttcaccttggaaagcttgaggctaacctcaccaagctcaccaaggatcacgctgactacat

SEQ ID NO: 19106 - DNA, 294 bp, Gossypium hirsutum
  Clone ID: uC-gsflnu33B062c05b1
caaatataagctagaagttttcatcgagtctcctacatcccactgcggtttttccaacgataagttgggtaaagttcagtatcgagtaatgttcctgccatgaaagaaggtaatcatttcaagcttttcgaattcaagctatagatgatctgattgcttctgttctaacttctcgcagtttttaattttgctcccttatggccttgtagagttatttttgttacaatttgttgcacgcttcttgaattgaattattgagaggatgttttcaaaaagggaatgttaaaaaaccaa

SEQ ID NO: 19107 - DNA, 447 bp, Gossypium hirsutum
  Clone ID: uC-gsflnu33B062c12b1
tcgggacatttatatgaacgcttccttaaaattatgattctaagtgtactaaagaatacccaccgtccagtgaaattctggtttataaagaactacttgtctcctcagttcaaggttgcatatatctttttggcattcgttccatcttagtatagcacttctgtttcacttgttagtgcataatgatttaaaaagcatgtctaatgcacatatgctttcgggttatgcaggatgtgattccgcatatggctcaggaatatggctttgattatgaactagttacctacaaatggcctacatggttgcataagcaaacagaaaagcagagaattatctgggcatataagattttgttcctcgatgttatatttcccatttcattggaaaaggttatatttgttgatgctgatcaagttgtgagggcagattgggagatctctatgacat

SEQ ID NO: 19108 - DNA, 529 bp, Gossypium hirsutum
  Clone ID: uC-gsflnu33B062d03b1
agctggtacgcgtgcgggtgccggtccgacttcccggaatgaccccacgcgacccacaacggctccctcgcgggccaggactctgtccatgcttcactcagattgatgatggcgaggatattaggattggattggccgctgaagttaaggccacgacgattcacgaagcaagcggggttttgctggcccaactgcaaaaattgaaatcagaacaaaaggagttgaagagaaaattgaaagaggaacgagccaagctcaaagccacttttgggaaatcagaatcatcatcttcctctgaatcaagtgacagcgaatgtgggaggtagttgacatgaaagccctgagaaacaatgctttgaaaccttccctagagtcagaaacaccaattggcaatgctttggaacgacccgaagagatagttatagaagctccaacggtggcagaggaagcaacattagctaactcgctcatggaactagaaaactcagattcaagcccccaaattcggatacgagttcctcttactgga

SEQ ID NO: 19109 - DNA, 381 bp, Gossypium hirsutum
  Clone ID: uC-gsflnu33B062d12b1
cccacgcgtccgtactactatggggataatccctggaaatcgagttagaacactcagtttcttggttgcaaccattatattgtttttattttgatatgcaatttctttttatagctataaatgttgaacaaaagcatcataccaaaaaaaaaaaaaaaaaaaaaaataaagtaaaaaaaaaaaaaaaaaaaaaaaaaaaaaaaaaaaaaaaaaaaaaaaaaaaaaaaaaaaaaaaaaaaaaaaaaagaaaaaaaaagaaagaaatgattataagttaaaaacctaacaaaaagaccaaaaaggatgcataaatgggggggggggccttttaggaatcccaatttttaacacccggctggcacaagaaatattttttttttg

SEQ ID NO: 19110 - DNA, 464 bp, Gossypium hirsutum
  unsure (1)..(464): unsure at all n locations
  Clone ID: uC-gsflnu33B062e05b1
tcgtggcgacttccgtaagctcctcctacctctagtgagttcatacagatatgagggagaggaggtgaacatgaatctggcgaaaacagaggcgaagttgcttcatgagaaaatttcagacaaagcttacagtgatgacgatgtcataagggttttggctacaagaagcaaggcacagatcaatgcaactctgaatcactacaaaaatgaatatggaaatgacataaacaaggacttgaaggctgatcctaaggatgagttccttgcactactaaggtccacagtgaagtgcttggtctatccggaaaagtattttgagaaggttcttcgnctagcaatcaatagacgaggaacggatgaaggagctcttactagagttgtttgcactcggctgaggttgatctaaagatcatagcagatgagtaccagcgaaggaacagtgtcccactgactcgtgcctttgt

SEQ ID NO: 19111 - DNA, 292 bp, Gossypium hirsutum
  Clone ID: uC-gsflnu33B062e06b1
tcgtccacgcgtccgcccacgcgtccggcagtttgagggacttgctttgatgacgtggattcaggtgtgactggtaaaaaacggggttgttatgatttatggatcgaaaagaggcaaaaatttacgtgtagcttgtaatcaccgacgaaataagtccaacttttttaatttgaggaactttctaaagtgcctttcaacctcatgtttagtatgagaatatgagtgttacttatattttgattttcatggttaaaatccattgttctttttatttgctcaaaaaaaaggaaaa

SEQ ID NO: 19112 - DNA, 502 bp, Gossypium hirsutum
  Clone ID: uC-gsflnu33B062e11b1
cccacgcgtccggaaggatagagttacagatgcactgaatgcaacaaaagcagctgtagaagagggtattgtgccaggtggtggtgtcgctctgttgtatgcattgaaagagttggacaagctacctacagctaactttgaccagaagattggtgttcaaataatccagaatgctctaaagacacctgtgcacacaattgcttcaaatgcaggagttgagggagctgttattgttggtaagctgttggagcaggataaccctgatcttggctatgatgcagccaaaggtgaatatgtcgatatggtaaaggctggtattattgatccattgaaagtaattagaaccgctttggtcgatgctgaagcgtgtcgtcgttgatgacaactaccgaagctgttgtaatcgaacttccaaaggatgagaaggatgttccggcaatgcctggcggtatgggtggcatgggatattaaggttattccccctaacaatacactgatttta

SEQ ID NO: 19113 - DNA, 314 bp, Gossypium hirsutum
  Clone ID: uC-gsflnu33B062e12b1
tcgaaaaaaccgaaaaaacaaaagagctatatatatatgagaatacaataaaagtgaaaaatgttgagagtggcaacgaggcggctcacttcttattcgtctgcgtggaggtcgcaccaggccaccttcgctatcgcctctcgtcctttcatcgacggcgccgattcttctgattgtctcagatccaattcctcctcctcctcctcttccttttccttctctttcgcttctcaattccttcttcccaccagagggtttgcttctgagtcactcaccccaaaaagtgaccacagtgggatttctgatgttccagc

SEQ ID NO: 19114 - DNA, 487 bp, Gossypium hirsutum
  unsure (1)..(487): unsure at all n locations
  Clone ID: uC-gsflnu33B062f05b1
tcgcccacgcgtccgattctctccaaccctgaattccttgccgagggaactgcgattcaggaccttttcaatccggaccgtgttcttattggaggcagggaaacaccagaaggtcaaaaggcaatcgcagcattgagagatgtgtatgcgcattgggtccctgtggaccggatcatatgctccaacctctggtctgccgagctatcaaaacttgctgccaatgccttcttggcgcagagaatctcttcggttaatgctatgtccgcattgtgtgaggccaccggtgctgatgtgagccaagtggctcatgctgttgggaaagacacaagaattggacccaagttcttgatgcgagtgtggntttcggtggagtcgtgtttccaaaaggatattttgaacctggtctacatctgtgagtgcaatggcccccagaggttgcanactactgganacaagtcattaagattaatgactaccagaaaactcg

SEQ ID NO: 19115 - DNA, 163 bp, Gossypium hirsutum
  Clone ID: uC-gsflnu33B062g08b1
tttagcatgcgtcgtgtcacgcgtactattgtagcctgaagagctggtctacgccttgaagatcactaagtggaaagaggggttgattagtactatctgtgatggatgctactaggcatctgaactgactaccctaggaacaggatcttttatcgtatttgtg

SEQ ID NO: 19116 - DNA, 430 bp, Gossypium hirsutum
  Clone ID: uC-gsflnu33B062g09b1
acgctcgcagtttgcacgctctcatcattatgctccgggaccgtcagtcttcccaaacaccttctttccgagaaaaaaaaagctcaagagagaagaccatggccgatcaactgacgggcgagcagatctctgagttcaaggaggcttttagcctgtttgacagggatggcgatggttgcattactaccaaggagctggggactgtgatgcggacacttggtcagaaccctactgaggcagaactccaagatatgatcaatgaagttgatgctgatggaaatgggaccattgattttcctgaattccttaacctaatggcaaggaagatgaaggatactgattccgaggaagaacttaaagaggctttcagggtgtttgacaaggaccagaaaggtttcatatctgctgctgagctttggcatgtcatgac

SEQ ID NO: 19117 - DNA, 399 bp, Gossypium hirsutum
  Clone ID: uC-gsflnu33B062g10b1
tacgcgcttggaaattaagtgggagaaatggggtttatcatgcacgtgatttgatcactatggtgatactgaatgctacaacgtgtatggggaattgcaaaacaaggagctgtataacaatacttttgctgatggagaaaagcgatccaagttcttgaggtggaggattcaggtcttggaaaaaagcatcagaaagcttgatttgagtgctaatggtatctctaccatagatgaggctaacgatctcaagaactcttccggacctggaaaaagggagctcacgcaagctaccaaccaagcccttcacttgcttcaggacaattatccacagtttgtggccaaacaaggtgtttatcaatgttccatgcgtgggacttggcttttaatatgatgattagg

SEQ ID NO: 19118 - DNA, 320 bp, Gossypium hirsutum
  Clone ID: uC-gsflnu33B062g12b1
ttcccacgctgacgcatcggaacctggttactatatatatatctatgattatctgtcgctcggataggaggacagacggctctgatgaccgcactttctgagttcttagtcatacatctaggaggcgaaaagactcaagttctgccgctaaatatcaagctggactctttgagtggagactccgattcttaaagctcctgtagctgtatagctgccttcacccatactgcctgatcatgcaaggccagttcagcccttttaaacagtgagtacaaggtacttcggttacatcggagaagatccaggacgaggtaacatga

SEQ ID NO: 19119 - DNA, 249 bp, Gossypium hirsutum
  Clone ID: uC-gsflnu33B062h02b1
gggtttttgattgtctgaaccgcgactaccaatggctttcgcaattcacagttcaagaacacaatgaaagcaatgcagccacagtgttgcagccctgatgaagtgatatttggtcctgatttccaccaatccttgtactggcatctcttgtgtgggctgatttttcgcaaagaaattcagatcatttcatccacctctttccatagcaatggtcatgctttttgaacctttgagcaagtttgggaagag

SEQ ID NO: 19120 - DNA, 385 bp, Gossypium hirsutum
  Clone ID: uC-gsflnu33B063a02b1
tttttaattgtatatttgctccgttagtttttagaaatggcagagctttgctcctttaatggcattatgatcatgtttgttgccgttatgctctcactcaccaccactgcgtcagctcaagacagtgcaatggcgcctgcgccgtcaatggataccggagctgctttctcgccgatggtttccggtgttgcagatatgttccctcttattatttcccttgttgcgcttttgaagcactgagttacgtgcatttgagtgattgagtattgtatttcatttatagcatattgaacttattatattggattatatcttctatttgcaattaattggtaacgtatgatatgaattcagtttgttcaatcaaagaacaagtttttggaat

SEQ ID NO: 19121 - DNA, 323 bp, Gossypium hirsutum
  Clone ID: uC-gsflnu33B063a05b1
tcctttcgtccgcaaaaagtaagctgaatacaccgttccgtatgcaatcgtgcatgtaaacttacctttaattttgtgtttaatgcttataataattgattttgagtatgctgttgatgtagttgtaagttggtttctaggtttacatattagtgattgcatgtatatgatttggaatctttatagatgttgtgtttcatttaataaaactggcagtgaatgaataagagttgcctgtactttcgacggtagccatttcataggatactattatcacatagtggctggttcacgttaggcattctgagttcgtagttgagttt

SEQ ID NO: 19122 - DNA, 515 bp, Gossypium hirsutum
  Clone ID: uC-gsflnu33B063a08b1
ttccgattgaaccgataataacaccgttgcgccaagcgcccaaatttaccacagaattggcacaggatctgagagttaaaaccccttccattgccaccagtaaatgagtgaccaccacgcgcgggttccaccgctatcggcgtcggagcagcctccatcagatttgcatgaaacggcacgtcctgcgccacacgagtctgtcgaatcttatattccaatagaacatccacaagtcgttgcatgggaagtagctcgaacgagaacgaggctagagtgagaacaacgtcgtgctccgatggcaggcccacaagaacaattttcaccttctcagcctccgagattcgagatctagatgcttcgatcaaggcacaagtattttgaatcttagccacatattctttcattatcatattaccttttttaatcgaatgcaaatcatgtttaatgcgagataactttgctccggttacagcggcgaacaatcggtttgctgtactctatacatcacatgatga

SEQ ID NO: 19123 - DNA, 514 bp, Gossypium hirsutum
  unsure (1)..(514): unsure at all n locations
  Clone ID: uC-gsflnu33B063a10b1
taaaaaaaaagaccaactaaactcaccaataaaaatggtggccagcaagaaaacgaagaagacccatgagagcatcaacaacaggttggctctcgttatgaagagtgggaaatacactcttggttataaaacagtgcttaagtccctcaggagctccaaagggaaactgattatcatttcgaacaattgtccaccgctgaggaaatctgagattgagtactatgcaatgctctgtaaagtcggagttcaccattacaatggaaacaataatgatctaggaactgcttgtgggaaatacttccgtgtatcctgcttgagtattgtcgaccctggtgattctgacatcatcaagtctctaccaggtgaccactaagtcaatgaaggtctggttctctatcacagcagaatgatgatgtttctttacttcctcacgatattattttcctttgccctcaaacccttntgttaagaataattggtatttttctaatggtaaagtgggatgttcttggta

SEQ ID NO: 19124 - DNA, 318 bp, Gossypium hirsutum
  Clone ID: uC-gsflnu33B063a11b1
tctcacgcgtccgcccacgcgtccgcacttatgtttaccagaaggctggtggggattgagtgggataagatagatttttacttgtattcaagtaatcgtattgtcatgttctgatctttgtttgtttttagtatgttataatttttgggtttctattttagaatttagggctctcaatgaaatgcttgaattcaaccttattaaagtttgttctagactcactatccaatttctctttaaagttttatttcactattccaatataatcattttactatctactaacttctttccttaaactcttctctttcttctgct

SEQ ID NO: 19125 - DNA, 537 bp, Gossypium hirsutum
  unsure (1)..(537): unsure at all n locations
  Clone ID: uC-gsflnu33B063b03b1
tcttagataaagggtaatttgcccctgatattatttactacaccactttaatcaatcaaggtatagctaaagatgcattgaacttgttcaagtagataatggagaatagttacaagcctttgatattgtttcttactgtgtctttgttaggggcttagctagaactgctcttacagaagaggtgatcaatctttggactatgtagagacgcatggtttgaagtgtaacactatcatgcacaacatggacattaaaggtttatgtaaaagtgggagggtgaaaaaagctaagccctcttaccatgaattttgaggattaattggtacacccttaaatccgacttgaaaattcaatcaaattcgaagggttccnttnnaaaaaaaaaaatattttattatacttattttttataagggattactttttgttttttgtataatttttgtggtgttggggtgttggcttgggtttccttccttgtttcctcgccttggtgttttttttatttttttatacctattcgggtcatttcaccct

SEQ ID NO: 19126 - DNA, 494 bp, Gossypium hirsutum
  Clone ID: uC-gsflnu33B063b05b1
ttcaatctcttctttttggagtttcatcacaccagatattacaatgggttcaatcggtgaaactcaaatgacacccacccaagtctcagatgatgaagccaacttattcgctatgcaacttgccagtgcatcagtcctccccatggtcctcaaatcagccattgaacttgacttgctcgagatcatggctaaagctggtccaggtgctttcttgtccccaaaagaagtggcttccaagctccccaccaccaaccctgatgcacccgtcatgctggaccgtatcttgcgtctcctggctagctacaacgtcctcacttgctccttgcgtaccttccctggtggcaaagtggaaagactctatggccttggccctgtctgcaaattcttgaccaagaacgaagatggtgtcactctttcgcccttagtctcatgaatcaagacatggtccttatggagagctggtactactagaaagatgctgtgctggatggtgg

SEQ ID NO: 19127 - DNA, 501 bp, Gossypium hirsutum
  Clone ID: uC-gsflnu33B063b11b1
tttcttaaagaacggcatcactagccctcttctttgcactcaacatcctcttcttttccctggtgagtgcttgtggttcctgcccttcccccaaccccaaacctaaacctaaaccaaagccaaaccccactccctccccatcttcttctggcaagtgccctagagatgctcttaaactcggtgtatgtgctgatttgctcggtggcttgctcaacgtcaccattggtacgcctcctgttcaaccctgctgctctctcatccaaggtcttgctgatcttgaagctgccgtttgcctttgcacggcaatcaaagctaatattttgggcatcaaccttaatgtcccactttccctcagcttgcttcttaatgtctgctcaaagaaagtaccctctggcttccaatgtcgctaaatcagttctctaaattctttctcttcttagagctgcgtggctttgatgttcttaaggcctagtttgcagtgatcaatgttttcttggtaac

SEQ ID NO: 19128 - DNA, 429 bp, Gossypium hirsutum
  Clone ID: uC-gsflnu33B063c04b1
tcctttcaagcctcctaaggtcgcgtttaggaccaaggtcttccatcccaacatcaacagcaatggaagcatttgtcttgatgtcctcaaagaacaatggagccctgcactaaccatttccaaggttctgctctcaatctgctcgttgctgaccgatccaaaccctgatgaccctcttgttccggagattgctcacatgtataagactgatcgggcaaagtatgaagccactgctcgtagctggacccagaagtatgccatgggatgacagttgttggcgtgtaatatgtatcagctttcttatgttgccaactgtgtcgaaccattttatgttttcttttggggaagggaggggtggttttttttttaaaggaacttgtcattgtgctttggatatgggaagatatggacattctttttatttattcc

SEQ ID NO: 19129 - DNA, 502 bp, Gossypium hirsutum
  Clone ID: uC-gsflnu33B063c08b1
tcgtcccccttggggaatgcatagagatgagacgttcatcgttggcaaggcctgagctttcttaccaccgtttgcgctccattggcggccgaaattgtcaccgaaaacacgtggaagacgggtgattcagtttgaagggtttcagttgtaaatatacatatatttctcacttctattgtaaacagacagtgattcagatcaaagggtatccgtttcttttcttatttgtcgttgtaatttctcgagctcttacggttcaaaaatggcggacaaagctaaaaccgaaaacccatcttttcttcatggaaaatactagcttggtcgaatgttgcgtcatggaacgttcgcccaagtctaccatgcgaagaaccttgaaacagggaagaatgtcgccatgaaagtggtgggcaaagagaaagtgatccaggtcgggatgatggagcagatcaagcgagaagatcttcgccatgaaaatggtgaaacaccggaacattttctagct

SEQ ID NO: 19130 - DNA, 287 bp, Gossypium hirsutum
  Clone ID: uC-gsflnu33B063c09b1
tcttcaatatttgtgaagctcactgccttaaacatgagctaaaatgtcttatgtctataagaaagtattaatttgcttagggtcataggtgtaaagtgcgccttgttcattctcagagatctggcctgaatttgggtctaaattggaggccttgttttaattttaactgtatggacctcgattttcgtggctaagaatagatcttgcaagttgaaggcctcatcgggtcaacaaaaaaaaaaaaaaaaaaaaaaaaaaaaaaaaaaaaaaaaaaaaaaaaccaaacc

SEQ ID NO: 19131 - DNA, 514 bp, Gossypium hirsutum
  Clone ID: uC-gsflnu33B063d01b1
ttcttatccaagcttgcaaatttgcagcctgttcttcaatccgttcaagccgattaatcctcagctttctgttttcggaagttactactttacctagtgatggcagacggtcacgagagtgacaagaatattgagatatggaagatcaagaagcttattaaagcacttgaagccgctagaggcaacggcaccagcatgatatctctcataatgcctccacgtgatcagatttcaagggttaccaagatgctgggagatgaatttggaacagcttcaaacatcaaaagcagagtcaaccgtcaatctgtgttaggtgcaatcacatctgctcagcagaggctcaaactttatagtaaggttcctcccaacggacttgtgctctacactggaacaattgtgactgatgatgggaaagaaaagaaagtcacaattgattctgagccgttcaggcctataaatgcttctctttatctctgggacaacaagtttcacacggaggcactgaatgaacttt

SEQ ID NO: 19132 - DNA, 319 bp, Gossypium hirsutum
  Clone ID: uC-gsflnu33B063d05b1
tctgtattgctgaagaaggatgggttaatggccacccatgatgaggaaactgaacaattcttcaaggatactgatgtcaactgtgtcttatgccctcgtaatccagatgatggtggaagttttgtgcaggaattacaaatatctacaatgttcactcatcaccagaagattgttgtagtggatgctgcaatgcctaatggagatccagagaaaaggagaattgtgagctttgttggaggtattgatctttgtgatgggagatatgacacacctttccattcccttgtcaggaccttggacaccgactaccatgatgatt

SEQ ID NO: 19133 - DNA, 412 bp, Gossypium hirsutum
  Clone ID: uC-gsflnu33B063d10b1
tttcttctccacactgccgttgatctagtaaacgagactaagctagatgatgaaatcaaatcctggctcgcatttgctgcccagaaagttgttgaagtcaatgcacttgccaaggcgttggctggtcagaaggatgaggccttcttcgcagccaatgctgctgctcaggcttctaggaaatcctccccgagagtgactaatgaggctgttcaaaaggctgctgctgctttgaagggctctgaccaccgccgtgcaacaaatgttagtgctagactcgatgcccagcagaaaaagcttaacttacctgtccttcccaccacaaccattggatccttccctcaaaccttggaactcaggagagttcgtcgtgaattcaaggctacaagatctctgaggaagattattgttaaag

SEQ ID NO: 19134 - DNA, 383 bp, Gossypium hirsutum
  Clone ID: uC-gsflnu33B063d11b1
tttgccaatgtaaatggaacgacgcgtctgtggggatggcttctggaatcttctacttgcggcgcgaggtgaaagagaggcagaaaccctaaggtttcatgcctcggtgtaacggtttgggccagttgggccactttagtcttgggtccatttaggtctgttgtaatgggccttaagagtaagattttagaaatgggccagtaatgtaacgggtttgggtctgctgagttgtaaccgggcataaggtttaggccaattgattttgggtctactggttggtgggccaatgtaaatggacttttaaaatatttatttggtttacagcccggtcaaatttgggctacttacaattaaaaacaaaaagagttttccttgtttactga

SEQ ID NO: 19135 - DNA, 277 bp, Gossypium hirsutum
  Clone ID: uC-gsflnu33B063e02b1
ttctctcgtgcaagcacgcgtgggcttgaggggaacatattagcagccgaccagcttggcacaaggttagtaagatctatgctttactgttaagaacgaaaaagaggcagtcgagaggagggatcttctgatactgtctggtctagggttaaaccttttggaatggtggtgccttgaatgcgtgttccagagggaccaacccatcgatatggtcaaggcaagaacccaactggttctaggatcgtcagaaactgttaccaagaacatgcttaaggag

SEQ ID NO: 19136 - DNA, 512 bp, Gossypium hirsutum
  unsure (1)..(512): unsure at all n locations
  Clone ID: uC-gsflnu33B063e03b1
ttaattatatattaaatccaaggacatgactcttaacaagcaccattgctgctccaccttcatctttctgctattaataactgctctcacagttttattctgtgaaaagtgaacttcaattgaactactacgcagaaagttgcccaagtgcggcagagattatcaaacaacaagttattaagctgtacaacaaacatggaaatacagcagtttcttgggttagaaatctcttccatgactgcatggtcaagtcatgtgatgcatcgctgctgttacggagggtgaagggaatggaatcggagcaagaatcggataggagttttgggatgagaaatttcaagtacattaacacaatcaaagaggctgtggagaaagaatgtccgatgacagtttcttgtgctgatatcgtctctctttctgctagagatggcattgtcatgcttggaggaccacgcattgaaatgagaagcngtaggaaagatagcaagcaaagttacccgacagaggtgcaa

SEQ ID NO: 19137 - DNA, 473 bp, Gossypium hirsutum
  Clone ID: uC-gsflnu33B063e10b1
tgtcccaagctggtggttcattcactgtcaccagggatacatccggagagaacattggtaggggtacaaagattactctgtttttgaaagaggatcaacttgagtaccttgaggagcgacgtttgaaggatttgattaagaagcattctgaatttattagctatccaatttcactttggattgagaagaccactgagaaggagatttctgatgatgaagatgaggaggataagaaggacgaagaagggaaagttgaggatgttgatgaggagaaagagaaggaagaaaagaaaaagaagaagattaaggaggtgtcgcacgagtggtctttggtgaacaaacagaagcccatctggatgaggaagcctgaggagattaccaaggaggaatatgctgctttctacaagagccttacaaatgactgggaagagcatttggtcgtaagcacttctcagtgaggggcaactgagttc

SEQ ID NO: 19138 - DNA, 415 bp, Gossypium hirsutum
  Clone ID: uC-gsflnu33B063f01b1
tttcttgtgtaaagaaaagggtatccgagttaccaacacccctgacgttttgactgaggacgtggcggatttggcgatcggtttgatgttggcggtgttgaggaagctctgtgagagtgatcggtttgtgaggagtggcaagtggaagagagggcaatatgtgttgactactaagtttactggaaaaagagttggcattattgggctgggaagaattggcatggcaattgctacgagagctgaagcatttatctgccctattagttactactctagaacagagaaaccagagatcatatacaaatactatccaagcgttgttgagctggctgccaactgcgatatcttggttgttgcttgtgcactgactacagagacccaccacatcatcaacagggaagtcattcgatgcatt

SEQ ID NO: 19139 - DNA, 487 bp, Gossypium hirsutum
  Clone ID: uC-gsflnu33B063f05b1
tgatcgcaaggggaagcctgattttcttgatataattatggataacagagaaaactctgcaggggaaaggcttagtttgaccaatgtcaaggcgcttctgttgaatctattcactgctggcaccgacacatcctcaagcataatcgaatgggctttagctgaaatcctgaagaacccaaaaatactgaacaaagctcacgaggagatggataaggtgattggcagaaaccgaaggcttgaagaatccgacatacccaagcttccctatcttcaagccatttgcaaagagaccttccgaaagcatccatctactcccttgaacttgcctcgagtgtccacccaggcttgcgagatcaatggctactacatccccaaaaacaccaggctgagtgtcaacatttgggccattggccgagaccctgacgtgtggggcaacccactggatttcacccctgaaggtttctgagtgggagatttgcaaaatcga

SEQ ID NO: 19140 - DNA, 274 bp, Gossypium hirsutum
  Clone ID: uC-gsflnu33B063f08b1
ttcaagccacaccaaaagccaatttacccgaagaggatatcaaggctctcacaaagaggacacaagatggaggcactgaagttgtggaagccaaggccggaaagggttcagcaacattatcaatggcctatgctggagccatttttgctgatgcttgccttaagggactgaatggcgttcctgatgtagaggagtgctcatttgtgcagccaactgtcactgacctccctttatttgcttccaaggtgaggctcggaaagaatggtgcccagga

SEQ ID NO: 19141 - DNA, 354 bp, Gossypium hirsutum
  Clone ID: uC-gsflnu33B063f09b1
tctgtaaaaatgatcaccgcaacatacatggtaaaatatcatttccttttagtttaatcctttatatatgtatatggtaaaagtaccgtggaagcccatgtactaggagttagattgtattttaccccatttattcaagtctttgtgcattagatcaaagagcaaattggtccttcagtgtaaaaacttctgtcattttatattgttaaaaattggcgtggttgatggaacaggttgacagtgaccagtttttaacggtagaaatggatgaaattttaacaaaacgaaacattacctttagaaccttaaaactacaccactaacttgtgttgggaacaactactgtctgttcaa

SEQ ID NO: 19142 - DNA, 562 bp, Gossypium hirsutum
  Clone ID: uC-gsflnu33B063f10b1
tcttttgacgcgtgggggaaggattacagttatcacaagaatgggtgctgagaatatgagagtgaagcttccccatctaattagggcagtgcgtcgtgctgggcaaattgtcacttgggtcagtgaccctatgcatggaaacaccatcaaggctccttgtggtctcaaaactcgccccttcgattccataagggctgaagtgagagctttctttgacgtgcacgagcaagagggaagtcatcctggaggagttcatctagagatgactggacagaatgtgacagaatgcatcgggggatcccggactgttacattcgatgacttgggttcacgctaccatacccactgtgaccctcgtttgaatgcctcccaatctcttgagctcgccttcattatcgccgagcgcctcagaaagaggaggatcaactcacagcaactgcaaccactaatcacagggctgttaagtggtggtcaaggatcctgccgctagcctttaccaaaaatatgtttgtccccgttttttcccctcgcttaagtgttatggcattataatattttttta

SEQ ID NO: 19143 - DNA, 447 bp, Gossypium hirsutum
  Clone ID: uC-gsflnu33B063g05b1
ttattctagagctgagttgaaacaggtcattagacaagagatggagagcaatcgagattgcaaggataggcaaaagattcgcttcctgattagtgaaggaaccgagagactgaaaggtctgactgagatgcttggtatgcagggacattgctagttcaatgaaagctgcctgctgctttggtatcttaaaactctgattttgtagaatagacttcattctccacaagttaaccaatttcataaatttacttcttccatgaatataaattttttatttaattatagtttattgaggtggcaaaaaaaaaaattaaaaaaaaaaaaaaaaaaaaaaaaaacaaaaaaaaaaaaaaaaaaaaaaaataaaactaaaatttaaaaaaaaaaaaaaaaactattataacctaacaaaaaaaaaaaaaatggggggggcctttttaaagaacc

SEQ ID NO: 19144 - DNA, 200 bp, Gossypium hirsutum
  Clone ID: uC-gsflnu33B063g07b1
tcgtccacgcgtccgctttggggtttgatatttagtattgaacttgcttttgggtccaggggtcaacatgccgatggaagaaactatgggttttccattttgaagtggtatggatgtatgtatgtatgtatgcctcattactccttttctaattttctagccaactcttaccgtttgtgcctttttggtttcttccataa

SEQ ID NO: 19145 - DNA, 332 bp, Gossypium hirsutum
  Clone ID: uC-gsflnu33B063h03b1
tgagtatccagtttgcggaagtgcacattgtgccttggcacccttggagccaaaagctgggaaagttagattttgttgcgcatgcggcatcacctagaggaggaattgagaagatccatctagatgagcagaaccacagagtgcttctgtgaggaaatgctgttatggtgatggaaggctctgttttggtgcagatttggagtcaaatctgcctaccctaatcctggatgaagtgcatgaagtagagttaggtactgacttcaacgttttcttgcctcatcaattacaacggtcgtacgagggtttgtgcaccaacggacaatattttgtgc

SEQ ID NO: 19146 - DNA, 515 bp, Gossypium hirsutum
  Clone ID: uC-gsflnu33B063h06b1
attgtgatattggaatcacttgcttcatccatagattttgggttttcagccctaggaaatattgtttcggttcgtcttttcaaatctatggatgtcggtgtggttgttcttgttggatgctttgggaaagaaagaaattctggttctgcaagatttcaccagccatggcgtctcttttacagtcaactactttattattcatattctctattacattgattcttatcccaaatagacacgctattcccttcatcgtattgcatggctattgcagcaatgatgcgtgctcaggaagccaatcctaccaatctggaagtacttcttgctcttggtgtgagtcatacaaatgttttgacaagctagctcggaaatcgagaacggtcggaggcccactcacactatccgtataccatcttggcataatggcttgtatattttgagtatggcatgtatagcattataatcattttgtatatatggtcttatgatatggctatggagtggtatggaaatgc

SEQ ID NO: 19147 - DNA, 562 bp, Gossypium hirsutum
  unsure (1)..(562): unsure at all n locations
  Clone ID: uC-gsflnu33B063h07b1
ttatgttcccgagttacctaagccagagttgcccaagcctgaattacccaaagctcccgagtttccaaaacttgaatcaccaaaagttcctgagttaccaaaatcagaattgcctaaagttcctgaggtgcctaagccggaattgcccaaagctcctgaattgccaaaaattcctgaggtaccaaaaccagaattgcccaaagcgactgagttgccaaaacctgaattgccaaaagctcctgaattaccaaaacctcaattacctaaaattcccgagttaacaaaaccagaattgcctaaagttccagaggtaccgaaaccagaattgcccaaaactcctgagctgccaaaacctgaattacctaaagttcctgaattgcctaacatgccgaaacccgaagaacccaaagttccagagctacccaaaccagaactacctaagttacccaatctaccaaagccagaaacacctatacaagaantgccttaagtgcctgatttgcctaccgtgctaaaaccttgaatcattgtactatgttttccctcgacaaataacatatga

SEQ ID NO: 19148 - DNA, 564 bp, Gossypium hirsutum
  unsure (1)..(564): unsure at all n locations
  Clone ID: uC-gsflnu33B063h12b1
tcttccacgcgtccggtcgaaggaagaaatcgagaagatggttcaagaagccgagaagtacaagtccgaggatgaggagcacaagaagaaggttgaagccaagaattcattggagaactatgcctacaacatgaggaatactatcaaggatgagaagattggttcaaagcttgacccggctgacaagaagaagattgaagatgccattgatggagcaatccaatggttggatggcaaccagctagccgaggctgatgaattcgaggataagatgaaggagctcgagagcatctgcaatcctatcattgccaagatgtaccaaggtgcaggggctgacatgggtggtggcatggacgaggatgccccacctaccggtggcagcggtgctggacctaagatagaagaagtcgactaaatcaaatattaagatagtattctgccgatgtttaacagcttctgctggtgctatatnttatgttttcaggcacctatgtcttgatgtattgaaaaaatctggcttatctttgggacattaccatcttaagaactaatggttcccgtttt

SEQ ID NO: 19149 - DNA, 404 bp, Gossypium hirsutum
  Clone ID: uC-gsflnu33B064a01b1
taagaccccctcaggactggccctgagactgactcatttgtgattggaaatgcatagggcacttccctcttagccggatcaaatgcatggagcacgcagtacatagaatttggatttaatatccggaagtttaacggcagctctctaagcgtattttcaaggggagaacaagggcttgcggtggtcggaggaagaggacgattcatgatggcaacagggactgaactatttaaccctatccttataaatgccaccaatgttattatggaatctaactctactgtagttcattactgagatgttatttacaagacttagttctcttggattgcgaaaaagtcatgtgatgttgcgccccttggttagagtggatgcatgcgtattaaattttcattactttatca

SEQ ID NO: 19150 - DNA, 252 bp, Gossypium hirsutum
  Clone ID: uC-gsflnu33B064a03b1
ttctaaagactatgtaaagaaagactctcacagggcgattgaaagaggatcattgtttctatcgctggctggggacaatgatcctaacacagcagaatcgatggatacagtcgtctaggtgagaatgcacacagggtcatctaagcgaagatgtgatgcgctgagtgaaggagcaacgtaactggaattccaaagttgatcgcgacttctttcatgcgtatgccaaatggtttgatgatcttgccaagagag

SEQ ID NO: 19151 - DNA, 298 bp, Gossypium hirsutum
  Clone ID: uC-gsflnu33B064a04b1
taccgacatctttgaagcaaaagatcagaacgggggggttccagatcctgcacaggtcgttgatcaaggacaagtgatggagtggatgccagagagctgcatggcgagggcgacctctaaccagacacaggaagctgctcatgaggcatggatgaaacgagtgacgattgctagcaagcattcagaatatgagcatggggctgccgacttggtgatgcaccattgagatgagcgttcaatggttgaccagaagaaccttgctgatatagagttggctgaatttggttccagggagcct

SEQ ID NO: 19152 - DNA, 207 bp, Gossypium hirsutum
  Clone ID: uC-gsflnu33B064a09b1
gacgacatagctcttatatagtgccacgtaaaataaatgcactgtccgtgctctgacaacatcccgactgggaaagccctgcagtaacccagctaaaacggcttgaaacacatgccccttgacaacagacggcgacatggccataaggcccgaaccggtcgtgctgaccgacagtcgcccactctgtatggacaatgggacgcgccc

SEQ ID NO: 19153 - DNA, 327 bp, Gossypium hirsutum
  Clone ID: uC-gsflnu33B064a12b1
tcacgcgtccgcccacgcgtccggtttgtctattgaattctttccttcactttctctagaaaaagaaaatgtcttcaggttgcaattgcggatctaactgcagctgcggtgacaactgctcatgcagcaggaaccttaaccttggatactcggagaagacaaccagcactcagaccatcatctgcggagttgcgccagtaaagatgacctttgagggaccagagatgagcactactgaatcaggacatggatgcggctgtggatcaaactgcaaatgtaatccatgcaactgctgataagcttgttgaaagccatggattatgaaaa

SEQ ID NO: 19154 - DNA, 460 bp, Gossypium hirsutum
  Clone ID: uC-gsflnu33B064b01b1
ttttgtcgatcctgccgagaggaacacaattggggtaccatctggtggatgggtgagctattagattccgtgcagataacccaggagtttggtttatgcactgccatttggaagtgcatacaacatgtggacttaagatggcatttttggtggacaatggaaaagggcctaatcagtcacttattactcctgcaagtgatcttccaaagtgttgaaccaggcaactatggacaccagcaccgagattttacgatgaaaggaaacgtgaaaagagaatgaaagaatttctttcatgtgcagaagatgaggctgcgaacctgtgctatctaataagcaaaagacgagttgagattgaatttatgttcttggagaaatggcgaataacatttgcatacgcattattatttttggaatgaaaggatgaataaatattttattcaaaaaaaaaaaaaaagggcgg

SEQ ID NO: 19155 - DNA, 459 bp, Gossypium hirsutum
  Clone ID: uC-gsflnu33B064b03b1
tctacgcgtacgaccacgcgtacggggattgtaagcttaaaaccctaaccctagaattttctttggaactcatcgctggtgctatttgacctcattcacaatgcctcgccgtagctctggaaggtctgcttctcgtcctgcttctgctcgcagccctccacctcaaccagctcatcatgctcctcctccagctcctgctcagagtggaagtggtggatccttgctcggaggcataggctctaccatagctcagggcatggcttttggtactggaagtgctgcagctcacagggctgtggatgctgtgatgggtcctggtactattcaacatgaaaccgtggtttccgaggcttgagctgcccctgcaccagcaactactttcaatatgttaagctggcactgattcatgcagcatccactacaaggcattccaggattgcctgaacagctatggaagcg

SEQ ID NO: 19156 - DNA, 358 bp, Gossypium hirsutum
  Clone ID: uC-gsflnu33B064b04b1
ttaccacacacttgctaatattgctacttggagtggtggttatcgccactccctgtcttgccacctatgagtctcccaactatgggaagccccctactcctgaccataaacctcctaaggtgaaacccccaccttatgaacatcctagggataaacctcctaaggtgaaacccccaccttatgaacataagccccctgactatgaaccaccaaagaaggaaaagcctgagcctaaggcaccaatttatacacctacaaagaaagagaagcctgaacccaaaccaccagtatatgaacctctaaagaactaagatgaaaaggtctgttaggatgcatgctgagaagactgggaaacgaa

SEQ ID NO: 19157 - DNA, 60 bp, Gossypium hirsutum
  Clone ID: uC-gsflnu33B064b06b1
tacacaaagactgaaaggaactctaattgccttttatgtaaaacaaaagcaagaaattgg

SEQ ID NO: 19158 - DNA, 89 bp, Gossypium hirsutum
  Clone ID: uC-gsflnu33B064b07b1
taatgtttgtcaaaaaaccaacttgcttgctgggcttaaaatctttgatgagcccctccatcgtcataaatatttggattaacgcatga

SEQ ID NO: 19159 - DNA, 354 bp, Gossypium hirsutum
  Clone ID: uC-gsflnu33B064b09b1
tgacttccgtggaagcagttattctggttgagttgttcaagcaccctcatcttttgctgctgcaagttaggaattccttctttaagcttcctggtggccgtttgaggcctggtgaatcagatattgatggactgaaccgtaagctttccaggaagctttctgctagtgaagatggcaatgaaactgaatggcaggtgggtgaatgtcttggcatgtggtggcggcatgatttcgaaaccttaatgtatccatacttgccatccaatgcgaaaaagcctaaggagtgcaccaaagtcctccttgtgaggatgcccgacagttaaaaatttatcgtacccaaaaatctcaaattgt

SEQ ID NO: 19160 - DNA, 302 bp, Gossypium hirsutum
  Clone ID: uC-gsflnu33B064b10b1
tacaaaccaacaaaaaaaaaaagaaaaaagagaggggatatttaaaaacaatacctaattaactcaatatgaaaatgaagattacatgactgacttgattaaaaatgcactgaacttttgaaaatatggggggggccttttaaggggatccaggtttgcctccgctggcttgaaagagcttattcttttttttgggggcccctaattaaaatcaatgggccgagggtttaccccggggtaatgggaaaaacctggggttcccccaattaagagggtttgggaaccatcccctttttgccagg

SEQ ID NO: 19161 - DNA, 465 bp, Gossypium hirsutum
  Clone ID: uC-gsflnu33B064b12b1
taatcaaagacagaaagcaacatgctcaagtgcagaatctgtagatcaaaagcaagaaattgggcctcatcaaaaagccgtcgtggtgttgattcggatcttatcagcaaattctgcagatggcatcgcgtactgtcagtttgattcaagatcagaatctaaatgttcagtttaatggcaaggctaatatctctaaagcaccgagaaaagccagtactggtggaagaaaaccacttggtgatctatcaaattcagtgaacccaaccgcaaagcagatatctaaaaaggagaattccaagatcattactttcactgagaaagaaacagttgcctttaaactcccaaatgattcaagcaggaaaaagaatgtccctaaggcctcagagaaagttcaagctagtggcaggaaagctctctctgacatttctaacttaggccagccttacttgcagggaacatcaaaag

SEQ ID NO: 19162 - DNA, 442 bp, Gossypium hirsutum
  Clone ID: uC-gsflnu33B064c01b1
taggcttttgcgtacatgaaggaaacacatacgttgtctatgagtacgcagataaaggctcagtcagtgatttgcttcactccaacaagttccaaacttcatttactctttcttggaagcaaagagttcagattgcatacgatgtagctgatgcactcaactatttgcataactacataaatcctccttatattcataagaatttgaagagcagcaacattctcttggatgttaactttagagccaaagtcaccaacttcgggttggcaagaactattgaggacaacgatgaaggtggattgcagttgacaagacatgtggttgggattaaaggttatatggcttctgagtacattgaaaatggtgtgatcacgcctaagctcgatgttttcgcattgagggctattatattggagcttttatcatgggaacgattgctgca

SEQ ID NO: 19163 - DNA, 125 bp, Gossypium hirsutum
  Clone ID: uC-gsflnu33B064c06b1
tagaactttgcaggccgaagaggggaaaggtgccatgtgaacggcacttgcacatgggttagtcgatcctaagagacgggggaagcccgttcgacagcgcgtacagtgcgagcttcgaaaaggga

SEQ ID NO: 19164 - DNA, 336 bp, Gossypium hirsutum
  Clone ID: uC-gsflnu33B064c07b1
tgatcgttcagttcgcgaattttacttgtaatcaagcgttactcgaggttttcgaagggtgtaataggcttcatataatcgatttcgatgttggttatggtggacaatgggcttctttgatgcaagaacttgttttaagaaatggtggtgcaccttctatgaaaattactgcctttgcttcaccttcaagtcatgatgatatcgaactcggtttcacaatcgaaaaccttaagcattatgctagtgaaatcaacatgtattctgatatccaaattattgagccttgacgccttgaattctgtcacctgcccctcccctttgcacttgggccataac

SEQ ID NO: 19165 - DNA, 467 bp, Gossypium hirsutum
  Clone ID: uC-gsflnu33B064c08b1
tccacgcgtccgggatgaggaagtttcagaaccctcaagtataaggaatcattgggccggcatctagaattctcgttatttgcaacaactaagcgaagcgagacaaaaatggcgacttcagccatgtcggaaaaacgggtcgtcctgctctgcggcgactatgccgaggactatgaggttatggtccctttccaggctctgttggcttatggtatatcaggggacgctgttcgtcccgggaagaaggccggcgaaacttgccgcaccgctattcatcaactttgcggccatcagacctataccgagatccgtggtcacaatttcacactaaatgcatcatttgaagatatagaccatactaaatatgatggtttagttatagccggaggacgagcttctgaatatctcgctatggatgcatttggattgaacatggttcgcaattttgttaattatggaaagcctgt

SEQ ID NO: 19166 - DNA, 320 bp, Gossypium hirsutum
  Clone ID: uC-gsflnu33B064c09b1
tatggaaatcctccaaattgtgaaggagaactgcgactttaggcctggcatgatcaccaacaacctggacctgaagaggggtggcaataaccgattcttgaagacagctgcctatggacattttggaagggacgaccctgacttcacctgggaagttgtgaagcccctcaagagggacaagtttcaattattaaaccaagctttgcccatcctccgtgctgactgcttgctattatccatagacgcatgaataattctgatgacttttactctatatctaacccaccacctgactgtttttaatatacatatgatagtgc

SEQ ID NO: 19167 - DNA, 335 bp, Gossypium hirsutum
  Clone ID: uC-gsflnu33B064c12b1
tccacgcgtccgcccacgcgtccgaaaaaggggaaaaataaaaaaaaaaaaacaaaaaaaaaaaaaaaaaaaaaaaaaaaaaaaaaaaaacgccaaagaagaaaaaaaaaaaaaacaaaaaaagaaaaaaaaaaaaaaagaagagccaataaaagaatcacagagaaaacaaaaacaaaaaaaagaaagaaaaaaataaggggggggggcctctaggggcccacgctcgcctccgctgcccgctgggggaatatggtttcattcggggggcccaaaaacaaactgcgggggcggggtttccacctcttgggggtggggaacctctggcgggcccc

SEQ ID NO: 19168 - DNA, 381 bp, Gossypium hirsutum
  Clone ID: uC-gsflnu33B064d05b1
ttaaaacagcatcgtccattgattcccttccgttactgctccctccctcttccattaaaaaagaagatagaaagcagctaccaaaatggctactttgctagcggctacaggtcgtagagcaactactctatctcgatccccggctctgtctcaagccgcttctctcattcctcgccgtggtcttgccggcgctgcggatcaccatggacccccgaaggttaatttgtggcaagacccaatgaacccatctaaatggaaagaagagcactttgttattggctctttatccgggtggggcctgcttttctttagcggatccaagttccttactaaaggcaaaggcaagaaagaagagaacatggtggaaacgacaattaatga

SEQ ID NO: 19169 - DNA, 451 bp, Gossypium hirsutum
  Clone ID: uC-gsflnu33B064d11b1
tggacgcgtgggtggatctgtcgttcaaaggggcatattcaaaagaaagttcgatggtatctcttttaatgaaaaaaaatggctgaaaatctgatgcatgctttacaatataacagctacgggggaggcgctgctggttcgaagcatgaagagagttccgatccccactccaagaaaaggtgaaattttgcttaaactggaggcaactagtctaaacccagctgactggaaaatacagaaagggatgctgagcccatttttacctagaaaattcccctacatacctgctactgatgtagcgggagaagttgtaaaagatggaccgggagtcacaaattacaaagctggggataaagatgagtctatgctccatcattttactggaggaggactagctgaatatgcagtggctaatgagaatctgactgttgcaaggtcattagaagtttca

SEQ ID NO: 19170 - DNA, 263 bp, Gossypium hirsutum
  Clone ID: uC-gsflnu33B064e02b1
taaacatggatatggtgatccagaaggctctagagagaaaggccttagctaaaaagtgggctgaaccccacatggaagcaattaaaaccaaatgggttccagctgctaaggatcagtgggtggcggtaactacatatgctgaaccacatgtgcaatcgctaactgcaacaactgtagcaaattatgaggtatacgaggctacaatagcttctcatattatcgactttcaagaaacagtgtgatactgacttgcaggaagccaa

SEQ ID NO: 19171 - DNA, 163 bp, Gossypium hirsutum
  unsure (1)..(163): unsure at all n locations
  Clone ID: uC-gsflnu33B064e06b1
tattttttttctttttaatgagatgatatgcataaaattttaaaaagaaaaaagttaaattctgctatcagttcttgtatttaaattgtggatttaattcatgtattataatttgatctttttttttcanacctgaaanaagctcactaaaccttgttgaaac

SEQ ID NO: 19172 - DNA, 446 bp, Gossypium hirsutum
  Clone ID: uC-gsflnu33B064e07b1
taagtttccaataaaaaggactttgtatctatcattatgcaactccaaaaggatggcatgtacgagatggacctcactcatgacaacatcaaagctatcttactggacatgtttgtaggaggaactgatacctctacaacaacaaaagagtggatgatggcagagcttttaaagcatccaaatgcaatgaaaaaggtccaagaagaggtgagaaatgtggtgggaaacaagttaagggtggatgccgaagatgttagtaaaatggaatacttaaaatgtgtactcaaagaaactttaagactacatccggccggtcctcttatggtccctcgagaaacaactgcaagtgttaaattgggaggttatgacattccttccaataccacagtcctggtcaatgtatgggccattcagagagatcccaaatggtgggaaaacccaaaaga

SEQ ID NO: 19173 - DNA, 393 bp, Gossypium hirsutum
  Clone ID: uC-gsflnu33B064e10b1
tacacgcgcactgccacgcctactgaacggagcgcttgtagacgaaaataactgtacccacagtgaggaaatgctgatgcatgaagctctccaacgatggatttcgacgatcatgtaccccgatggatcgtcatcgtcaccagctcctattctgcaggggatcacgatctatgtttacgagaatgggcctcgccttgcggaagcctctagaaacactaaccgtactgctatactgtggactcgtactggcagtccccttcgagctgttcgtggaatgtctgatgggaccatagcttttcttacctcgacaggattgcttgcgtttatgctgatctttcatagctccaactgtcgatgccgtcatcatcttttacctcattgctcaggctgctg

SEQ ID NO: 19174 - DNA, 513 bp, Gossypium hirsutum
  Clone ID: uC-gsflnu33B064f10b1
ttcacgcgtccgtctggttctgcggcatgaatctaaatacagcattcgaagcactgacctcaaaacgaccttgtggacccaataaaagagcaatacgaggagccacctatgatctggctaagaatgatccatggaaggagccctttgaaaatcttcctggacatgcttttgagggtgtagcagattgggagaggaagttgattcaagaccgtgttcgttccctccgtggaacctgattatcttggttaacattctcttaaagccgggtcacaagcgcatggcagacaaatccgcagaatcttacgtattgcttgtgggatgttgaagctgatctctccagggactattttcctgactgaataccaaattacttggtcaaatcataaatatgatctgatttttatagaagctatttgtcataaaccatacataaaacatagagaagtacagaaaacacggaatattccatgttcaaagcatgggttatatgctattgaagctaaatttttaggt

SEQ ID NO: 19175 - DNA, 483 bp, Gossypium hirsutum
  Clone ID: uC-gsflnu33B064g05b1
tccacgcgtccggaaccgttcagattttggttcacccgattgaaccgtcaggtccagggttttttcaaccatgctgttctgctgttctccgtttcccagtttttgataatcgaatcggtgaaggaagcttcttttgtttttgatcgtcgactgagtttgtgcgtccttagaatctaaaacattctgaccccaaaaatgttgaagctctctttttcttcttcgtcgtcatcatcatcatcatcatcttcaagaattgtcgctgctttcctcaagctttacttaaaccgtcttcaagtcaaccccttttccttcttccaccaccaccaccaacttcctttaaatcccattttctcaaattccgctcttttccactttctttcttgttcttcccacccccacgctcgcactacccctttttttaacctttacattgcttagcccaatcatccctttttccctttgggtttagggttcttttcttta

SEQ ID NO: 19176 - DNA, 379 bp, Gossypium hirsutum
  Clone ID: uC-gsflnu33B064g06b1
ttaacctgagttttctattcaaaccttgtgcgaccgagttacggcgctggagtctaaattcgaccgtctcgttaacgggaggaactccggaggggacaggaagtacacgtggactgcggagatcaaggggccggttgaaaggaagtacaaatgggtagcggagatcaaggatgggaagaagacagaagaggtgaaagagaaaaagtataaatggacggctgagattgaaggacagggaattgatgggcctatctcgagaaagtacgggttgtcagcatccactggtggcgatgcaagtgaatgtagcaaattcgagaagaaggaaaagaatgagaagaagcatcagaaaaaggacaagaaaggagagaatgtcccgcgt

SEQ ID NO: 19177 - DNA, 326 bp, Gossypium hirsutum
  Clone ID: uC-gsflnu33B064h02b1
cttcggtcacgccttcggttaaattgtcagtgtttttgaggatatatgatatttggtcaccttgcatagaatataggctttattaagaattatttgtgttacgaaattatgctggcgtttttgtatataagaaaagttggtggagttgactcagaatgcaatgatgaagcgaagtatgaggggtggaactaggatgccgtgacattattggaaacggcaatgcccaaaccatggattgtttaaaaaaactaaaacaagagctggataatatcccgaaatgcctgtatgtattgcttaaagatagagatgaccccattttttggctt

SEQ ID NO: 19178 - DNA, 426 bp, Gossypium hirsutum
  unsure (1)..(426): unsure at all n locations
  Clone ID: uC-gsflnu33B064h03b1
tctagggcaggctgatcttgcagttggtagctgtaatgagctttcagtgattaatcttcgaagattatttgctaacaagggttctactttcatggaccggcaaaagcagatcatagagaagactcctccgaaaaggaagcttacagttgataccatcttctgaatcatgttgaccttcctttcatttcaaagttgcccctgtattttaagcgagagcgcagtttaagagatagttgtatgagccatgagtacatagntgnatgatccatggtactcttcattctcatggtatggagatacatacatgtatctggggctgagtccgagtaacaataggtcacagtttactttaaaaattgatttaattaggaaaatgttggcccatatatcattcgactgaatgcacagtaattgaagtgtattatg

SEQ ID NO: 19179 - DNA, 317 bp, Gossypium hirsutum
  Clone ID: uC-gsflnu33B064h05b1
tttattatcaatttgaagccttcttcgaaattgctctttcaagatgcaaattttcgtcaagaccctcactggcaagaccatcacccttgaggtggaaagttctgataccatcgacaatgtaaagaccaagatccaagacagggaagggatcccaccagaccaacagaggctaatctttgctggtaaacagttggaggatggccgtaccccttgctgactacaccatccagaaggaatccacactccatttggtcctccgattgaggggtggtatgtaaatttttgtcaagaccttcaccggaaagaccattcccttt

SEQ ID NO: 19180 - DNA, 84 bp, Gossypium hirsutum
  Clone ID: uC-gsflnu33B064h09b1
tagctgctcccgcggcgagagcgggtcgccgggtgccttccgggggacggaactggaaccgtttctttgggggttttcctgggg

SEQ ID NO: 19181 - DNA, 302 bp, Gossypium hirsutum
  Clone ID: uC-gsflnu33B064h12b1
tccacgcgtccgcggacgcgtggggacagagcaaaaatttgccttttaaatattgtactgtaacatataatccccttgaactgccgtgcatgcaggcggtctagagacttgggtttagtctatttttccatctcattggataataccaaataaactcatgaatggacaccattgcttttggagatatcagctttgaaatggaaaagttgtggaacaagacaagaaaaataatatagttaggcgtttctgatgcttaacaaaaaaataaaaaatagaaaaaaaagaaaagaaaaataataata

SEQ ID NO: 19182 - DNA, 394 bp, Gossypium hirsutum
  Clone ID: uC-gsflnu33B066a03b1
gtaaaacagagagcaagagaaaatgaagaccatactcttatcagagaccatggatatccccgatggggtcaacatcaaagtgaaggctaaaatgatcgaggttgaaggtcccaggggtaagcttacacgtaacttcaagcacctcaacctcgatttccacctcaccaaggacgaggagacgggcaagcgtaagctcaggatcgaggcctggatcggtactaggaagaccagcgccgccatccgtaccgcccttagccacatcgagaatctcatcaccggtgtcaccaaaggttaccggtacaagaagaggttcgtctacgctcacttttcgatcaacgccttaatcactggcggcaacaagttcattgagatccgtaacttccttggcgagaag

SEQ ID NO: 19183 - DNA, 316 bp, Gossypium hirsutum
  Clone ID: uC-gsflnu33B066a04b1
gtccgcccacgcgtccgagaagaagaagagagatgaaaatggtttctattgagttatcaccggagttgattcccggattacctgaggaaattggacctcgattgtttgattcggtttcattattctacttaccgagtcgcagctcgagtctgccgacgatggcaacagcttctccaaagcagggagttgcactatctcagaaagtaagccggatatacccgtaaagcggcttgcttagttcaattatctaataacaccaccgattctgctgggcccaagccggttggtccatctacatatctgccttacagttttt

SEQ ID NO: 19184 - DNA, 371 bp, Gossypium hirsutum
  Clone ID: uC-gsflnu33B066a06b1
tattatgtatgttgcagtagataacactggaggaggaaatgggtctgagagaacttcaatagaccaatcgaagaaagagttgatgcattctctttcatattccaaccctaccagtcaaaattctggtgctgttgatgataaccataccagagagtctggactagatgcattcgggactagtacggtaattttgcaaggagaggccgatattggtcctattaaacctcaacctgatacaactataggtgatgtttcaattggaatccagtagtcatactgatagtttggaagctcactggggatctattttcagttttttaaccccaatcggatgctctttttcaaggcagagaaaaccaaaaaagtaaaag

SEQ ID NO: 19185 - DNA, 292 bp, Gossypium hirsutum
  Clone ID: uC-gsflnu33B066a12b1
atgcccacccaatacgtgccatgaagttttctgtctcacctgttgtccgtgttgctgttcagtgcaaggttgcatcagatcttcccaaacttgttgaagggttgaagcgtttggccaagtctgatcctatggttgcctgtaccattgaagagtctggtgaacacattgttgctggtgctggagagctccaccttgagatctgtctcaaggatttacaagaagatttcatggttggcgttgagatcatcatgtcagaccccgtcgtcgttcttttcgcgagactgtccttgag

SEQ ID NO: 19186 - DNA, 462 bp, Gossypium hirsutum
  Clone ID: uC-gsflnu33B066b01b1
taaaccttctgcttagcttaaaaaatcttgaattcgtactctcctacttccctcgttatcgccaatggcttcggacaagaagattaagatcgggattaacggatttggaagaatcggacgtttggttgccagagttgctcttcagaggaacgatgttgaactcgtcgccgttaacgatcccttcattttcaccgattatatgacatacatgttcaaatacgacagcgttcacggtcaatggaagcaccatgatcttaagcgtcaaagactctaaaacccttctcttcggtgaaaaacccgtcactgttttcggaatcaggaaccctgaggagattccatgggctgaagccggggctgagttcgctgttgagtcaactggagtgttcactgacaaagacaaggctgctgctcacttgaagggtggtgctaagaaagttgtgacatctgtctctagctaagatg

SEQ ID NO: 19187 - DNA, 479 bp, Gossypium hirsutum
  Clone ID: uC-gsflnu33B066b12b1
tttcacctcaacaaaacacctacagagcaaatatgccaattgagagctcttccactaatgccccaaccgtctgtgtcaccggtgccggtggcttcatcgcctcctggattgtcaagcttcttcttgaaaaaggttacactgtcaagggcactgtaaggaacccagacgatcccaagaattgtcatttgagagagcttgaaggagcaaaggagaggctatctcttcacaaagctgaccttcttgattaccagtctcttaaggaagccattagcggttgcgatggagttttccatactgcttcacctgtgactgatgatcctgaacaaatggtggagccggccgtgattgggactaagaatgtgataatggcagcggcagaggccaaagttcgacgtgtggtgttcacatcttccataggtgccgtgtacatggacctcaacaggagccctgatgtggtggtcgatgagtcttgctggagc

SEQ ID NO: 19188 - DNA, 188 bp, Gossypium hirsutum
  Clone ID: uC-gsflnu33B066c02b1
cgcgggcggacgcgtgggatatatatatatatatatagaaaaaagaattgtgtagctatgaagctgtatgtatgtatctagcatttagcaaagtttgaatgtatctttctctgattcttaataatataaagctttttaaggcatcacaaaaaaaaacaacataactaaaaaaaatccctacaacaaaa

SEQ ID NO: 19189 - DNA, 456 bp, Gossypium hirsutum
  Clone ID: uC-gsflnu33B066c07b1
gcgtccgcaaaaccctaaatccctaaaaaaaacttcgatccccaaatttgaacccaattctccgatttctgatcctaaaactccatccaatttttcgagctattacggtaaatcatgggcataataagaagcagcttttcgttcatcgcaggcacagcttgcgggatttacgttgcccaaaactacaacgtacccaacataaaaaagctggttgactccgccttcttcgtagccaagcatgtcgaagagaagtaccgcaagcccaagaacaaggacgacgactagatcctaaataccctgctgttgccaagaatcaatagacttaacaggtccattgttgttttctcttctttaattatggaaaaaaaagggaagttgtctttttggaataaatacgatattgagattttctttttttgtgtacattttacaaattgggagaggggaaccttgatc

SEQ ID NO: 19190 - DNA, 52 bp, Gossypium hirsutum
  Clone ID: uC-gsflnu33B066c11b1
aaaaaaaagaaaaaaaaataataaaaaaaaggagaaaatattaaagaaaata

SEQ ID NO: 19191 - DNA, 310 bp, Gossypium hirsutum
  Clone ID: uC-gsflnu33B066d03b1
aggggcttggaatatcttcatgatggggcagtttctcctgtaatacaccgcgacatcaagtcatccaatatcctgttggaccagtccatgagagctagggtagccgattttgggctttcaagagaagagatggtagacaaacatgcagctaacatacgaggaactttcggatatcttgatccagagtatatatcaacaaggacctttacgaagaaaagtgatgtttatagctctggggcatcgctattcgaactcatagttggtagaaacccttttacagggtctcatggaatatgttgagctcgcacct

SEQ ID NO: 19192 - DNA, 455 bp, Gossypium hirsutum
  Clone ID: uC-gsflnu33B066d04b1
ttcaatccatcgagattcgagaatccagcttcacttccaccttactgcttcattccattcggtgggggacctcggatatgtccaggatacgagtttgcaaggattgaaacccttgtttcaattcattatctgattactcggttcacttggaatttactatgttcagataactctttcagcagggatccgatgcctgtcccaactaaaggattaccagttcaaatcagtcctagaaaactgccctaatattggagtctcttggtagcttaacttacaagattcctgttgcagagcaaatgagctttattttgttcacatatttaggtaggccagtaaaacacagtaggaatctcggaattatatcattggtcggaatggcatttcactgctgaaaatgtttcccgacaatgtccgaatctctagaattttcccacaaatactcgcatcgaatgtat

SEQ ID NO: 19193 - DNA, 261 bp, Gossypium hirsutum
  Clone ID: uC-gsflnu33B066d07b1
taacgcgcccggagaagaccaccttgcttggggcctgtatcatgattctagcgaatctttactttcatgctctcttatgatctttcgagtactgaccgcttctataactgtatatacctcatagcaccctactttttggttttggtttaactaatttgatatgtatgttagaccgatgacgattgtattatctctgggattcggaaggttgattgcattggaggtcataccacctatatcaatatagagcggactacaggc

SEQ ID NO: 19194 - DNA, 469 bp, Gossypium hirsutum
  Clone ID: uC-gsflnu33B066e06b1
gacgttgcacagcgcgaaagccgtgagagatttaatgagccaagatggatggggacgtggccatggcgttgaaaaaggccaagcttatcaaagttaggctggaagcgcttgaccggtccaacgccgctaacaggagcttgcctgggtgtggaccgggctcttcatcggaccggacgaggacgtcggtcgtgaacgggttgagaaagaagttgaaggattctatggaaagttttaacgagttgagagagaggatctcgtccgagtatagagaaactgttcagagaagatattttacggttacgggggaaaattctgatgacaagactcttgatcttttgatttcaactggagagagtgagacttttttgcaaaaagccattcaagaacaagggaggtgaagaattttggacccaatctatgggattcaagataggcatgatgctgggacggatttggagaggcattttag

SEQ ID NO: 19195 - DNA, 415 bp, Gossypium hirsutum
  Clone ID: uC-gsflnu33B066e07b1
taacgcgtccgctagacgccacaaggatagccctatatcagcagcagcagaagcagaagcaaagggtttagagacgaaatggcagcgaaaaggaagactcccgtcaagaccagaaacccggatctgatccgtggtgtgggaaagtattccaggtctaagatgtaccacaagcgtggcctttgggcaatcaaggccaaaaatggcggtgctttcccccgccatgatcccaaacctaaggcccccgctgccgctgagaaacctcccaagttttacccggctgaggatgtcaagaagccgttccttaacaagcgcaaacctaaacccaccaaactcagagcaagcattacaccagggactgtgttgattttgttggctggaaggtttatggcgaagagagttgttttcttgaagcaac

SEQ ID NO: 19196 - DNA, 195 bp, Gossypium hirsutum
  Clone ID: uC-gsflnu33B066e09b1
atcacgcgtccgcccacgcgtccgcagattaggctcattttcaacttgaacttcctttggtaacatgggagtcgagctatgatgcagccccgcaaacagggacatgtttttaatatattgtattgtgtgctttaaattaacctcgagattcactcttttttttttaatttcaagtttattaattattttttattt

SEQ ID NO: 19197 - DNA, 437 bp, Gossypium hirsutum
  Clone ID: uC-gsflnu33B066e12b1
ctctttctctattctctttggcttatctatcgctttgatttcgcgtccttactgtgcactcgatggcaaatcgatggttgaggcctgaggtgtatccgctgttcgcggccgtaggtgttgctgtcggaatctgcgggtttcagttggtgcgaaatatctgcatcaaccctgaagtcagggtaaccaaggagaacagggctgctggggttttggacaactttgctgagggagaaaaatattctgaacatttcttgagaaaatatgtccgcaacaagacgccagaaatcatgcccagtatcaacagctttttcactgacccaaagtgaggcttcactcttgctttatgctgaaactaaaataaaaaaatagaagaactaagtcttattcaatcaataccaagttttgccctttctttctgctgactgtgatgcaaattt

SEQ ID NO: 19198 - DNA, 457 bp, Gossypium hirsutum
  Clone ID: uC-gsflnu33B066f02b1
gtccgctcccctaccccgattccctttatcctcaatttccccaaatcggcagcccttttatttttcccaaaccatttctcccctaccccgattccctttattttcccccccaatttccccaaaccggcagccctctgcatctcctcatcttcttcctcacatttcattcgtcccaaaaaacatttctattcctctttcatacaaacaaaaaacaatggctactgctgcttcatgttcttcctttaccatacttcatttagcttcatcaccaccactaatttctgccctcctaatttcgctcttcccagcgataatggtggttggtgtaacccgcgatggcctcattttgcccttgctatgcctatgttcctcacgatcgctgagcaccgtaccgatatttgccccattattttccaatgaacactcctacaggttttggaaagctatcatccacatt

SEQ ID NO: 19199 - DNA, 389 bp, Gossypium hirsutum
  unsure (1)..(389): unsure at all n locations
  Clone ID: uC-gsflnu33B066f03b1
atacacccactttccgtcgntaaaaacatccttagcctttatgttcttttagattattatgacccacaaaaactccataaaatttccgatggtactacacttactactactctttaccaaaccaccggaaatgctcccggaaatttgggtttcgttaatatcaccgatctacaaggtgggaaagtcgggtttgggtcagccgttcctgggtttaaacttgattcgtcttatactaagtctgttaaacaggtaccgtataatatttctatactggagatcagtgcgccgattattgctcccggtgtttcatcagctcctgcaccgtcggctttcggtgttaacattaccggtttacttgagaaagctggctgatagaagcttgctaattt

SEQ ID NO: 19200 - DNA, 405 bp, Gossypium hirsutum
  Clone ID: uC-gsflnu33B066f06b1
cgtgcgattttagcttcccaagaatgggttcttttggagaaacattatctgctttagaactcataaatcaacaccttaatgattttgcttcaatggaaacctttcttttcacctgctccaacaccccagtttcataaacaatccaccctaagccaacgttgaccttctattaacgttacaattccaccatcgaaagttgaaataacctccaccgccacgaaagccatcgaggaacatgacgagaaaaggcattacaggggcgtaagaagacgaccatggggaaagttcgcagccgaatttagagattctaatcgaataggttctagaattaggttcggaactttcgaaaaccgctattgaagcctcttaaggctttgatagagcctgcttttaagctacgcggaa

SEQ ID NO: 19201 - DNA, 479 bp, Gossypium hirsutum
  Clone ID: uC-gsflnu33B066f09b1
ttcacgcgtccggatccttccttcgccgcctattgttttttgttaccttgatctcaagtgcatcagaatgggtaaggaaaagactcacattaacattgtggttatcggccacgtcgactctgggaaatcaaccaccactggccacctgatttacaagcttggtggtattgacaagcgtgtgatcgaaaggttcgagaaagacagctgctgagatgaacacgaggtcattcaagtatgcttgggtgcttgacaagctcaaggtttgagcgtcgagcgtggcatcaccattgatattgtcttgtggaaatctgacacccacgacatactactgcactgcgattgatgcactcggacaccgcgactttatcaagaatatgatttctggtaccccacaggctgactgcgccgtattgactcttgattccccctactgctggttctgaggctggcttcccccacgttggtctgattcttgagct

SEQ ID NO: 19202 - DNA, 425 bp, Gossypium hirsutum
  Clone ID: uC-gsflnu33B066f10b1
cttgcgcttagaggaggtttcagacatgggctattatccactcggaaatcctccctgcggtgagatatgcgtgaaaggaaagactattttctctgagtactacaaaaaccctgaactgacaagagaatctttcaaggatggatggtttcatacaggagacataggccaaatgcttcctaatggaattgttaaggttattgataggaagaaaaatcttattaagctctcccagggagagtatgtcgcactagagtacttggaaaatgtttacggagtcactacaatcattgatgatgtatgggtttatggaaacagcttcaaatcaatgctagttgcagtggatgggctacatgaagaaaatgctaaaaaatgggctgagtcgaatggatacactgatatactttctgagttcttgtttctgagta

SEQ ID NO: 19203 - DNA, 419 bp, Gossypium hirsutum
  Clone ID: uC-gsflnu33B066f11b1
ttaatttctcataagctaaacagatgttgttatatctcgaaatcatcacatcaatggcccgtacaaagcaaacagctaggaagtcgaccggtggaaaagctccaaggaagcagctagccacgaaggccgcccgtaagtctgctccggcgaccggcggagtgaagaagcctcaccgtttcaggccaggaaccgtggctttgagagagatccgtaagtaccagaagagcaccgaattgttgatcaggaagctttctttctagaggctggtgagggaaatcgctcaagatttcaagactgattcaaggttccaaagcagcgccgtcgcttgctctttaagaagctgcggaggcttatttcgtctgattgtatgagacactaacctttgggcaattcatgctaagagggtttctattatgccc

SEQ ID NO: 19204 - DNA, 468 bp, Gossypium hirsutum
  Clone ID: uC-gsflnu33B066f12b1
tctctcctttgttttcccttttgtctctctctctttttttccaaccctaaccctacctcaccaaccaggattcaacatgaagggaggaaaatccaagtcagatactaagagtgccaagctatccgtgaaatccaaagctggaaagaaatcggggaaggctgccaaggatccaaacaagccaaagaggcctgctagtgccttctttgttttcatggaggagttccgtgagcaatacaagaaggatcaccctaaaaacaaatccgttgcggctgtcggcaaagctggtggagataaatggaagagcttgtctgaagctgaaaaggcaccttatgtagctaaggcagaaaagcggaaggttgagtattgaaaagaacatgaaggcctacaataagagacaggctgagggtcccaaaaccaagatgttgagtttgacaaatcagtgtctgaggtgaatgatgaggatgatga

SEQ ID NO: 19205 - DNA, 260 bp, Gossypium hirsutum
  Clone ID: uC-gsflnu33B066g01b1
cagcaactctctgctcttcttcttccttaaacaagcaaaaaaaaaaaattatgggtggagaaggaaaggtctatactttggctgaggtttctcaacacaacaatgccaaaggctgttggcttatcattgagggaaaggtacatctttttgttggtaaaaatttcttggatgatccacgctggggttgcctttatgtttttttggtaaaaattggcttctttcgacttttccttattttttgccaaagttgggtgttttaa

SEQ ID NO: 19206 - DNA, 364 bp, Gossypium hirsutum
  Clone ID: uC-gsflnu33B066g04b1
ccggtaacgattaaaaaagattcattacccactccatttgcgcagaatatgatggtcgacggtctgtacggaggcctggtgtatgatgttgttagggttaagcggattattctttggaccactgattgtaaggtggctactaagatcattccgaccgaaaaccatattgtttgggaggatatagtgagcattcttaatccctacaatagctctgacatcttgcccttatcatgtgggggtgcattttcctctcgagcttatatccatgcaaatgcagatggatctttaaacttgacagtataaattatgttaagttggatgcaatcaacctgcctttctttgcataatattatagctccatgct

SEQ ID NO: 19207 - DNA, 286 bp, Gossypium hirsutum
  Clone ID: uC-gsflnu33B066g06b1
tcaactgttttcatcatctaacgataaacccaacttgggtttagggttcttggagtcctcggagccgcagctgccacctcctcctccccctgtcgaagtcctctcctcagaggtttcttcttctgtgaaatacactgtggagcctgtcaacttggatggccttactttactcaagggaagggtgagtactaaagaggttcttgggttgcctaacttgtatttagtccttggaatatatgaagggggacttaagctattggaaggtttcatttaccttgttaaagct

SEQ ID NO: 19208 - DNA, 423 bp, Gossypium hirsutum
  Clone ID: uC-gsflnu33B066g09b1
ttagagatgaggaaaatcatgggtgccaaaggtccttttttctttgctttgctttccttttcagctgactcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgataaggagacagacaggagctttggcctaaggaaattcaggtaccttgagaccatcaaaataacttgccgaaagggaaagtcctggagcttgtacatgtgctgatatccttgttctgtctgctagggaaggcat

SEQ ID NO: 19209 - DNA, 431 bp, Gossypium hirsutum
  Clone ID: uC-gsflnu33B066g12b1
acaaaagcctcttccttagctaactgtctaagcggctactttataccgcatctcaaccatgatcatcccagaaaagaaccgccgcgagatctccaagtacctcttccaagagggcgtttgctatgcgaagaaagactataatttggcgaagcaccctgaaattgatgttccaaatcttcaagtaataaagctgatgcaaagcttcaagtcaaaggaatacgtgcgtgaaacttttgcttggatgcattactattggtaccttacaaatgatggcattgagttcttaaggacttacctgaaccttccttctgagattgttcctgctactttgaagaaacaagctaaacctgctggtcgtcccatgggccctcccggtgaccgtccacgcggcccaccacgctttggtgacggtgagaggagatttggtgaca

SEQ ID NO: 19210 - DNA, 426 bp, Gossypium hirsutum
  unsure (1)..(426): unsure at all n locations
  Clone ID: uC-gsflnu33B066h01b1
attcacaagagaagcagccgctcctccttccatctcctaaacaagaatggattcgcaaattaagtttgctgtggtggtgaaaataatgggaaggaccggttcaagaggtcaagtgacgcaggtgagagtgaagttcttggacgatcagaaccggttcattatgaggaacgtgaagggaccggttcgtgagggagatatcctcacattgctggagtctgagagagaagctaggaggcttcgttgaagggttatttttatactttttggggtttatgcttgttttgaatagtctaccgtattgcttttgaattacgtttagtaggtattcgtatatcgagacttgcgatttgggagaatggttgttgcttaaacctggattttatgatgattatgttgaaatgaactgaatttgttntgagttttggt

SEQ ID NO: 19211 - DNA, 455 bp, Gossypium hirsutum
  Clone ID: uC-gsflnu33B066h03b1
tgcaccacaactacagagaagagagtaaaggggaaaaaaagcgtcgtcgtttttgcttcttcttctacttcgctctctctccttctccgaagttcctctttcgttctttcatttattcagtattgtaaaagatggccgacggtgaggatattcaacccctcgtctgtgataatggaactggaatggtgaaggctggttttgctggtgatgatgctccaagggcagtttttcccagtattgttggtcgtccccggcacactggtgttatggttgggatgggtcagaaggatgcctatgtaggagatgaagcacaatctaaaagaggtatccttactttgaaatatcctattgagcatggtattgtgagcaactgggatgaatatggaaaagatctggcatcatacattctacaatgaacttcgtgttgctcctgaggagcaccctgtgcttctcac

SEQ ID NO: 19212 - DNA, 357 bp, Gossypium hirsutum
  Clone ID: uC-gsflnu33B066h04b1
ataggtgacaagcctcgccccatcatcccctaccaggtctccgcggcgtccagtttactatgtgcagagcccttcacgtgattctcacgatggagaaaagacaacaacctccttccattccacgccggttatcagccccatggggtcacctccccattcccattcctccatgggccgccactctcgtgagtcttcatccagtcggttttcagggtcgcttaaacctggatcccgcaagatctcgcctaacgacgctccgtcaaggggagctcattggaaggggaataagcagtggaaagaatgtgatgggattcgagaacaatgtcttcttgaagatgaagtaatgtgagctcggac

SEQ ID NO: 19213 - DNA, 240 bp, Gossypium hirsutum
  Clone ID: uC-gsflnu33B066h05b1
gacggccgccctttttttgacaatgatgttcgtgctatgtgttctcattttttttatctgagtctggttttagaactttatttaagctcaattattctgcttcaaaataaaaaaacaaaatctcctatcaacacctcttactataaccattaaaatcaactcttctacataacaaaaaaggggcggtccttttagaggaccaaagttttctccccctttcatccaaactaacatccttta

SEQ ID NO: 19214 - DNA, 235 bp, Gossypium hirsutum
  Clone ID: uC-gsflnu33B066h06b1
atatatcataatgaaaggttttcgctccattcttattgtttctaggcctatttgctttcgcttgctcatcggtctcagcatatgaccccagttctctccaggacttttgtgtagctatcaaggacatcaagaatggcgtgtttgtaaatggtaaatttagcaaagacccaaagtttgcagttgcagaagatttgtttttttcaggcctaaacaggccggggaacacatcaaaaat

SEQ ID NO: 19215 - DNA, 116 bp, Gossypium hirsutum
  Clone ID: uC-gsflnu33B068a02b1
ctattgggccctattacattaattttgggtgtttgctttgtaactttgtaactttatgtcatattagtattcttatcttgaatttcagaattttaatttggattaaaaaaaaacaa

SEQ ID NO: 19216 - DNA, 402 bp, Gossypium hirsutum
  Clone ID: uC-gsflnu33B068a03b1
tttcacgccttcctcatctgcgccgcccccaattttctcccttactaacaacaaaaaccctgaaatgtcggacgacgatcatcatttcgaatccaaggctgatgccggcgcctccaaaacctatcctcagcaagccggtactatccgtaagaacggctatatcgtcattaaaggccgtccctgcaaggttgtggaagtttccacctccaagacggggaagcacggtcatgctaagtgtcacttcgttgggatcgatatcttcactggcaagaagttggaagatattgttccctcctcccataactgtgatgttccgcatgtcaatcgtactgactaccaattgattgacatttctgaggatggatttgtgagcttgctgactgatagtggtgatactaagga

SEQ ID NO: 19217 - DNA, 158 bp, Gossypium hirsutum
  Clone ID: uC-gsflnu33B068a06b1
gtaatttttaagctgacttttcgccaaaccgggaataataccagaacgacgccgtcttcttcttcagcgactaatctatacgttcaaactaaaccatttgtataatgatatgatttatcacggctctgccatttcggacactttatttacaaagtcaa

SEQ ID NO: 19218 - DNA, 445 bp, Gossypium hirsutum
  Clone ID: uC-gsflnu33B068a08b1
ttatgataccttctgggagaatttaacagtggttattaatgcattggataacgtgaatgccaggctttatgttgatcagaggtgcttatatttccagaaaccgcttctcgagtctggaactcttggtgccaaatgcaacacacagatggttattcctcacctaactgaaaactatggtgcttcaagagacccacctgagaaacaagctcctatgtgcacagtgcactcattttctcacaatattgaccattgactgacatgggctcggactgagtttgagggtctactggagaaaactcctgctgaagtgaatgcttatctgtccaacccagtttgagtataaaactgcacaaaggactgctggcgatgctcaggcatgagataatttggaacgtattcttgaaatgccttgagaaaatgagaaggtgtggtgaatttttttttt

SEQ ID NO: 19219 - DNA, 81 bp, Gossypium hirsutum
  Clone ID: uC-gsflnu33B068a12b1
acgatcacgcgtccaggggagcctctcactcgtcttctgccacttgctcttggactttaataccttgggaagcaggaaaga

SEQ ID NO: 19220 - DNA, 373 bp, Gossypium hirsutum
  Clone ID: uC-gsflnu33B068b01b1
atctcccgaccttgcacccgatcaatgacagtctaatgtatggttacgctagctatcttgaagcccaaattcaatgctggtcgaacttgcggatcccgctgaagatgcaaagatgcccgctcttgctgctggaaccataaactacgatgtaaagggaagacaaccagcactcagaccatcatcttccaagtggagcgaaggaagatgtccgtgaggggaccacttatgcgcacatactgaatcaagacctgtatcccagagtcgatcaaactagcccttgagagacgagcgactgctgtcaagctagcatgaagccaattcatgctaagctaatgaagctactcattcaactagcctaaagattgatagtatt

SEQ ID NO: 19221 - DNA, 413 bp, Gossypium hirsutum
  Clone ID: uC-gsflnu33B068b06b1
atagacaacaacaggagcaagagcttgcaaagcacattgcagaggaagatgacgacgagttttagtgattaaaattcgaaaagttactttatccaccatatgatggtttgatcaagttgtgcattttcctttttaaaagtgccctagtagaactagaaacgcttttggttttattttcgcaatagctactatttccattgataacattgctttacagtcctacaccatggagttgcactttatttgtatttttattttcctcccttgatttcaagttttattccttgaaaaaaaaaattacacattttatctatctttctttttcttaataatacaacttttttttaatcttctttttactttttctatttcaattatcttctaaaaaaaagggggggcccccttttaaagga

SEQ ID NO: 19222 - DNA, 156 bp, Gossypium hirsutum
  Clone ID: uC-gsflnu33B068b08b1
gtccttcatcaacggattgtctaactttgtcatctctttttcccctatttttttttgttttcttctttttttttttttcttgtattgccttgctctctcttttatgcttttataaattttggcaccttccttataatgccttccttcttctttttt

SEQ ID NO: 19223 - DNA, 363 bp, Gossypium hirsutum
  Clone ID: uC-gsflnu33B068b09b1
ttcccgtctctgaccaaagcccccccttgccgaccaggaaattaatagaactgcagagatggcttctgtttttcttgcagctcgtaaagatactctgataatgagcagcagagaactcatcactggaaaaactgcttctgagagtttggagatcaatttcaaagtgagctctgcacttgttgaagtagttaggcggataactacaagacctcgttacattctggccaagggtggaatcacttcatcagaccttgcaacaaaagctttggaagcaaaacgtgccaaagtagtcggacaggccctagctggaatacctttgtgggagctagggcctgaaagttgacatcctgcagtcccctatat

SEQ ID NO: 19224 - DNA, 156 bp, Gossypium hirsutum
  Clone ID: uC-gsflnu33B068b12b1
gtcctttactgcaattgaaattcacaatcttttcccaaagcaaccaaaaacacaatttctgtttattgtttaaaattttttttatcgtttttccatggctaaacttgatgacactggaggtgatataagttgggacattgtagatagtgagttttg

SEQ ID NO: 19225 - DNA, 401 bp, Gossypium hirsutum
  Clone ID: uC-gsflnu33B068c01b1
atcaaaccgtaaaattccgacgaaatctgccgtgaaggatgaatgggaaggtggagtcaattcgcggttgcggtgactattctggcggtgggcatcctttcggcatcagccaccgctagaccctgcaagacattcttcgcggcctcctattctttctcttttgaaaaccctaacgacccttcctcctccaccggattcgacaccgtcttcaccgagatcggtcaattgagcgttgtaccaccgaaacccaagccctccgatgtcttcagctctctccgtgagcgcagtaaggacatccttagcgtgatcgtagctcttttttacggcgttggttgcggtgctctcacggccggctcccctctacttggtctggacccttttctcggaacggcctgaatatc

SEQ ID NO: 19226 - DNA, 218 bp, Gossypium hirsutum
  Clone ID: uC-gsflnu33B068c05b1
gtacggactacgaggcgtacagttccattcctctttgttagaggagatggagtcatactggtttctccacctctacgcactgcttgattgggaggacggagtttcaagcacacgaaggaaactttgaggaaggcagaagagatttttgggacagataacaaagatctgttcctatcattctcagggactgctaaatcgatacattcactagatttcaa

SEQ ID NO: 19227 - DNA, 214 bp, Gossypium hirsutum
  Clone ID: uC-gsflnu33B068c10b1
taagggtggcactgactatgtactttatcataaaggacagccactggcaaatattagcttacagattccaggagctcataatgtcctcaactctctagctgttattgccacagggacggtactcttacaaggccgccgacaagtacatgaactaataaactctttaaagttacataagctcgttcccaatgctcctcctagcccgctttgcgag

SEQ ID NO: 19228 - DNA, 75 bp, Gossypium hirsutum
  Clone ID: uC-gsflnu33B068d03b1
gtcactcattcccatagacgagaaatagtaccttcaatgttaaatgagcaacatcactgcccccccactacactt

SEQ ID NO: 19229 - DNA, 301 bp, Gossypium hirsutum
  Clone ID: uC-gsflnu33B068d04b1
ttggactgaagaattaaccaaagtctacagtagaaaagccggatctgctcattagtcctttgatcgaagacgcagggcactgttggaaaatatggctgctgtcttctacattttgacgacacctagggcattgagcttccaccacaactctctttaagtctgagtttaacaagggacggaatgaagttctatgagattctccatactgaactagaatttttaaggggatgtatattttccatagtctttttttgaacattcttattttcgccatctgatttctttttttttacgatcccct

SEQ ID NO: 19230 - DNA, 60 bp, Gossypium hirsutum
  Clone ID: uC-gsflnu33B068d08b1
tcacgcgtccgtgactgagctcaaaggactgaaaattttaaattatgtacccaataaagg

SEQ ID NO: 19231 - DNA, 210 bp, Gossypium hirsutum
  Clone ID: uC-gsflnu33B068d09b1
tacaactctgccgggtcatctatgcctcataatcccactgatcttcacctttcgttacctgaaatgcacctttctcaccttaataacatacttggtattcatggtagtaatactaacttcatggagagtaaatacaatccactgcttgaaaacccagggccgatcgatttcttgtctaggaactatgacgttatggcgaatggttagttt

SEQ ID NO: 19232 - DNA, 400 bp, Gossypium hirsutum
  Clone ID: uC-gsflnu33B068d11b1
ttcaatattgagcaacagagccctgatattgcccagggtgtccatggccacttcaccaagcgcccagaagaaattggagctggtgaccagggccatatgtttgggtatgccactgatgagaccccagaactcatgccccttagccatgtccttgcaactaagcttggggctcgtcttactgaggttaggaagaatggcacctgcccctggctaaggtctgatggtaaaacccaggttactgttgagcactacaatgacaagggtgccatggttcccgttcgtgttcacactgtcctaatttccactcaacatgaccaaactgttacaaatgatgaaattgctgttgaccttaaagagcatgttatcaagcctgttattcctgaaatgttcctagatgaga

SEQ ID NO: 19233 - DNA, 334 bp, Gossypium hirsutum
  Clone ID: uC-gsflnu33B068d12b1
taactgactcagcagatgtgggatgctaaaaacatgatgtgtgctgctgacccacgccatgaccgttacctaactgcctgtgccatgttccgtgcgtatgatgagctcattcgaggtgagccttctgaagtaacaatcaaaatagcggattaatcgatttttaattcgcttagattaatcttatggaattaagctccccggggcactgcgatactataactctcggacgtagtgtccaagttgtgaagaggttccgtatgctgtatcgtatgaatcctcttcctgttgctggaactaagcgatcctgtaagggatataatatggaggcaataat

SEQ ID NO: 19234 - DNA, 184 bp, Gossypium hirsutum
  Clone ID: uC-gsflnu33B068e03b1
taaaatcgagagaaaaaaaaatggggcttgaagaaaatctcaaatcaatgaacatcaacgaagaagaaaacaagaaccctaagaaccctaaccctaacactaaagatgaagaagatggtgaacttgaagaaggggagatcgcaggtgaagaagatgatacgacgtcctttacgttaaagaaagg

SEQ ID NO: 19235 - DNA, 174 bp, Gossypium hirsutum
  Clone ID: uC-gsflnu33B068e06b1
taatcttttgggtttacttatagttgggagaatttgattaaagactggtaacttgtcttccaacttttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggac

SEQ ID NO: 19236 - DNA, 110 bp, Gossypium hirsutum
  Clone ID: uC-gsflnu33B068e09b1
ttattgttttcagttcctgaacaatgtttcttttcgggatcaatagtttaataaaatcaaaggtgagatgttgaaaaaaaaaaaaaacacaaaaaaaaaaaaaaaaacaa

SEQ ID NO: 19237 - DNA, 351 bp, Gossypium hirsutum
  Clone ID: uC-gsflnu33B068e10b1
tgagaaacgaaaagaaaacagatctggaaaatcaccttttttgctttgtattgcttgtatatcttgcgtaaaatgtgtaggcattcgtaacctttacatagactaagaactatggctttatagccgaaggaaaaaagaaaaaggaaaataaattaaaaatgccattttttcatttgctgttctgctatttttgtttgtgtttgttgccgtgttcgtcctttcttttgcaggtacgggatgcgctggcccttgacgtgagactgtgctggtgcgtgtgatatcttctagatggtttactttactctctttctttttctactctttacttcttctatttatatttttccttta

SEQ ID NO: 19238 - DNA, 171 bp, Gossypium hirsutum
  Clone ID: uC-gsflnu33B068e12b1
tgaattaagaagtctgactatagtttaatcaacaagctggttccagtttgtgaatttgcaataaagctttgtggcactgatggtacagtctcttgcatggcttcctattttgtctgcaataccatactcgctagcattatagcacgtgctggtggtataaattactatgat

SEQ ID NO: 19239 - DNA, 409 bp, Gossypium hirsutum
  unsure (1)..(409): unsure at all n locations
  Clone ID: uC-gsflnu33B068f02b1
tcacgcgtccgaaaaatttgtttctatcagcattgctttgcattgctgttgcaggagttttgggtcaagctcctagtaatcctcctacgtctacgccggcgccacccacaccaccggcttctactcctcctccgacgactcaagcaccgcctacaccaaccgccactccgccactggtttctactcctcctcccacttcatcaccgcccccagtgacagcttctccacccccagtttcaactcctccacccagttctcctcctcctgcaactccaccacctgcttctcctcctcctgcaactccaccttcagcttctccacctcctgccactcctccaccagcttctccaccttccgccactccaccacctgcaaccccaccgncagcaactcctcctcctgctacccc

SEQ ID NO: 19240 - DNA, 254 bp, Gossypium hirsutum
  Clone ID: uC-gsflnu33B068f05b1
ctcacgcgtccgcccacgcgtccgcccacgcgtccggtctgttggaacaaactttttctatgaagcctagtagtttaaccttgtgaaaaatgtttggtttatgatgttaaaagagaaccaacgatggaggtgtgagtttgattgaattatattattaattgtttcattatctgatttatggttatgatgcatattgtctacatatacaccttttctctttacttttctttatcttctatttatatcttctcttc

SEQ ID NO: 19241 - DNA, 159 bp, Gossypium hirsutum
  Clone ID: uC-gsflnu33B068f12b1
tttgtctctctctacatctctctgaacctaaaggtctttagcttctcgctacgagagagaccatgttggtttaccaggatctcatttccggtgacgagcttctttatgactcatatccctacatggaaatcgagaatgggatgctgagggaagttgagg

SEQ ID NO: 19242 - DNA, 78 bp, Gossypium hirsutum
  Clone ID: uC-gsflnu33B068g08b1
caaagcacatgcttagcgatacaatccgccgatcaaattagggggaagtatgggtgtatataacctacaactgaaacc

SEQ ID NO: 19243 - DNA, 413 bp, Gossypium hirsutum
  Clone ID: uC-gsflnu33B068g09b1
tataaatgggttttgaggtccttggagacaatgattcccctgtaatgcctataatgctttacaatccagcaaaaatccctgcattttctcgagagtgcctcaaacaaaatgttgctgttgttacagttgctttccctgccaccccactacttttagccagggcacgtatttgcatttctgcctcgcacaccaaggaagaccttcttaaagcgctagaggttattagtcaggttggtgatatggtgggcataaaatactttcctgcagagcctaataagcagcagcaggaccagcaacagcagcagccggggaaagacacaatcaagttggactgaagggtttttgaaacaggctgacgttgaattgcttgctttgcttctagcaggtaccgtaaaattgatgtttgaatagga

SEQ ID NO: 19244 - DNA, 172 bp, Gossypium hirsutum
  Clone ID: uC-gsflnu33B068h04b1
gtgtctctctcttcatctctctgaacctaaaagtctttagcttttcgcttcgagagagaccatgttggtttaccaggatctcatctccggtgacgagcttctttctgactcattcccctacaaggaaatcgagaatgggatgctgcgggaagatgaggtgtagacgatcttg

SEQ ID NO: 19245 - DNA, 414 bp, Gossypium hirsutum
  Clone ID: uC-gsflnu33B068h06b1
ttacgcgtccgtgaagggtctgcaggcacttatattggcaatggtaatggttatggcgatcgctacaactgatgctcaaagcatttgcaacatgccagcttcaggtttgatggcatgcaaaccagcagtgaccccccccaaccctccgccgcccacgtcaacttgctgctccgccctctcccacgctgacatgcgttgcctttgctcatataagaactccaagctcttgccttcccttggtattgacccaaaccttgccatgaaattgcctagcttgtgcaagcttcctcatcctgcaaattgttagttcctggttctccatatttgatctcaaatgtgagggaaaatcatgcttattataagcctctacttcacataattgtactgaccttcgggttttcttttttcctttta

SEQ ID NO: 19246 - DNA, 79 bp, Gossypium hirsutum
  Clone ID: uC-gsflnu33B068h10b1
ttgggattcattctctcgttctcattttatggctaggaaaaaccatctttatcagggatcctgttggtataccaggatc

SEQ ID NO: 19247 - DNA, 180 bp, Gossypium hirsutum
  Clone ID: uC-gsflnu33B070a02b1
gcgtccgcgatttttaactcactctcgactcagagagtccaattgtagcaaatcgcaaaaaggtttatagttttccttatcactgccggtaatgctttccggcagcaaagcgtgaacagaaaatcaagctttctcgttgtcgctttctaaagttttttttccctctgttgttttcgcgcg

SEQ ID NO: 19248 - DNA, 444 bp, Gossypium hirsutum
  Clone ID: uC-gsflnu33B070a09b1
tggcacacaagaagtatgaaccatttttgaataaaagcattgatcattatgatgaaatgacttttgttgttggcaaagatatggcaatagggagttttgccaaaacattttctgacaatgaagagactgaagaggtaagaacaaaagtatcttcatctggcacatccaaatgtaaaagaaaaaatgttcaataaagtgtcgttgatgacaaaattaaatttgtgggtgaacaacttggcaaaattgctaatgctttggaacaatttactgcggataagacaccacatctttacgaagaagtgatgccgatggaggaagaaggatttgatgatgacttcctgtgttctgtgtttgattatctagatagtcatgaatctgaagccaaatcttttttagttttaaaggtagaagcataaaaaaaatttggcttcgaaaattttctaa

SEQ ID NO: 19249 - DNA, 483 bp, Gossypium hirsutum
  Clone ID: uC-gsflnu33B070a10b1
cacgcgtccgggtggaccagccgagattattgtccatgggaaatctggtttcaacattgatccttaccatggtgatcaagctgctgacatactcgtcgatttctttgaaaagtgtaagaaagatccatctcactgggataagatctcccaaggaggcttgaaacgaatagaggagaagtatacatggaagatttactcggagagactattgaccctgacaggagtgtatggattctggaagcatgtttccaaccttgaacgccgtgagagtcgtcgttaccttgagatgttttatgctcttaagtaccgtaagctggctgaatcagttccattggcagaggagtaaattgaagctgttaaataacattgggcccggttttcttggagaataatattctggtttgtaatttcatttggagaagcttcctttgtattttatcttggcctttcccttttcctttttccgccgcattgtcttgaaca

SEQ ID NO: 19250 - DNA, 322 bp, Gossypium hirsutum
  Clone ID: uC-gsflnu33B070a12b1
attataaaaatttaatttaatcctttacaaattataaaaatataaactataaaaaattaaaatttcatccggcccccttaaaaaaattttctagctttgcctctgctcccgtggaggtttatcgtttagatggggatcatttaacccacgaaaattgacccgattcaaagaactgttgaagaaacctatatttgaagcttgggctggcccaatgatacggatctggaatgttaggctctctttgatacttcgctattcttattttatatgtttgaatagtatattattttcttttcttctcttcattccccttttttttcct

SEQ ID NO: 19251 - DNA, 334 bp, Gossypium hirsutum
  Clone ID: uC-gsflnu33B070b02b1
gcgtcgcggcatacggtcctggcagaaacatggcctacggaatgaccgaaaccgaaagttgccagtaccgcagtgaagtatactattccaacgagtcacactacaacgacggcggccgtggacaccaccacgctggcaaaggtgaccaccctgtcaagggtctgctaaggaaaataaagggtggcatttaacgtaataaaagctgcagcgacagcgacagtggcagcgacagcgatgatgatggttacgggaagaagacggtcttcgtgagcaaggcaatattgataagacatatatgataataaaaataaatttggttgaagatgtttttctt

SEQ ID NO: 19252 - DNA, 85 bp, Gossypium hirsutum
  Clone ID: uC-gsflnu33B070b04b1
aggagaagaaggggctcttcttggggcattttgcggatcgatgcgggctctactcttcaagcgacgaggaagaaggtgtaggaga

SEQ ID NO: 19253 - DNA, 452 bp, Gossypium hirsutum
  Clone ID: uC-gsflnu33B070b07b1
caatgcaactctcaaccattacaatacctcattcggcaatgctatcaacaaggatttgaaggctgatcccagtgatgaattcctcaaattactaagagctgtgatcaagtgcttgaccaccccagagcaatatttcgagaaggttctacgtcaagccatcaataagttgggatccgatgaatgggctcttacccgagtcgtcacaactcgtgcagaggtcgacatggtacgtattaaggaggcatatcaacgaagaaacagcatccctctcgaacaagcaattgctaaagatacttcgggtgactatgagaagtttcttcttgccttgatcggagctggagatgcatgaaccgtcttcggtattaagttcctctgtatgaatgtctagtttgccttatccgctatgacttaataatttatgcttggttttcatcggtttcatatttaaagca

SEQ ID NO: 19254 - DNA, 313 bp, Gossypium hirsutum
  Clone ID: uC-gsflnu33B070c04b1
aattcaagcacgggaagcatgggaaatttaagcacggaaagcatggaggcggcaaattcaggaagtggaagtgatgttactgcccgcaaaagcatggagaattgggagtcaaaactgatagtgtcgaatgaatgaatgtaataataatttgacttcaactgctttgtattgaataatcacagacttgcttttctttctttttaattgttgacatataacattaacaacatttgattcaacgatctgatattatgcattaccacttacgagacataactcgtaacatgtcattgtaaaccctgaatatttcaac

SEQ ID NO: 19255 - DNA, 448 bp, Gossypium hirsutum
  Clone ID: uC-gsflnu33B070c12b1
cgcgtccgagcatggtctcctggagaagcttcaccgatcagatagcagcagctccagctcttcaagcgacgaggaagaaggtgaaggagaagagaagaagaagaagaaaaagaaggagaagaagggactggaagaaaagattgaagagaaattagaaggggaaaagaaagaagaggacacctcagttccagtagagaagtgcgatgagccagtagtccagccagagacgccagagaagaaaggtttcctcgagaagatcaaggagaaactccctggacaacacaagaaagccgatccgggcaaattcttccgggaaaagttgttgaagcagggaaccgtgatgccaatgccggacattaaagataaaatgcctgtaaggtcatttttgccccggactattgtttcaaaattaccattttctttctccaagtttggtgaattgaaagcg

SEQ ID NO: 19256 - DNA, 152 bp, Gossypium hirsutum
  Clone ID: uC-gsflnu33B070d03b1
atgcttagtggagtatagaggagttagagccttcttgaacttactgcaatgacatcaatccctgctgcacctgtggtccagaagaagccgctaataagattgaacttcacgtccttgggtaaggcttccgagaaaagttggccaaagggggg

SEQ ID NO: 19257 - DNA, 81 bp, Gossypium hirsutum
  Clone ID: uC-gsflnu33B070d09b1
ttgggtttgtatgctacgcggagggggattaactgaatgttattcgcaccagatcaagcatttaactatcaaaacacagtg

SEQ ID NO: 19258 - DNA, 292 bp, Gossypium hirsutum
  Clone ID: uC-gsflnu33B070e05b1
cgcgtccgcttcatgtggttatggagtggcaactgggggaccattggcttggggtctatgctacaacaaggaaatgagtcctagcaaattgtattgtgatgattactacaaatacacctacccttgcactcctggagtttcttaccatggccgtggtgccttgcctatctattggaactacaactatggagaaacaggcgacgcattgaatgtggacttattgaaccgccctgattacatagataacaatgcaaccttagcttcccaggctgtactctgtagatggatgaca

SEQ ID NO: 19259 - DNA, 220 bp, Gossypium hirsutum
  Clone ID: uC-gsflnu33B070e08b1
cattttgtctttgcgccggtcttctatctcctcgacttacttcccagccaaaggtaagccatggttaagcataacaatgttattcctaatgggcactttaagaagcactggcagaactacgtgaaaacttggttcaaccagccagcaaggaaggctagaagaagaattgcaaggcaaatgaaagctagtaggattttttcaagatctactgatggtccat

SEQ ID NO: 19260 - DNA, 267 bp, Gossypium hirsutum
  Clone ID: uC-gsflnu33B070e10b1
aagagtgtcaaatcaccggcgaagaaagctacgacgaggaggggaaagaaatgagaagggaggctagtcgaaataggggtagtcttgtaaattggagtgatgtacagtgggtgtatatggatccatgtatacccacgaaatataacattcagatctcttttttaatatttttatttgagttggttttttttttcgtgagtttaaaagttgaaacagttgttagatgtaactttcagttgaatgtatttatgagataaacttagagtt

SEQ ID NO: 19261 - DNA, 297 bp, Gossypium hirsutum
  Clone ID: uC-gsflnu33B070e12b1
ttgagataaaagatcaaacaaagctatccactcctttttctcagatccgaaacgccgtcgtcttagtcggaaccacttcgatccacaatgtcttctactttcagcggcgatgaaacggcaccgaaacttcggcttcctcggcgccgctgctgctctcgtcttctcctgtatgggagctgcatatgggacggctaagagcggagttggttggtcattaattgatatttcttccttatattttaagctcaccttaactaacattttcttatccatttataatttttaattcatatattt

SEQ ID NO: 19262 - DNA, 226 bp, Gossypium hirsutum
  Clone ID: uC-gsflnu33B070f03b1
ctcgttcatgaaactattcaaagttcagttggtgcagaagggttctggtcctactatccttatggaactacggtgtcgataatcatcacagtgttagccatggtattggggcattataacgggccctcactgtttttcttcttgtccttcagactctttcttttcccttctattatgtcaccccacaatcctcatcatttgggcaatcctccgccccacaatacct

SEQ ID NO: 19263 - DNA, 422 bp, Gossypium hirsutum
  Clone ID: uC-gsflnu33B070f04b1
cgcgtccgggatgaaggagctcttacaagagttgtttgcactagggctgaggtggatctaaagatcatagcagatgagtatcagcgaaggaacagtgtcccactgactcgtgccattgtcaaggacactcatggagactatgaaaaattgctgctggtacttgcaggacatgtggagaattgaatctgatatcatgagacaatttcctggtgaataaatgtttatgaccaaactataatggtctagtgtggttattgatgttttcctgattttctttgtcatttttttagtttttcttattctttttctttttagtcttttctttattcccttttatctatttttttttctctttctatatttttctcttttattattatttcattatcttttattttttattatttattttatatcctttc

SEQ ID NO: 19264 - DNA, 358 bp, Gossypium hirsutum
  Clone ID: uC-gsflnu33B070f07b1
agcaatactaagctaattctcctccatccttatatccaaaaacaaggaagctcaaacagattatggctccttgcttttgtctccttcttcaccatagctttccttctaactcttatatacaccagagagtcgattactactaaaactactgccccaagcacaactgtcaccggccctgcaggctccgccattggtggtccgccgttgccaaacaccgtggtcaacaccctccttcactatgcttcaaaatccaacgatagttaccacatggcatactcagagctcaagccaatctccgatgtgctgaggaaatgtccttccccttgcaacttcccttgttttcggtcttacacatgaa

SEQ ID NO: 19265 - DNA, 465 bp, Gossypium hirsutum
  Clone ID: uC-gsflnu33B070f08b1
ctcttccaccttggttcaccgaggaagatctcgcaacatacggagctttatatgagaaatccggattcaagactgcattacaagttccatataggtcattcgatgaagactttgggataacagatccaatagttaaagttccggcattactgataatgggttgcaaagattatgtcttgaaatttcctgggatggaagaatacataaagtttgggaaggcaaaagaacttgtacctgatttggatataatataatcgtctgaaggaacccactttgttcaagagcaatcaccctagctcgtgaacaagttaattctgtacttacttcttagccattttgtgttagtgcgccttgtctattatttacttgctttctatcgtttcttttattattttctgactctttatcttatttttctattcttttatatcttattatttcttcttccttccttttttttttatt

SEQ ID NO: 19266 - DNA, 176 bp, Gossypium hirsutum
  Clone ID: uC-gsflnu33B070f11b1
aacagaaggctgaggatgaagctgccgattctgccaggctcgcagactttcagaggaaggtttttgatgtcttatacaaggctgctgacattccttatttaagctcacacaagcattaaattcttgattatattcgagcatgctgtgacacagtcggaatcaacaattggagtagt

SEQ ID NO: 19267 - DNA, 495 bp, Gossypium hirsutum
  Clone ID: uC-gsflnu33B070f12b1
ccaccaaagattgtcacaagcaaagcaatcacaactattacagggataataatttgtaaatctccattcgcctttaattttctccgaggaagtgaaggaagctttgagtagtctaggctttgagctttcccaattttactgaagctccaccccagaatatactggctgctaaccacttcaccagtcgatgaagagaaaccaacatacatagaatccaataaaccattagaaagatcaacggttgttaataaaagcagttggctcggtttgttgcttcccataggagctagtgttacattcagcaacttgtccacttgctcgaatcgatccacagctgcattggatttccatttaagagttccaagcttctattttgcccttcatcttcgacgaagtatgctgtcgaagctgtttccaaagatctcaagttgttcacgtcaatgccaacatgacccccgttgatgtcttcaaattcaaggctttgaactgtgtcta

SEQ ID NO: 19268 - DNA, 433 bp, Gossypium hirsutum
  Clone ID: uC-gsflnu33B070g01b1
aagggagagaaaaatatgggaagaggaaaattcaagggcaagcccaccggccaccgccacttctctactcccgaagagctccgtgctggtacctcagctcgaccccgtacatttaggaaggaagaagctgaagtagaggaagaagaagaacgagaagagtctgaagaggaaatagaagaagagcccgagaaacgaaaagggacccaagggcttattgagattgagaatccaaatttggctaaacaaaagaatgtcaaagccaaagatgttgatatggggaaaacaactgtaactctctaggcgtgaaagagtgccacattgaatatgtttattcctattatccatatttttatgctccatgaacattttttcttcttctatttaggtttctttttataatctattcttttccttattttctatctttcctttt

SEQ ID NO: 19269 - DNA, 268 bp, Gossypium hirsutum
  Clone ID: uC-gsflnu33B070g02b1
gcgtccggaagaatatacggcgtgggaagcggcggcggcggagaaaggttttattccggcactgaatgatcactttcgaagtcttcgcacggagcaccattgcaaccgcctgacgcttccggggattagtgttgctgagattggaagcatcaaggacacggtcgtttgcgttgactgcggtaagccgatggaagcgctccttatgtttccgcttgctgacccgattgatgtctaagcgcgttcttattcgtccgagctttatttgtaa

SEQ ID NO: 19270 - DNA, 354 bp, Gossypium hirsutum
  Clone ID: uC-gsflnu33B070g04b1
tccctgcaaagctcgcctcagcggttcctgcacaggcttctttcttcattgcttatgtggtgacatccggatggacgagtacttcatcagaactttttcgcataatccctctcatttggagtctgatacgaaaacccttcacttgttgctcagacgaagagtttgaagttccatcgattccttaccacatagacattccaaggatttttttattcggtacttcttggaattacatatttttttcttgcaccattaattttgtccttcctcttggattcccttttgatttcttattaaatttatccaaatttgtttctatatttccttttctcccattttcttcctatttttctt

SEQ ID NO: 19271 - DNA, 252 bp, Gossypium hirsutum
  Clone ID: uC-gsflnu33B070g09b1
ggcctccctgggggtgccacgcttccagccgcgtataggcgaccctatagtcattctattgggcgcctaattacacttcactggccggggaatcccaggggctgcccatggtaaaaccccgtggttcaccaccctcatttcgccctggcaggccatctccccttttaggcgctggcggattgcccttccggccagttccgcatcgctgtttgcaacatgggacccgcccgaatggggcccgttacgcgccct

SEQ ID NO: 19272 - DNA, 342 bp, Gossypium hirsutum
  Clone ID: uC-gsflnu33B070g12b1
gcgtccggaacttttcaatttgctttctatggggaactcgggagaaaatgactctgcgttcagctcatgataattctttgcaacctactgaagcaaagtccgccaaggaggcaagtgatgttaaacaagatactatatttgaaaagtcaagcacagtgtctttcattttccgtcctttaacaacttactatgcttcccaaacatcaatctatcacgagcactgttacaaagtccaacggtagatctctaagcctttcctattaacgctcattttttcatttcctattggccttttttttccttcattccactctttctttctcttactctcaccctcttctc

SEQ ID NO: 19273 - DNA, 388 bp, Gossypium hirsutum
  Clone ID: uC-gsflnu33B070h07b1
aggaacaaccaactaagctagcccagtcaccccctccccaaaggaaaatatggcgccaaaatcgttctcatttccggggattttccctgcacttctcgcctcctcacttgctttactcctattaccgactccaatcatagccgtccacgactaccacgatgctctccgcaagagcattctctttttcgaaggccaaagatccggcaaactcccacccgaccaacgagtcaaatggcgccgcgactcggcattgcgcgacggctccactgctggcgtggacttaacgggaggttactacgacgccggagataacgtaaagtttgggttcccaatggcgtttaccacgactctattagcttggagtatcatagatttcgggaggaacatg

SEQ ID NO: 19274 - DNA, 344 bp, Gossypium hirsutum
  Clone ID: uC-gsflnu33B070h09b1
atcaaggcactgctccaagaagaataagcctgcaaattaatctttctactggaccaatgaaaggttctgcaggctgtgtcgatggtgggagcatgacaagtcctggcctcgttgaagaagaagttcagtctgctctaaccgaggtcacagaagctgaagctgtaggacagacttctagctctgatgagtcagagatgaatattgtaaaccaagccattgctcctagaagaatacgtttgcaactttctactgggccaatgaatggttctgcaggctgtatcgatggcgggaacatgacaagtcctggccttggtaaagaagaagtcttgccttgtctatctgtt

SEQ ID NO: 19275 - DNA, 213 bp, Gossypium hirsutum
  Clone ID: uC-gsflnu33B070h10b1
gtaaagcgttagacggtgtaaatggagtgcaagtggttcctcgttcaccttttgcattggaggagataaaccaacaaagggaattccaatccactcatgataaatcattttttacagcaaatcaaccactattgatgcaagtatggcagcagaggccatcttgtttaaggccagcaagatgttgcatgaaaggtgttctcaattttttctcct

SEQ ID NO: 19276 - DNA, 368 bp, Gossypium hirsutum
  Clone ID: uC-gsflnu33B072a11b1
tcttacgcgtccgcccacgcgtccgtggagatcgctgccgattcactctacaaggccaagctcatccgcggtttctgccacttgtacgacggtcaagaagctgtcgccgtcggcatggaagctgccataactaaaaaggactgtatcataaccgcctatcgtgaccactgcacgttcgtcgctcgcggtgggaccctgctggaagttttcgccgagctgatgggacgccaggctggatgttctaggggcaaaggaggttcgatgcatttttacaagaaggattcaaatttctatggcggtcacgggattgtcggagcccaagttcctttaggatgtggcttggccgttggccaaaagtattcttaaga

SEQ ID NO: 19277 - DNA, 338 bp, Gossypium hirsutum
  Clone ID: uC-gsflnu33B072a12b1
tctatttgagcctggaggactactgcgttgatgaaacgatgatttgagtgtgctggagtctgatctggattcagcaaaggaggaatatgcttctaaagtgaatgttcatccaccagagataatcattgatgatgtccatcttccccctggcccttctcatcatcatggttttttccatcatcatgctgaggctcacgggcctttctgctctggaggtgtagtcatagcatctagagatggaaaaaccgagcttgagaataccttggatgcaccgctggatgttgcattcaataagaaaactttcagagatccccgagtggctttttggacaggttgct

SEQ ID NO: 19278 - DNA, 505 bp, Gossypium hirsutum
  Clone ID: uC-gsflnu33B072b01b1
gtttttgaaaagaagcaatgacaaacttcagcaatggagtccacgttctaatgatcccattcccagcatcgggacatatttttccccttatggatttagcccaccaaatcctccttcgtggcttaacagtgacgatcatggtcacacccaaaaaccttcattatctcaactcgctcctctctttacattcttcttccaatcttcaaaccttggtccttcctttcccttcccactcttcaatccctcatggtgtcgaaaacatgcaagacgttgacatatcttttgtcccagattttgctgctgccttgagtaagctccaagatcctttagttaactggtttgaaaatcatgttttgcctcctaccgccattgtttccgacatgttgctttgttcttggactcttttgttagctttccgtcttggggtcccgaatgtatgtttcgtcgtcaccaatgctcatgcagtgtcttcttggtgggtgaatgatcttgattccatgcctga

SEQ ID NO: 19279 - DNA, 429 bp, Gossypium hirsutum
  Clone ID: uC-gsflnu33B072b11b1
tttcccttggtttcttgttttctctctgttgaagttcaaaataataatgggaatgaggagaagagaaatgggtttttatttcctggctttcttatggttttgggttcctataaacggattgctttctcctaaaggagtaaactatgaagtgcaagctttaatggctataaaggatgctttgcatgatcctcatggtgttcttgacaattgggatggcgatgctgttgatccatgtagttgggcaatggttacttgttcacctgaaagcctagtcattggcctgggaagtccaagccagaatctatctggtacgttatcttcaagcattgtgaacttgacatacctccggattgtgctcgtgcagaataataacattactggaccaattccttcagaccttgggaagctctcaaagattcaacacttgat

SEQ ID NO: 19280 - DNA, 405 bp, Gossypium hirsutum
  Clone ID: uC-gsflnu33B072b12b1
ttgttacaaaaaaaagagcaaaaaatggcagaaagaggcggcggagagcgtggcgcttttaggcgcggcttcggtggaggaaggggtgaccgtggtccaagaggcaggcgccgtggccgcaaggacgaagaggagaaatgggtacccgtcacgaaactcggccgtttagtcaaatccgggaaaatcacgtccctcgaacaaatttacctccactctctccctatcaaagagtaccaaatcatcgaccagctcgtcggcccttccttgaaagacgaagtcatgaagatcactcccgtccagaaacaaacacgtgcaggccagcgcacgcgtttcaaggccttcgtcgtcgtcggagacggaaacggacacgtcggattgggtgtcaagtgcagcaaagaagttgcg

SEQ ID NO: 19281 - DNA, 348 bp, Gossypium hirsutum
  Clone ID: uC-gsflnu33B072c02b1
taatactttgcttctttactaactaaaaaggaaaaacattttttgtttaacgcttaagattcctttaacaacaatggctgtctcaatgtctactctaatggtcgttctcgtcgctgtatgcgctctcatgggttccgccattgccgccgacgctccggctccgagccccacctttggtgccggctctatctctccttcatttgtctctgtttccgtcgcccgcgccgctgaggctctgcttttcggatctagacttcggatctgaatgatgctttctttggtgttcagatgatgcctctgcctttctttatatatgcatttctttctttttgatacgattttgaattt

SEQ ID NO: 19282 - DNA, 528 bp, Gossypium hirsutum
  Clone ID: uC-gsflnu33B072c07b1
ttttttacgcgtccgaggagacactcacttcagcgttttcttgagaagcggcgggacaggctggtgaacaagaacccatatcctggtccatcaacaccaaaaatggctgatgacgtcaaagctgacgtgagtgccacaacttcaccagagtctggctacttcaaggcatcacccattcgtcaagaagatatccaaccaaaagctccagctcatgttgcctaaagctaagcatataggattccttatatatatatacatatttgataaaaactgaatctagctctgttattgtaagtgacaaagtgcagaggaatacatctgatctgccactggagttaggtgtggatagcaagtgtacaattaaacaggtctcatggtaggatcccgccacttggttccctattgccttcttgggctgcagtttgatgtttcctaaaacctgaccccctttttctgatctgcctgacaattacatttgtatgcatgatgattcttttgtttatggtatgcaagattgttaattggtgt

SEQ ID NO: 19283 - DNA, 441 bp, Gossypium hirsutum
  Clone ID: uC-gsflnu33B072c10b1
cttgccaagaaagcttatagctttgcaaccatttcaccaccttcggttacattcaatcacacatttgctaaatcttccattgaatctagacacctttacttccccttcttcaactgcaaaaaaagaagagaaagctaaggagcttcaatggattcatgttgtgtagcttttaaacccaattctcctttattgaatacaagaaatggctatggctatggcaatggagatattaaaaatacatttttaggggaaagaacaagagggagtgtttggttcaatcagctctcaaacacattgagaggtgatgataagaaggaaaataagatcaaatctggtgtttttgctgttcttacatcaaatacaccaagggaagctgtgacattgaaaccacgtcggtttgaaagaccaagagttgaccccaaaaatgtagcttcaatcata

SEQ ID NO: 19284 - DNA, 305 bp, Gossypium hirsutum
  Clone ID: uC-gsflnu33B072d01b1
cctactcgtccgtttttttttttttttcactccaaaacaagcttagctttgaaatatgaaaaataacacacacacacacaattaatacgatcctatgaactaactaaaattacaacatcgtactacattgatccgttcggggattcatcaccacctattgtgaagccaccaacgcctgttatcgttaagccacctttaccggatacaccgtgtactacaccaccactctttggtacaacaaatatgcccaatagacactttaaagctatgtgcatgtgtcaacgatttggttggcttagcacaca

SEQ ID NO: 19285 - DNA, 486 bp, Gossypium hirsutum
  unsure (1)..(486): unsure at all n locations
  Clone ID: uC-gsflnu33B072d04b1
cgtgtctcgtgggcggacgcgtgggtgcagctgttgagccaaactcttatccaatctccagcatcgattaagtctaatgaaatgcaaagatatggacagttcaggagacctggaaataacaatgtgtttcacattcctccatcatcttatcagattcattttccaagcagcagcaatggaggccgaataggaagcgatcttttactatccattagtgaacaacaatggcaatcaggtcctcaccaaatgtttggaaattctgcagcatcatcaggattcccatcgcagattagaccttcttctcaaacttggctgcagaaaaatgggttccactcactcatgagaccctcctaactcaaaaagtagccataaaaatgtctccgctaattaaaaaatatatttctgttntctccttggtgggcttgtaagtatgtcattttttaaatcccccctttcttttcctctacaactttcttcggaaatcac

SEQ ID NO: 19286 - DNA, 460 bp, Gossypium hirsutum
  unsure (1)..(460): unsure at all n locations
  Clone ID: uC-gsflnu33B072d05b1
tagtatcataattttgaaatggtaacaaaatattgaaaaaacaacaaaaaaaaaaaaaaaaaaaaaaaaaaaaaaaaaaaaaaaaaaaaaaaaaaaaaaaaaaagggggggcctctttgggggtcccaggtttacttccccgggcttgcgaagtgatagttttttattggggccccttaaattaatttcccgggccgcggttttccagggtggggctgggaaaaacccgggggttcccaaatttaatgtcctggaagaacatccccttttagcaggtgggggtaattccaaaggggccccatccgattggcctttccaaaaagtggggtnacctgaatggggatggggaccccccctttgggggggctttaagggggggggggtgggtggtttcccccatggtgttccctttcattggcggggcgtttagggcccgttttttggtttttttccctttttt

SEQ ID NO: 19287 - DNA, 454 bp, Gossypium hirsutum
  Clone ID: uC-gsflnu33B072d06b1
attttattaagcaatcaagacttttggatttgagcaaaacatagatgaagcttgtgtttacaaacgtttaggggatggaaaggtggtctttctcattctatatgtcaatgacattctactcattcaaaattatgtagggaaattgtcattgattaaactatggttaacttaacagtttagcatgaaggatttaggagaagctaattttgttctgggtattcaaatcctaatggatcgaaagaaaaaagtgatagcactgtctcaggcttcatacatagacaagatattgaagtgttatacaacaatcaattcaaggaaaggaaatcaaccttctgtatcaggatttcatctctctttagaggactatccttagaaagctaaagaaagagaaaacatgagaaaggttcggtatgattcagaaataagaagcttatgtatgctatgctatgcacac

SEQ ID NO: 19288 - DNA, 281 bp, Gossypium hirsutum
  unsure (1)..(281): unsure at all n locations
  Clone ID: uC-gsflnu33B072d07b1
tttagtagcctctaatcttctccgagataatatttgggtgttatcaattttcaatttctctaaagttttaaatatctctatatatatcatgttacattagtgacataaatttgattttgtaatgtaattggtgtgattttcttatatatcatagatatataagggtattgatcctatttcttttgtattcatattatgcagtttgctttgctttgccttttgtaataataatttttttttgggtggttgaatnaaaaaaaaaaaaaaaaaaaaaaataaaa

SEQ ID NO: 19289 - DNA, 404 bp, Gossypium hirsutum
  Clone ID: uC-gsflnu33B072d10b1
ctctcgcgtccgaaaaaaaaaaaaaaaaaaaaaaaaaaaataaaaaaaaaaaaaaaaaaaaaaaaaaaaaaaaaaaaataaaaaaaaaaaaaaataaaaaaaaaaaaaaaaaaagggggggggggttttttttgggaatctaagtttccttgccgggccagggaatgtctttgtttttttttggggaaacttaatttaatttgactggcctttgttttccaccgtttgggattggcaaacccttggccttcccaaatttattggctttgaatcacatttccttttggcgggttggtttaatagggaaggggcccgaacggtttgcctttccaaaaagttgcttaactggaatgggtaatgggcccttccttgttgctgttaataagggggggggggtgggttgg

SEQ ID NO: 19290 - DNA, 429 bp, Gossypium hirsutum
  Clone ID: uC-gsflnu33B072d11b1
ttctcatcccagtcttcaaactcaagttcttctcccctttctcccgttctttccctctcctaaactaacgtctcaaaccacactccctttacctcaaaagctctctccttttcttgttttttcggaaagaaaatgaatccggctgataacactgaccaccctcagcttccaactatcaagatccaccacccatcatcccctcaccaccctatctctgctactacccccaccccaacatccggtgcccgacgtaagatcggggtagccgtcgacctctctgatgagtctgcttttgccgtgcgttgggctgtccagaactacctcagacccggcgacaccgtcatccttctccacgtgttccccactttagtactctttggagctgactggggtccactccctcaaacccccgcaaaccccggaacccca

SEQ ID NO: 19291 - DNA, 468 bp, Gossypium hirsutum
  Clone ID: uC-gsflnu33B072e01b1
gagtgtagagatgaggaaaatcatgggtgccaaagttctcttcttctttgctttgctttccttttcagctgtgtcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaagttcattgagaccatcaaagaagctgttgaaagggaaatgtcccggagttgtttcctgagctgaaatccttgttctgtctgctagagaaggcattcgtttcgtgggagggccttacattcctttaaaaactgaag

SEQ ID NO: 19292 - DNA, 438 bp, Gossypium hirsutum
  Clone ID: uC-gsflnu33B072e10b1
tttccaccatgttttcggtggaggcaaaccggccgacattttactgtggaggaacaaaaagatctcagcaggagcgcttggtgttgcaactgtgatatgggttttgtttgaattgcttgaatatcacctgctcactctagtgtgtcacttgttgatacttgctcttgcattgctcttcttgtggtcaaatgctactcagttcatcaacaagtctacaccgcacatcccggaagttcaaatccctaaggaaccggttttagagtttgccatggcacttaggtttgagattaaccgggctttcgctgtcctgcaggatattgcattaggaagagatcttaagatgttcctctctgttattgctggattatgggtcttgtctattggggaagttggtgcaacttttgactctgttctcatagtcttcggactacttacact

SEQ ID NO: 19293 - DNA, 443 bp, Gossypium hirsutum
  Clone ID: uC-gsflnu33B072f01b1
gggatatgaattgtgagtttttggtttgttcttcacaaggatctattttaagcttttgggttttgtttttgagtgtttagagaaagagaaatggctggaagtaatgaaatcaacctcaacgagtgcaagtcaagaggctcaactagagatggtaccggagttcatgacagcattgtgaaccagctgcttaccaagatagatggagtggagtctctaaataatgttttgcttagtggaatgaccaacagaaatgatctgcttgatgaagcccttttgaggccaggacgtttggaggttcaagttgagataagtcttcctgacgaaaatggtcgtttgcagattctttagattcatacaaacaagatgaaagagaattcttttcttgcttctgatgttaaaccttaagagcttggtatggttgttagtatttatggttgtggaat

SEQ ID NO: 19294 - DNA, 384 bp, Gossypium hirsutum
  Clone ID: uC-gsflnu33B072g03b1
ccgtccgctgttttgtatagcttgatggacctcactacaatggatggctagaggtagggcacagagtaagtcatacaaaagatccagccttggtgaggaatggaaaaagccatttgctggttgtctacatgccaaaggcatcggcctcgaaaagagaggcattgaagctaactaacctaactctgctctgcgaaagtgtgcttgagttcaatggatcaataatggaaaaaagagtgacaggatcgactcaaacgacggatgatgaaactacatcgcctataatgatcacgggttgaccgctctatttggacgaaagggtcatgccgattgcgagattcccgggggtagagacaaggatgcgaaggtacttggcggttcattatt

SEQ ID NO: 19295 - DNA, 535 bp, Gossypium hirsutum
  Clone ID: uC-gsflnu33B072g12b1
tttgggaatatatatagaaggggaaaaaggaaaggaaaggacgacgaaaaagacggggacggggacggtgacggggacgggtcggatatcgggtttaatttcgggctgggctaatttggtctttggagtttgcgttgacgagcgcgtcgtgtgggtcctctgtaggaccgggcggcttggtgaggtgggacccacacactaaaaaaaaagaggaatgtgtgataacggcaatcgtgtgttttgtttggttgtcgttagccgatgttcggattttttggggacaggataacggaggtttgatgtcggaacgtttagttgtcggggtgttaggttctttttttttttttaaatagagatttattaattattattagatgagtgggacccacatcgaataaggacaatgctttatttatttatttattattattattatataatgacattggccttttatttttgtgttgacattgaaacaagttgcatggtcttgtaaaaatgggggttgattttaattgaaattctgttgatgggt

SEQ ID NO: 19296 - DNA, 445 bp, Gossypium hirsutum
  Clone ID: uC-gsflnu33B072h02b1
gttgttttccaactatcaatctttaggtttattgcattaaatagatcatgaaatctttcctttctttttttgcattcctctcacttctcctgtttgtagacaccattgcagcagctaggaaagatgctggagagtactggggagctgtaacgaaagatcagcctatgcctgaggcactccaagagcttgttcggattgaggctgccgttgtcagccccgattagaaaaccaagtgccatacatcaggtaatattgagcttaaggaagagaagattattgttaatgaggagttcgaaccaaggccaaacgtttcagcttatggtgatgacgcttatctaaaaggagataaatcatcatcttttgctgaagattttgaaccgagacctaacgtttcggcttacgggggcgatgatgcttgtcttaaaggacagaaagaatcattcac

SEQ ID NO: 19297 - DNA, 297 bp, Gossypium hirsutum
  Clone ID: uC-gsflnu33B072h05b1
taataataaaataaaaaaaaaaaaaaaaaaaaaaaaaaaaaaattaaaagggacaagcataaataaataagaacacaacatgccgtcctgacagcatatagcagtacgagatcttctgtcgggccccgtgtagggtttgctcgtgcctcggttttacaagagtttgattgggcgcaccttggtgtaccccgtcgtgattgtgtcgcacccgttcccctttcgtttggtggatggacatctgtttggcctgggccagttgcctttcccatccattgctcatcctgaatggcgtttggg

SEQ ID NO: 19298 - DNA, 415 bp, Gossypium hirsutum
  unsure (1)..(415): unsure at all n locations
  Clone ID: uC-gsflnu33B072h10b1
tatcnccggcaatggttccagttatagatttctcaaaccaaaacctgaaaccgggcagccctgaatgggatttagtgaaatcccaagttcgagaagcattgggggagtacggttgtttcgaggcattgtttgatccaatcctggagcttcgaaaggcagtgtttggggctttgcaagagacctttgacttgcctttacaaaccaagaaactgtgtgtttccgataagccctttcgtggctatttcaatccttcatctggaccgttttcaaagcttggcgatggaagatgctcatatttgctgaaaacattgaacatatcctcaccaacactttatggcctcaaggaaacataattttttagttaacttttggcgattttaacttaatctagcatccgatttacttaataatattt

SEQ ID NO: 19299 - DNA, 152 bp, Gossypium hirsutum
  Clone ID: uC-gsflnu33B073a02b1
catacggacttggctcaatcaatgccccgtaggttttgcagcattacgtttgctctgggagtcaaaagcttgtgaaaaacgaccatacggtaacccttcgtctatatgtgcttgcaacgagtgacacactacttctttctgggcggtgaaac

SEQ ID NO: 19300 - DNA, 229 bp, Gossypium hirsutum
  Clone ID: uC-gsflnu33B073a04b1
cgttcgacgatttaacaaatacccccacacttaagcttccgctagtcctcaagaaaattcctcaacccttaattaaaataaatgcttctcaacttataatttctatcgataagtatcttaacatagtccataggtaaacatacattgagaatttaatttacagatcttaaaagtttcaaaacatttcacgttgtgtattcaattatgcaaacaaaggtgttttccctca

SEQ ID NO: 19301 - DNA, 236 bp, Gossypium hirsutum
  Clone ID: uC-gsflnu33B073a08b1
ttttggctatgcctcttcacgtctatacaaaatgtttaaaggaacagagtggaagaaaatatctctaaagactgcatgcttgttcccgggcattgtctttgccatcttctttgtcttaaatgctctcataaggggccagaagtcatcagggtctgtgccatttgggacaatgtttgctttggtcgacatgtggtttgtaatttcagtaccacttgattttgtgggtggaaacattg

SEQ ID NO: 19302 - DNA, 55 bp, Gossypium hirsutum
  Clone ID: uC-gsflnu33B073a11b1
acgcctgcgcggacgcttggtgaaaatttctttgttgccgtgcatgtggatgttg

SEQ ID NO: 19303 - DNA, 446 bp, Gossypium hirsutum
  Clone ID: uC-gsflnu33B073b02b1
gtgcttttgaggaacaaagagaaacagagtttttcctttccctttttctttggtaaatattttgtttgaaagggaaggaagagacatgcacaaatccaagcttagaagaaaattcttcatgagtgttatttctctttcagtttaacaaatcccaaaggtcactgatgtgcgagcacgttaacatatagcagcaaagatttcttcttagcactttcaaaatctctcacggttccttttataagtcaggatgcatttgaagtttgaatggtaggttaccgaaatgcaaaccttgcaataaaaaggattgtgtgttaagttttcatttgacatgcaccgaatgtagttggctgctcatcttgggtcaattcaactgaatctcatgtccagcaatcattatgtctgaaaggttaaacttgaagatgggaattggaccttaacactttcat

SEQ ID NO: 19304 - DNA, 257 bp, Gossypium hirsutum
  Clone ID: uC-gsflnu33B073b04b1
agccgacccaagccaatgactgctttctggtcatctaccgcacaaagcatgactgtactctcaacgaagggaatgctttactgggcctgctaccattcttaactggtcctttgtcagaaatgatcatactcggttcgagacttgtctccagattgccttggtcatataaggactaagaggaggatcttcgagaaggtcggaactaatgttatccaaattgactaggcttttttgagagaggggttgtcctttagaaa

SEQ ID NO: 19305 - DNA, 118 bp, Gossypium hirsutum
  Clone ID: uC-gsflnu33B073b05b1
ccaagggacgtgatttgccaggtagctcgcaagtataatgctgatgcgcttgtatatgggaagccatgtctattgtcttatatagagggcatttttattgtagtgtaagtaatatatt

SEQ ID NO: 19306 - DNA, 441 bp, Gossypium hirsutum
  Clone ID: uC-gsflnu33B073b07b1
tctttttatttcatgacaagtctcttgcaaatgaagatacttatgaacctttcctaagattgctctggaaaggtaactggttcatacaagaaaagagctgtaagatacttgccttgatagtaagtgccaggccaaaaacccagaatggtgttgttgcaaatggagaagcctcaaactcgaagacaaagctcactaccattgatgctgtactaagaggattggttgaatggctttgtacacagctgaagaagccttaccatcctagtcgtggtattccaactgctattaactgtcttgcagcattgctgaaggaaccttgtggcagatcctcctttgttcaagcagatggagtgaatgatgttgattcctttaatttgtccagcattcacacagcaatctatccagctttttttaccaaacatgtctctgtgtgtggcttta

SEQ ID NO: 19307 - DNA, 459 bp, Gossypium hirsutum
  Clone ID: uC-gsflnu33B073b10b1
tttttatctctcctggacaggcaaaaagatttacaaaatttagagagaggaaaggccttatagagaaagatgtggtaaggacagacagatcgctctctttctatgatggggatgacaatccaaatgtgaatcttttacatgatattctcttgacctactctttttacaactttgaacttggttactgtcaggggatgagcgatctgctatcttcaattttgattgtgatggaggatgagtcagaatcattttggtgcttttgtggctctgatggaacgcccttgggcccaattttaattcgtgatcaaaatggcatgcaattctcagcttttctgcatttatctaagcatggttggagttgctggacagaacctcttgcaccaaatatttcctagcagaatgactgcttgaaattattttttttgtttccgctggcattctgaaccagtttaaaaggga

SEQ ID NO: 19308 - DNA, 221 bp, Gossypium hirsutum
  Clone ID: uC-gsflnu33B073b11b1
tttttcacgcgtccgtccacgcgttcgcggacgcgttctttcacgcgtacggagaaatgtcattgtggtccatctgggacatttgggcataaagatgaatgcccttgttatagggacatgaagaactctaagggcaaaatcaagtgcccttagatgttttttttcccataaatactcgtatgtatttattttgcctttatacccttataaagattaaacaa

SEQ ID NO: 19309 - DNA, 352 bp, Gossypium hirsutum
  Clone ID: uC-gsflnu33B073b12b1
tttttcacgcgtccgcccacgcgtccggtttactggccctgttaccattcttaactggtcctttgtttgaaatgatcagcccagattcgagactttgctaccaaaattgccttggtcattaaggatgaagtggaggatcttgagaaggccggtattaacgttattcaatttgatgaagttgttttgagagaagggttgtctctatgaaatttctagcctgctttttactttgaatgggttgtccactcctttaggaacactaactgtggtgatcaggatacttcttaaaatcacacccacatgtgctacttccattttaaatgccatatttcacttttatcaatcgacatgg

SEQ ID NO: 19310 - DNA, 65 bp, Gossypium hirsutum
  Clone ID: uC-gsflnu33B073c01b1
gtccgaacattataggcaaaggaggtgcttggattgcgtacaagggatccatgcctagtggtgac

SEQ ID NO: 19311 - DNA, 226 bp, Gossypium hirsutum
  Clone ID: uC-gsflnu33B073c03b1
ttttcgcgtccgccgctttatactataaaactctctctatataaatattgtaatgagactgcctgacgttcaccttatcacataactgttggtgcttgcatgtaatgcaaaggagaagctataatctgtacagtctactggacggtgcaggcctaatatatatataatttcttatcgtcgatccagatcaaatattgtattgaataaattccgtctagagaagatg

SEQ ID NO: 19312 - DNA, 357 bp, Gossypium hirsutum
  Clone ID: uC-gsflnu33B073c08b1
tcttttctattgaattctttccctcactttctcgaaaaaaaaaatgtctccaggttgcactagcggatctaactgcagctgcggtgacaactgctcatgcaatatgaaccttaaccttggatattctgagaagacaaccagcacttagaccattatcttctgagctgcgccagtgaagatgacctatgagggacctgatatgagcactactgaatcaggacatggatgcaagtgtggattaaacagattttgtgatccactgcaactgttgaaaagctagattgaaagccatatattttgaaaaaaatgtaagttcttttaattaacatgccaaattctatgatttaatgtcaaggt

SEQ ID NO: 19313 - DNA, 98 bp, Gossypium hirsutum
  Clone ID: uC-gsflnu33B073d01b1
tttttacgttcgccgacagtcctgtcatatcgagtctgaattcgaacacctaactggttttaaaatcttaggcgaagtccctccctactatcacaaaa

SEQ ID NO: 19314 - DNA, 335 bp, Gossypium hirsutum
  Clone ID: uC-gsflnu33B073d12b1
tttcaagagccaaactgagagagaaaaagattcatccatggagggcatgaatgatgaccatatgcatggtatgatgatgcacaacacatcatatggcggcatgaacatgaccaagccttcataagatgatgatgcatatgaccattcttatggggcagtgacgcctagattctctttttcggatggtcgggaaccagaacacagcatggacgtcttggccctgatagttgactttctgcttgttttcatgggtggagggggagtcatacactttcggttggagaaaactccggttccacccaccactatgaccgaccggtcttggttaaaaactt

SEQ ID NO: 19315 - DNA, 288 bp, Gossypium hirsutum
  Clone ID: uC-gsflnu33B073e01b1
tttttattgcttgatggcgtggaaccagttgtgagtgcatgtgttttctggagggaaaccttggtcacattagatccaaggaactggtgctggcttaatatctggggttttagacctcaatttaatcgtttaagactttcaaatataaagtgaagtagtatatcgtaactgaataacaaacttgctctgaaagaaggattgccggtaggtatattattcgtggctgttgtctaccccagcttttgacatagccatgtggccattaaaatgctacgaaactatatttgt

SEQ ID NO: 19316 - DNA, 326 bp, Gossypium hirsutum
  Clone ID: uC-gsflnu33B073e08b1
tttttatattccccccttctacttgcaatttctgtagcaaatacactatcaagagagagagaaaagagagatattttgagactaaaaaaaaaaaaaaggaaaaggactaaagttggatggttgtagggttttgtacgtaaaagtctttgtttaattatcataatgactagcattattggcacagaggatgataagtatagcacgattaacttttaagagactgagttgtgtttagggttgtccggcgccaatggaaacaattgttaaattaccaataacaatttaaaattagggtttttagagactgttaatttgatgtttaactt

SEQ ID NO: 19317 - DNA, 326 bp, Gossypium hirsutum
  Clone ID: uC-gsflnu33B073e10b1
tcggggaaaaggaactggaagctttggaaagcgaaggaataagacccacacactttgcgttcgatgtgggcgccgaagcttccatcttcagaagagccgttgcagtgcttgtggctaccctgccagtcgcatccgaaaatataactggagtgtgaaggctattagaagaaagacgactgggacaggccgcatgaggtaccttcgttatctgccccgaaggtttaaaactggttttagagaaggcactcaagcaacttcaaggaagaaggcagttgttgctgcatcttaagttggttttggtgtttcgattttgagattttctgaat

SEQ ID NO: 19318 - DNA, 237 bp, Gossypium hirsutum
  Clone ID: uC-gsflnu33B073f04b1
ttctgatctcgggtacaccataaataaccatactaaagcaggtaggttctgatgcttctagtacagacatgggaatatacatttccacctttgatggacaaggttattgcaatccttaatgatggcactatgatgaccatatccaaagacctagtcaaggcatctctgacctcagactagtaggatatctaatgagatatttgcaaccggcagttgtcaattggaaccctattttag

SEQ ID NO: 19319 - DNA, 236 bp, Gossypium hirsutum
  Clone ID: uC-gsflnu33B073f05b1
tttttatgtccttggaatagacccagcagtatatactagaacacttcccactaaattgtttcttctttttgcttcaatcttttactaaaacggaacagaaaaattgtttatgattcatatacatgcttttctgggctactctttattggtagaatttgatggcagtatatacatgtatatcttttcttatataaaaataaacattattgctggactttggttaaaaaaaaaaatat

SEQ ID NO: 19320 - DNA, 458 bp, Gossypium hirsutum
  Clone ID: uC-gsflnu33B073f07b1
aagtctagtcttgttttgcgcttcgctaaagggcaatttgttgaatttcaggaatcaaccataggtgcagcttttttctcccaaacattggctgagaatgatgcaactgtgaagtttgagattcgggatacagctggtcaagagaggaaccatagtttggcaccattgtattacagaggagctgcagctgctatcattgtgtatgatattacaaattacgcatcatttgagagagccaaataatgggtccaagaacttaaagcacaaggcaatcctggtatggcaatggcactttgctgggaacaaagtagatttaccttgattcaaggaaggttgcatcagaggaagcacaaacttatgcttaggagaatgggcttttttttcaggaaacatctgctaagacagcattccatggcaatgagatttttttctaaaaagccacaaaataccttcagtgc

SEQ ID NO: 19321 - DNA, 358 bp, Gossypium hirsutum
  Clone ID: uC-gsflnu33B073f09b1
cacgcgtccgcaattgtggaagctctcaaatctcagctgctatggcacccatcgcacggttacttttgctcgcgcttctctcaactgcactcacgatttcatcagggtctggggatgggttcaccatcaatggtcgagtgaagatcccccaaggtctgggtacaaaagggtttgctttgcctggaaaaacgtccaatgtcaacgttattactcaatggcggccaaattgatacttatctgagacctgatggatatttttcatttcagaacataccagcagggactcatttgattgaagcggctgctattggctatttcttttcttctgttagagttgaagctagtgcttgaaacccta

SEQ ID NO: 19322 - DNA, 227 bp, Gossypium hirsutum
  Clone ID: uC-gsflnu33B073f10b1
tctgttgaagaaaaaaaaagaaaagaagaggaagagagggggagaaggaagggaaacctgtacacggatcgaataccggacagaaaccggaggctcactaggaaactgatcaccgcgaaaggtacgagatcatctaaatatgaaaatataagcctttaaatactaaaagtatatgcatactaaggatttaaaagattaaaacgcaaaaatgcaccatgaaccctgat

SEQ ID NO: 19323 - DNA, 514 bp, Gossypium hirsutum
  Clone ID: uC-gsflnu33B073f12b1
tctttacagatgaatttcaattgaaagcttttgaaatgagtttggtacaagcgcaggttacttctctgtttgatggcaggtgccaacttacttatttggctttgcttaataaacttttttttggattgtgttctgtctgttgaatttttctggaaatcagggcgggggaaattctttaattaacccaattgcctggaaagtttcttgtctgggaactttatttgggggttgccctaaaaatcagaagcttgccgtacaggttgttgaaagtatcaaaatgcctcttgaagtgcctcaatttgaatgggacaattattttggtaggccaaaaattcaattgtttttaacctaatgccctggtaggaaaccaaatttttttgataaaacaatattttttagggggaccttttttgggatttgttggggagaaagaggtacctttctccaaaaagtttttggggagggttctctttaattataagtggtgtggcccttacccctttgaaaaccattt

SEQ ID NO: 19324 - DNA, 437 bp, Gossypium hirsutum
  Clone ID: uC-gsflnu33B073g07b1
aataggccctagccgccacttgaccgccgaacggttatcgacggagggagacttgttcgtttactaaccccgcttgggccctagcttataaggactactgatttcaggccttacaccctgccccgactttgatttatgcgaattgacaccaatatttccgaggtacggggtgcgctggcatcgtaccgaggctgtgctggcgtggttgctggagactgaaaacatactgaggagctaatggggctctgctagcggcgcaaagcgaggtggagccctacggtttctggacttgtaattttctgggcccatcgggcctgtatttggggtttagggtcatgataaattgggtttaggattgcgtaatgtaatattggacttgtaactggcctattgggtagttatacaactggacctaatggtttatttggtttcaatta

SEQ ID NO: 19325 - DNA, 318 bp, Gossypium hirsutum
  Clone ID: uC-gsflnu33B073g10b1
tgttagcctctcatcagggatcatggttacccgttgagagtaattgtaccaggtgttataggagctcgttccgtcaagtggctggattctatcaatataaatagcagaagaatgccagggatttttcatgcaaaaggactacaagatgcttccaccatcggtggattggggtatcatcaattggaataccatgaagccacaaatggattttccagttcagtccgtgatttgctctttggaagatatgcattctataaaaccgggaatggtaagaattagcggatatgcagtaatcaggaggtggctgtggaattgaac

SEQ ID NO: 19326 - DNA, 353 bp, Gossypium hirsutum
  Clone ID: uC-gsflnu33B073g12b1
ttgttcagggaccaattccttgaggagaggaagaagcttgtaaccacaaatagaaatgacaactatgctttgaaatgtgccattgatcacattattgatgcttaaagtaaggtatagatcaatgaagacaatgttctctacattgttgagaatattaatgatgctgttattgaaacaaccttatggtcaatagaatggggcattgatgagcttgtgaaccattccgagatccagcataaactccgcaacgaaattgacaccggcctatgacccggtgtgcatgttaccgaacccgacactcataagctttcatatctgcaggcagtgatcaatgatacttttatgctcctaat

SEQ ID NO: 19327 - DNA, 284 bp, Gossypium hirsutum
  Clone ID: uC-gsflnu33B073h02b1
actactcgtccgaaaaaaccatgctcctcgtatctgtcaaatctctacgctgaccatcaaaatacgaagtatgaagaaactctaccgtagaggcatgggtcatccatcaccatcaatcacgacctattcttcttcttttcctcccggctaccaatataaaccccttttggttgctctttcctctgaagacaaacaaggcttgggcctattctaacttctcgctccaacaacggattttggcaacttttcaggccgccgtaaaaacactccaaaaccccaaactt

SEQ ID NO: 19328 - DNA, 87 bp, Gossypium hirsutum
  Clone ID: uC-gsflnu33B073h04b1
tttttacattggagcagggatttcacatgtttctggaatctacaatgaagaacacgtggaggcatggtagatgattgctgattgctg

SEQ ID NO: 19329 - DNA, 390 bp, Gossypium hirsutum
  Clone ID: uC-gsflnu33B073h09b1
caggtgttaaagtttttgtggatgatgaagagctttgtagcaatctttttcgccatcctgctgattttggcaaccatggaagctgatggaaaacgaatgaccctggagaaggagcgcgagccaaagaatcattatcatgggtctgaaaggccgacatcggagcttaaagacgatatagatttaacgggagaagaaggttctgttatagaattgatcgctttcaagaatagacttattgattcacgtcaccatatctacattgaacgataccaggccctatccccctgaagcattcgtgacactgataagcttgcttagttgtttacagcttggtttgagctttacggaatatggtgtgcctaaaaataaacctgaaattaacatgtttgt

SEQ ID NO: 19330 - DNA, 272 bp, Gossypium hirsutum
  Clone ID: uC-gsflnu33B073h10b1
tttaaaaaaaagaacaagaaaaagaaaaggaaagttagggttttaatttgaaatcggattctgtagagattaagcaatggctggagaaagggccatgttcaagttccttaagcctgggcaacgtctacagcccgccgacattcaagctgccgccatgtggggcgtcgatttcactaccggcgctctttggctcatttcagactattgattggttgaagaagacctttctggagaaaccagagtcggagttgaagctaatgggacatttttgc

SEQ ID NO: 19331 - DNA, 199 bp, Gossypium hirsutum
  Clone ID: uC-gsflnu33B074a01b1
ggggaagtggctccgacaaggtgatgattattgtggaggcggctcgtgctcaacaaaatgaaagttgcaggtacagcctgattatcctaacacagctctataagtacccagacgttgcacaatcatcaagtttatacagagactgggggaaggtttctaaatgaggaggtaaaagcatgaccttgcttccctttgctga

SEQ ID NO: 19332 - DNA, 403 bp, Gossypium hirsutum
  Clone ID: uC-gsflnu33B074a05b1
cagttttgtaagagctatggctaaggacatttaggttggtggtgagttccaggccaaggactaccatgatcctccacccgctccattggtagacgctcaggagttagccaagtggtctttttacagggctgtcatagctgagttcattgccactctcctctttctctacatcactgtcttgactgtgatcggttacaagacccagaccgaccttgctaagggcggtgaagattgaggaggcgttggcattctcggcattgcttgggcttttggtggcatgatcattatccttgtttactgcactgacggaatctttgggggacaccattagcccagcagggacctttggactttttatggctaggaaggcgaccgtaagttcagccatattttacatgggtgc

SEQ ID NO: 19333 - DNA, 210 bp, Gossypium hirsutum
  Clone ID: uC-gsflnu33B074b02b1
tttacgctggacggtaaagatagtgttgcttcgttgattggggaatcagatctatgtgtttcttttagggttattcagagtctttgcctatgtcgtcttaagattaacaaactgttgtcgtgtttgcttgatttgacattgatcttgactcttaaatccttctatctgatttgtattgaaattgatttcctaaaaaataaaaaccctaac

SEQ ID NO: 19334 - DNA, 440 bp, Gossypium hirsutum
  unsure (1)..(440): unsure at all n locations
  Clone ID: uC-gsflnu33B074b05b1
cgtccgcccacgcgtccgctcaacattcccattttcaatctccagctcccaaggtaaatatgccgatcagaaacatagcagttggccggcccgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaggaggccacgtcaaccccgccgtcaccttcggtgctttcgttggcgggaacatcactctcttgcgcggcattctttactggatcgcccaactcctaggctcaaccgncgcttgcctgttgcttaagttcgctaccggcgac

SEQ ID NO: 19335 - DNA, 189 bp, Gossypium hirsutum
  Clone ID: uC-gsflnu33B074b10b1
ctttactaccgcggggatgcgagctaaaagcttttttatagggtcaccaaaattaaatcaactggccgacttataaaaacgtcttgacgggaaaaaccttggctctccccaccataaatcgcctgcaataaaagcggcttttagccagcgggcttaaaactaaaaaggcccgaacctgttggtctttcc

SEQ ID NO: 19336 - DNA, 449 bp, Gossypium hirsutum
  Clone ID: uC-gsflnu33B074b12b1
ttgggcttttggtgggatgatctttatccttgtttatttgcactgctggtatctctggaggacacatcaacccagcagtgacctttgggcttttcttggctaggaaggtgtccttagttcgagccatattttatatggctgctcaatgtttgggagccatatgtggatgtgggctagtgaaggcattccaaaagtcatattacaacaagtatggaggaggagccaacagcctcgctgatggatacagcactggaactggttttgcagctgaaatcattggtacctttgctcttgtctacactgttttctctgcaactgatcccaagaggaatgcaagagattctcatatccctgtcttggcaccacttcctattggatttgctgtgttcatggttcacttggcaactattccaatcaccggcacccgtatcaaccctgcttgtagtttt

SEQ ID NO: 19337 - DNA, 463 bp, Gossypium hirsutum
  Clone ID: uC-gsflnu33B074c04b1
tctatgcggattgttttccgcttattgttaataaggaagtaacggagtatcagtggaatggctatcttgagaaccccgaagagtggacggaagccgagtattatggcgacactgtcgaactagaaagtatttcaccactagattttgtttcaattgtggatatcaggtataaagataaaacaatatgctcaaaagtgctgtggggtattcctaatgcaaatggatccaatagttggtttcacaactgcccgtttcggattgatcttctcaattatgcagctagagatgatgatagtgaaagtgaggttacccttacggtttctgatggcctgccacctattacttttatggaaaaggaaaggaaagatgggaagctatggaaggagctacgagacggccttcggcttagttggatcgttgtaaaccggaaagttaaacaagctgctaacccttgcagctggag

SEQ ID NO: 19338 - DNA, 410 bp, Gossypium hirsutum
  Clone ID: uC-gsflnu33B074c06b1
gactagagattcacccgaaatctctgttgatcaagaaaagaaaacattggaatatggaagtgttaaaagcagcttggtgtctgccaaagttagtgacgggactagtagtcttgccaagatcagtgaccgtcttgattatgttgagagtggcaagagggagtaacgaagaagctatgctttcgtttacttcaggtgtaattttaccttcatctggtgtggtgaaatcaagtgggggtgccggggattcagatcactctgatcttgaagcttccgttgttaaggaggccgatagtagtcgagtcgtagagcctgaaaagaggccttgaaaacgggggagaaaacctgctaacggaagaaaagagccttttaatcatggtgaagcagagccgtaaagaagggagaagcttaac

SEQ ID NO: 19339 - DNA, 463 bp, Gossypium hirsutum
  Clone ID: uC-gsflnu33B074c09b1
ccaactcgctcgtttctttcatccacggctcattgagtcaacccggaaggacctcccactttcttccttcaccttctctttctttccccggatctcgctcgctctctctgaaactcacccgccgctccaactcgccccttctttgctctttagatgcaaccaacgccacagataaggacaccccaatcgaaacaaggttcccagcttatccaactgtgatggacatcaatcaaataagagagatattaccacacagattcccattcttgttagtggatagagtgatagaatataatccaggggtatcggctgttggtataaagaacgtgaccataaatgataactttttccctggacatttccctgagaggcccataatgcctggtgttctcatggttgaggcgatggcccaagttggaggtctagttatgctgcaacctgaggtgggaggttctcgggaaaa

SEQ ID NO: 19340 - DNA, 395 bp, Gossypium hirsutum
  Clone ID: uC-gsflnu33B074c12b1
gcgtccgcttttcaattccgatgctgctttaactacggactccactagcttgggtcttatcaaccagcttctttcgagccctcagtcgtttttctatgctcagtttgcaaagtctatggagaaaatgggtcggattaatatcaaaacaggatcccaaggtgagataaggaagcaatgtgcactcgtcaacagttaaaaaaaacacttaattcagctgaagaaggttccttcaaaattgtatagggaagtttcatagtgtggtctcggtgggtgctctgtgtgtgtgtgtcatgtcctgaataattgggctcactgttacgttttttcttctttttcctttttatgttcttttttagctgatgagctcaaagggtatcataatcttcatatgttca

SEQ ID NO: 19341 - DNA, 278 bp, Gossypium hirsutum
  Clone ID: uC-gsflnu33B074d01b1
cgtccggttcattgacatttacagatgatgaatataaaaaaagtaatttagttttcaaaaaagaacattttaacatgtctatggtttaatttgccaatcatgtaatgttctgtgttttacagtttcttgcctttcaatccagcactcaagcttggtgtcttttcccattttcaaattgggttaaatttagggactggattggatatttgcctatatatatatttatatattcgaatttataaaaaaaaccactccattttttaagataaaatattata

SEQ ID NO: 19342 - DNA, 446 bp, Gossypium hirsutum
  Clone ID: uC-gsflnu33B074d06b1
gtccgcttcaagcttttcattacagactcttttaagaatttcctgaacgaaaagaagagaaagaagaagaagatgttgctggggaagaggccaaggccacctatgaaaagaaccacaagcatgacagagatcacttttgatctaaacaccaccaccaccaccaacgccgaaccttcaccctctgatccacataacccttttaacaactaccccaaacaggcttgccctttcggtggcgcagcaccttctgtagctgctgctggcggaggtgttggacttgaagggttggatcaacggatgttggcgacggtgtcacctagagttcatagaaggcattcagctgattttatggaaacaccttatttcttaaggtcttgcgggctttgtagacgtcgccttgttcctggccgcgacatttacatgtataggggcggtacagcattttg

SEQ ID NO: 19343 - DNA, 384 bp, Gossypium hirsutum
  Clone ID: uC-gsflnu33B074d10b1
tccctctgttctcttcgcattatgttatttttttcattatttgcatatttcgatctaattgagaaaagatctttttcttttgttactttttttgaaaaatccgccatggtagcggttacgccaccacaacaacaacagcagtagcaacagaataaacaggtggcggtggagaccacaacggtgacggtggccggggctacaaagccattggctgaagaagaggctttgaagaggaatacggattgcgtttactttcttgcttcccctttaacctgtaaaaagggaagtgaatgtgagtatttgtatagtgaatatgtccgggttacccaagggattgttattactggttggatggaaattgtttgaacttaaaatgtggatttt

SEQ ID NO: 19344 - DNA, 222 bp, Gossypium hirsutum
  Clone ID: uC-gsflnu33B074e02b1
ttgtacatcataatgtcagcttcaacttctagtctaataaaagcttgtttggttatgagaaatggcagtaactttctgattaggtagctttatgttaaaactagcttttattcctgtttcgtcctttgtacatcataatgtcagcttcaacttctagtctaataaaagcttgtttgagggtcccaaactaaaaaaaaaaaataaaaaaaacattcatttcat

SEQ ID NO: 19345 - DNA, 449 bp, Gossypium hirsutum
  Clone ID: uC-gsflnu33B074e04b1
ggacattctacaaaatcagtggagtccaatttatgatgtagctgcaatactgacatctattcagtcattgctttgtgatccaaatcctaattcccctgcaaattctgaagctgctcggatgtttagtgagaacaagcgcgaatacaatgggagagtacgtgagatagtcgagcagagttggactgctgattgatctctcatgttggatttccatagtcagaacgaagcgtggataaattacgagagcatgtgagactgtcaagcagagttggactgctgattgatagctcaacgtttggtttggtttctatggaacgtcaaaaatagtccaatgtcctgtctaaataacattgaacaccgcaatgtgttgcaaactattttgtctttattatgttgtttgtgttaagaaaatgaacgctgtttcttgggcagtatatttcatctagtac

SEQ ID NO: 19346 - DNA, 468 bp, Gossypium hirsutum
  Clone ID: uC-gsflnu33B074f03b1
ccactttcgagccataacagccgaatcggaaggagttgtcaccgctgagaccattcaaagagcttttcgacaaaccgaagaagggtttacggcccttgtgtcggagttatggagtactcgaccaaatatggcaacggtcgggacatgctgtctggttggggtaatatatcagcaaacactttttattgcaaatctcggtgattcacgcgttgtgctcggcaagaaagttggcaacaccggaggaatggctgctatgcagttgtcaactgaacacaatgctaatatcgaggctattagacatgaactcaaggaattacacccgactgatccgcaaattgttgttctcaagcatggagtttggagagtaaagggcattattcaggtttctaggtcgataggtgatgtttatatgaaacacgcacagtataacagtgaaccgattaatgcaagatttaggctttctgaacc

SEQ ID NO: 19347 - DNA, 377 bp, Gossypium hirsutum
  Clone ID: uC-gsflnu33B074f09b1
aattaagaagaaaaaagaaaagaacccttagtagaaactccatgtttcgctgttgacctgttcatggtagtgggaatttgctctagtctgagtaatctggtgatagttaatgatatctgtataacaactatgttgctttaaatccttaatttagagtaaatatgagcttagttggatgtttgctgtaatttttctgggctcatgcttttacatctgcgaacaataatggctttttaagtcataggtttataatgtaattttatctacttgcttatatataaaactagtttgtacctgtgaagtcgtttatataatgttacgatgtttccagctgctaaaagagaaaaaaacccttgtaattgttccttttgtattta

SEQ ID NO: 19348 - DNA, 111 bp, Gossypium hirsutum
  Clone ID: uC-gsflnu33B074g08b1
gtaactttgggccaggtcttaggttttgggttgtaaaaataggtagatttgggctgatgtaattggactctaaacgtttaataattttggtttttttcttcgagcccaggc

SEQ ID NO: 19349 - DNA, 451 bp, Gossypium hirsutum
  Clone ID: uC-gsflnu33B074g09b1
cgcgtccgtttcgtgtttgtctattgaattctttccttcactttctcgagaaaaaaaaaatgtcttcaggttgcaattgcggatctagctgcagctgcggatctggctgcaattgcggtgagaactgctcaatgaaccttaaccttggatactcggagaagacaaccagcactcagaccatcatctccggagttgcgccagtgaagatgacctttgagggaccagagatgggcactactgaatcaggacatggatgcagctgtggatcaagctgcaaatgtaatccatgcacctgttgaaaagcttgatgaaagccatagattatgaaaaaagaaagcagcaaaataacaggcctctgtaatgatttattttcaaggatggatgcctgcaaggtctataattatgtctctctctgccttgcgtaatagaagctttgtttgtggtgaaaata

SEQ ID NO: 19350 - DNA, 443 bp, Gossypium hirsutum
  Clone ID: uC-gsflnu33B074h01b1
tccgaaaccaccagtttatacaccaccaaagattgagaagccagaacccaagccaccagtatatgaatcaccaaaaaaggaaaagcccgaaccaaagccaccagtttatacacctccaaagaaagagaagcttgaacacaaaccaccagtatatgaaccaccaaagaaggaaaagcctgagcctaagccaccagtttataccccaccaaagaaagagaagcctgaacccaagccaccagtgtatgaaccaccaaagaaggaaaagcctaagcctaagccaccggtttatacaccaccaaagaaagaaaaaccagaacccaaaccaccagtttatcagcctccgaagaagccaccagtttatgagcctaaaccaacaaaaccaccagtttatgtaccacccaagaaagagaaacccgacccaagccaccagttttatgaacatt

SEQ ID NO: 19351 - DNA, 438 bp, Gossypium hirsutum
  Clone ID: uC-gsflnu33B074h03b1
gtccgcccacgcgtccgggactcatcatccatttgttggaaggcagtgatctcgtttctcaacttagcgttcttgcttggtgggaaatacttcatggggaatctttcggctaactcttgccacgtagaaattaagtttggtggcaatgaattcaaccaggctcgagctctgtcccttagtgagtacgagaacagctttaatcgtaatgcctctttgggaaccccagctaatttgaaagcgtcgcttaccttcataaatagtcttaggtgaagataaggatctttagtaggcattccactgaattggcccaccgtctgaagcatctggaacatgactggcttcagctctaattgttgtaccttgattccgggtctcctaatgcccagattaagatcgataaatactgctacaacatattgtcttaaggctttattccta

SEQ ID NO: 19352 - DNA, 291 bp, Gossypium hirsutum
  Clone ID: uC-gsflnu33B074h04b1
cgtccgcccacgcgtccgaaatgaaattcattccacttccttactatcactaatactctacactaagattatgaattttcttaccgcaagtaataacaaaaataaggttaatttaggtaagaaaatcaaaatgctcaaaagcattgctagagactatggaagtggaatgaatggctttagaaattgtatgaaatgaaattcatattctaaaaaaaaaaaaaaccgaacacaacaaaaaaacaaaaaaattaacaaaaaaaaagacaaaaggaaaaataaaaataaggagaa

SEQ ID NO: 19353 - DNA, 482 bp, Gossypium hirsutum
  unsure (1)..(482): unsure at all n locations
  Clone ID: uC-gsflnu33B074h09b1
acgcgtccgcttacagctaagcttcaagcaaaatatggggtttgcagtagcaactaaagctgccttgctcctgcacctttcccttttcgtactgagtagcttcacggtgtcttctcagatcttgcctgaggctttgcctcctcattaccatggaatttcgcctgtagtgccacctgctcacccaccaagccaccaccaccaccatcaccatccccatccgcatccgcatccgcatccgcatccgcatccccaccagccaaccccttcccctactaagcccccaactcacccacctgtttaccccccacccaaagcacccaagattgctccagtttatccaccacccaagtcaccaagcaagccgccaacttacgctcctcctcccaagtcacccagcaagccgncaacttacgctccttcacccaagtcacccagcaagccgncaacttacgctcctncgtccaagccaccgaccaagccac

SEQ ID NO: 19354 - DNA, 420 bp, Gossypium hirsutum
  Clone ID: uC-gsflnu33B075a10b1
tagaaatgatgactaaggtctatgccaaggttagtggattaaactgtgctggagtctccaacagttgatgtcagctccaaggaattttatggtgagggttatgatgatagtgacaagagaattccagacatgaccataataaacaaacaactcggttggaaccccaagacatccctttgggacttgctcgaatctaccctaacctaccaacacaggacttatgccgaggctattaagaaatttatagcaaaaccttctgcatcctaaaggaggctagattgttaaaccacggcttaagaaaggacttattaatatgtgcttcatggcaaatgtttcaattcttttttcccccccctcttttaggaagtcttaaatatatcataacgtcgcttttttttatacctcccccccttttttttt

SEQ ID NO: 19355 - DNA, 295 bp, Gossypium hirsutum
  Clone ID: uC-gsflnu33B075a12b1
tcgtcacgcgtccgcccacgcgtccgcttagtcattcttttccaactgacaatattgacaaatcacctgggggaagtgcatctgctgttgaaagtatcaaaaaacaatctagtcaggttgatacagaaaaggaacggaatgtgtctctactcttaaggtctccaatattagaatcaaatcaaaccacgactgctaatgcaaatactgagctcgatgggggagattttgctggtctttttgacaaatttgttaatgataatgataggagacttgattttggtattagtgctgtctc

SEQ ID NO: 19356 - DNA, 100 bp, Gossypium hirsutum
  unsure (1)..(100): unsure at all n locations
  Clone ID: uC-gsflnu33B075b02b1
gctgntgatctagtaaacgagactaagctagatgatgaaatttaaatcctggctcgcatttgctgcccagaaagttgttgaagtcatctcacattaccac

SEQ ID NO: 19357 - DNA, 243 bp, Gossypium hirsutum
  Clone ID: uC-gsflnu33B075b05b1
gatcgttcagcgccttcgattccaatagagatagagagagagaggaggagatcttcgcttctctccgtcgttctgctccatttgataaccgcttgcagttctctcagacgtgaaaaatggggttgttttttacaaagctattcatccgggtttccgccaagaaggagacgcgtatactgttggctgggcttgttgctccttggtaaaccactttcctttacaagctgtaagccgggagagact

SEQ ID NO: 19358 - DNA, 297 bp, Gossypium hirsutum
  Clone ID: uC-gsflnu33B075b11b1
tataatgaattgaaggcacaatgtaatcactcttcctaatcggcttttagcatgggtaagaaagttatcacacctgtgaggagtccgcttaagccataaacggttcaagccgttgtttgcttggatgattggatgcgagctaagggattttcagcagaaattggttgcaaaaaggacgatgaggacgatgatgatgatgtttcttcagtagctttttaagatactttatttctaaatgtttaaaatttaatttagcttacaatttataatttgttatgaaattaaatatgttgatgg

SEQ ID NO: 19359 - DNA, 558 bp, Gossypium hirsutum
  unsure (1)..(558): unsure at all n locations
  Clone ID: uC-gsflnu33B075c01b1
tctcgcgtccgatccaatcaaactatcagtgcttcacactacacttcaatctccaaaaaccaaatcaaagcgaagctcaaaaatgaggtatggcatttcaaggaggaagcgagctttgctacgttgcttattcattctcttcgcagcttttactttcattacccggcttatgctcactctaagatccctcgatgccccgcccaccaccattaccaccacttccaacggagccatgctggatttgcctgcccagctcgagctcctagacctcaaaagggtcgcctttttgtcttcggccgagacgcccattcaagctgggcccaagaccaagaactgtgcaaccgtggaagaaatgggcaaggtttttagggggaggattttgaaggacagtcttagagttcgaaagcttattcaaactcacttttctatcaacggtaatcgtatttctcttttgagtcccttttcaaagaattactggtaattttttcctattttaggcgctccaagaatccgtgaactgccttncgagcagttttgcagacatgggtttgtgatagg

SEQ ID NO: 19360 - DNA, 584 bp, Gossypium hirsutum
  Clone ID: uC-gsflnu33B075c05b1
cctacgcgtccggcctaggcacgcaaacttaggctttgtcctttttattccagtgaacgttacaagttgattctcacaatagagctcatatctgaacatggagttttcaaaaaaatctcaggtgtttgagacactgatctcggctatatttttattggaactactgagaccgaatgtagcagaatttcgagcagtggggtttgcgaccagctccattactttctcgggcgcttaattgcctcctacttagtgcgtgttttgcatgtatttcgggttgattctttacttttattcttcttctcttataattttctatttattttctcttcttatttctattcttttttactctatccttatcttctcttttcttttctatcttaacaattcttctcttctatttttatctttctatctcttctttttattgttctatttttaacctcttttattattattcttttcattatctctatttttctattttattcttttcaattcttactttccttatcttttctattattctttttttttctttttatttcttctcttttcttcttactttctttttattttttttt

SEQ ID NO: 19361 - DNA, 493 bp, Gossypium hirsutum
  Clone ID: uC-gsflnu33B075c07b1
tcgttaaaacagggaaagaaaagcagcgtaatgggtgaagaagtgaaggtttttggatactgggcaagcccttacagctacagggcagagcttgctttgaagttgaaaggtgtttcttatgagtacataaatgaggatatctttggcaacaagagcgatttgcttttgaaatacaatccggttcataagaaagtcccggttcttcttcacaacgggaaaccaattgtagagtctcttgttatacttgaatacattgaggaaacttggaagcataatccctatttgccacaagatccttatgacaaagctaccgttcgatttctggatcaagctcatcgacgaaaagtgctttcctaccctttggttagctgtatggagcgccgtgaattgagctatatactgtgacaaatgaagcttgttagtttctgaaatctcttgaattgcctttatggtatgaaattttttttaggataaaccatctgattgctttata

SEQ ID NO: 19362 - DNA, 470 bp, Gossypium hirsutum
  Clone ID: uC-gsflnu33B075c08b1
tccacgcgtccgcttaatttgaagacacagttctctcatactaaaaatgacatggaagtttaccttgtaattagagatttggtttcattgctttttgttgggttattaatgatatggggatgcagaactttaaactgggtatggctggccccaaaaaggctcgaaagctgcttgagacaacagggttttgcagggaattcttacaggttcctttctggtgacataaaagagctttcaactatgagctgacaaacaagagccaaacttatgccttttagtgatgatattgggctctatgttgttcttttttaacatctaattgctaacctggatgtatttatttacgtgttttgttcttagactaaggtgtgtatttactgccctctttatttttggtcatttttttgtttaatttttttgctttcatgagattcctttctagtcttttttaatctttttgttaatgttct

SEQ ID NO: 19363 - DNA, 266 bp, Gossypium hirsutum
  Clone ID: uC-gsflnu33B075c10b1
tcgtattcctccggtgaggttcaagccaacagccgcgatattttaacgttgcctgcgatgggctctcacgcattgcgaaacacaagccttgaacccagttgacggagatgaaaaacgagaggcgattgcaaagcaaatctctgaccgtacatagtacgaactctggagataagagaagctgctgctaatacaaaaattaaacactaaggctctgaccaccatcaccaccagtactactacttccacggcgcgcgtaacggcccctg

SEQ ID NO: 19364 - DNA, 79 bp, Gossypium hirsutum
  Clone ID: uC-gsflnu33B075c11b1
ttgttgggtccaggggtcaacatgccgatggaagaaactatgggttttccattttgaagtggtatggatgtatgtatgt

SEQ ID NO: 19365 - DNA, 472 bp, Gossypium hirsutum
  unsure (1)..(472): unsure at all n locations
  Clone ID: uC-gsflnu33B075d01b1
tctacgcgtgcggccacgcgtccggtcaggggttaacgtatacaagtttgatgacaagtactttgccaaggaagtagagaagaggaagaagaagactgagggagagttttttgaggctgaaaaagaggataagaaaaaactgcctgaagacaagaaagaagaccagaaagcagtcgacgcctctttgataaagtccattgagggagtcccagacttgaaggcctacctcgccgcaaggttttctctcaagtctggcatgaaaccgcacgagcttgtcttctagagggtattttgcattcccttatgttaaagggattttacttttgaattcttttggtttagattatctatggttttattatggggtgctattgctatatgtgcagaacctaaattttggatagtatcttctgttatgcaagaactaaagtttccttaaaaanaatggtgcctgatgtgtttttttttattt

SEQ ID NO: 19366 - DNA, 411 bp, Gossypium hirsutum
  Clone ID: uC-gsflnu33B075d07b1
tcgttctttttcaactttctcttcttctctttgttttaaagaggggctggagttttagccaaagaaaactccatggctaaacttgttgctactttcttcttggctctcattgccatctccatggttcaaactttggttatggcatcacatggacatggtggtcaccattatgataacaaacgttatggacctggaagtctcaagccttaccaatgtccatctcagtgcacaaggaggtgtagccagacacagtaccataaaccatgcatgttcttctgtcagaaatgttgcaggacatgcctttgtgttcctccagggtattatgggaacaaacaagtttgcccttgctacaacaactggaaaaccaaggaaggaggccccaaatgcccttaaattactcaaaagaagacc

SEQ ID NO: 19367 - DNA, 108 bp, Gossypium hirsutum
  Clone ID: uC-gsflnu33B075d08b1
tcgttgtccccatctctctcgtctctgggtctcgtaagtgggtgaatagtgttgccattagtgccaacggcccggattgggacctctgcagctcacattgcgttgtca

SEQ ID NO: 19368 - DNA, 462 bp, Gossypium hirsutum
  Clone ID: uC-gsflnu33B075e01b1
cccacgcgtccgctttgtggaagtgaaaaaggaacttgatcttgtcccctccgtgcctcaactttctctggctcgccaaaagtttactgatgactgtgaagcttccatcaacgaacaaatcaatgtcgaatacaatgtttcctatgtgtatcatgctatgtttgcttacttcgatagggacaacgttgcactcaagggtcttgccaagttcttcaaggaatcgagtttagaagagagagaacatgctgagaaatttatggaataccagaacaaacgaggtggaaaagtgaagctgcagtccatagtgatgcccctctctgagtttgatcatgcagagaaaggagatgcattatacgcaatggagcttgccttgtccctggagaaactaacaagtgaaaagccttttaacctacgtaatgtagccgtgcggaaccatgatgtgcagttgacggatttcattga

SEQ ID NO: 19369 - DNA, 413 bp, Gossypium hirsutum
  Clone ID: uC-gsflnu33B075e02b1
gtacacttcctttgtttgtgagattattttctcacgaggggtaatgaaaagagttatagaatggattgctacctatgcctagatcgcagataaatggaaattttattgataagaccttttcaattgtagccaatatcttattacgaataattccgacaacttcaggagaaaaagaggcatttacttattacagagatgggatgtcggctcaatccgaaggaaattatgcggaggccttacagaattattatgaagctatgcgactagaaattgatccctatgatcgaagttatatactatataacataggccttatccacacaagtaatggagagcatacaaaagctttagaatattattttcgagcactagaacgaaacccgtttttaccacaagcttttaataatatggct

SEQ ID NO: 19370 - DNA, 448 bp, Gossypium hirsutum
  Clone ID: uC-gsflnu33B075e04b1
cttctttcaactcaaagaaaactcccaagtaatattagaatcatgggtgttgtcacttataactatgagtctacctctccagtcgcccctgccaggcttttcaaagctttttctcttgaagctgacaaggtttggcccaaggctgctcctcaggcagtcaagagcgttgaggttgaagctaatcctggccctggaagtatcgtaaagatcaactttgctgaaggccttccattccaatatatgaagcaccagattggaggacatgacgacaagaatttgtcatacagttatagtttgatcgaaggtggacctttgggggacaagcttgagaaaatcagctatgacaacaagtttgaggcagctgcaggtggaggaagcctttgcaagagctcgatgaaattttacactgttggcgactatgtgatccactgagatgaaatcaaggctt

SEQ ID NO: 19371 - DNA, 247 bp, Gossypium hirsutum
  Clone ID: uC-gsflnu33B075e08b1
tccacgcgtccggctcaacccaggaaagctccaaaaaatagtcctacttctgttttacgatctacatttcggtgtctaagactgtcgcgaaagatggataaagtggcagagcttcgaagcatttcagaggcagcagcagggtgcaatagggataggctgctgttctcgtcgccactgatacctgctaactatatgaaggttggacgtggttcaaggaaaagggaaccctcagatgtggaagatgcat

SEQ ID NO: 19372 - DNA, 505 bp, Gossypium hirsutum
  Clone ID: uC-gsflnu33B075e09b1
tccgtctctttgtctcatgtttcatactcatccaccttcacctcttcagcatcaaaaaccagagtctccggaccttctctctcccctcattccatcaaagttcccaccttctcgtctttgactgtcaaacccctaaattctagcttcaccccacatggcgcacgtgcgatcaccattgcgccacatgccacctccaccccctcttccattccttctgacacctcaactacaacctttcatggcctttgttacgttgttggtgataatattgacacagaccaaataattcctgctgaataccttacgttggttccttcaaacccagatgagtatgagaaattgggctcatatgctcttattggcctcccttcatcatatgctacacgttttattgaaccaaatgagactaagaccaaatactccatcgcgataggtggtgctaactttggctgtgggttctcgcgtgagcatgcacctggtgcacttggagcttgaggggccaagg

SEQ ID NO: 19373 - DNA, 229 bp, Gossypium hirsutum
  Clone ID: uC-gsflnu33B075e10b1
taagtttcctttctcgattttctatttagccagagacaagatgcagatcttcgctaagactctaaccggcaagacgatcactctcgaggtcgagagcttcgatacgatcgacaacacgaaggcctaaatccacgagtaggacggctgccatccagaccagcagcgtctgatcttctgcggtaaacagttccttgactaacagccctgcttcaagggctgcctgtaaaac

SEQ ID NO: 19374 - DNA, 449 bp, Gossypium hirsutum
  Clone ID: uC-gsflnu33B075f02b1
atgccgccaacttatcctaaaccacaaaggagcctagtggctgttcagggcgttgttttttgcaagtcatgcaaatacgctggatctgacaccctgttgggagcgactcctattttgggtgccactgtaaagctgacatgcaagaacaccaaatacaagcaataggccactgcgaaaactgacaagaatggctatttcttcctgcaagcaccaaagaccgttaccagctttggagcccacaaatgcacagtgtctctagtatcatcgtcaatggctaaatgcagcattccatataatatgcatggaggattgaagggggctaccttgaggccctggaagccatttactgtgaacaagcttttgtttattatatacaccgttgggccttatgctttttaacattaattccattaaatacttaatatttacttttttacttagtcttcttt

SEQ ID NO: 19375 - DNA, 534 bp, Gossypium hirsutum
  Clone ID: uC-gsflnu33B075f05b1
agtgatcaaccaaccaaaaaagataaacaagatggtttcagggtcagggatctgcgccaagagagtggttgtggatgcaaggcatcacatgctaggaaggttggcttccattttggccaaggagttgttgaatggccaaaaagtagtggttgttcgatgcgaagagatttgtatgtcgggtggtttagtgaggcagaagatgaagtacatgaggttcttgaggaagcggatgaacactaagccttctcatggccccatccattttcgtgctcctgctaagatcctctggcgtaccattcgtggcatgattccccacaagaccaagcgtggggcagctgctcttgctcgattgaaggcttatgaggggattccagctccatatgataagacaaagaggatggttattcctgatgctctcaaggttttgaggcttcagaaaggacacaagtactgcttgttgggcaagcttttctctgaggttggatggatccattatgacaccttaaggagctcgagaggaagaggaaggaagag

SEQ ID NO: 19376 - DNA, 225 bp, Gossypium hirsutum
  Clone ID: uC-gsflnu33B075f09b1
tacaattaattaatgtaaaacgtgtggtttgttccaagtttttaaccttatggattctacttgttccccccctttgagaaatgaatgattgtactgagttgtgaaaaattcttttgaatggtaaaccttcatagccattgaaaattgagacttggaaggggtatcaaaattgtaatgcttgttgctatcgcaatatagaataatcacgtttgtgctgtgcatgcc

SEQ ID NO: 19377 - DNA, 71 bp, Gossypium hirsutum
  Clone ID: uC-gsflnu33B075f11b1
tcgtataaaaaaaaaaaaaaaaaaaaaaaaaaaaaaaggacatacaaaaaaaaaggaaccaagaaaacaac

SEQ ID NO: 19378 - DNA, 51 bp, Gossypium hirsutum
  Clone ID: uC-gsflnu33B075g10b1
tcaaaatgccgtcaacggagactatcatccgggaacttcatgaaagctccg

SEQ ID NO: 19379 - DNA, 454 bp, Gossypium hirsutum
  Clone ID: uC-gsflnu33B075g12b1
tcgttttggatgacagcataagtgatgaaaaacttaaagagctattctctcaatatggtatcataacgtcatgcaaggttatgcgagatactagtgggataagcaaaggatcagggtttgctgcattttcaactgcagaagaagcatcaagagctcttgcagagatgaatggcaaaatggttgtcagcaaacctctctatgttgcactagctcaaaggaaggaagataggagagccaggttacaggctcaattttctaaaatgcgaccagctacaatgtcaccattagttgctcctctgttgccaatgtacccacctggtggtccaggtcttgggcagcaaatattttatggtcaagcacctccagcaatgttttcgctgcctggatttgggtattaacagcagctcgtccctggtatgaggccttgtggagcttccttgccaatttttttgtc

SEQ ID NO: 19380 - DNA, 461 bp, Gossypium hirsutum
  unsure (1)..(461): unsure at all n locations
  Clone ID: uC-gsflnu33B075h02b1
tgtgaggccaactagttgttgtagctaacttgaccaaagatcaattaggacagtctgttcaccttgcacatttggagctcaggataacacatgcaggtggcggagtacctgaagcaatgctgaaccaaatgtttggaaatgaggaagacgcatcagaggagggtatcagtttgctcatcagccggaagttggtaaaactcatgaatggagatatccagtacttgagggaagcaggcaggtcaactttcattgtgacagttgaacttgctgcagcaaatggtccagattccagaacctaactgacttttgtggatatgatttgacaatggtgctgtacagttaaggagaagttttgngtgtttgacaatgtaatttgcaaaagcctgtgggttttatttgttgaatgagttgcactttcataagatgtctttcttccaggctgcagtaaaaggtgctcatta

SEQ ID NO: 19381 - DNA, 304 bp, Gossypium hirsutum
  Clone ID: uC-gsflnu33B075h05b1
cctacgcgtccgctcctacctctcaaaccaaatagaaaagagaaaaagaaggttaagttttcttcaaatttccgtcccaaataaccaagctaaagactcgggacgtcgtgggataaaggaaaggcgaaaactgtagacgagtagcttatctgatttcaattaggtctcatggattcaagaaggttggcagcatccaggtttcaaatctcagctcagtaatgtttgaatcgtcaaatgaggtgtgttttaggttgtttttttggaccctgccaaacttctccctttgaaagtgttttgatgtttt

SEQ ID NO: 19382 - DNA, 174 bp, Gossypium hirsutum
  Clone ID: uC-gsflnu33B075h07b1
tagaaacacgtaataaaaagtggggtagcatcaatattgatatgggtgaagagctgacggctccccgaccctgcacagcccctctccgcccaactgcacctgatcactccccttcgccgccatcgcccctctgtgcaccaatccaccacccaccattaccagactgcccctctc

SEQ ID NO: 19383 - DNA, 415 bp, Gossypium hirsutum
  Clone ID: uC-gsflnu33B075h12b1
tcgtgatggcggctgtggaagttaacgccatatcggcgggggctccagaggcggcaacaacaacaggggcagagaagcaaccacataagctcgagagaaagtggaccttttggtttgataaccaaacagggcataaacaaggcgccgcttggggtacctctctacgcaagggttacacatttgacaccgtagaagaattttggtgttcgtatgatcaaatattcaagcccagcaagttgcccgggaatactgacttccacttgtttaaggccggaattgagcccaaatgggaagatccctagtgtgctagtggaggaaagtggacctgtcactagcaacagaaaggtttaatgttagaatatgtggtttgtaaccttgatggcattgatcggggagcaatttgaagaggttggtg

SEQ ID NO: 19384 - DNA, 78 bp, Gossypium hirsutum
  Clone ID: uC-gsflnu33B076a07b1
agggccccggcgcggaatccgcgggggacgacccacgcgctgctacgagggataaagggccgggcaatgatggggggg

SEQ ID NO: 19385 - DNA, 435 bp, Gossypium hirsutum
  Clone ID: uC-gsflnu33B076b02b1
tgctggcctttttttttctgtttggactgatttgctctaaaatcgaccttcgagacttccttgggactgctaagaaacatgtgcttaaacaacgaaaatctaaaaaactggctattttgacctttcctctgtgacgatctgcgaatattataaaaagatcaggcactttccggaacggccggttgggtgagatcgatattgagaagcgggcgcgacttgacctcatggtggttcaaatcaacgacggatgatgagtcagagcggctctgtacaccattaaacgtcgcatgaagagcatgatgatcgaatccagaccgtgcagatgggtgtgctctgactggaccacgccgaacgaatggttgaaagtataatactttgcggcccgcattatatggcaccggtgactcttgctggaaaggaaatctaacaggcgta

SEQ ID NO: 19386 - DNA, 182 bp, Gossypium hirsutum
  Clone ID: uC-gsflnu33B076b08b1
gcctcgcaaccccagcacacagagtttgtggttgggtagtggtttccacaagacaacaatattaaattttgggatcaggatgatcagatatcgggagatgacgtgttgcgtgttattcttctgtaaacatgcgttagggaacaggaggaagaaaatgggtagagaatgattggtctaacctt

SEQ ID NO: 19387 - DNA, 233 bp, Gossypium hirsutum
  Clone ID: uC-gsflnu33B076b11b1
cgggggccgggccggaagaactggggggaccacaccacgcggatggtcacccacacgaccagccgaaccttggggggggttaatgaacaaaaccaaggaagcaccacccgccaccaaggcaaagaggcaacccccagaggcagcagcacagcgggcgcacaagaagacccgaaaccggccgacccggccacaagcaggagaaagagagcaaaaagaggcctagaacgacccaa

SEQ ID NO: 19388 - DNA, 159 bp, Gossypium hirsutum
  Clone ID: uC-gsflnu33B076b12b1
ggtgccgggccggagtttctttggtcgaccacacgccgcgggtgggatgttggttgaagatcgcataatagcgggttgtttttttataaaaccagagaagcatcacatgtcaccaatgtaaagagccaaccagatgtttgatctgatcagtggtgtatg

SEQ ID NO: 19389 - DNA, 250 bp, Gossypium hirsutum
  Clone ID: uC-gsflnu33B076c06b1
atcgtgaatctctatcccaagccaaatgttggaggtcatcagacgctccaaattgggcagactgtctcaagaaaggacaaaattaagtttcttgtcaccacacttcttgatcttaaagacagtcaagaagctgtctacagagctcttgatgcgtgggttgcttgggagcagaattatcctattggacctcttaaaaatgtaatccttgctcttgagaaggagcatcagtggcatagagctggatcaggtt

SEQ ID NO: 19390 - DNA, 120 bp, Gossypium hirsutum
  Clone ID: uC-gsflnu33B076c09b1
acctaaattcttcaagcgggtgagagagaagaaagggttaatttgacgaagatgccagttgatcacggaatacgttatagaacaagggatttgttcgtaagattctatagaaagaaggtt

SEQ ID NO: 19391 - DNA, 379 bp, Gossypium hirsutum
  Clone ID: uC-gsflnu33B076c12b1
gcctaccacgcgtccgcccacgcgtccgcccacgcgtccgcccacgcgtccgaagaaatcacattattctcccaaaaccatggcaagaggttcctctcactcgcaaaacaccgcttcctccaccaccacccgtcccggcgtcatggctcctcgaggttccgctgcagcgacggccggaatgcgtcgtcgcagggttaccggaggcgctgctgccacctccgcattgaccaccgtcggctccggaacgagcaacatgctccggttctacacagactatgctccgggcttgaagatctcccctaccgttgatccttgtcatgagtttttgcttcattgcctttcgtcgttgcttttccactctttttttcatgatctatct

SEQ ID NO: 19392 - DNA, 134 bp, Gossypium hirsutum
  Clone ID: uC-gsflnu33B076d09b1
gcctaaagaatcacctggaatgggggatcgaggatgagttattttgaaaaggcatccacaaacacacttacttgaaagggtcttacaagaagattccaccggccgtcatttctgccgctttagctgtaagttgc

SEQ ID NO: 19393 - DNA, 66 bp, Gossypium hirsutum
  Clone ID: uC-gsflnu33B076d10b1
actgggacgcgggggctcgccaagacagagggggagccgtaaacgacagccccgcgggaacaccca

SEQ ID NO: 19394 - DNA, 94 bp, Gossypium hirsutum
  Clone ID: uC-gsflnu33B076d11b1
aatgatgacaccggggaccgacaagacagagggggaccctgaggggaaagaaggggaaaaacacccgcaaaaaaaaaaaaagaaacaacaaacc

SEQ ID NO: 19395 - DNA, 195 bp, Gossypium hirsutum
  Clone ID: uC-gsflnu33B076e02b1
accacgcgaacggaactagagggcgagcggacgatatagaggagccaaccccacaaacgcgagcaaacgacacaaaagctctaagaaaacccacccgaaaaacacacaagcgaaggccagaggaaacggaaaaccaccaaaaaaaccaagccaataccaaacaacaaaaaaaaggagcaaaacaaaaaaaacaag

SEQ ID NO: 19396 - DNA, 486 bp, Gossypium hirsutum
  Clone ID: uC-gsflnu33B076e06b1
atagaagccctaaattttctcagcctttcttgctctttccctcgctttctcgggaaaaaaaatggcaaacgcggcttcaggaatggctgtgcatgatgattgcatgctgaagtttttagaactgaaggctaaaaggacttaccgattcatagttttcaagatcgaagaaaaacacaagcaagctcgctgcggaaacggtcgctgaacccactgctaggcctccagcttagactgctactaatccaccaaccaagcctccaactcagtctccgacgaagccaccaacacacccaccatctcatcctccggccaagccacctaaatcgagccaggtggcagtgcagggcgttgtttattgcaagtcatgcaagttcgccggagtcgacacccttttgggagctaaaccaattcttagtgcccccgtaaggctgacatgcaaagacgcttaaaacgaattaacggtccagttcaagactgacaagaatg

SEQ ID NO: 19397 - DNA, 385 bp, Gossypium hirsutum
  Clone ID: uC-gsflnu33B076e11b1
acactctgtgcaggggacatagtcatactgatacacagagcagtcagatagagaatgatgaggtcattgctcgtacccttcaggaagaattctcgcatcttgctgtggcagaagcttccgaattttctcatgctggggaagagcagtcgcaagcatcctgtgaacctcatgattggcttactccttcaacaacagactactgttattcaggctatgaatatggccgggatgaatccgatgattttggtgccacatagttcatgctctagttctagccccagtgattcagaggatttttctggctctttggagctgactgagggttatttacttgatgatgaagctggcatgaggttgtatcaaatggtttcacatttctaatgtt

SEQ ID NO: 19398 - DNA, 122 bp, Gossypium hirsutum
  Clone ID: uC-gsflnu33B076f05b1
atgtcgcgtgggttgatgtcctggttcatggagagccttatagaaatgatatggttgagtcctttggtgagctctttatctggttgtgctttcactgctctcggatggttttcatttcttat

SEQ ID NO: 19399 - DNA, 508 bp, Gossypium hirsutum
  Clone ID: uC-gsflnu33B076f06b1
cgtgaccacgcgtccgagattcgggggaacagcggagaacttatagggaaccaaaagtattcggtagccgaaacattgctcggaaacgccacatgcgcaggcctggctgtgatgataataattttatccaccggacacatatctggggctcatcttaacccttccctcaccattgcatttgctgcctgccgtcacttcccctggactcaggttccagcctacatagcagctcaagtttcggcctctatttgcgcttctttcgctctaaagggggtcttccatcccttcatgtctggtggcgttactgtcccctccgtcagccatggacaagctttcgcactcgagttcctcattacttttaatcttctcttcgtcgtcaccgccgttgccaccgacacccgtgccgtgggagagctggctggaatagctgctggggcgactgtaatgctcaacatccttgttgctgggccatgtagtgggggtttaatgatttctgtgtggatactgt

SEQ ID NO: 19400 - DNA, 377 bp, Gossypium hirsutum
  Clone ID: uC-gsflnu33B076f07b1
cgcggcgcggtatttttgggtcgacaccacgcgtgctacgtatgctgaggccaagtagatacttagtggcacatataaatggcatacattttactaactaatgcattacatattataactcaatacgcatccatcatttactccataaccgaacaccatcatatgaaaatatatacctggagatattatatatgtcatgccaatacatcatgcgcaaacatatatatatgtgggtgtgagccacattatatggcggcgtctgaaccaacatattggtgaatttagagggggcgcataagcttctagggctggaaggccatggctactgtagcatgtgtcgtttcgcgttttcatgatcaaagtgttgcttgtgagtt

SEQ ID NO: 19401 - DNA, 128 bp, Gossypium hirsutum
  Clone ID: uC-gsflnu33B076f12b1
gcgggggcaccggcccagaaacctgccgggacgacccacgcggttgttcacgcgaccgagaagacgcagaagagggggaacatcagggagaccacccccgaggccacagacacacggaaacacacagc

SEQ ID NO: 19402 - DNA, 414 bp, Gossypium hirsutum
  Clone ID: uC-gsflnu33B076g01b1
tatacgctggggcagactacatacctggcctaggcacttggcatgttatcagagagcttacaggcacattgcactatgaacatcgtgagagacactgtcctgatgaagctcctacatgtcttgtccctgtgcctgaaggatacaagcgctcggtaaagtggcctaagagtagagataaaatatggtactacaatgtcccccacaccaagcttgcagaggttaaggggcatcaaaattgggttaaggttactggtgaataccttacctttcctggtggtggaactcagtttgtgaatggtgctcttcattatatcgattttattcaagagtctgttcctgaaattgcttggggaaaaagaacccgtgttgtattggatgttgggtgtagaggtgttctatcaactatttttcagg

SEQ ID NO: 19403 - DNA, 416 bp, Gossypium hirsutum
  Clone ID: uC-gsflnu33B076g02b1
gtagagctaccgaagtgtacacctggaccacgggcgttgatctcgaaacttatgcgggttcacaaacaagctcaaaaaagatggccaacgctgcaacgggaatggaggtgcatgacgattgaaagatgaaactgaaggatataaacccggacagaaccggccagatgatagaggggcggccttagtagtggtaccaagtatacatccggcgggggtgcaacatcatagctctactatagggcaaccaaaaattaatttactggccgtagtttaaaaaggtagagacggggaaaacccgggggttaccaaatttaaacgcttggaagaaaaacccctttttgcatgttggaataatacaaaaaaggcccgaaccgatcgtccttccaaacagttgtccaaccctgaatggttaatgg

SEQ ID NO: 19404 - DNA, 400 bp, Gossypium hirsutum
  Clone ID: uC-gsflnu33B076g03b1
atcacgcgtccgaagcaacagacaatggaagcagtacatagggaacttgaactcttgcagcgacaaaaagccacatctgaacaagttgccataaatgcaaagcagcggcagggctccggtggcgtatggggttggcttgcaggaagaactccacaaaatgctgatgatgcttgaaaacctaattaaatagtgcttgcagggaagtcatacccggtgcaatgttctattcactggatcaagagctcaaaccatggatacagcctcttcttgcaaagccggggggaggttgcggacattaggaccttctgcaaatccttgttttagtaggaacctaacgcattgggcactctctttttgtcaaaattttgggtaaaatatacatatatgtcctgttctactt

SEQ ID NO: 19405 - DNA, 464 bp, Gossypium hirsutum
  Clone ID: uC-gsflnu33B076g05b1
acgcgtccgagctgggagggaggctcagatgggaggcatgcactacatgctggggacatatgcagaatcttacaaccttcttcagcagtgccatctggaagctacgcatatgtagagacaagaaatctgccttcttcggcattgctctcaatcaaatggggctggcttgtgtgcaacgctatgctataaaggaggctgttgagttgtttgaagaagctaaaagcattttagagcaagagtgtggaccgtaccaccctgatacactcagcgtatacagtaatctcgcaggcacttacgacgcaattggcaggttggatgatgccattgaaatactggagtatgttgtttagaccagagaggaaaaactggggacagcaaattctgtggtcgacgatgagaagaaacggatggttgaactattacaggaagcaggaagagttgtatgcagaaaagtcagatcatta

SEQ ID NO: 19406 - DNA, 96 bp, Gossypium hirsutum
  Clone ID: uC-gsflnu33B076g09b1
acgcgactaccacgcgtacgcccacgcgtacgaggatgggcattaatacaggtttgaatgggaggaccacaaaaacccagaattgaagaatttcat

SEQ ID NO: 19407 - DNA, 284 bp, Gossypium hirsutum
  Clone ID: uC-gsflnu33B076g10b1
cgcggaatttttgggaccacacacgcgcgctaccacgcgtccgaccacgcgtacggttgagatgggttaactaaatgggctctttgtgctagcacgatccattggtttgattgggcacactttcgatcagaagagactgaagcagccactataccgtcatccatgggaagatgttctttacactaagtgagagaacattacgagcagtaggtgcaaatctcctcgagcattgttgttactggagtccttttgactgcatttttatggggtatggttgatttttt

SEQ ID NO: 19408 - DNA, 376 bp, Gossypium hirsutum
  Clone ID: uC-gsflnu33B076h02b1
ccgtctcgcagtccggcattgttttatgccgcagcttgtcttttcgcacattgctggcgccgaagatccctacaggttctacagctggaatgttacgtacggtgacatttaccctcttggggttcgtcagaccggccttctcataaatgggcaattcccaggccctgatattcactctgttaccaacgataacctcatcatcaacgtctataacaactaaacgaatcttttctcctctcctggaatggagtccaacaaaggaggaactcgaatgaagacggcgtgtttggcacaacctgccctattccaccaggaaagaacttcacatacatgctttaggtgaaggatcatatagggagtttcctattactaccca

SEQ ID NO: 19409 - DNA, 225 bp, Gossypium hirsutum
  unsure (1)..(225): unsure at all n locations
  Clone ID: uC-gsflnu33B076h03b1
tgtanctcaaaataacagcaaatgtgacttgtagtctgtaccagctttatggatagctgattagcagcaatagcagatattttcatttatctgtgttcaattaaaggagttccataaaggctggaacgattgtttgaagcattagcagattttaactccttggatgcatgttcatcctgaattttaacagatagctgattacgagcaagtaccagattttttttc

SEQ ID NO: 19410 - DNA, 310 bp, Gossypium hirsutum
  Clone ID: uC-gsflnu33B076h04b1
ttctccttttccaaacaaatcaaaagaagcagagcccacttttatcgaccatggcagtatcaaacaatacccttttgccatgagccctgccattccctcaacctgggccgtcggatgcagctcacgccgatgcgaaagcgtacgccctctccacgattacactaattcatggttgcattagcgccgacggcatccataggatcacagcactgccgggcactgactgtgcctgaactgactcaccagatgtgggatgctaaaaacatgatgtgtgctgctgacccacgccatggccgcaacctaactgccc

SEQ ID NO: 19411 - DNA, 533 bp, Gossypium hirsutum
  Clone ID: uC-gsflnu33B076h07b1
gaggaagttagttgggtagggggaacacatagtagatagaatggtccggatagattcaagtagagattgcatgcgcattgcatagctgggacaataggaaaggaagcagggagttaatggggggtccaataagttggcatgaaatggattcaaatggatcaaacagcctagtgatttctaatgggtcaggaaccattaataacaacctttcaacccacactgatgtctatcattccgatggaacagcaaagaataggaacagaactacaaaagttgaacccaaccatggggatgaatgggttgagcaagatgagcctggtgtatacattacccttgttgcattgcctggaggtatcaaagatcttaagcgtgttcggttcagtcggaggcgtttcagtgaaaagcaagcggaacaatggtgggcagcaaacagggctagagtatattagcgggtcaacgtttccttggttgaaaaaaccactcttggggcgggaagggaagggtaggttattgacttgggagatttaaaattt

SEQ ID NO: 19412 - DNA, 533 bp, Gossypium hirsutum
  Clone ID: uC-gsflnu33B076h11b1
taggaaagagagacaaagatgggaggtgggctgtattctgaagggactgaaagggctctatacttagctgacaactgagctttttttcccactgggtgttgctttgatttgatgattttctgtgggggagtgtatattacgaagacctaatatagtggttgctgaaatattttatgcaatagataggttgtaatacgctaccctagtgacgttactttggtccaaaatggtggtctctatgtgtgccatattaacacatatgtggattttgtggcctgtcatgtatgttggtgtggatatgatgacctagctgtttgatgcggacagagttgatggattttctggatctggattgaattgttgtgttctgtcttgcccatgttgttatttttctgaattcttattaattttttcttcttttttgactcctggctattttattgattttccgtcatatgtccgtttttatatcattttatattttttagctattttgtactctctttctttctttttttttcatgttttttttt

SEQ ID NO: 19413 - DNA, 92 bp, Gossypium hirsutum
  Clone ID: uC-gsflnu33B077a02b1
aaaaaaaaaaaaaaaaaaaacaaaaaaaaaaaaaaaaaaaaaaaaaaaaaaaaaaaaaaaaaaaaaaaaaacaaaaaaaaaaaaaaaaaaaa

SEQ ID NO: 19414 - DNA, 130 bp, Gossypium hirsutum
  Clone ID: uC-gsflnu33B077a09b1
taacccaagtgggtacgaaaagtattcaggttcagcagcagaagcaaccaagtttggccaagacgccgccacgacagggattccagttagcatactacaactcatattacactcgactcttcacaaaaca

SEQ ID NO: 19415 - DNA, 243 bp, Gossypium hirsutum
  Clone ID: uC-gsflnu33B077c02b1
tatttgaatagtttagattacaagaatggcaggggaattagtattgttggatttctggccaagtccatttgggatgagatccaggattgcttttggctgagaaagggataccatacgagtacagagaagaagatttgaggaacaagagtgaatttgttgctgcagatgaaccctgttcacaagaaaatctctgttcttatccataatggtaaaccccgtttgtgagtcttgttattcaggttt

SEQ ID NO: 19416 - DNA, 96 bp, Gossypium hirsutum
  Clone ID: uC-gsflnu33B077c07b1
agttcgcgccaaattgtgctcaaatctgccggcgaaattatgactctgaaaatctaaaaatgtccgtccacaattcagcaggtgatgaaaacggct

SEQ ID NO: 19417 - DNA, 175 bp, Gossypium hirsutum
  Clone ID: uC-gsflnu33B077c11b1
actaagaaaatggggttccaagaaaggtggaaattgatcttatagcaaatggcatttttagttactaaagtcggactgtcatccttggtttaatctgcaaaattacattaccttgcatttgcattttcatgctttggaattttaactggttggattaatagctctatgctcacag

SEQ ID NO: 19418 - DNA, 289 bp, Gossypium hirsutum
  Clone ID: uC-gsflnu33B077d02b1
gtccatggaagctgaagggggtgttatgatattaatgtacttatttgaaactcatctggacttacggcaacatgctgatctagagtgccaactcttacaaaaacattggagggagtaagtcatccaatagaaatttgaaaagtcgtagagcctatagcactcgataagagccactttcatatggttcatgagttcgtgactatccggatagattctgcactgtgttcattggaatattgccttggatttggaagaaatcaggaacttacttgcctttacttggactaaa

SEQ ID NO: 19419 - DNA, 136 bp, Gossypium hirsutum
  Clone ID: uC-gsflnu33B077d06b1
gagaatcccctagtaacggcgagcgaactataaggagcccagctagagaatcggtcgccatcggcgtaaaaaaaagaaactaggagaagcgttctcagcgactgaccggttccaagttcttctgccaaaggagctc

SEQ ID NO: 19420 - DNA, 120 bp, Gossypium hirsutum
  Clone ID: uC-gsflnu33B077d07b1
tattcgattaaaacctttgaacagcacctaaacgagaggaaaaagaacaccctgataactgcccatatgtgaacccccacagatggagaagcccgagacaacagccataggttcacacac

SEQ ID NO: 19421 - DNA, 195 bp, Gossypium hirsutum
  Clone ID: uC-gsflnu33B077e04b1
aaataagtcttctttttcttcaatttagaggaatttgtgggggtagaataaattaactgcggaggttcatgaaaacgatttggatgaaccttgggttaaattgaattgggtttttagttaatatatcgaaatcgatggactcaacttttttaatgggtttagaccttgaactcatatttatttgctgctgttttt

SEQ ID NO: 19422 - DNA, 53 bp, Gossypium hirsutum
  Clone ID: uC-gsflnu33B077e06b1
ataaaaaatggcttctttcaattacatgttcctgagctttagtcctggcctct

SEQ ID NO: 19423 - DNA, 93 bp, Gossypium hirsutum
  Clone ID: uC-gsflnu33B077f02b1
ggtaacattgggatcattgcacccattgcaatcggtttcattgtgggtgccaacatcttggctggtggagcctttgaaggagcttacatgaac

SEQ ID NO: 19424 - DNA, 63 bp, Gossypium hirsutum
  Clone ID: uC-gsflnu33B077f07b1
aaaaaaaaaaaaaaaacaaaaaaaaaaaaaaaaaaaaaagatagcattggggcagcagaaaat

SEQ ID NO: 19425 - DNA, 116 bp, Gossypium hirsutum
  Clone ID: uC-gsflnu33B077f11b1
aggtcgcaattgcggatctaactgcagctgcggtgacaactgctcatgcagcaggaaccttaaccttggatttttggagaagacaaccagcactcagaccatcatcttcggagttg

SEQ ID NO: 19426 - DNA, 294 bp, Gossypium hirsutum
  Clone ID: uC-gsflnu33B077g03b1
acagtgctggatgcagatctggaggttgatggtgaggttgccgctgcggtggaggctatcaggcagaagaatatggagtctgatagcatccttgaagctaaccctgaatacaccgctcctctgactgcgcctctgaagaatgcacttgactggccttcaggaccaccaaatgtatgggcagatatagcgggtgccataggaagcgccggaggaggcttagcaggtgcgcgatcacattatcatgttggccaagttggggtacatcttgatctacattccatgaataaacccgag

SEQ ID NO: 19427 - DNA, 70 bp, Gossypium hirsutum
  Clone ID: uC-gsflnu33B077g04b1
ttttggaacctgcttcagttgatgctgatggaaatgctcgtgaagatgtgatgcatgcgaatgacctagt

SEQ ID NO: 19428 - DNA, 84 bp, Gossypium hirsutum
  Clone ID: uC-gsflnu33B077h01b1
acctctgagacaaaccatatgtcagatttattactactaattcctccctttgcaagtctagattttagggttttgaattgtagt

SEQ ID NO: 19429 - DNA, 238 bp, Gossypium hirsutum
  Clone ID: uC-gsflnu33B079a05b1
gtattatttggcgtgctttctttctttttgtcttgctgttccagtaccttatgtttggtagtgtttaagtaagctttaatagtttatatatcttaaatttgtgttgtcttgctattttgaatattttgttgtttatatcaatctaggaaaatttgacatataaaaaaaaaaaaaaaaaaaaataaaaaaaaaaaaaaaaaaaaaaataagattaagaaagcgcgacctctgggaggat

SEQ ID NO: 19430 - DNA, 488 bp, Gossypium hirsutum
  Clone ID: uC-gsflnu33B079a06b1
ctcacgcgtccgaaacgccccatctccgatgatgaggttgcatggcttgcaaagttgcttatttggttatccagttggttgaatgaaagccttggcctaaaccgcccagaagataatgatgtgggttctaagtggttctatgtgaacatcccaggtgatgcagtaaacctgaacggatcaggtgagatcgtgaaaactctggtttgcttaattggttcttggcttttaatgatgggaacaacaacaacgagattaatgagaaaacacggtttaaggataaatcttagggtgttggcttccaagaaggtggtgatggtgttgctcatatttgttgtatttagtgtattgaagaaagcttgtggattgttccattgatagtgtaaataaatcaaacatacgaatagggaggaaatggttctcagtttttttggatttgatctcctaaagcaacagcaacgtgtgaagcaagaaagaaatttcgcataaaa

SEQ ID NO: 19431 - DNA, 479 bp, Gossypium hirsutum
  Clone ID: uC-gsflnu33B079a09b1
ttgaccagcagaggcttatctttgctggtaaacagctgttggatggccgtacccttgctgactacaacatacagaaggaatccacactccatttggtcctccgattgaggggtggtatgcaaatgcttgtaaagaccctcaccggaaagaccatcacattggaggtggagagttctgatacgattgacaatgtcaaggccaagattcaggacaaggaaggcatccccccagaccagcaaaggctgatcttcgctggtaagcaacttgaggatggccgcacattggctgattacaacatccagaaggagtccacactccacttggtgcttcgcctacgtggaggaatgcaaatttttgttaagactttgactgggaagaccattacattggaagtagagagttcagataccattgacaatgttaggcaaaaaatcatgacatggagggaattcccccaaacaacaaaagctgatttttgc

SEQ ID NO: 19432 - DNA, 414 bp, Gossypium hirsutum
  Clone ID: uC-gsflnu33B079b01b1
atgcttgtcgcctgcgtctctctcttcatctgggtgaactttaaaagtctttagcttttcgcttcgagagagaccatgttggtttgccaggatctcatctccggtgacgagcttctttctgactcattcccctacaaggaaatcgagaatgggatgctgtgggaagttgagggaaagtgggttgtgcaaggagctattgatgttgacattggtgccaatccttcagccgaagatgctgatgaggatgaaggtgttgatgaccaatctgtgaaggttgttgacattgttgacactttcaggcttcaggagcaaccccctttcgacaagaagcagtttgtcgtgttcatgaagaagtttatcaagaacttgacaccgaaacttgatgcggaaaaataagagtcctttagaaaaaca

SEQ ID NO: 19433 - DNA, 485 bp, Gossypium hirsutum
  Clone ID: uC-gsflnu33B079b04b1
atacgcgtccgcggacgcgtgggttcgtcgggaattcttggctaacaagatctctgaggacgactatgttaaagccatcaaggaggaaattaagaaggttgttgaccttcaggaagagctcgacattgatgtccttgttcatggagagcctgagagaaacgatatggttgagtactttggtgagcagttgtctggttttgctttcaccgttaatgggtgggtgcaatcttatggatctcgctgcgttaagccaccaatcatctatggtgatgttagccgccccaaaccaatgactgttttctggtcatctaccgcccaaagcatgacttcacgcccaatgaagggaatgcttaccggccctgttaccatcctcaactggtcgtttgtccgaaatgatcagcccagatttgagacttgctaccagattgccttggctatcaaggatgaagttgaggatcttgagaaggctggtatcaatgttattc

SEQ ID NO: 19434 - DNA, 548 bp, Gossypium hirsutum
  unsure (1)..(548): unsure at all n locations
  Clone ID: uC-gsflnu33B079b06b1
gttaccttctctcaacccaaacacatatttcccaggaaattgaaaaagcttgagccaaaagaaaatggccgatcagcttaccgacgatcagatctctgaattcaaggaggcctttagcctgttcgacaaggacggagatggttgcattactaccaaggagttgggaactgtgatgcgatcacttgggcagaaccccactgaggcagaactgcaagatatgattaatgaagtcgatgctgatggaaatgggaccattgattttcctgaattccttaacctgatggcaagaaaaatgaaggatacagactctgaggaggagcttaaagaggcattcagggtgtttgacaaggatcagaatgggttcatatctgcagccnagctgcgccatgtcatgacaaaccttgttgaaaagcttacagatgaggaagtcgacgagatgattccggaagctgatgttgatggtgatgggcagatcaactacgaggagttcgtcaaagcatgatggccaagtaaaggacctttcactataccaggattaaaattgggtt

SEQ ID NO: 19435 - DNA, 403 bp, Gossypium hirsutum
  Clone ID: uC-gsflnu33B079b12b1
tccacgcgtccgtgtgtttaaggtattatttgttgtaacttgaaagcacctcgccaatcatatttgtatgtgattttttttatatcactaggaatttaagatttcttaagccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcctttttagaggttccaagttaccttcccggggcttgaaacgcaataatttttttatggggcccccaaatttaatttcatggcccgcggtttaaaaacgtgggaaggggaaaaaccctggggtacccaaattaaatcgctttgaaaaaaatcccttttttgcaagtg

SEQ ID NO: 19436 - DNA, 325 bp, Gossypium hirsutum
  Clone ID: uC-gsflnu33B079c01b1
gtacgtcgtccgcacgcatacgggcttggggaaagtttttgtgcacaagtgacggagagcccaaactgccgacgatgcacaacaggacattctgagcacagaatgcacatgaagctacaacagagaagacaaaagagaccgttgaacgagcagaccataacgatgacctggatactaacaagcatgggaggtcgcgcagcacaagaagatcaaggaacagggaactcgggaccaggaacagcatcaccagtgcaaagaagacgtgcaagcgagagacgcatgatgcagaaagcaactaaaggataagcacaaactatctggcgag

SEQ ID NO: 19437 - DNA, 535 bp, Gossypium hirsutum
  Clone ID: uC-gsflnu33B079c02b1
tttggtgctctcggattgtacaagggtattgttcctctttggggccgacagattccatataccatgatgaaatttgcttcttttgaaactattgttgagatgatctacaagtatggtattcccactcccaaggagcagtgcagcaaaaatctgcagcttggtgttagttttgctggtggttatgttgctggtgtcttctgtgctattgtttcgcatcctgctgacaaccttgtctccttccttaacaatgccaaaggagcaactgttggggatgctgtgaagaagcttggattatggggtctgtttacccgtggtcttcccctccgtattgtgatgattggaactctaactggagctcagtggggtatctatgatgctttcaaagtgtttgtggggctgccaactactggtggtgttgctcctgtgcctgctgctgtggagctcgccaaggtatagaatgttggaaaacctgttgtcatgggggacaagtaaacataagattgctggaatgtttgtcaagctggtggaaggatat

SEQ ID NO: 19438 - DNA, 413 bp, Gossypium hirsutum
  Clone ID: uC-gsflnu33B079c11b1
tactccgcagcctcccccgttctttgaaatcctattttccctttatccgcactggggaaaagaatagagaaaaattgcaatagctttttttgatcgtcataaagaaaaagcgccggggcgtgacctgagatcatcaaaacctaaacacgatcctttgatttccgaaatatgtggagaaggctacttacttcacagttcaaatatctggcaacacttccatgccgatccgcctctaaaacggcgccgcttccattcaaatctcacatttctccttccccttctgcttccctcctcgttcgccatttcttcggcgagtcagcggatactgctgtgaagaagagagttgaggatgtaatgcctatcgctacaggtcatgaacgagaggagctcgagtctgagcttcagggaaagga

SEQ ID NO: 19439 - DNA, 464 bp, Gossypium hirsutum
  Clone ID: uC-gsflnu33B079c12b1
tgctgaacaggcatctataagaacaaagaacgtgctgtgttgattggacgaatatcccttttctgttggatgggatcatcaatatgtaccacattggttgagcttggggagcttggaaggctatctgcatcaatgaaaaagttggaaaagagatttaaggatagtgataagtacaagaatgaggagtatcgtgcgaagctccaaaaatcaaatgagaggactttggcccttgttaaagccggaatggatatagtagtagcagttgggcttcttcaattggcaccaaagaaagtcacccctcgagtaacgggagcctttggatttgtttcatctctcatctcctgttatcagttacttccgtcaccgcccaagtctaagacaccttgaagttggaagcctgttttgcccaacaagcttgggtatctctatcgtttaaataattttattgaacttgtgctttaagt

SEQ ID NO: 19440 - DNA, 323 bp, Gossypium hirsutum
  Clone ID: uC-gsflnu33B079d02b1
atcacgcgtccggtctaatttatgcgagtgtagaaatgttgccttgcgtatgattgatgaagctttatctatctattgtgggcatgcatttgctattaggtggataattagatgtactatgggcactattagcaataaaagaatctatttgttccatatgcaaaacgagtcaaaaagagataaaactatattagggaacacattatatatgatgatatgtgaaattgaggtagaatgaaaaatagctttaatatttcttttttatatgatcaaaaaggatcgggtggggatttttaaagaacaaaagttttttttcctttgat

SEQ ID NO: 19441 - DNA, 267 bp, Gossypium hirsutum
  Clone ID: uC-gsflnu33B079d04b1
gtgactcgcgctgccatcttgagaaacacagtggcagctgaaaagaggggttcatagctctacaccacaggataagccaaagattgaacatgctcttgtagaatctaggcagtggttggattgttgccaattgactgaagctgatgaatctctggatcaaatgcaggaattggttagtgcatgtaaccctataactgataaaatgcaccacgctgctggtgaccacatggttgagattatggatgaggacgcttcttcgctgggtgg

SEQ ID NO: 19442 - DNA, 446 bp, Gossypium hirsutum
  Clone ID: uC-gsflnu33B079e02b1
taaatccctggctctaacaaggatatggctgtcttagaattatggaaggaagtggaagcccaccagttcgattctccatcttcaaaaatagcctgggaggcgttttacaagccatttttcggcatggttaccgactccgcggctgtggaggaaaatgaaggtaagcttgccaaagttcttgacgtgtacgaggctcgattgacacagtcaaaatacttggcaagtgactgcttcaccttggccgacctgcatcacattcccaacattcaatgcttgttggctacacctgccaagaagctgattgattctcgtccgcatgtttgtgcttgggtgaaggagatcactgctaggcctgcttggtctaaggtcctcgctatgcaaaaacagtgaaaggtttctgcgatttggcgcccacccgagctgatatcagtagtccaatgttgaat

SEQ ID NO: 19443 - DNA, 286 bp, Gossypium hirsutum
  Clone ID: uC-gsflnu33B079e04b1
gtcacgcgtccgaccaatattaggcacacgctctcagcttatatacgctagttcacaatgacaaggaaaggccagcatgcagaggcgactcaatcctatgctctcaaggcagttttggctagagtatcaatataaccgagactgcaatccatctggagcagacccaggcctggttatagacgtgtggacggacatcggagcaacaagccccgggcggtctcggaaccgacgctggagctcagggctgaggacccatgctgctgactccgttggcgccaacatctca

SEQ ID NO: 19444 - DNA, 488 bp, Gossypium hirsutum
  unsure (1)..(488): unsure at all n locations
  Clone ID: uC-gsflnu33B079e06b1
gtcacttcagctgccacattggagtgggcattatcagagctcctaaggcatccaagggtaatgttaaaactccaacaagagttagaaagtattgtcgggaacaagagaatggtagaggaaaatgatttaccaaaattggagtacctagacatggttgtgaaagaaatttttaggcttcatcctgttgcacctttgctagttcctcgtgagtcagtggaagacataattattgatggctgttacataccaaaacaatcaagggtcttagtgaacatttgggcaatggggagagaccctaatacttggtccaataatgctgaagagttttttccagaaaggttcattgatagcaatatagaccttcatggacatgattttgaactcatcccatttggtgcaggccgtagattatgcccagggaagaaattaggattaatcacagttaaacttattctagctcattagtgcattgnttcaattgggagcta

SEQ ID NO: 19445 - DNA, 415 bp, Gossypium hirsutum
  Clone ID: uC-gsflnu33B079e08b1
tgcacgcgttcggaccgccatgagcggccattgagaacttacgaacacctgctattgtgacaccacacacaccgggaacagcgcattctgcaccgccacatcgggcacagcaaacatgcaccagagacactgcaaagctaggagcatgagcggacgtgtcgggtggctgatgacacatacggacgtagtagcatgcgccagatggcacttgatgccctgatctacaagaggctgttggatttagacgctgccatttgtctctgtactacgaacaaagccaacctgttgaatatcaataatataatccccatagcttttcaggtgcttatcgactgtggcaaaacttcacctgcagggttccaatgtccagcacaatgatgaaaaacataaaaaccccagggttttgttttttttg

SEQ ID NO: 19446 - DNA, 250 bp, Gossypium hirsutum
  Clone ID: uC-gsflnu33B079e10b1
tccacgcgtccgcccacgcgtccgcccacgcgttccttttacgcgtcccgaactggctgttagagaaacaatgggagaccaaatgcatgggccggtttggcttatggttgggaacaaagggaaaccattctgggcaatcatctccctgcaattggaatatgcagggaggtatataatctcctgggtttctttaaggcatggatggagtaatttcatccttggtacctatcgtcatgtggttgccaccatt

SEQ ID NO: 19447 - DNA, 383 bp, Gossypium hirsutum
  Clone ID: uC-gsflnu33B079e11b1
taacatttttgtcacttatttattcttccagttatttatttgtaaaaactcacacaagtttaggaagaagacgaagatgtcgtggcagacgtatgttgatgatcacctgatgtgtgatatcgaaggcaaccatctgtctgccgctgctatcatcggccaagacggcagcgtttgggctcagagctccaatttccctcaatttaagcaagaagaaatcaatggcatcatgaatgacttttctgaacccggatcacttgccccaaccggattgtaccttggtggcactaaatacatggtgattcaaggtgaaccaggagctgttattctcgggaagaaaggacctggaggtgctactggtaaaaagaccaatcaggccttgatca

SEQ ID NO: 19448 - DNA, 508 bp, Gossypium hirsutum
  unsure (1)..(508): unsure at all n locations
  Clone ID: uC-gsflnu33B079f07b1
tatgctctactcgaatgctttatgctcttgcaaagcatccttttacccccaaaagatatttctctatagatcgtgtgttcagaaatgaatctgtggaccgaactcatcttgcagagttccatcagattgaaggcttggtatgtgacaaggggcttactcttggtgatttgattggtgtcctgaatgacttcttctcacgactaggaatgtccaagttgcgtttcaagcctgcttacaacccatatactgaacctagcatggagatattcagttaccatgaaggcttgaagaaatgggtggaaatcggaaattctggcatgttcagacctgaaatgttgcttccgatgggattccctgaggatgttcgtgttattgcttggggactttctctcgaaagaccaactatgatactctacggagtcgataacatccgggatctattcngacacaaggtggatcttagcctcatgaaacgaaaccccatctgtcgtctcgaaattgattagat

SEQ ID NO: 19449 - DNA, 513 bp, Gossypium hirsutum
  Clone ID: uC-gsflnu33B079g04b1
tcacgcgtccgctgccatctgccagcaatgtggccttgtccccattgttgagcctgaaattcttgttgacggatcacatgacattaaaaagtgtgctgcggtgacagagcgtgttcttgctgcttgctacaaggctttgaatgatcaccatgtcatgctagaaggtactcttttgaagcctaacatggtgacccctggttccgactccccgaaggttgccccagaggttattgctgagtacactgtccgtgccttgcagcgtaccgtccctgctgcagtccctgctattgtgttcttgtctggtgggcaaagtgaggaggaggctacccttaaccttaatgccatgaacaagctccagaccaagaaaccatggtcactctcattctcatttggacgtgcccttcagcagagcactctcaaggcctgggctggaaaggaggaaaacgtgaagaaagcacaagatgctctccttgttaggtgcaaggctaactcggaggccaccttgggtacata

SEQ ID NO: 19450 - DNA, 520 bp, Gossypium hirsutum
  Clone ID: uC-gsflnu33B079g05b1
atagactttacaacatgacacacatgaaggtgcactagatatatttatgaggacattctgtgcataaatataaaaatgctctgtgtgctttgcatttctgctgtttataataggtaataaagcagttgagctgctgtaggtagcatgggagcatgaacagttctcaaggctgagagtcactgctgccactctttctgaactttctgtcacaccagaactcctagaaagcactggtggtctgtttgataccagacaatacgtaaatgaaactgctattgttagaggtgtgaagctagttgctgaaagtcttgcgaggcatatctatggccatcagggaaaaaatatccaaatttttgcagatgagagcagtttggctgtcaatcctgcctatatacgatcttggctggatgttttatcacagacacctcgagtagctccatttctttcaaaggatgacccttttgtcatggcattgaaaaggagttagctggtcatgttgatgaagtgaatgtgcaacatg

SEQ ID NO: 19451 - DNA, 371 bp, Gossypium hirsutum
  unsure (1)..(371): unsure at all n locations
  Clone ID: uC-gsflnu33B079g08b1
ataatatttcatgatttataactattgtactgatttgatacgtttccctcaaggtgttccaccagagtgtaaacgcccaaggttctaaaatcaaacctctcctcctttccatgtaatatattctttttttcactactttcttactatgtattcaagttgcactcaacttgatgcttggggatggatggaataagttgctattattattattcttttttttatgtatttttatttcgttttgttgcttcttaaatcatcttgaaaatagatgtaaattccctgtttctgataataaaattttcctcttttttagtnnaaaaaaaaaaaaaaaacataacaaataaaccaaaaaaaataatataaaaatattg

SEQ ID NO: 19452 - DNA, 420 bp, Gossypium hirsutum
  Clone ID: uC-gsflnu33B079g12b1
taaaaaccactcgttttagcagttaaagatgataaacatgtggatcaagaaccccagtctgaaactccccttcttgctttacaagtaaccaacaacaacagtaagggttgtcaagtgaacaagggtaataagattcacgagtgttcaatctgtgggtcggaattctcgtcgggtcaagcccttggaggtcacatgagacggcacagggcagcagctgccaccaccgcaagcaatcaagttgtggtgagcgttggcaatggcgatggcattaaacccagaaatattctatctttggatcttaatcttcctgcaccagaagatgatctaagggattccaagtttcaattcggagcaccccaacaagctattgttttcttcacaccagctttggtagattgccattactaacccccccccccc

SEQ ID NO: 19453 - DNA, 182 bp, Gossypium hirsutum
  Clone ID: uC-gsflnu33B079h08b1
taccgggcccggatttcctggtccgcccacacccgtccgtcgtgccgccaggctaacatatacctttattgtgaactgttaggagatcaaggacctatgggtgggactgtcttctgtaccacattgggagtccctaggatcgctgtctatccgaaactgccgagggtccggtgatgctagct

SEQ ID NO: 19454 - DNA, 465 bp, Gossypium hirsutum
  Clone ID: uC-gsflnu33B079h11b1
ctcaagatgagaaggatcatgaccgtccctttcttcaccaacaaggtcgtgcaacagtacagacatggatgggaagccgaggttgccagtgtggttgaagacgtgaagaagaacccagaagcggccaccaatgggattgttttaaggaggagattgcagctcatgatgtacaataacatgtataggatcatgtttgataggaggtttgaaagtgaggatgatcctttgtttgttaagctcaaggctttgaatggagaaaggagtagattagcacaaagctttgagtacaactatggtgattttatccccattttgaggccattcttgagagggtatttgaagttatgcaaggaagtgaaggaaatgagattgcagcttttcagggaccattttcttgaagagaggaagaagcttgcgagcacaaaaagaactgacaacaatgctttgaaatgtgccattgatcac

SEQ ID NO: 19455 - DNA, 121 bp, Gossypium hirsutum
  Clone ID: uC-gsflnu33B079h12b1
tacgtttgaatagatgattggcttctccaatagttcatgaagttgttgtttaggtcattcattcactctgtttacttgcttttctttaagaaaaatcatcctggttttgaagcttgttttc

SEQ ID NO: 19456 - DNA, 489 bp, Gossypium hirsutum
  Clone ID: uC-gsflnu33B088a02b1
gttcatatccaaacaaaaacagaaatgggtttccccgatgcatccgcaatcggcggaggcccggaacccgactctgaatccgccctcctcctccgcacatccctaaaaccagaagacaaattcaatttgggctacatcatctacttcactttgggcgttggctttctcctcccatggaatagcttcatcactgccgtcgattacttttcctacctctacccggaagcttccgtcgaccgtgttttcgccgtcgtttacatggtcgtcggcctcgcttgcctcttggtcattgtattttatgctcacaagagtgaagcttacatgcggatcaatgttggtttgggcattttcgtggtttccctggtcgtcgtgcctgttatggatgcggtttatatcaagggtcgggtcggattgtatgacggattctacgtcacggtcggtcttctcgctctggcgggtataggcgatgcgcttgttcaaggtgggctc

SEQ ID NO: 19457 - DNA, 140 bp, Gossypium hirsutum
  Clone ID: uC-gsflnu33B088a11b1
tggacgcgtgggaaaaaatggaaaacgaaatgttttatagttttaacaattttaaaagaaaaaactaaattgtttcgaaaagcttcaaaagaatcttaattttggatcactcaaagcatactatttcttaaatggttaat

SEQ ID NO: 19458 - DNA, 484 bp, Gossypium hirsutum
  Clone ID: uC-gsflnu33B088b02b1
ttcatgcgtccgagaagaagaagaaaatgactgtcattgatatattgacccgagtagatgtgatctgtaagaagtacgacaaatacgacgtcgaaaagcagcgagaccaaaatatctccggcgacgatgcctttgctcgccaatacgctgctattgaagccgacattgtatccgctcttcaaaaagcggagcttgtttccaaggagagaagtaaggcatctgctgttgcggtgaatgctgggattcgacgaaccaaggctcgaatgcttgtggaggtacgtaaaatgttgaggtttgaatgtttataagagcaaggagagaggccataaaagatgtgagccgtagaatttgccattgttgatatgagaacattgtttacaacttcgattttcttcgttccataactaggttatttattacagtgttttacaattgtcttggaatatgttctaaaactaactttttgtgaacgaattgtcttctg

SEQ ID NO: 19459 - DNA, 509 bp, Gossypium hirsutum
  Clone ID: uC-gsflnu33B088b04b1
tgtttattgaattcatgaagggaaaggaggataagattgctgtggttgtggggacagtgacagatgatattagggtttatgaggttcctgctttgaaggttactgctcttaggtttactgagactgctagagctaggattgagaaagctggtggagaatgcttgacttttgatcagcttgctttgagggctcctttgggtcaaaacacggttctcctcagaggtccaaagaattcccgtgaggcagttaaacactttggtcctgctcccggtgttcctcacagccacaccaagccatatgtgcgctcgaagggaaggaagtatgagagggctagaggaagaaggaacagcaagggatttagagtttaatattacttcactacttgattttgaggcctgtttgttatttaggttttctctttcagttgttcacttgcttatgtttgcatcttattcatggattggttaatagcttgtttgaggatgaaccttttaagcgttttaatgtta

SEQ ID NO: 19460 - DNA, 451 bp, Gossypium hirsutum
  Clone ID: uC-gsflnu33B088b05b1
cctcgcgtccgcccacgcgtccgcccacgcgtccggttctaaatgtctatttggtcatacaagcattgggtatttaggacatattgtttctcggcaaggagttcaggtggatcccgataaaattaaagccatccaatcgtggcctattccccgcaccgtcaaggctgtccgcggttttctcggcttggtcgggtattactaccgctttatccgtcacttcgcggccattgccggtcccttgactgacctgctgcgaacagatgccttccaatggacttccttagcccacacggtctttgagcatttgaaacagttacttagtgaatcccctattcttgcattacctgatttcagccaaccatttgtggtggaaacagatgcttagggtactgtcatcagtgccttccttttacaaggtagtcccccttttgcttattttgtcctctacttc

SEQ ID NO: 19461 - DNA, 308 bp, Gossypium hirsutum
  Clone ID: uC-gsflnu33B088b06b1
cataggaggtgctcttaggaatgttcctattggaggtggatgtaggaaaaacaagaactctactactactactactactactgcttctgtttcaacatctatgggaaaatcaagtgctgctaagatgaaaacagtagtgtttgatattggaagaactggtcttggaaatgcgtcccatcatgacctttaatctagtccaatcctttgggctttatctcagagatctcatcttttagccttattgagaactaccccaatccttaacgcttacactttgtctactaatagtactgttagttttaaggaag

SEQ ID NO: 19462 - DNA, 339 bp, Gossypium hirsutum
  Clone ID: uC-gsflnu33B088b10b1
tactcaattcactaaagcaaagacagctcgaagaagaatgaatggccgtctcggataaagttcaagaactgcatgtatatgagatgaatgaaagagatcgtggtagtccagcttaccttcgtttaagtcagaaacctgttaactcacttggtgatattgtcccttttagcaacaaaatatataggggagatttggagaaacggattggaataacagcagggatgtgtatattgatagagcataaacctgtactgaaaggtgaccgctaccaagccatttttcgcttttcctttcggagactactgttccattagcgttgcagggtccttttcttgactt

SEQ ID NO: 19463 - DNA, 484 bp, Gossypium hirsutum
  Clone ID: uC-gsflnu33B088c01b1
taagttcggtgagattgtcactaccattcccaccattggctttaatgtggagaccgtagaatataagaacattagcttcactgtttgggatgttggtggtcaggacaagattcgacctttgtggaggcactatttccaaaacactcaggggctaatctttgttgttgatagcaatgaccgtgaccgtgtggttgaggccagggatgagcttcatcgtatgctaaatgaggacgagctgagggatgctgtgcttcttgtgtttgcaaacaagcaagatctgccgaatgctatgaatgctgctgagattactgataagcttggccttcactcccttcgtcagcgccactggtatatccagagtacttgtgccacctctggcgaagggctgtatgagggactggactggctttccaacaacattgctaacaagggttgagggttggttgaattccagtcatatctttaggcagctatcctattattt

SEQ ID NO: 19464 - DNA, 269 bp, Gossypium hirsutum
  Clone ID: uC-gsflnu33B088c03b1
ttcattcgtccgcaatttgtcggcctcagtcctctgcgatcgagctgatactttggagttcatttattcattaaaaaacctatggaatgacaaatgattaggaatccaggttccatcgttgccaatgacttccttattcagttgctcagaaatttggctttgcatattgaggtctctctctctcttataagtctaaattttttatttttgaacttttttgaattatttatatatcttttactgtttttaatcaaaaaaaaaaaaacaat

SEQ ID NO: 19465 - DNA, 456 bp, Gossypium hirsutum
  Clone ID: uC-gsflnu33B088c10b1
tgctgcttcatgccttgcatcgtgctgtgcggcgtgcgcctgcgatgcgtgccgcacggtggtttcggggataagccggaggtctgcaaggatggcctattgtggactatttgccctttctatgtttgtttcgtgtatacttcttgaggttgatttcctaattatatattattctactttgtatcaattattttcattatttacacaaaatagtattagttttttaacatatttttttatttattgtaattatatacaatttttttattatttttaccatttttattataatataataattttattttttatttatttatatttttatataatttttatattatttctttttaattattctatattttttatatttttttttatttttcaatataataataaattttttttttccttttttattctattattatatatataacatatttatttttt

SEQ ID NO: 19466 - DNA, 256 bp, Gossypium hirsutum
  Clone ID: uC-gsflnu33B088c12b1
tcccacgcgtccggtccttaagtttgtcaaatgcgaattgctgaatgcctggtaggagacgagacatgaatgattatctttaccgctagaaatgatcaagtggacttaatgaatgaggtagctactgtaacacttcatagcgcgaaaatagacatgtttaaaggatcaatgaggcttgcagtggacaagtgttgtcgatttgaagttgatgaacctgccagtttcaatgtgaaggatgataacaatctgtcactga

SEQ ID NO: 19467 - DNA, 230 bp, Gossypium hirsutum
  Clone ID: uC-gsflnu33B088d08b1
acctcccacgcgtccgcggacgcgtgggtttgagggtttattcatttgcagccatgaaattcagaagcttttgtttttgcatcccaggatcaaagcaagaagattcagacagttcttctaacaaagcaaaatcccataaaaagtctgacaaaagtgggaaaaaggaagggaatgtggatgatgctgattatcagggtgacactactactactacgacagccagtagctga

SEQ ID NO: 19468 - DNA, 341 bp, Gossypium hirsutum
  Clone ID: uC-gsflnu33B088d11b1
tgatatacgtgacttctatcaccagatggaagaaaggctttattagccaaataattctatcattccctatagcagttgttactgggagaaaaacgccagctgaaaggacaaaaaatggtattagcgataccaagacatatcattatcatttaaatcttggaggaagcgttcctaccaaaaggctgactaggctaccatcaatatctaagaatgatccaaagtccacggggcatgttggaattcacagttcgggatccagaaactttctgctaaaaccggaaccgctttgatctattgtggattccggctctgaacatccatccgaaggcatagttaaaaac

SEQ ID NO: 19469 - DNA, 547 bp, Gossypium hirsutum
  Clone ID: uC-gsflnu33B088e06b1
ataattaaaaagaaaaaaaaaaaaaaaaaaaaaagaaatttttataaaaaatacctaaattctgggttgccctctataggatgtcctgaatttttttttggctgtgctctttcgcgtaataggggcttttcttgttaggctttctatgcttttttgtccgcgggtgttccccccttagtttttttttttttgccctcccgttttcccccccttttttgccttgtgttttccctctcccttttctctctgttgatttccttttggtttttctttccctctctttctctttggtgcccttcccctctttttcgctccccttgccttttttcttttttggtggtccccctccttttgccctctttttttactcttttgctcttctctgttttttctctcttttgtttcttccctctttttggtttccttcttctctgctggtgttttttgcttttttcttttttttttttttctcctctttctttgtttttttttcctcccgctttttccttttttttctttctttctgtctcccccttcgcgttttttt

SEQ ID NO: 19470 - DNA, 438 bp, Gossypium hirsutum
  Clone ID: uC-gsflnu33B088e10b1
taaaaaggatcaagaaaaaccagaaactgtgcaacgtgagcatgatcaacctgttagatgtgttgcttaccaattacaagatgtacaaagtggagcaccagaaccagaacaaatttccgatgatgacaataacaaccagctagctgaggagaacattgaaggagacattacaaaacttaccggtagacagaaaaaattattcgagttgagactaaagatgaacgaagcaagaaaagctaatcaaacggctatggtggctgaaaagaaacgaatggaagctccacctgaatctaaaggaacttaaggaccgggaagaaaaacgcaagtcatttagtaggaggaggaaatttcacgaagagaaggatatcgattcgaacaatgaccgtaacgagcattttaaatagaagatcgtacggttcctttggtaattactcattt

SEQ ID NO: 19471 - DNA, 375 bp, Gossypium hirsutum
  Clone ID: uC-gsflnu33B088f08b1
tcgtgaaagaccgcatccaaatgaatgctcgggtggtgatcttgatggggaccagtttttcataagctgggacaaagatctcatcccatgtcaaactgagccgccaatggactacactggacgaagacctcggataatggatcatgaggtgaccttggaggaaattcagaagtttttcgttgactacatgatcaacgatactttgggtgccatttctactgcacatctagtgcatgctgatcgggaaccatacaaagcgcgcagcgaaaactgaatagcattggctacctcttcactctatggctgcagattttgccaagacaggaacgccggctgagatgccttgtgctctgaaaccaacggagttaccggcct

SEQ ID NO: 19472 - DNA, 567 bp, Gossypium hirsutum
  unsure (1)..(567): unsure at all n locations
  Clone ID: uC-gsflnu33B088f10b1
aaaaaaaaaaaaaaaaaagggaataataaaaaaaaaagaaaggcaaaaaaagaaaaaaaagaggaaaaaaagaaaaaaaaaaaagaataagaagcgaacagaagaaaaaaaaaaaacaaaaaaaaaaaaaaaaaaagagaaaaaaaaaacaaaaaaaccacaccagaaaaaaaaaaaaaaaaaaaaaaaaaaaaacacgaaaaaaaaaaaaaagaaaacaaaaatagaaaaaaaaaaaaaaagaaagaaaacaaaaaaaaaaaaaaagaaaaaaagaaaacagaaaaaaaanataataatacaataataaataatataatgtttttcataatattaaaataattataaaaaatgtaatataataaatttaaaaaattataatatatatctttattatattaataaaaaaatatggacatatttatataattaataaaatgttatcaaaattgataagaaataaaaagaatgagtaatatattcattatttctaatattaataatataaataattaaattttgtagtttaataaaacataatagactataataataaataattaaaat

SEQ ID NO: 19473 - DNA, 339 bp, Gossypium hirsutum
  Clone ID: uC-gsflnu33B088f11b1
tcctacgcgtgcgcgatttttgtggtatttgcctcagttgtatcatttttattgcctagataccaagtaagtgtcaccaataaaaagaacatgccacattgtagggacccagaggcgctggtggccaagtattcagatccactggtgtatacaggacctttctgagtgagaactggatatgaaattttgagaactacatgctacttgtagtagaattatgaacagatttgagagtttctttgcttgttatccatggtaccgaagacactgtaactgatcctcaagtttatcagaaacgttttgaagtagcttgccttgtccgacatagcgaccaaattc

SEQ ID NO: 19474 - DNA, 314 bp, Gossypium hirsutum
  Clone ID: uC-gsflnu33B088g02b1
tttactctgcggggatctgtatagagaactacatctttctctttatcaaaagcctaccgatggtgggctcgccgagacgaatagaacactgggagaggaggaagaagaatactttaaggctgtcgttgatgcaccaacaggggggatggtgtatccaccgtttaggtctcacagggggctattttcaggtggcacaggacgcgatgcacctatcttgaacgggggacttttacctatagcgcttgacctggcagagtttagctatgaccgtgaggcaactgcggttataccgcttgatgcagcttgttgaggat

SEQ ID NO: 19475 - DNA, 443 bp, Gossypium hirsutum
  Clone ID: uC-gsflnu33B088g04b1
tctgattgggtgaagaagtgaaggtttttggatactgggcaagcccttacagctacagggcagagcttgctttgaagttgaaaggtgtttcttatgaggacataaatgaggatatctttggcaacaagagcgatttgcttttgaaatacaatgcgggtcataagaaagtcccggttcttctttacaacgggaaaccaattgcagagatttttgttatacttgaatacattgaggaaacttggaagcataatccctatttgccacaagatccttatgacaaagctaccggtcgattttggatcaagttcattgacgaaaagagcttttctaccctttggctagctgcattggagcgcctataatgagcgagaaaaagtgcctaatgaatcttgctagtttttgaaaacgccttgacgtgctcttaatggaaagaaattttttgg

SEQ ID NO: 19476 - DNA, 194 bp, Gossypium hirsutum
  Clone ID: uC-gsflnu33B088g08b1
tcgaaaatggcgagaagatcttgatcttgtcgagcattgtgtccatatcggtggccgtatgtaaaaacgatcataagccggcccatatatgacatcagtacatttgatgtcagcccaagtcaagaccgacctgagatgtgatcttaagattaggcctaagcccggtttggccagctgctgcaaatgcaaataaa

SEQ ID NO: 19477 - DNA, 334 bp, Gossypium hirsutum
  Clone ID: uC-gsflnu33B088g09b1
ttgctcacgcgtgcgctacaatattaatctggactttgtttttcagatatggagcttcaactcccttcattccaagtgcttctcaggatcctacttgtttccttattcatatagcagaagtttaaagagatcaacacgccgagagaccggaccttaagccgataccggggccgagaaaaatacccgtgacacctatttagaaccaaattgctagcccattaccacaccagaggtttagagacttgctcctgaaacatggactactgagccaatcttcaactggtaggagatatctacagtgatagtttgcttacccccagtggattaagaatag

SEQ ID NO: 19478 - DNA, 435 bp, Gossypium hirsutum
  Clone ID: uC-gsflnu33B088g12b1
tactacgcggacggtttagatgataaaagactgaaggagttcacttatcaacacagcatcataacgatatgcaaggttatgctagaatacattggggataaggataagatcatggaatgtagcattacaaactccagaagatgcatgaatagcatgcgcggatatgaatggcaatatggcagtcagcaaacctctctatgttgcactagactaaaggaaggtagaatggagagccaggttacaggctcaatttatctaaatgcgaccaggtacaatgtcactcttagttgcttctcgtctgccaatgtactcacctggtggtccaggtcttgggccgtatatattttatggtcaagcaccctccagcattgttttcgcagcgctgtatctgggttttaacagtatgctcgatcctggtttgaggcccggcggagc

SEQ ID NO: 19479 - DNA, 370 bp, Gossypium hirsutum
  Clone ID: uC-gsflnu33B088h04b1
gtcgttctttaacctttcataccgcaaacaatggttctccaaaacgacatcgatttgttgaaccctccggccgagctcgagaagaagaagcacaagctcaagcgtcttgttcaatctcccaattccttcttcatggatgtcaaatgtcaaggctgcttcaacataacaaccgtatttagccactctcaaactgtggtggtgtgtggaaactgccagacggttctgtgccagccgaccggtggtagagctagactcaccgagggctgctctttcaggaaaaagggtgactaaatccgatccagcggcaacgattcgaggaagaggttttttttgtatgatcccactctggttatcttttagatgtggtaaa

SEQ ID NO: 19480 - DNA, 182 bp, Gossypium hirsutum
  Clone ID: uC-gsflnu33B088h08b1
ttggtgaactcctggacactaactcaacctaaggtcatgtctctggaatggttattccttgtcaataagataactacatggtcgaacgcattgcaaacattgtaattgatatgcatctttagctcaacaaccaaaaaactcccattacaccaaaataacagtgaagggattaagcaatccac

SEQ ID NO: 19481 - DNA, 416 bp, Gossypium hirsutum
  Clone ID: uC-gsflnu33B088h09b1
tagaaggcccaggctttgagggataacagcatggctggttacatgtcatgcaagaagacgatggagatcaacccggagaaccccatcatggaagagctgagaaagagagccgatgcagacaagaatgataaatctgtgaaggaccttgttctccttctcttagagactgctctcctgacctctggcttcagccttgatgaccctaacacctttggcaacaggatccacaggatgctgaaactcggcttgagcattgacgaggatgcaggtgaagctgaagctgatgcttgatatgcccccattggaggatgctgatgccgtatgcagcaagatcctggaagtagctcttttctatccttgtcctttattacctttactaaatctttcctttccaccttttggttattttcttatct

SEQ ID NO: 19482 - DNA, 528 bp, Gossypium hirsutum
  Clone ID: uC-gsflnu33B089a01b1
gttgttatgagagctagaggaaattacaggttgattctgaacgcaagtctttacccagatatgaagctgacaaatatggacaagagaggtatcacttttgtctgcatgaatagtactggtgaagacaaagagggtctgtctacattggctttgaagttcaaggacgcttccatagtcgaagagttccgtgttgctgtaatggcacacaaaggtaacacagctactgttctgaagacacctgaacattccccttaagctgcagaagcttgaaaggtatctccgttagatctgatctatcctgaacttgccatttccagtagtcctctttcgttattgaggaagtatcgttgcttgggcatatgctttttataatgcctatgctcttgtatgtagcaaagtccgagtcaaccgagaccagttcaatctgtttttgattgttataaatcgtgtatgttggagaggctggcaatagagaccgatcaaatcttttatcggtttggtattaactatgtagcctgcgggagaatg

SEQ ID NO: 19483 - DNA, 471 bp, Gossypium hirsutum
  Clone ID: uC-gsflnu33B089a02b1
atatgaagctaagagtgttcaagttataacatttggacaacctcggattgggaatgctgtgtttgcttcttactatgccaaacttgtgccaaatacaattagagtgacaaatgaccatgatattgtccctcatctgccaccatactattattatttccctcaaaagacataccatcactttcctagagaggtgtggctgtattcccttggactgggaagtctggtttatagagttgagaaggcctgtgatggttctggtgaggatccaacctgtagtaggtcggtgacaggtaacagcatcatggaccatttgaactattatggtgttgatttaatgtgccaagaatggagatcatgcagaatcgtgatggatcctcgtgttgcggagtatggcaaaacggatcacaaaggaaattttattttgttcagagcaccatccacgcgtgttcggtcgaatgaaggggaagttaa

SEQ ID NO: 19484 - DNA, 249 bp, Gossypium hirsutum
  Clone ID: uC-gsflnu33B089a08b1
tcggctgccttgaaaattaacaatcttgatgtcagcatggtgtacccggaaccatggtgcatgccccggcttttcacctctggcatagctgctttttatgagggttattatgctaataaagggatcaaaattataaaggggacagttgcggttggattcacctctaactccaatggagaggtgaaggaagttcaacttaaggatggcagagttctggaagctgacattgttgtggttggtgttggtgga

SEQ ID NO: 19485 - DNA, 211 bp, Gossypium hirsutum
  Clone ID: uC-gsflnu33B089a11b1
cctgattatcgctcggactgaaagggatgctatgaacacacagaggacagagatggacagcacaaactagaaacttcacctgtggtgattgaaaaggcggagcatagaaaccgtggatctgaggcaactggcaaggaaagagttaagcgcaagactaaacacgaggctggtaagagaaagcataaacggtcccggaggcttatagtcactt

SEQ ID NO: 19486 - DNA, 434 bp, Gossypium hirsutum
  Clone ID: uC-gsflnu33B089a12b1
ctttatatcgctcggactgaaagggatgctatgaacacacataggacagtgatgaacaccacaaactagaaacttcacctgtggtgattgaaaaggcggattattgataccgtgcatctttttcatcttgccaggcacgtttttaaaatatatattttaaagggcttttttgaggcaggatcttacgccaagacatttgcagttttgtccggcgttcacagtttggttgtttgctttttgaagaggcttcggggaaaagatgatgttattaatgccggtgtagccggatgctgcactggacttgctctaagtttcccaggtgcacctcaggcacttctacagagctgtcttaactttggggcattctcatttatcattgaagggcttaacaagcaagaaccagcattggcacattcatttctgcgagaaacaag

SEQ ID NO: 19487 - DNA, 289 bp, Gossypium hirsutum
  Clone ID: uC-gsflnu33B089b02b1
gttcatatgacacaaaaagtaaggaaaaattcctctgtttttcctttctttccactcttcctttccacatatttcttcaacttatcaaaattcatgtcttgatttcccatctatttcctctttaattcttccactgttgtaattcagggaagatcagctgctaaaaggatgtggttttgctcctcatacgcctttcgatagtaaggattgtctgccccaaagtgatgcgatgcgatgcttgcttgactaatacatccctcaccgcggagttcatcagaactgttttttt

SEQ ID NO: 19488 - DNA, 289 bp, Gossypium hirsutum
  Clone ID: uC-gsflnu33B089b04b1
tccatgcgtccgatctgattttggattggcaaagcttgatgatgacaagaaaacgcacatcaccactcgcgctgctggaacaattggctacctggcaccagagtatgcgatgcgtgggcatcttacagagaaagtagatgtttttggctttggtgttcttgattagcagattattagtgggggaccaaactcatattattacgcagaaaatgtcagaatctatcttattgattgggcgtggattctgtttgatatttcccaaatttcgagctcttctcgatcccatatt

SEQ ID NO: 19489 - DNA, 53 bp, Gossypium hirsutum
  Clone ID: uC-gsflnu33B089b08b1
tgaaacagcatgtatagaggaggttatggtggtctatatttgaactctggaac

SEQ ID NO: 19490 - DNA, 168 bp, Gossypium hirsutum
  Clone ID: uC-gsflnu33B089b10b1
taaataacagagagcctttgctctctccttctccctttcttcttgcagctagggtttcgacctcaaccttggagcgtcacctcaccaccatcggactcggtggccgaccacgcgaagaaggaacgcaatgagaggccggaggtctagacgaaagtgatgggacggggt

SEQ ID NO: 19491 - DNA, 499 bp, Gossypium hirsutum
  Clone ID: uC-gsflnu33B089c01b1
attatttccatttctgctcctccttccctcgtcttcgagctagggttttctcccgtagcggtcagctcacgattgcaaccagcttccattctgatattttcccccttttttactcacagtcatgcctcggtattactgtgattattgcgacacttatttgacccacgactctccatcagttagaaaacaacacaatgcagggtacaaacacaaggcaaatgttaggacgtactaccagcaatttgaggagcaacaaacccagagcttaatcgaccaaagaatcaaggaacatcttggccaagctgcagctttccatcaggttggagctgctttcaatcaacatctaatggctcagagacctcgacttcctgttcttccgactcctgttatgcctattccgagggttgcacctttacgtataaatcaaccaatggtccctgggattaggccacctgtactgccaagaccagttccaggttatgctcctgttccaggcatg

SEQ ID NO: 19492 - DNA, 195 bp, Gossypium hirsutum
  Clone ID: uC-gsflnu33B089c02b1
gtcagtcatccggttggatgatgatgttgataatatcgagaatacactaacttctgccttggtggacactaaaagtaatgctgctgtggttgacaaaagcattacaacatttgatcccccggtctcaagctcgtgggaacaggttccacccaccatgatattgatcacacctgattagtgcaaatcttttgtggt

SEQ ID NO: 19493 - DNA, 185 bp, Gossypium hirsutum
  Clone ID: uC-gsflnu33B089c06b1
tatactgggcattttcattaaaccaacaaccaccacggatattcaaacacccagaggttaccaaaagagaaaatgggcaccaaaggttacaatggatactattccatggatggacatgttgagaaactggcccaagagatgaagaaaggagcttaatttgtagagggaggggatgttcaactttg

SEQ ID NO: 19494 - DNA, 177 bp, Gossypium hirsutum
  Clone ID: uC-gsflnu33B089c08b1
tcgctcacgcgtccgcttaattttaacagtaccaataccaattaccttactagatgaatcgtttcccatgcgcacaactctaccttcaatcgaactgtatgtggagaaccattctctattgggacacatgtggaaagaacatgctgtatctaggagccactcggacgtgagcttggt

SEQ ID NO: 19495 - DNA, 123 bp, Gossypium hirsutum
  Clone ID: uC-gsflnu33B089c09b1
tggacgcgtgggcagaaagtgaaaaagaaagcgttttttttttttctgtaatttatgcaaacggcaaatctgtcacaatttctcttgatgaattcgccttttggaggactgagcgcttcaaat

SEQ ID NO: 19496 - DNA, 478 bp, Gossypium hirsutum
  Clone ID: uC-gsflnu33B089d01b1
ctttatttgagcaaagaattagggttaacaaagggttttaataatggaaggcaataatttggagaaaatactccaagaagggaaccttttcaggcaactcaattgccttatcgttgctcatcttcgccatcacaatctcacccaagctgcaagagcagtggcttcagcaacaatgacgcctttagacgttgaagcccctcctaataagcttcttgagcttgttgccaagggtcttgcagtggagaaagatgagacattacgaggggttccttcttctacattgtttgatttagggactgctttgggttatggcttgaatccggatcctcgagtttcttctgttgatttcagtgccgtgcaagatacaaaaggctcatcaaagagcttttcaaagcacgagacaaggcatctttcttgacacaagaatattgctaggtgcgcaaggtttagtcctgatgggaggtttgttgctactgga

SEQ ID NO: 19497 - DNA, 356 bp, Gossypium hirsutum
  Clone ID: uC-gsflnu33B089d02b1
aatagggattttttaaaacataataccatgaatacaatcaaaaacaatcatcaaatttaaataaatatacaaaaaaataaaataaaataaaaacaaaaaactaatttaaaacaaaaatttaacaaaacataaaattaataccaaaaaaaaaaaatttttaatacctaacaaaaaaatatataacagacaatatacaaaaatatattcaaacaaataataaaaacattaacataaattattaattaaaacttaaataaaaacaccatcatatttattaaaaactcacaacaaaaaataataaaataaaaaaataaaaaaaatattaaaataaactataataaaaaaaattaaaacaa

SEQ ID NO: 19498 - DNA, 330 bp, Gossypium hirsutum
  Clone ID: uC-gsflnu33B089d04b1
gttcatgtttcttctttatttgcatctactgtgactcgagtctttggacgaaaggcgtcgatgcttgtagcaggggttgctgtccttattggttcagcccttggtggcgctgcttctaatctctacatgcttgtatttggtcgtctttttcttggaattggacttggatttggcaaccaggtactgtaatctactttgtcatatatatatatatattgaagtttttgctcacaaaataaaaaaaaaatacatctattaaaaaaattattacttttatacatccatcaactattgacattatatttaacatctccttctaattttcctccc

SEQ ID NO: 19499 - DNA, 208 bp, Gossypium hirsutum
  Clone ID: uC-gsflnu33B089d05b1
gttaattcttatgtcatgcacgaagtcactcgagtttttcttggggcttcctctatattttctaatgggactgtatattcgatggttggaactgcatctgttgctatggttgctcatgcattccgtgttccagatttggcctgctgtgaagcctataaatctcatgaaagggtgcatcatgattcattctgctttaacgtgttaggtg

SEQ ID NO: 19500 - DNA, 356 bp, Gossypium hirsutum
  Clone ID: uC-gsflnu33B089d07b1
ttggtaattgaagaatactctgaaatcttcaatccaaaatgcctaagcagattcatgagatcaaggacttccttctgactgctagaaggaaagatgcacgctctgtaaagatcaagaagagcaaagatgttgtcaagttcaaggtccgctgctccaagtacttgtacacactttgcgtgtcggatgctgagaaggctgacaagttgaagcagtcccttcctccaggtttgagtgttcaagacctgtgaaaatatggcagcctcaggtttgtcacctgatttataggtgatgaaagctagattttagttttggttttattgtatttctggccaatttgcatacagagaacctcaatt

SEQ ID NO: 19501 - DNA, 349 bp, Gossypium hirsutum
  Clone ID: uC-gsflnu33B089d10b1
ttcgtttgacctaatggagcctaaaggctggaaaaggaagttctgtggcagtgagtctttatcctacgaagctcgtctcgggtacagtattgaagacgttcgaccaaacgggggaatcaagaagttcagatcggctgcttactacaactgcgctcgcaagccatcgtgatatactaacaagcgtgtcgtctgaccactagtagtggttaataaaactgctatttgcttttgaaggtagaattagaaaatcttcccgaccaacttattgctgttctctcttcgaggctggtttctttacattgcgttcttctgatttggcgactttgtaattgggataaagtttgcagtt

SEQ ID NO: 19502 - DNA, 244 bp, Gossypium hirsutum
  Clone ID: uC-gsflnu33B089e02b1
ccatgcgtccggccaccggtttacacgccaccaaagaaagagaagcccgaacctaaaccaccagtacatgagtctcccaagaaaccaccgtatggtcactatccaggacaccctccattggggaagcctcaatagagagatcccatcggctagcaatcccaagaaccgagctattatgactagctaaatagataaattagtatccatgcaataagagctgctcaatactcatgttctgttttct

SEQ ID NO: 19503 - DNA, 289 bp, Gossypium hirsutum
  Clone ID: uC-gsflnu33B089e05b1
tttactcttgggcggacgcgtgggtctatccccatcgtctgcctccaagagaagacagagaggtttcctcacaaccaccgtaatgggtcgtgtcattagagcttaacgtaagggtgccgattaggtcttgaaggcccatacccaccacctgaagggtaccctccaattctttagtctcaactaacgtgaacttgacgggttcctaaaaggtgagggtaccgcctttattaactacattggacatggggctgcgttggcgctcatgatttacccagacgcaatccgttac

SEQ ID NO: 19504 - DNA, 244 bp, Gossypium hirsutum
  Clone ID: uC-gsflnu33B089e12b1
tttattactagtattaaagtcgtgtggaaccttttccagaaacaataggcttggtgtttgtaatagtgataatgcttgtgatccttttgctttgtttctgtgcttgcttgatggatggtattgtcaagattgtggagtgaggtactttgtctaaattttacaatgaattgttctagttgatttggtaaatcaattcgaagctttttgtctaaaaaataaagataaaaataaaaaaaaataatac

SEQ ID NO: 19505 - DNA, 262 bp, Gossypium hirsutum
  Clone ID: uC-gsflnu33B089f08b1
tgtttacgcgtccgctcaacccccaactacgtggaatgtttgactcgaaccctcaattgagagaaatgatgcaaaaccctgaagtacttcgtcagatgttttcccctgagacaatgcagcaaatgctaactttacaacagtcgcttctgtctcagctcaatcggcagcagtctactcaggattcaacgcggagcagtactactagaggagcacctggtacttcctagtctggacttgttgatgaatatgttcggtggcctag

SEQ ID NO: 19506 - DNA, 98 bp, Gossypium hirsutum
  Clone ID: uC-gsflnu33B089g05b1
aactagtctccattctctatacgtagccgtcttcaggcttttgtgctaagcaagaggcgttataaatccaaagccaagcatgggaggaaagggatgtt

SEQ ID NO: 19507 - DNA, 185 bp, Gossypium hirsutum
  Clone ID: uC-gsflnu33B089g06b1
taaatcatttcttttatttttaataattttaatcctctacaacgcacctcacgacgttcccctcaccgttgttgtagattcggagatatgacgtcagatggggcgacgtcgacgccggcaccagtgccaaggaggaaaccttcttggagggagagagagaacaacaggaggagggagaggaggag

SEQ ID NO: 19508 - DNA, 349 bp, Gossypium hirsutum
  Clone ID: uC-gsflnu33B089g08b1
tttgctactcggccgaccacgcgtacgcccacgcgtccggagcctcacactatataagggagcatcatgctcaaccaaggatataggcactcgtctcctggcatatggcccggcagcaatgcatgctattggtagtgatacattgccgcagttcgtattcttgtggtagcctgctagcgaatattcattaccgcttcattggctcgtcctctgagatcaaagcttccgaggaaggtgtggacgtgttatactgacagagataatgatgaaaatcatacttttttaatatattcataaaaaaaaaaactaggtagataagctcaattacttaagtgacttgggttggctt

SEQ ID NO: 19509 - DNA, 443 bp, Gossypium hirsutum
  Clone ID: uC-gsflnu33B089h02b1
gttatttatgactcatatgcaacatatgaagagctcattccctatacaaatgcaattgagaggtagggatatcaaatgtatagatgaaattcccgaatacatgaaaccaagctacaaggctctattagatgtttatgaagaaatggtacaattggtggctgagcatgggagacaatatcgtgtcgagtatgcgaagaatgcgatgatacgacttgctcaatcttatcttgtggaggccaaatggactcttcaaaactataaaccatcattcgaggagtttaaggctaatgcattgccaacttgtggctatgccatgcttgctattacatctttcgtcggcatgggagatatcgtaacaccagagacctttaaatggggcgctagtgacccttagatcattcaagcgtccacaattattttgtggtttatggattgaatgttgt

SEQ ID NO: 19510 - DNA, 179 bp, Gossypium hirsutum
  Clone ID: uC-gsflnu33B089h04b1
cccatgcgtccgcccacgcgtccgacataccttcttttaatacattacatgggggcctaaatgtatgatagcattgattttgctgttgtatgtcataattatcaatgaatgactgtatttccatccccaattacagccttgtcttggtggagaattaaaaaccttaatgtttgcgaatg

SEQ ID NO: 19511 - DNA, 357 bp, Gossypium hirsutum
  Clone ID: uC-gsflnu33B089h08b1
tgttgttctaaggtatcaaccaagattggagggattgaatcactcttggccagggttgatattgtcatactgggtggaggaatgattgataccttctacaaggcccaaggacatgcagttggatcttgacttgtgggagaagacagacttgatctagcatcatcactgcttgagaaggccaaggcaaaaggagattctctctcgctcccctatgatgtggttgttggtgacaagtttgctgttgatgctaacagcaaggtggcgccagcatcagggatcccagatggatggaggggctaggatattggacctgacttcatgaaaacctttaatgaatctatggacacttacccagac

SEQ ID NO: 19512 - DNA, 181 bp, Gossypium hirsutum
  Clone ID: uC-gsflnu33B089h10b1
tagagtgatgggcacgtatggatattgcgcaccagaatatgcaatgaccggtcagcttacattgaaatcggacgtttatagttttggtgttgattagcttgaaatcattactggtaagaaatgttgttgccaattttagtgcttgtttttagcttatatttatattcttatcctaatcttt

SEQ ID NO: 19513 - DNA, 382 bp, Gossypium hirsutum
  Clone ID: uC-gsflnu33B089h12b1
tctgtttcgctggtaccgggagcatgtagtgtggactgataaggaattgaagttgaaacttttgaggaggggcatcttaactcggatttatgctcccatggttataattcaaggacttagggattcagggcttttcggttccgtaatacaatcggcacaaacgactctctcaaaggaaatcaagagtagcaacacttctagagtagataaacctggaatgatttcatccagaaagattggtgtcaaagaaacaacagcaactgcccgaaggatcttggaaatacccaacgaaacttcttacgagtcagccatcccaccactttctcctccaatcctggatggtcttcacatcggaatattacaacacattagactcacttgc

SEQ ID NO: 19514 - DNA, 421 bp, Gossypium hirsutum
  unsure (1)..(421): unsure at all n locations
  Clone ID: uC-gsflnu33B090a01b1
cncctgngaaacaagcggcggtggttttgggagcgctagctttcgggtggatggctatagagatggcgtttaaacctttactggacaaggctcgctccgccatggacaactccgaccctgatcgggagcccgacgacatcgactccgctcgcaaggacgactccgactccgactccgatcggaagcctatctcttatgctgatgccgccgccaagaacatagcgggtgcaagttaggggcgagattcttgtgtttggtccagtccaagtaatcatgaaagtagggttcctttttatgataaatggaattatggtgttatcttattttagatttcttgctgctgcttttctaggttagccttaagaattaatgttgagagaagagctaattggcgctatttttctgtttctacattattatg

SEQ ID NO: 19515 - DNA, 362 bp, Gossypium hirsutum
  Clone ID: uC-gsflnu33B090a04b1
cctcgtgtccgggcaggcagccatggcaaggatcaaggtgcacgagttaaggagcaaatcaaagacagagctgttgactcagctcaaggatttaaaagccgaactttctctccttcgtgttgccaaggtcactggtggtgcccccaataagctctccaagattaaggtggtgaggctatccattgctcaagtattgacggtgatatcccaaaaacagaaggctgctttgagggaagcttatacaaagaaaaagttttttgcctttgatctccggtcccaagatgaccagagctatttcgccgccgtcttaccaagcaccagctaattttgaaaaccgagctggagaaaaagaaggagattta

SEQ ID NO: 19516 - DNA, 489 bp, Gossypium hirsutum
  Clone ID: uC-gsflnu33B090a08b1
tgtgtgagagagtcaacagaagattgtgtcattagtggttatgagattccagaaggtaccaggctctttgtcaatgtgtgggctcttggtagggaccccaatcaatgggagaacccccttgagttcataccagagcgatttcttagtgaagagtggaggcaaggcaagaaccagtttttggatgtgaggggacaacacttcagcctgttgccatttgggagtggaagaagaagctgccctggagcttcgctggcactacaggttgtcccaacagtccttggcataatgatacaatgctttgattggaaggttagagatggagcaaatggcactggtaatatggaggaaaaagcttgaatgactcttttagagctcatccattggtttgtcacccaatcacaaggctttctccattttcgccatatgagtattcctatccagaccttgcttccttgagacttccttggactctaattaatatctagtaaa

SEQ ID NO: 19517 - DNA, 507 bp, Gossypium hirsutum
  Clone ID: uC-gsflnu33B090b06b1
gttttatagaataagaattgcaagtgttccagcttgtaattgtgatttccattaaatttacaagactttgatggaagtttgatatgttttgatataggtacaataatggatagcagcttaaggcctcatttctagctcggttgaagctcaaatatgtgcgtgcagctcctctcagctcgaaatagttcagaaagttcgtttccaactcatttcagctcagtacatttccagctagctcaatttcagctccaccagctcaactctagctaacaagtccagatgtagctggaaggtgtcctacgtgtcggggagtgtcccatacacatgtgacagcctaggtggcatcccagtatgtatagcacacacgtaacagccttgacacatgtgtgtgcatgtgtggccgaaatcagcccttttctctacatatgacgctaaattaaagggttagaacatgagttcaaatgttgaatttaaaacgttttgattaaaacaagagttaaatttttg

SEQ ID NO: 19518 - DNA, 215 bp, Gossypium hirsutum
  Clone ID: uC-gsflnu33B090b10b1
gacgtcttaggttttctagctcgtcacctaaatacaatttactggccaaaattcaacataccgcttgactgggaaacccactgacagcccctgatctttgtcccttgaacaactatccccacgtccccaccttggccgattacaacaaaggccagcaccgaatgtctttaccaagaccttcgcatgcggaatgggaaacggatcttccccaaaac

SEQ ID NO: 19519 - DNA, 455 bp, Gossypium hirsutum
  Clone ID: uC-gsflnu33B090b11b1
ttatttgctgaagaagatatcagtgaagctgctgaagcgctgagtgatatgcctataaaaaagctttatattttgattgagatggcagctcaaggagaacaaggtggagcagcggaggcgatcttctctggccgagagaagattaagcttgcgcacttttacgactgcctccaggatgtcatccggtattagtttgaatgcctttttttcattctgataatctggtcttctgttccgtatagttatgtatattttgagtggatgaaattctaattattatttgttttattaatgttttgattgtttgttaattcattaagtgaattagtacactcaattcatgacatgaactttagctatttctttagggttcattcgggtagacgatgatttttgctttagtcagattaaaactagcagttgcgtttagatttacgtacatttattcttttttc

SEQ ID NO: 19520 - DNA, 83 bp, Gossypium hirsutum
  Clone ID: uC-gsflnu33B090c01b1
gttaaaatagtaatggttataaatggcatgtaataggataaaagttattcaagtgatttggctagttttgagtggtgccaagc

SEQ ID NO: 19521 - DNA, 195 bp, Gossypium hirsutum
  Clone ID: uC-gsflnu33B090c12b1
tggatggtttcagattgtctaataatctttattgtaacatataataatgatagctacttgcactaacaaaatgcttgttattcttaaaaaagaaaaaagaaaagagcaaatctccttagtaaaaagagaaaaaaacacttttaaaaaaaaaacaaaaattaaaaaaaaaaagaacccaacaaggcaaactaaagg

SEQ ID NO: 19522 - DNA, 203 bp, Gossypium hirsutum
  Clone ID: uC-gsflnu33B090d01b1
tccatacataggccaacacgagcgtccacaattgggcgcattattgcaagcgaacccgcttgggacaatacctgcagaaggggccatgaaagatgcaagtctatgggggtatggttgttcatggttccaagcacaccttgacccaagctggtagagccgaggaataagcaagatggccctgttgatacgtggaatcatgttct

SEQ ID NO: 19523 - DNA, 191 bp, Gossypium hirsutum
  Clone ID: uC-gsflnu33B090e02b1
acatcaagaggctttgcaagtttgcaaaaaaaatgagtgacctcaaatatgcttatccctaccctgctcaaggctattatcaaggtcccccaggggtggcaccaccgcaatatgcagttgcaccacctaggagagaacctggtttccttgagggctgccttgcaacctcatgatgctgttgagttatagac

SEQ ID NO: 19524 - DNA, 487 bp, Gossypium hirsutum
  Clone ID: uC-gsflnu33B090e03b1
cttcttttttcactctcttcttcgctaatatcctctctcgtggagttcggggggcatattaattacttcaccctcccctgcttgtcctttcttcttccatcattcctcatttttctgctttggaaatcttctaggcttgtagctaagctaagctaaactaaacttcgaagacatggatcttcttcactcctttagctcattagctcttattctgtatctcattgtcttaactctgaactctaaaggtgcattaggtgcttctttcacatttgtcaatcgatgtgggtacacggtgtggcctgggatattagcaaatgcaggcagtcctacactcgacagcactgggttcgagctaccaaaggactcgtctcgttcatttcaagccccaactggctggtcgggtcgtttttggggtcgaacgggctgcacatttgacggatccgggtctggtacgtgcgtaacgggcgactgcgggtcgggtcagatg

SEQ ID NO: 19525 - DNA, 460 bp, Gossypium hirsutum
  Clone ID: uC-gsflnu33B090e04b1
atttctttgaattattcatacaaaacaatgaaaacccacttttttcccctggtttttctcctcatttttttcttagcccaaggtctgaaccccaaatgtgccatccaagaccatggctcaaacctgcaagtgttccatgtttacagtccatgctcacccttcaaaccctcaaaaccactctcatgggaagaggatgtgctgcaaacgctagccaaggaccaagccagggtgcagttttttgtccagcctggtggctaagaaatctgtggtgcctatagcttcaggcaggcagattgtgcaaagcccaacttacattgtgaaggccaatattggaaccccacctcagcccatgcttatggccatggatacaagcagtgatgctgcttgggtgccttgcactggctgcattggctgctcttctactgcttttgactttgctaaattcaccacttcaagaccc

SEQ ID NO: 19526 - DNA, 172 bp, Gossypium hirsutum
  Clone ID: uC-gsflnu33B090e07b1
tccacgcgtccgcgttgctgttaaggatcttaaacgtggttttgatgctttaaactccaaggatgatccggccaaggaagctgccaactttaccttacatgttttcatcttgaaccaccctggtcaaataggaaatggctattccctattactcttctgtcacacttttcac

SEQ ID NO: 19527 - DNA, 382 bp, Gossypium hirsutum
  Clone ID: uC-gsflnu33B090e12b1
ttggttaggcaacagttgatatccctcttgatacagcttcaggaggatcacgtaatcaggatttaaagaagaaagaaaaggaactccaggccaaggaggctgaactgagaaggcgggaacaggaagtgagaaggaaagaagaggcagtggcaagagctggagttgtgctggaagagaaaaattggccacctttttttcctatcattcatcatgatattgccaatgaaattccaattcatctacaaagattgcagtatgttgcgttttcaacatatttaggattggttctatgccttctatggaatatcatagctgttactacagcatggatcaaaggagaaggtgttaggatctggttcttggctatcatcttcttcctagc

SEQ ID NO: 19528 - DNA, 490 bp, Gossypium hirsutum
  Clone ID: uC-gsflnu33B090f01b1
gttgttactgaaggacaattctaatccacagatagccttgcttcctttacatccagatatacgtgcaaagttcaactccaccgcagcatgggagtatgctcggagcatgtcaggcaagccatatggttatcacaacatgatatttagttggatagacactgtagctgacaactatccaccccctcttgatgctcacttggtcatttctgtcatgtctatgtggactagagtgcagccagcatatgctgcaaatatgtggaatgaagcgttgaataagcggttagggactgaggatttggatctgtatggaatattagaggagactgaaaggcgcaggataacctttgatcaattactcactatcccggaacaagatgaatgggtctacagtgatgggaaatcaacagcatgtgttgtctttatccttgagatgtataaagaggctggggtctttggtgccctttgcaaactcaattcaagtaactgaatt

SEQ ID NO: 19529 - DNA, 498 bp, Gossypium hirsutum
  Clone ID: uC-gsflnu33B090f03b1
cctactcgtccgcccacgcgtccggtggacactccaagacttggccgcagggaagctgatatcaagaacaggtttactttgccaccatttctgactttgaaaaactttgagggtttaaaccttggcaaaatggataagaccgatgactctggactagcttcttatgttgctggccaaattgataggtcactgagctggaaagatgtaaagtggctccagacgataacatcgttgcctattctagttaagggtgttcttactgctgaggatgcaaggctagccatacaagctggagcagcaggaatcattgtatccaatcatggcgctcgccagcttgattatgtgcctgcaactattatggctttggaagaggttgttaaagctgcacaaggcagagttcctgtttttcttgatgaaggggttcggggtggaaccgatgtcttcaggcattagctctgggtgcatcgggaatatttattggaaggccagtagtgtttt

SEQ ID NO: 19530 - DNA, 498 bp, Gossypium hirsutum
  Clone ID: uC-gsflnu33B090f09b1
ttttgatcgagaagtgcatttgcagttgctttgatttgctttgtggtaaccgctgtcggtggtcaatctccggcagcctcacctactaaagctccgccggccgcggctactcctgctactgctcccgctactgcccctgttagcaaacctaaatcaccggctccaactgctgcccctaccacttccccaccaacttcttcaccaccggctgcggctccggagaagtctgcggcggttccagccccatctaaatctgctacggcttcttctcctccggctgctgctccggtgagttctccacctgctccagtacctgtgagctctcctccagccaaatcgcctcccgttgctgcaccgacgactccaccagagagctcggcctctcctccggctcctgttgctgcaccaactactgctgaggttccggccccagctccaagcaagagcaagagcaaaagcaagaaatccaagaaacaccatgcttcgactccttcacct

SEQ ID NO: 19531 - DNA, 107 bp, Gossypium hirsutum
  Clone ID: uC-gsflnu33B090g01b1
gtctgttattgaacagccggagacattagaataaaggggccggttccttgaaaaacaaaaaaacaaaaaaaaaaaaaaacacaaaaaaaaagacaaaaaccaaaaat

SEQ ID NO: 19532 - DNA, 280 bp, Gossypium hirsutum
  unsure (1)..(280): unsure at all n locations
  Clone ID: uC-gsflnu33B090g02b1
tncctannaacagtgacagaggacaaattatttcatatctatttttctcagcggagttgttgttgaaaattacatcgacaataagccatacaattatcagagcatacagaatgaaaagactgacttggattctaatcctccatctcctcagggaatcagtgcagagccgagacttcacaaactgtttgccatggtaaggtacatgctgtcatcaccaaaccttatttatttggtgctatggattcctgagcaagagattttgaaacgagaacagaacgaa

SEQ ID NO: 19533 - DNA, 183 bp, Gossypium hirsutum
  Clone ID: uC-gsflnu33B090g04b1
aacatccgtcactaaatttttgtttttcttctttcctgatatgggatcaggaaactgtatgttcctggttacttgtgctttgttgtcatattagtgctgaaaaattttatattattttgtacttgtagatttttagttataataattgaagttccccagttttcataaaataataaaaatatt

SEQ ID NO: 19534 - DNA, 291 bp, Gossypium hirsutum
  Clone ID: uC-gsflnu33B090g08b1
ttatctatcactctttaggtttattgcattaaataaatcatgaaatctttccttcctttctttgcattcctctcacttctcctgtttgtagacaccattgcagcagctaggaaagatgctggagagtactggggagctgtaatgaaagatcagcctatgcctgaggcactccaagagcttgttcggattgaggctgccgttgccaaccccatttgtttaagaatatttggtatttttcttaatggtaagctgtggattgttcttgctaaaaatttggaggcttgagccaag

SEQ ID NO: 19535 - DNA, 473 bp, Gossypium hirsutum
  Clone ID: uC-gsflnu33B090g11b1
ttctctacgcgtccgcccacgcgtccggttaggatctggttcttggctatcatcttcttcctagcaggggtaccaggagcctatgtattgtggtatcgtccactgtatcgtgcttttaggaatgagagtgctttgaggtttggatggttcttcctgttttatttgcttcacattgccttttgcatctttgctgcggtggcaccccctatagtttttagagggaaatcactcaccgggatcctacctgcagttgatcttgttggtggcaatgctttggttgggatcttctacttcattggtttcggactattctgtcttgaatcagttgtaagcatctgggttatccagcaagtatacatgtatttccgtgggagtggtaaagctgctgaccttgaacgtgaagctggcagaggagctatgagggctgccttgtatgggactgacagactagctgtagtgaatatacagtaaac

SEQ ID NO: 19536 - DNA, 397 bp, Gossypium hirsutum
  Clone ID: uC-gsflnu33B090h01b1
tttcattctcttccctcagatttttttctcttttcccaaagcaaaacaaaagccatgtctcagactgttgtgctcaaggttggcatgtcatgccaaggatgtgttggagccgtgaagagagttctggggaaaatggaaggtgtggaatcatatgaagtagatttggagcaacagaaagtgactgtgaagggcaacgtccagcctgatgctgtgctgcagaccgtgtcaaagaccggaaagaagactgccttttgggaagcagaagctttggctgaatccgaggcgaagccagccgaatccgaggtgcagccagccgaaaccgaggcgaatccagtcgaaaccaaagtggagccagccgaaactgaggcgaaacccacagaacccgaggcaaagccca

SEQ ID NO: 19537 - DNA, 454 bp, Gossypium hirsutum
  Clone ID: uC-gsflnu33B090h03b1
cctactcgtccggtgatcttcctggatggattttcaagtcgggtctgaatgaagtctctctttcagagaataagcttggtgtaaatttgagcaatcccatttcagcttcaccaagaaccccacttcaaaagattcaagtcttggatttatctcacaattcgttttctggggaattaacatacgatattggggttttaagcagcttgcagttcttgaacctgtctagaaactctctcattgggcctgttccaggaactgttggagaattgaaggctttggatgttcttgatttgagtcataatcagcttaatggaagcattcctatggaaattggaggagctttctccttgaaggatctgaggctcaatgcttattttctaggtgggaaaaatcctacatcaaatgagaactgcaccttgctatcaactttgatcatatcacaaaacaacctgag

SEQ ID NO: 19538 - DNA, 462 bp, Gossypium hirsutum
  unsure (1)..(462): unsure at all n locations
  Clone ID: uC-gsflnu33B090h04b1
agctgncgagcctgggatgagaccaataacacccagcccgaaaagctcatttggaatcttatgggaatgatgaacaactgctggttccgtgtaaaaacaaacgtgtgcaggccacacaaaggtgaaatcgggattgttttcgagcacccgacactgccgggcaaccaatccggtggatggatggctaaggaacgacaccccgaaaacccaaccataaagaagagtgtctcttctcctttcatgaacactgcctccaaaacattttcaatgtccgaggtcaataaacacaactctgctgattcggcttggatcgttgtccatggtaacatctatgattgcccttggttcctcaaggatcaccctggtggcaccgacagtattcttatcaactccggaacccactgcaccgaggagttcgacgccatttcacttcgacaaagcccaaaaaatggtagaagatta

SEQ ID NO: 19539 - DNA, 433 bp, Gossypium hirsutum
  Clone ID: uC-gsflnu33B090h06b1
tgtagtgcggccggccctcagaaaccatatgaaaagggataattggaggttgtaatgcacatatggagaacacatcatatcacaccaggatcaaacgaatcatatagacagctttgcgaccagagaccatccgtgcgggcatgcccgcacacaggcatgcatacatgcataccactgaggaaatggaaaacccatagcctcttacatcagcatgtatgacccctggacccaaaaggaagggcaacctaaagatcaaaccccaaagcagaaaaacaaccattaaagaaaaagaaagccctcatcatgccacatccgacatagtaatcataaataatagtagtatgactccgtcaactatgacataacagtctatagaaaaaagaagcttctttaagcttttgccaccttacggatggtattggtcggtctattt

SEQ ID NO: 19540 - DNA, 205 bp, Gossypium hirsutum
  Clone ID: uC-gsflnu33B090h07b1
ctcgctttaatttgtttctgcatctctcgttttatttctcgtatattaatgacgggtcggggtaagactctcggatccggagcctcgaagaaggcaacatcaaggagtagcaaggctgggcttcagtttccggtgggtcgtattgctcggttccttaaagctgggaaatatgctgagcgggtcggagttgaaccaccatgttacc

SEQ ID NO: 19541 - DNA, 127 bp, Gossypium hirsutum
  unsure (1)..(127): unsure at all n locations
  Clone ID: uC-gsflnu33B090h08b1
gtcnagcgcagacacacgcgaacgggtgaaggaggactgcaagcgagggcgaagagagctgttgaccgaaatccgcatgcggaagacggcgacaacatttgcggttaataatccggagaacgggaaa

SEQ ID NO: 19542 - DNA, 495 bp, Gossypium hirsutum
  Clone ID: uC-gsflnu33B090h09b1
tatttagcagagggcaacaatgaagtgggtcaaagtcatagtatctttcatcctcacactctcgtttttgtcgtttccttcatgcgcgttccaatccgatgagcttcttgttgacgacgaagagttcggactcgagggggctccgcaacatcgttcccctgaacccatccccactcgatccccaccagtcacatccccgacccgaaagaggcattcggatctagattccgattctaagatccagttctctcttgaccacgcttttggcgactccgatttctctcccgctggcactttctccgcccgcctcaaaacatggagccacggcggccagactcttacaaagctacggttttcgaggaacagtttctctgatgtggagaaggagaagttcaaaaatctgctcgaaagtgatgacttctataggataagactcccatctaatgttttgaatcccgctgggagggattttattatttcatcagtgaaagcaag

SEQ ID NO: 19543 - DNA, 473 bp, Gossypium hirsutum
  Clone ID: uC-gsflnu33B091a04b1
atatggtgaagtttgtagctgcactcaatcgagaatccatcattgatgcaatcggtatggtatctgtccctgggaatcccatcaagggaaccacccagcaggtcgagattcatgttagaaaattgtattgtgtgaataaagctatgcctaccttacccattaacgttgaggatgctgctcgaagtgatgctgaaattgaagctgctttgcaagctggagataagcttcctcgtgtcaatcaagatacacgcttgaactttagggttcttgatattaggaccccagctaatcaaggaattttccgcatccagtgccaagttggaactatatttaggcaattcttgctgtctgaggttttgttgaaatccacacccctaagctgatagctggctctagtgaaaggtgggtctgctggttttaagctagactacatagggcaacctgcgtgtctggcacagtcccctcaacttcac

SEQ ID NO: 19544 - DNA, 408 bp, Gossypium hirsutum
  Clone ID: uC-gsflnu33B091a06b1
ctctcgcgtccgtgtgattgattcggtccaaggtgctgagggtgccattcaaatggggtcgttctactcaagctttccggaacttagctcaccaaacctttctggtaatgaccgttcttcgtctttgaagatcagtgggcattcaaagccatctgaacctcaacttgagaactgcatgttcagccaaggagctgctgctccgaagtctccatcttcttcatgcagccagagctctggttcaagtacctgttgttccattggagtgaaacagcatagtacgagtatcagtgctttatgtagtgcagatgggttgatggtggaagaccctggtggagcactaaagagagctcgtagtgatgctgaattgcactcgttgaaacaagaggagcctaagctgctagcaagatc

SEQ ID NO: 19545 - DNA, 481 bp, Gossypium hirsutum
  Clone ID: uC-gsflnu33B091a07b1
tatctccctcatttgcttgcacggctgggcgtagtttaagcggagagggtgtgcaggattaaagggtcaccattgtttccaatatgatgcttaataataagtttttgttcttatcagctttgttttgcattgctgtagctggcgttttaggccaagctcctcctactcctagtaatcctccgacatccacgccggcgccgccgactccacccgcttccacacctccacctactactcaaccaccttcaacacccacaactacttctccgccaccagcttcctctcctcctcctacttcatcaccaccaccagtttccactcctcctcagcggactcccccgcccgttagctccccaccaccagttctcctcccccggctactccacctgccgcaactcccccaccggcttctccacctccggctaccccaccacctgcttctcccctcctgctactcctacttcagctaccccaccaccag

SEQ ID NO: 19546 - DNA, 321 bp, Gossypium hirsutum
  Clone ID: uC-gsflnu33B091a08b1
taatctttgggttttcatggaggaaatcaatggggattcccttctgctcgaggttgacttacccgatttcgggaatatcttagataatgaaccggtaacggaacctcctcctcaaccttgttcaacccagaatcccgatgaagaaccggcggtgtcttcgtggatcggggcgatcgagaaggttttgatggaggatgataatttttgatcctagggttgagactcaacctgtctccgatgatgatttcttggccgatttactggttgattcaccttctattagctggtgcgactttggttggcgtctacggtgctgatttg

SEQ ID NO: 19547 - DNA, 378 bp, Gossypium hirsutum
  Clone ID: uC-gsflnu33B091a09b1
tcgggtttctctagtttattattttatttttaggagggaaattaaggagcatggatgatggatcgtctctgacgtttccgaggcagctagcttggggaaggtcggttgtttcgttcatgagcttgtataaatactaaaatttcatttttatatttatttttcaccgtcgtcatgggcatgttaggaactcatcccttgggtgggtctgccgacatgtggcccatatttggtaaaaaaaaaaaagaacaaacaaaaaagcaaatgaaacacaccctgtaaaaaaaaattaaagccaaaaaaatgtggaagttacacggggcgggcccgctttagttgccaacctccctacccccggctttctagggggggtcccttttt

SEQ ID NO: 19548 - DNA, 421 bp, Gossypium hirsutum
  Clone ID: uC-gsflnu33B091b01b1
gaaaaaaagggttacaaaatttgaccacgtttatttcataaccatgttgaacatctgtttatccttttgatggtgccaaacctttaaatcttacatttaccatgcatgatgaaagccaaatcatgcatgtcccatgcaatctaagcacgacgaaaaccatgtcatatattttcctttcccttttccgttcacatattatgaacattaattccatgcaaggaaggcaataaaattatactacgcaaacaacctcaaaaatgaccagctcaaacttggacctgttatgtcccatggtatcatcatcccatcttttttttttactttgattttttatcttccctggctattaagggtggattgctccggtatttctacgtttagaggacttctataacttatttcttttacaaattctattacc

SEQ ID NO: 19549 - DNA, 437 bp, Gossypium hirsutum
  Clone ID: uC-gsflnu33B091b04b1
tttatttccaccatgccctttcctttcctcctgttcttttcctccatgttcctctcctttccttccctttccttctctcaacaaacccctcccaaaggatatttaattaactgcggcgcaaccaggagatcggtgatccacggccgagtatggttacccgacggtaacttcatatccgccggaacatccaaaaacctaactgtccccggcttagtccccacgctctccaccgtccggtcgtttcctctcgagaacaagaacctccggcgtaagttctgttacgtggtgcgtgtataccgtggcgcgaggtacttgattaggacgacttactattacggtggagtcaacggcttggattttgattcgccgccagtttttgatcagattgttgatggtacgttttggagcgtggtgaatacgaccgaggattatgggaa

SEQ ID NO: 19550 - DNA, 434 bp, Gossypium hirsutum
  unsure (1)..(434): unsure at all n locations
  Clone ID: uC-gsflnu33B091b05b1
cttctcatcgcactcacgttcctctcccatctgactcaggtggcaatccatttgacgatgaagcttctccggtccctatccatatagtgaccaatgcttctcagctgccggcggagttcttgaacccttcaccggagaagcagttggttgtaggttttgactgtgagggcgttgacctttgtcgcaatggcactctttgtattatgcagcttgcatttcaggatgccatatatttagttgacgccattgaaggtggagaagtgcttataaatgcctgtaagcctgcacttgagtctagttacatccaaaaagttattcacgattgcaaacgagatatgtgggcattgtacttccaatttggcatcaagttaaacaatgtcatggacacacagattgcttattctctcttagaggaacangcaggacagaccaga

SEQ ID NO: 19551 - DNA, 209 bp, Gossypium hirsutum
  Clone ID: uC-gsflnu33B091b06b1
ctggggggtcttttttatttttatgcggttaacaaaacttttattgaagcttgaaatgactggaggcacggccagcaaaagaaatgaacataacggaacagcacaagcacggttgaaccataaaaaaaaagcatgcaggtaccacaacaaggaaatatatcacaaagacccataacaacacaccacaactaaagacatctacagctaat

SEQ ID NO: 19552 - DNA, 449 bp, Gossypium hirsutum
  Clone ID: uC-gsflnu33B091b10b1
tcccatttcaacagggcctgttgctttgcctgaaaagccagttctgcttttccttcctcatcagaaagataagaaaagcattaatttactgttggggttgcctgtttcagcaatgaatagctttgaagagctgatgcaggtttaagcagaagaaaaaaaaagacatgttttatagcaagttattttatgtcagatactcagattcatatgttgcattgcatgcagtcattatctgaggattttctgacagtgggttttcggtaaattgaagaacaaaaataacctcagatcagatagactccgaattctgagtcatataatttgtattataaggggttaagtgctccgtctatattcgtttttttcagtcatgatttgggttacagtatccgaataagaagcctgaaggagcatggggattcaaacaaatattccttgtccccctttta

SEQ ID NO: 19553 - DNA, 230 bp, Gossypium hirsutum
  Clone ID: uC-gsflnu33B091c05b1
tgtctcgcgtccgctcttggatattctgtgagctcttttgaaactcttcaaagtgtcttcttctatgttctttgcctgtcttcactaaaaaccagtctgttgtatccaagtaatgtcctttaatcgtggtctgtgatatgaatgagaatggttgtctaaattatgcttgccaaaaaaaaaaaaaaaaaaaaaaaaaaaaaaaaaaaaaaaaaaaacaaaaaaaaaaaaca

SEQ ID NO: 19554 - DNA, 412 bp, Gossypium hirsutum
  Clone ID: uC-gsflnu33B091c06b1
ctgtctctaatgctttcgcttgttttgaccgtgtattaaatacccccatacgctggccacaccttctacctacaatcactaaaaccgctgtcctttgttagacgaaacctgcgtcccagaacttgttttttgtggctcttttaccctttttgttggaatcaaaccatggcccttttgtgatttttgagaatgggggaaacaacttggagctgtagtgtattgatgctctccgcttgcagatcgggggcgagcactgtccttactgtttgtgctgattctggtttcagattcggttcttgcagagaaggctggtactaccgctggcttggacttgacccataagcaaccccagctgaatgcctatattgctttgcaccaatagcccagagtctgatattgtttgacacacgcc

SEQ ID NO: 19555 - DNA, 196 bp, Gossypium hirsutum
  Clone ID: uC-gsflnu33B091c09b1
cgaaaccagagagagaaaaaaaagaaagaaggaatggttctgctagacaaagggtgggacgatgtagcagctgggcctcaacctgcacgtggcctcggcaggcttaggaagatcaccacccagcctttgtacatcaaagatgacggagaaaagaaaaagcaccagaggtcgctgccgatgccatatagcccagcgt

SEQ ID NO: 19556 - DNA, 390 bp, Gossypium hirsutum
  Clone ID: uC-gsflnu33B091c10b1
tgcttagccttttgtctgcaaaatcaatcctgaggatggcattgatgcaatcgctaaaccacacaagaacaattcctatttgaaatccatatggattctcgagattcttctccaagtccagcccttttattgtgaaagttggaattccagaatttctgaatggtgtagggcatggggttgaaactcacgtagcaaagctggaatctgagatcggcgactttcagaaactgctcgtcacccgcactctcaagctcaagaagattggaattccctgcaaacataggaagctgatactgaaatatgcccacaaatataggctgggtctgcggaggccgagagctgagcccgtgaatagtgggattaactagaccaatcctttgggagctatgc

SEQ ID NO: 19557 - DNA, 422 bp, Gossypium hirsutum
  Clone ID: uC-gsflnu33B091c12b1
ttctattccattcccaaccgatttctactgagaaagaaaacggagacctgctttcaaaatcattccaagatataatatcgactctccccaaaggaaatccctggggctttcccgaccattttttacagtaccacgggttttggcacagctcggttttcctacaaggaatcttgtcagctcaacaacagatccaggctcaacctgctgatatcatcctttgtagcgcccccaaaaccggcacaacctggttgaagtccctcacttatgccaccatcacaagaacttcattcgatgattctaccagccctttgctttccaagatgccttatgatgttgtgcctttcatggagcttgatcatgcccatttttccactaatcgagatcttggatccccgttttgggtactcatatgccttacctct

SEQ ID NO: 19558 - DNA, 484 bp, Gossypium hirsutum
  unsure (1)..(484): unsure at all n locations
  Clone ID: uC-gsflnu33B091d01b1
tcttgatactactttaactaccaaaggtgactctaaagaaactttctatcttggtccactagctgatggcctcaatcaatggcctttagaagaagatctaccatcttggagaagcgcaatggagacttatcatcaaaaagtgctgtctgctgggactaaattactctccttaattgccctgtcccttaaattagatgaagacttcttctggaaagtgggtgcccttaatgaacaagtaggagttattcgtttattacattatccaggctcaggggactcggactcttcaagtgaagaaatatatggtgcttctgctcattcagattatggaatgatcactcttctgatgacggatggtgttccggggcttcagatttgcagggagaaatccaaacaaccacaggtttgggaggatgtgccaagcataagtggggcattcattgttaacattgnggacatgatggagaggtggaccaattgtttg

SEQ ID NO: 19559 - DNA, 486 bp, Gossypium hirsutum
  Clone ID: uC-gsflnu33B091d02b1
tttacgcgtccgacagattttctctgtaacatggatccttacgtgcttcttacttgccgaacccaggagcagaaaagcagtgttgcatcaggaaaaggatcagaaccagaatggaacgaggatttcatattcaacatctccgaaggtgcttcggaactcgcactgaaaataatggacagtgatgctggttctcaggatgatttcgtgggagaagtagctataccactggagcctgtatttatcgaaagaaacattcccctgactccatatactgttgtcaaggatggagaatatcgtggggagattaaatttggtctcactttcacccccgaggaacgtgaaagcagggattttgaagttgaagaatcttttggagggtggaagcagtcttcatacactgattaggcaggccacttatagttttcagccttaattcccgtttcaagaagtaactattaagtttgattctcggaccatgtttggtgg

SEQ ID NO: 19560 - DNA, 450 bp, Gossypium hirsutum
  Clone ID: uC-gsflnu33B091d06b1
tccaaagctcggtcgcagatattttggtccatatcaggtcctcaaacgtgttggtccagtcgcatatgagctcgatctgccttctacggctcgtatccatcccgtctttcatgtgtctatgctcaagaaatgcctcggacaccctgaccagcaagtcactcctttggatttggtcgattccaccagctctattgacttgtaccccattgcaatcttagatcgtaggcaagtacaacgagggtctgccaccgtaagacagtgcttaatccaatggaatggcctgaccattgacgatgctacttgggaagataacgagaaactgcaccagctttaccttgctttccaccttgaggacaaggttcatcctcgatgaggagggtactgttctgaacccaaatgctgctgagggccctgctggagagtacattgcccaaaggaactaagagttga

SEQ ID NO: 19561 - DNA, 407 bp, Gossypium hirsutum
  Clone ID: uC-gsflnu33B091d11b1
tttcacgcccccatttattttatttttcaaacaaattttcccttcaattttcgtataatttcctaggaaaagaaatatgagagagtgcatttcagttcacatcggtcaggccggtattcaggtcggaaatgcttgctgggaactttactgtctcgagcatggcattcagcctgatggccaaatgccaagtgataagactgttggtggaggagacgatgctttcaacacctttttcagcgaaactggtgccgggaagcacgtccctcgcgccatctttgttgatctggagcctactgttatcgatgaagtgaggactggtacgtaccgccagttattccaccctgagcaactcatcagtggcaaagaagatgctgccaacaatttcgctcgtggccattatacaattg

SEQ ID NO: 19562 - DNA, 320 bp, Gossypium hirsutum
  Clone ID: uC-gsflnu33B091e01b1
gtgcttgcaatccaagaaaatgccaacgggctagctatgtatgctgccatctgccagcaatgtggccttgtccccattgttgagcctgaaattcttgttgacggatcacatgacattaaaaagtgtgctgcggtgacagagcgtgttcttgctgcttgctacaaggctttgaatgatcaccatgtcatgctagaaggtactcttttgaagcctaacatggtgacccctggttccgactccccgaaggttgccccagaggttattgctgagtacactggtccgtgccttgcaacgtaccgtccctgttgcagtccctgcta

SEQ ID NO: 19563 - DNA, 295 bp, Gossypium hirsutum
  Clone ID: uC-gsflnu33B091e12b1
tccgagaccacctgtgatcagagtccagagagagaagctacaggaaccacggagggggaaggaacacggaacgaagggacgcgccaggccagggagagggcacactccaaggggggccaggcaaggcgaggggaagaagccccaaggtcgagcccataagcggatgcaatacaagacaccgtggccacactgccgatgtaggcttcgggaagaagcggggaccgaactcgcaagagaagtgcagggattccagtatgaggcgtacacaacatacgaaggattggagccacaccag

SEQ ID NO: 19564 - DNA, 342 bp, Gossypium hirsutum
  Clone ID: uC-gsflnu33B091f07b1
taacaacctcatgaatcgaacaagaataacaacaagaacgacaaagatcaaggcgatgataatctcaccgccggttacgcgtccgccgacgataccgttcctcactctaccggaaatcgagagcgcaaaagaggggtgccgtggacggaggaggagcacaagctgtttctggtaggactgcaaaaagtagggaaaggagattggagagggatttctagaaacttcgggaagactcgaactccgacacaagtagcaagccatgctcagaaatactttctccgacgaagcaatctcaaccgtcgccgtcgcagatctagcctctttgatatcaccaccgatacg

SEQ ID NO: 19565 - DNA, 476 bp, Gossypium hirsutum
  Clone ID: uC-gsflnu33B091g06b1
tctgaaaaaaccagagtcctcattaacgcatgggccctcggaagagaccctaattactggaacgaacccgacaaatttaaccctgaaaggttcctcaatggttcagtcgattacacgggaacaaattacgaattcatcccatttggggctggaagaaggatgtgcccagggatcacctttgccacacccaacctcgagctgcctttggcccatctgttgttccattttgactggaagctacctaatggaatgaaaggggaagatcttgatatgagtgaggtgtttggcatgactgtcaagaggaaaactgaacttgttcttattccaactccatatcatggatctaaaattgttcattagaaccacaaagacatttggttggtttcctttcagtatcatatgtcctagttgccatgttgtaacttatacccctaaaacataatacttgttcctgtcaggtctttggtaaaacacaa

SEQ ID NO: 19566 - DNA, 363 bp, Gossypium hirsutum
  Clone ID: uC-gsflnu33B091g07b1
tcggaatatcgtcggaggttcgatctatgtggccgggatattcttcaaaccaacagctttctctttagtcgaaagaaatgtacaataacttgggagcccagcctggggtgcctaggccgcctgtaaatcctcaaccaacaccatttggtaatgcattttatggtgctggttctggtcttatccgaggcggtctaggtgcatatggagagaaaattttgggatcaagttctgagtatgtgcaaagcaatataagtagatacttttctgatccttaatactactttcaagtgaatgatcaatatgcgagaaacccattgaaggctgaattgctgccatttcagaacaagaggccttggaccagaa

SEQ ID NO: 19567 - DNA, 193 bp, Gossypium hirsutum
  Clone ID: uC-gsflnu33B091g08b1
acggtcgtaccaaagagtcaacacaaatggcaccaaaggggatttttaaaaccactgacgggctttcaaccgcacccccatgaaagcaccactgtctacacccttttccaataccaaagctgctgcacaagaagctgaactatggaccatatgtccaatcaacaagctaaatacatccctcaccaaacacaaa

SEQ ID NO: 19568 - DNA, 385 bp, Gossypium hirsutum
  Clone ID: uC-gsflnu33B091g12b1
tcctcctgttgaaaacaaaaagctacagagggatcactttagaacggaatcggggtactaaccaatccatgaagtggattccagatgctgctttagatgcgaacaccaaacccctcactgattagagccctgacggaaatccaactcattggcctcgccccagctatagacactttattggcttcttccatgctagccgaaagcactatatatatcgatcatcaagtgctacatcccccctgctagatactctgacaaagacattgtttcaatgagaacgctctcggacgaaaccagttgtgcctcattagattcttgagccgtttatgttcacccagggacggaatggaacccgaggtgaccactggcaaaaatttgcaaagca

SEQ ID NO: 19569 - DNA, 320 bp, Gossypium hirsutum
  Clone ID: uC-gsflnu33B091h07b1
taacacaccaactacaaaagaggcatattacgagcaggatgatttttgagaggggtttccctcagaactcggcaagattgactgtccctggaggagctagtgtggcatgcagcacagctaaagctgttgagtgggacgctgcctggaaaaacaacctctacccttcaggcctgtctggcttgggggttcatctctaaacgaatgactcatagactcccctctttttcgggctatccaaggttattgatagtataccacgaatttgctcaggtggagttgccctacgtaggtaacgcctgactactggaagacaacaggat

SEQ ID NO: 19570 - DNA, 459 bp, Gossypium hirsutum
  Clone ID: uC-gsflnu33B091h10b1
tctctcacgcgtccgaaaaaaaaaaaatcacctactctctcactttgctctcttcttgttcctgtcctctttcaccaaactatcgccgacaacctctccaaaagaatggcatatgaagggattctgttggggatgggtaatcctctccttgacatttcgttagtcgtggacgaagagttcttgaaaaaatatgatatcaagttgaacaatgcaattttagctgaggagaaacaccttcccatgtatcaagaaatggcatccaagcccaatgtagagtatattgctggaggtgctactcaaaattcaatcaaagttgcacaggggatgcttcaaattcctggtgcaactggttacattggctgcattgggaaggacacgtttgcggaggaaatgaagaagaactcaaaagctgctggtgttcatgttcaatatctcgaggatgaaactgccccaacagga

SEQ ID NO: 19571 - DNA, 285 bp, Gossypium hirsutum
  Clone ID: uC-gsflnu33B091h12b1
taattttgtaagcaagtatggctaaggacggggaggttggtggtgagttccaagccaaggactaccatgatcctacaccagctccattagtggacggggaggagtcgacaaagtgggcattttatagggctgtattatccagagcttattgccacgctctcatttttatacatgactgcgatgacagtgatcggatacatgagtcaggttgaccctgatcagggcggtgaccaatgccgaggcgatagaattcatggcattggcagtgctttaggcgggatgaaa

SEQ ID NO: 19572 - DNA, 553 bp, Gossypium hirsutum
  unsure (1)..(553): unsure at all n locations
  Clone ID: uC-gsflnu33B092a06b1
cccactttttcgcccacgcgtccgattcaaagttagctttttgcaaccattgtctcaccttgtatcgaacaatgtccctccctgtaacacaagggaaaaccctccctgatgcctgggactacaggggcaagccgaccgagcggtccaagtccggtggctggaccagtgcagctatgattctaggtggcgaggcatgtgagaggctaacaacgttaggtatagctgttaatttggtgacgtatttaactgagactatgcatttagggaatgctaccgcagccaacacagtgaccaacttcctcggcacctctttcatgttgtgtctactcggtggcttcatcgcggatacttttcttggcagatatctcaccatcgcaatcttcgccaccgttcaggcaactggcgtcaccatattgaccatctcaaccataatcccaagcctaaggcctnctaaatgtaccagggacaacgcaacaacttgcaccccagcaagcgtatacaactcattattctctacctagctctctacctgaccgcctttgaaactggggac

SEQ ID NO: 19573 - DNA, 306 bp, Gossypium hirsutum
  Clone ID: uC-gsflnu33B092a12b1
gtgtttccaacaaacatatgcatgcataaacatggacagaatgatgtatgagaacatgatgggcctatctgcttgatgcatacacgaagcctaaaacatgctgatgtaacaaacgtcgagtgctaaacacatgattgtgacatgtgttgtcgctgcaacagtgcttgatatgctaatcaatggttaggtatgttaccaggatgacagcctaacaattgcataaccaagccatgactttaagaacggttgctattcactgatgttatgaataccacactcacatcagagaccgacttactccgggcc

SEQ ID NO: 19574 - DNA, 190 bp, Gossypium hirsutum
  Clone ID: uC-gsflnu33B092b07b1
tccatacgtccgtatttaggtacctatgccagtaggattggcaattgggttggcagagttagtgaccctcccaatcacaggaactggtacaaacccaggtagtaacctaggtggggccattattgtgaacatgaacaagggatgggacaagccatggaatgaccatggggtcccatggatgggtcctttc

SEQ ID NO: 19575 - DNA, 300 bp, Gossypium hirsutum
  Clone ID: uC-gsflnu33B092b09b1
cttaattccaaggtttcattccaaagtttcaaaggcctcgtctaaacttcgattacaacgaagtagctaggattcgaaggagccgatatgaaggtaaatctcttttccttactcttttttttttaacgaatatcgatcatgaagaaagcaaaaaagaaaaatgaatgagacgttagacttaaatcaatcaccttttcgatttgtgatttctgctttttctattaatctctttgctgtatgtgtgtaaccttatagataattccttttcgggcgttatagtcttagaaaaaactgattaaa

SEQ ID NO: 19576 - DNA, 512 bp, Gossypium hirsutum
  Clone ID: uC-gsflnu33B092c02b1
ccaaatccataatgataaaacatttctttggtggaccttaagcgctccccaataaattccgtgaacttttttaaattctttttaaaattaagagacaaaattctgtaattaaaataaaatataaatacctcaaatataatacttttactgtttgaaatctaaattcactgttcaaaagataacactctaaaaatttctccaaataataaagtgaaacccctcaacacctacctaaagagttgtaatcatggttcctacttaaagaatgttattgcgactaaactggataacaaatatttgttattttaggtggccatacaattggattggcaaagtgtgccaccttcgacaatagattattcaatttctcaggaactggtgctcccgacagtacgatggaggctaacatgttggcggatttgcaaagcttttgtccggttaacggtgacagtaacaggttcactactcttgataggaaactaactgatctatttgacaaccattattttaag

SEQ ID NO: 19577 - DNA, 550 bp, Gossypium hirsutum
  Clone ID: uC-gsflnu33B092c03b1
aggaatttgttggcaacaaacaacaatgaggtccaactccaaacctcattctccttttaacaccaagctcatcctcatctgtgcttctgttgttctcttcgtcttccttctcattaccaccacctcttccttttccaaaccccccatttcacaatcccatctctccaactccacacaccctgtcgacgacagtgaaccaaccccactagattgcccatcccttcccttgaccccaacatgcaccaaaactccaccttctctagccaatgccctcatccactatgccaccaccaacatcaccccacaacaaaccctcaaggaaatctcggtttccgctagagttttagagaagaaagccccttgcaacttcttggtattcgggttaggacatgacagtctgatgtgggcaggtcttaaccatggtggtcgtaccgttttcctagaagaagacaaggcatggatcgaacagatcaagcaaaaacttcccagtttggaatcgtaccatgttgagtatgtaacccaagtccaccaagcagatgatctgctagag

SEQ ID NO: 19578 - DNA, 188 bp, Gossypium hirsutum
  Clone ID: uC-gsflnu33B092c07b1
tattgtctggacctgcagtgacgaaggtccagccagacacagtctgatatataggggcttggttcccatcctggcagaagggtcagccaaggcaactgatgccgaatccaccgaggtcatcttagaagcagcaatgaagtcagctacggagaaggggttgtgcaagcctggagatgccatctccgcac

SEQ ID NO: 19579 - DNA, 471 bp, Gossypium hirsutum
  Clone ID: uC-gsflnu33B092c08b1
gtttattactttgtccaaaagtcatgtcggacgatttgctattagacccagacatccgagtctgggtatttttgcccattgttattattacattttttgtcggcatccttcgtcattatgtatccatcttgctttcttcgacaaaaaaagtggaacttcagcaagttattgacagtcaagcaatgattcgaagtcgactgcttagggagaatggcaaatacattcccaaacagtctttcctcatgcggcgccattactttaataatgaagaatctggttatttcaaaattagtcaaaaacgaaatacaaccgctccaaatccaatgactgatccctccatgatgactgacatgttaaaaggaaacctcacaaatgtattacctatgattctaatcggaggttggaataattggaccttttctggctttggtaccaccaaagttcctttttcattgacacttcgctttaaac

SEQ ID NO: 19580 - DNA, 305 bp, Gossypium hirsutum
  Clone ID: uC-gsflnu33B092c10b1
ccctgcttccgaagggggttagataagcatcaaacattgcaatcgttggggaatttgagtgtggattctactgtttctatgcctgctacgatgggaagaaagccatttaatacatttgtgtgatttgttgctcaattaggcttatttatgaaattttgtgaaggatcatatctagaattactataatccgatcctgtaaactttacaagattcctgatcaaccagccacccctggatttagaaagaaggagctttctgattgtccctgctgtcactaggttgtttagaaattactttgagccacc

SEQ ID NO: 19581 - DNA, 340 bp, Gossypium hirsutum
  Clone ID: uC-gsflnu33B092d04b1
gcggcctgtctatctttgtggacagggcaccaactgaatggggggtttgtccttacagaataccacctccgtcatgctaagtaatttgtatctgtttcagacaaagaggaaagatctagaggagaacaagggctgggataaggagacaccgacggaatgaaagggcttagttttatgcaaagatgtggcctttcggggaggattatcagtgcgatcctggacatagccgctgaagctggataggatgcaagtgagttacaagctcatgtttgtatacactacacaatgatgtcatcccacggagacctgtacttagcactgggcttaactgtcgctgcag

SEQ ID NO: 19582 - DNA, 271 bp, Gossypium hirsutum
  Clone ID: uC-gsflnu33B092d05b1
taatattgtttatcaataatctcttgcattttggttttaagagatttaaaaaaaataaaggagaggaaaaacaaaaaaaaaaataaaaaaaaaaataaagggttgccggtgtgggggttcctggctttcccaggtttggttgcggcgcttgagctgtcttttcgggttacctgagtttgtttcattggcggtcgttgtcctactttgtgactgggaggactgtgttgttcccggccttactccgcttgttgcccttgccctttttgccctt

SEQ ID NO: 19583 - DNA, 104 bp, Gossypium hirsutum
  unsure (1)..(104): unsure at all n locations
  Clone ID: uC-gsflnu33B092d06b1
gctacnttgaatttgataaaagaagacaaagtggtttggaaaatggctttactcatagcggtgcggaccttaggtatgctagtgtctgagtcgacttaccagcc

SEQ ID NO: 19584 - DNA, 424 bp, Gossypium hirsutum
  Clone ID: uC-gsflnu33B092d12b1
gcccgcctggcacgcggacccgggaacggacattgccggacccgacccacgcggacatttgcttcgctgtaaattagaggaggcatctatgggagtatttttggagaattaatggcgggcagctgatacagtttgagatgcggtgcctacaccaatgactacttgccgagactggcgtatgtgacttaacccccagaagctcatagatgttggctttttcaggcttggacctatgatgacgatgagccgaaccattaaactttacaagttacctgatcaaccagccacccctggatttagaaagatggagcttcgtgatgtccctgctgtcactaggtggcttagaaattacttgagccacggtggtgtgtctccagattttgatgagaatgatgtggagcactggcttcttcctactgaggat

SEQ ID NO: 19585 - DNA, 115 bp, Gossypium hirsutum
  Clone ID: uC-gsflnu33B092e10b1
caatgagtgttgaaacaggcacaaaaacaagaggagagaattgtgtggagaaagagagggctacactccgcctgaggcttctcaacacaaccatgcttaagactgttggcttgcc

SEQ ID NO: 19586 - DNA, 68 bp, Gossypium hirsutum
  Clone ID: uC-gsflnu33B092e11b1
aaataaataaaaaaaaaaaaaaaaaaaaaaaaaaggagaaattatataaaaaaaaagagaagcaaaaa

SEQ ID NO: 19587 - DNA, 346 bp, Gossypium hirsutum
  Clone ID: uC-gsflnu33B092f02b1
ctcagatactctgatccaaattattccttcgtcaaacaccctttctccggtcttctcacggccaaaattttaaacagcgatgtcgggaaatgctaaattgcggcggtcggtgatgttccaggcggtgctattagtggtattgatgttagcttcgagtaatgctccggtcggtgacgccatatggatgaacgttcctccgactggcactaagtgtgtttcggaggaaatccagagcaacgtcgtcgttttgtctgcctacgtcgtttgttccgacgatcacgttcccttccttcccttttcggacctcgtgtcattctcttctgtccacaatcttcatctcttggtg

SEQ ID NO: 19588 - DNA, 204 bp, Gossypium hirsutum
  Clone ID: uC-gsflnu33B092f03b1
ggccgttggtatctacaaccaggacaagccatgggatgatcattggatgttctgggttggaccattcattggcgcacccattgatgcaatctatcaccagtttatcctgagggcagactgctgataaagctcttggatcctttaggagcagctctcacatgtaactaagcaatcattctccagccacaagcttaaacaaacaaa

SEQ ID NO: 19589 - DNA, 113 bp, Gossypium hirsutum
  Clone ID: uC-gsflnu33B092f06b1
cccacgctccggctgttgacatctcacactgattagagctaatttcaacaatcatgggaggcttggagcattgctgcagcatgaagtcataccgaagtcattgttgacagtct

SEQ ID NO: 19590 - DNA, 504 bp, Gossypium hirsutum
  Clone ID: uC-gsflnu33B092f08b1
cttgtttgtctattgaattctttccttcactttctcgagaaaaaaaaaatgtcttcaggttgcaattgcggatctagctgcagctgcggcgacagctgctcatgcagcaggaaccttaaccttggatactcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagcaaaataacaggcctctgtaatgatttattttcaaggatgaatgcctgcaaggtctatgactataattatgtctctgtctgtgtcttgtgtaatagaagctttgtttgtggtgaaaataatgtataagccagttggttgggagcaaatttttcttttgtccaaaggatttttttgctgctcattcat

SEQ ID NO: 19591 - DNA, 305 bp, Gossypium hirsutum
  Clone ID: uC-gsflnu33B092f09b1
ctcactcgtccgaaaagaggaaaatagagggcctttgccccctctcttctccctttcctatttttctcctttggctaaggttaggaaacccatcatcgccgctgttaccacggcaacaccacaagcgaaggtcgacgacgcgaatgggtgaggtcatttagccccttttcaaggcgtccccgaaggctacgccttctcggtcttcccccatttggttcaaccccgacaacggaagaggaaccccggcgacgaaaccttagacaatccctgtgccaatgcgacgcgtgaaaggggcaacggccagg

SEQ ID NO: 19592 - DNA, 537 bp, Gossypium hirsutum
  unsure (1)..(537): unsure at all n locations
  Clone ID: uC-gsflnu33B092f11b1
tatttttctaatttgcattaaaaaattttgaaaggtgttggcaccactccccattggattcgctgtgttcatggttcaccttgccacaattccagtcactggcactggtatcaaccctgctaggagttttggagctgctgtcatttacaacaaagagaaggcctgggatgaccaagtaaataataatttcccatcctatataaatatacaattttccatttgatgttataaattgttgctcataatgtatatatatttcatgtggtgttgttatacagtggatcttctgggtcggacccttcattggagctgccgcagctgcattctaccaccaatacattctcagagccgcagccatcaaggctcttggatctttcaggagcaatgcttaagtccagctttcattttcttacgaacttcaaccaaaaaagaaatggagaaccttgagttcagtgtggaccattgaaatgtaaataaatatttatgaacaagggtgtcttattttcttgctttcaatgtattntatttcgtacgttt

SEQ ID NO: 19593 - DNA, 390 bp, Gossypium hirsutum
  Clone ID: uC-gsflnu33B092g07b1
agataccgagggagagtttttcgaggctgaaaaggaggatatgataaaactgcctggcgacaagaaagaagaccagaaagcagacgacgcctctttgattgagaacagcgagggagacctcgattcaaattgactaccctcctttgaggagagggtgtgcctcttacaaagtccgagcccacctttattcttagaggatctctcccccccctcataatcaccaactgtggacgtacaggatactacctagatccacactcatatgtgctacttcaacttcaatgacttcatccactcaattaatcgcatggatgctctcttcttaccatccacaacccactttcatattaaaagctcctttctgtattccctgaaggagtgaaagtatgg

SEQ ID NO: 19594 - DNA, 529 bp, Gossypium hirsutum
  Clone ID: uC-gsflnu33B092g09b1
ttcagtcttacagaaagccaaagctgataaagatgcaatttttaaatgtgaactcgaaccaggcaccggggagaccaaaatctgtgccacctctttggaatccatgcttgaatgtgtgagaaatgctgtggggcccgatgttgattttgagttaataagcactagccaccctacgatgactacaccaatattgcagagttacacaattacagaaccttcttgagagatcaaatctacaaagaaagtggcatgtcattctctcccatacctttacacgatctacatgtgccattatgatacctatgagaccaatatttttaaagttgcactcgttggtgacaatggcgataaagtggatgctttcattgtttgccatatagatacctcagcttggagccctaaacatgttgcgtttagcttgctccggactaagcctggtatccttgtttgccatacttttactgaagggcatgatgtttggattaggcttccactattgcagtcatttaagacgtagctttacccttgt

SEQ ID NO: 19595 - DNA, 387 bp, Gossypium hirsutum
  Clone ID: uC-gsflnu33B092g12b1
ttacctcctcatcgtgctcggcatcgtcttcaccatctttgctttcgcggtgacgaataaaggtgctggagaagctttgtctgggaaagggtacaaggaataccgacttggtgattactccaactggttacagaagagagtcactagccagaagaactggaataagattaagagctgtttggctgatagtaaagactgttctgatttccactataagtttctgaatacttctgtctcgaagtttttccatacgcatattttttaccctttcgtctggtagctgaaagtcaatcatccttgtccattttccttttttcctttttaatattctttcctaaaagtctctttcatattaagccattctttatatttacctttcttttattt

SEQ ID NO: 19596 - DNA, 155 bp, Gossypium hirsutum
  Clone ID: uC-gsflnu33B092h01b1
atcgtttccttgtgtccgtaagttcaaaggagacagggttccaagtttggttgatgaaccaggaccgtgtgacctgagcgtgattattggtctggtgattcccttgctgggttcactttgactgctcatggattgttcttattttagctttgttg

SEQ ID NO: 19597 - DNA, 404 bp, Gossypium hirsutum
  Clone ID: uC-gsflnu33B092h04b1
ggttatcacttggatcaaacgtgaatgggaaaacgaggatggaggatgatcaacagacgtggagttctgtgaattggccataaacaacaaagaaaacagcagcagacatcgacacctggaggaactaggcgactgataccatgttaagtgctaagtagaaaacatagcaagactacagaagctcactgcgtatggacttggaggaaataaaggtgcgtagggacctagatattgagttagaacattaatgttggagatgcctagtgctatttgtgtttcacttcaggttctactcttgattccaccaatactggtagcaattctcctatcaccaattggtgtatctcaagctttggttattcaaaacatgcccgctccctttggattacttttaatttgaacca

SEQ ID NO: 19598 - DNA, 247 bp, Gossypium hirsutum
  Clone ID: uC-gsflnu33B092h06b1
caatcttccttttcttctcttctttgaactcaaagtcccagctaatattagaatcatgggtgttgtcacttatgactatgagaatacctccccagtcgcccctgccaggcttttcaaggcctttactgttgaagctccgaaagtttggcccacggctgctccaaatgcagtcaagagcattgaggctgaagctaatcctatctctggaagtatcgtcaaattcatctttgttgtaggccttccattc

SEQ ID NO: 19599 - DNA, 77 bp, Gossypium hirsutum
  unsure (1)..(77): unsure at all n locations
  Clone ID: uC-gsflnu33B092h07b1
tanatccattatcacatgatggtatcgagtacgtatggcagctgcagcgacaacggtgatgactatgaggatggtga

SEQ ID NO: 19600 - DNA, 127 bp, Gossypium hirsutum
  Clone ID: uC-gsflnu33B092h09b1
ccctgcgtccgaaatttcagggttttgtgctcggttgtttgcttgtaatctcaggtggcgttcatcccaggctcccatggtgtcggcagacaggccattttctatcctgcctgatcaacaaagatac

SEQ ID NO: 19601 - DNA, 293 bp, Gossypium hirsutum
  Clone ID: uC-gsflnu33B092h10b1
aatggtggttacattcaacgacttgggttctgctgccggcttgaagaagctcgatgagtatctcctcactcgcagatacatctctggataccaagcttcaaaggatgatatcaccgtctacacagctctatctggggccccatcgtctagctatctgaatgtttctcgatggtacaaacacatcgatgcccttttgaggatctcaggtgtttctgaagaaggctgtggtgtgactgttgagggatttgctcccgatgaagctgtggtcatctctacaactgcatattcaaagg

SEQ ID NO: 19602 - DNA, 527 bp, Gossypium hirsutum
  Clone ID: uC-gsflnu33B094a03b1
atcggtgatggggcattggaaaacgtagaggccattgttgcagtccatgtatcccacgaacaccccacgggtattatcggctcaaggcctggtcctcttcttgccggctgcggattctttcgagctgttatcagtggaagaaaaggccttgccggcagcccccatcactccgtcgacccaatcttggctgcatcagctgccgtaattagtttacagggaattgtttctcgtgaatcaaatccattagattcccaggtcgtctcggtcacttctttcaatggaggcaataatcttgacatgatccctgaaacggtggtcataggaggtactttcagggctttctccaacgccaatttttacaattttctccaaagaattgaagaggtaatcgtcgaacaggccaatgttttccgatgttgggtgacggtcggtttctttgaaaaagattcaccatctattccccaacattgaatgacgaccgtatgtccagcacctaggaaagtggcaattgattgctaggaccacca

SEQ ID NO: 19603 - DNA, 446 bp, Gossypium hirsutum
  Clone ID: uC-gsflnu33B094a07b1
tttctccacgcgtccgattccaactgctaggagggttttatatgcttatcaggtgactgccaagccgaggctgcttgagccagtgtacttggtggagatccaagccccagagcaagcacttggtggtatttacagtgttcttaaccagaagcgaggacatgtgtttgaggagatgcagaggcctggtactccactatacaacatcaaagcatatcttcctgttatcgagtcatttggattctcgagcaccctgagggctgcaacatcaggacaggctttcccacaatgcgtgtttgaccactgggatatgacgtcatcagatccattggaacctgtgttccaggcatcacccatgttgttgagatccgtaagatgatgggattgatggtgcaaaatacctcgttcctcctatatcatgacaagctttatctttttttccatatttt

SEQ ID NO: 19604 - DNA, 59 bp, Gossypium hirsutum
  Clone ID: uC-gsflnu33B094a11b1
gcacctacccggacggaattcctttacccacccaccctttttttatacacgaacggaaa

SEQ ID NO: 19605 - DNA, 380 bp, Gossypium hirsutum
  Clone ID: uC-gsflnu33B094b01b1
gtattagattaagcagggatatttcctttcaagagcttgttcaaaaaatgttagcaatttatgaccaagcccatacaataaagtatcagttgcctggtgaggatcttgatgcattggtctctgtatcttgtgatgaggatctgcagaacatgatggaggaatgtaatgtgctagaagaaggaggaccccagaaacccaggatattccttttctctagtagtgatttggatgatgttcagtatggcttgagcagtgtagagcgattctgagatgcaatatgttgttgctgtcaatggcatggacctaggatctaggaaaaaactcaattgccttaagtgctatcgagaataattgggtggagtaccttggtttgacattgt

SEQ ID NO: 19606 - DNA, 430 bp, Gossypium hirsutum
  Clone ID: uC-gsflnu33B094b03b1
ggtaattacagggcattcaatagagaattgcgtgtgccttcatgaaactagttgaaagattcattaaaataggcattgtcaaattcgatgaggcctccagtgtagaaaatccgctactcaatcatacggataatgaagggaatgcgatgaatgaagaaatgttagaaaatgttcacatcagtgccgaatacgaagaaacaactggagaagagatcttattagatgttcgcccttataaacttgggagtgttctgaacaattgaactgcagaagaaattcttgtagagtaatgatcagaacatttttgtttttagcctaaaagtgatagaatttccttttgtaaataggctaatgtctgaacgtcattattctaataaaaatcaattttcgcatttctttctgagcccaatattccttcatcactcttgta

SEQ ID NO: 19607 - DNA, 324 bp, Gossypium hirsutum
  Clone ID: uC-gsflnu33B094b04b1
tgctacgcgtccggatgatacgattcccaagcggggggttttttcaaaaactggtacgggtaacccattaattcattattgtcttgatagaaaatgctttgcccatggcaagtaatactccatcgaaaatggaaatcttgcaaacaaataacaatagaaagttgatcgtaacatggcaggtcttcacaacaaagcatctattggatgaaatcctatattgaaaagaacctttttgttgtattgctcaatagtcacaaactctgaacatcctccattgatttcgtttaatcctctaattgttttcttctattaggagtgcttaac

SEQ ID NO: 19608 - DNA, 457 bp, Gossypium hirsutum
  Clone ID: uC-gsflnu33B094b07b1
tcgtccacgcgtccgattccaactgctaggagggttttctatgcttctcagctgactgccaagccgaggctgcttgagccagtgtacttggtggagatccaagccccagagcaagcacttggtggtatttacagtgttcttaaccagaagcgaggacatgtgtttgaggagatgcagaggcctggtactccactatacaacatcaaagcatatcttcctgttatcgagtcatttggattctcgagcaccctgagggctgcaacatcaggacaggctttcccacaatgcgtgtttgaccactgggatatgatgtcatcagatccattggaacctggttcccaggcagccacccatgttgctgagatccgtaagaagaagggattgaaggagcagatgaccccgctcttcgattacgaggacaagcttggagcttagctacaaaataataatttattgg

SEQ ID NO: 19609 - DNA, 218 bp, Gossypium hirsutum
  Clone ID: uC-gsflnu33B094b09b1
tcgtgtaaacccaaaaaggagaccgcagcctagagttatttttaaaaaagcctgtccttgtcacacaccccagattgagatcttgtaaacttttaccgactttccccctcataaatgctacttatggctcccgccatcaaaccactctatctgaaacagacggatcgactcccaaaaacccaacaaccacccatcacctccaacctcacaaaaccccc

SEQ ID NO: 19610 - DNA, 383 bp, Gossypium hirsutum
  Clone ID: uC-gsflnu33B094b12b1
tccacgcgtccggctgctttgaagttccacagcgataagggcattgaaaacttttacagtctacactcatggttgggcatagcttgccttttcttattcggcattcagtgggctgctggattcgcaactttttggtacccaggtggctcaagaaacagcagagctgcattgttgccctggcatgtgttcttcgggatgtatacgtatgcacttgctgttgctactgctactacgggtatcttagaaaagcttacatttctccaaacaaaccgggtaatatcacgctactctacggaggcattgctagtgaactcattgggtattttgattggtgtgctggtgggtttttgtgatttctgggcacactcacttctgggaatggg

SEQ ID NO: 19611 - DNA, 449 bp, Gossypium hirsutum
  Clone ID: uC-gsflnu33B094c01b1
ttgttgccttccatttttcattttgctgggcgtcactaatctgtctctcgtttatgctatcaagttcgcccaggtaatgcctgacatacctagcagcctcttttcctaaaaaatccttaccttcatgtaagttcttgttcctgtccatccaaagaacccacataccatagatcactagtcggcgttgtgcttccatacaattattgaaaatccaggacactccacaaagacacgccgaagggtttcagttccagctctacatcttggacatatggcatttggagccactcttctctggtgcagattgaccatcgtgggaatgaaattccacgataccttccatgccagtagctttattttattaggaaagtgcaatgcccacaattgtttgtaaaatggttgggccgtagtctgtgaatcagtaggataagtagtaggaatttgggttt

SEQ ID NO: 19612 - DNA, 297 bp, Gossypium hirsutum
  Clone ID: uC-gsflnu33B094c03b1
gtagaaattgacggagatgaggatttcaaggcacagtttttatgtccattttgcgctgaggatttcgacattgttggactttgttgccatatcgatgaagaacatcctgttgaagccaaaaacggggtgtgcccggtttgtgcgaagagggtcggaatggatattgtcagccacattaccatgcaacatgggaatttttttaaggttcagcgcaagcggagattacgcaagggtgggtccaatttgacattttcaatgtcgagaaaagagctgcgagagggaaattctcaggccctt

SEQ ID NO: 19613 - DNA, 277 bp, Gossypium hirsutum
  unsure (1)..(277): unsure at all n locations
  Clone ID: uC-gsflnu33B094c04b1
cgtccgccaaatcagatgaagaaaaagaagaggcttgagattcaagttcacataaaaatactgatgggattgtgtttttcttaaattgttcaaaaattatctgcttttgtttttgaggttgtatttgttgtatatttcatatttaagtttcttcttttcccagcatttttagtacaaatcataaggaaaaaaaaagtttgctttcggtatgtaagaaatgacatgtttccattcaaaanaaaataatagaatttttcttttgtccattcctttatct

SEQ ID NO: 19614 - DNA, 343 bp, Gossypium hirsutum
  Clone ID: uC-gsflnu33B094c05b1
cctacgcgtccgctcctgagtacgcttttggatcatccgagtcaaagcaggagctggcttcggtaccccctaactcgactgtgtattatgaggttgagatggtgtcatttatcaaggataaagaatcatgggatatgaacaccccggaaaagattgaagccgcaggtaaaaagaaggaagaaggaaatgtattgttcaagtctggaaaatatgcgagagcttctaagagatatgaaaaggcagtaaagtatatcgattatgatttttcctttagcgaaaaggagaaaaagcaagccaaggcattgaaaggttctttgcaatctgaacaatgctgcttgcaagc

SEQ ID NO: 19615 - DNA, 227 bp, Gossypium hirsutum
  Clone ID: uC-gsflnu33B094c09b1
ctgctgaaccctaggtcctcccttctcaagcgcgaaaccttcatcaagaatggcgtctcgcccttctggcttcgacttactgctctttggcctcaaaacccccctttagcttcgatttcgacgaagcaagagtggatcgacggccaaatcgcacggtatagcctctttttctctctttctttgctttctattataacgatgaatggatcgaaggaaaaatgaacccc

SEQ ID NO: 19616 - DNA, 446 bp, Gossypium hirsutum
  Clone ID: uC-gsflnu33B094c11b1
tcgttccacgcgtccgcccacgcgtccgaaaaatggagggtgcaaagcctggatcttgtgaagctcttgttcgcaggttgctcgagcgactggcaagctcaaaggaatcgtctatgaaagatatgcaggaactagcagtccgcttgttcaataagggcaagacaacttctgaagatacacaaactccaaacatggaaatcgacagtaaaagaaaacagcaacttaattcaaattccaacttgagccctctcgcgagatttctactttccaggtggcaaaaccaaacatcgcgcgatctcaacccatcatgaagggaaaaaccagagatggattatatctgtttttgtagtctgtttacagttctgcacttcttttgattttgatgtacataacattgtgagaaattatgtatttttgcatccattatgattaaatcttctattttt

SEQ ID NO: 19617 - DNA, 380 bp, Gossypium hirsutum
  Clone ID: uC-gsflnu33B094d01b1
aaagaaaaaatggttctgctagacaaaatgtgggacgatgtagcagctgggcctcaacctgaacgtggtctcggcaggcttaggaagatcaccacccagcctttgtccatcaaagatgaaggagaaaagaaaaagtaccagaggtcgttgtcgctgccgaatagtccagtgtcaggtccgacacccgtgacaccgacgactccgacggcgcgtaaggagaacgtgtggaggagtgtgttccatccgggtagcaacctagccaccaaaagtatagggtctgatgttttcgacaagccacaacccaactcttctaccgtctatgactggctttacagtggggagacccggagcaagcatcgctgagagggtggcgactgaca

SEQ ID NO: 19618 - DNA, 403 bp, Gossypium hirsutum
  Clone ID: uC-gsflnu33B094d02b1
tttctctttcaatcctgatcgtgcttatgtttttggttatgagccacattccgttttgccgattggagttgttacactcgctggacatacaagtttcatgcctcttcctaaaattaaagtccttgcaagcagcgctgtattccataccccatttttgaggcatatatggacatggttggatgtggcaacagcatcaagaaaaaaattttattccctattggatgccggttatagttgtattgtagtgcctggtggagtgcaggagacatttcacatggaccatgattctgagattgccttccttaaggcaccgaagggggtttgttcgcatagccattgaaatggggtgtccactggtcccagttttcgcctttggtcagtcacgtgtctacgactggtggaa

SEQ ID NO: 19619 - DNA, 172 bp, Gossypium hirsutum
  Clone ID: uC-gsflnu33B094d09b1
tcgtccacgcgtacgcaccatcgagaactcacggggcgatgataaacaactgttgggtttacgccaaggggcgaagtatggagccggaattgggcctggagcctatgataagcacgtcacaagaataccattctccggatacacccatttataggaggcaaccagatgcttg

SEQ ID NO: 19620 - DNA, 329 bp, Gossypium hirsutum
  Clone ID: uC-gsflnu33B094d10b1
tctgtttaaaagcagtttccgaatcttttacgactcgtaaaatagttgaattgactcatggcttccgccgttgcttccgttgcgaagaagaaaactgctggctctaagaagtctaaatcagctccttcacatcctccatttcttgagatgatttcagatgcaatcgtttcgttgaaagagaggacagggtcgagccaatatgcgatcgcgaaattcatcgaagagaagtataagcaattaccggcgaatttccgcaaagtcttacttgttcagacgaagaagtttgttgcttctggaaagcttgtcaaagtaaaagcctcttttaagct

SEQ ID NO: 19621 - DNA, 294 bp, Gossypium hirsutum
  Clone ID: uC-gsflnu33B094d11b1
tcccacgcgtccggagaaatgtagttacttggacaacaatgattaatgggtacctaaaaatgggatatttaattgatggttttggtttgttttcggctatgagaaaagaggaaggagttttggttaattctactactatgactgttttatttgaagtttgtggacattttgatagatgtttatggttgactttcaacttgttttggattgggtttttttatgttcttattttctactctgtttatcctgttttttgggtattgttatctatttttacatctatacgaccatctt

SEQ ID NO: 19622 - DNA, 313 bp, Gossypium hirsutum
  Clone ID: uC-gsflnu33B094e03b1
gcctcctactcgtacggctacacggaatataccggaggagattttttgggagcattgacggtactagaacaaaagggaaagcttgcaatttttaagggaactctgactgatgatgaaggtgacaaagtactctgtgtgataatttatcgaattggctttcaaaggcaaggcaacatttggcctattgatcatcagaactttaatgaccagcagcctgacggtaacctgatatgtgctgaaaaaccaaacctgatggaattttttactcaactattccctggtactagactggtgccattattggcatttttgt

SEQ ID NO: 19623 - DNA, 505 bp, Gossypium hirsutum
  Clone ID: uC-gsflnu33B094e05b1
tgagtagctcgggattccctccccatcgcctcccgtgcagactttgccacgtctttaccaccagaatgtcatcgatcactacaacaatcctcgtaacgtcggttccttcgacaagaacgaccccaacgttggtaccggcctggtcggcgctcctgcttgcggtgatgttatgaagttgcaaatcaaaatcgacgaggattcgggcaaaatcgttgatgcttgctttaaaaccttcggttgtggctcggccattgcctcttcttctgttgctactgaatgggtgaaagggaaaagcatggacgaagtgcttactattaaaaacacggagatcgcgaaacatctatcactttccccagttaagctgcactgcagtatgcttgctgaagatgcaattaaggcagctgtgaaagatgctgaagctaaacgtggcaaaatgaatggtaatttcaaggctgctgatgcctgatgtatgtgggattgctaagggaagaactctggaaacttt

SEQ ID NO: 19624 - DNA, 184 bp, Gossypium hirsutum
  Clone ID: uC-gsflnu33B094e10b1
taccacgcgttcgtacctacacatgtggcggaggaattttttaagaaaaaattccgaaagggccacttacttggtcgctgctggcatgtctagtctcggtatcacttccatggctatcatggctggttattatagatcatcatggcggccggagggaggcgacgtgcccactggtgaaaccctc

SEQ ID NO: 19625 - DNA, 445 bp, Gossypium hirsutum
  unsure (1)..(445): unsure at all n locations
  Clone ID: uC-gsflnu33B094e12b1
tcgtatagggtttctcctcctctctacctccaatgggaaagggaactgggagttttggtaaacgaaggaacaagacccacacgctctgcgtcagatgtggccgccgcagcttccacctccagaagagccgttgctctgcctgtgctttccccgctgcccgtaagaggacatataactggagtgtgaaggctatccgaagaaagacaactggcactggtaggatgaggtatcttcgccacgttccacgcaggttcaagacgggtttcagggaaggtactgaagcagcaccaaggaagaaggttgcagcagcttttgcttaaaaggcaaattgtaatggtatgaggtttttgttttggatgaagccatgtttatgaggaaacatttagtgatgaagagtggaattatgttccatcggatgctntaggtattaagttcctatttgaat

SEQ ID NO: 19626 - DNA, 521 bp, Gossypium hirsutum
  Clone ID: uC-gsflnu33B094f04b1
ttttataaagaagcaaaaaaacatggccaaagttctgttgttcattgctctatgtgtgcttccagctttggttagtgctacacgcattctgaataaccaattggtggttgaaggctatgtgtactgtgatacttgccgtgctggttttgaaacccctaagactagaaggctagctgatgccatggttaagctggtatgctccgacaggaagaccggcggagttgttttcgagaaggagggatataccgacaaaaccggaaaataccagattcgtgtatccgaggatcacttggatcagatctgtgatgcagtttttgtgaagagcccccagcttggatgtgccacaatgtcccccggtccgtgaacgtgcccgtgttattttgaccaacttcaatgggcatttatccaccacccgttatgccaatagcatgggcttcattgttgacaaggctgaagttggctgtgctgagatgatgaagattgtatcgggagattgaggaggtttgttttttctacggttt

SEQ ID NO: 19627 - DNA, 246 bp, Gossypium hirsutum
  Clone ID: uC-gsflnu33B094f05b1
gtgggatcagcaacacatgctttctttggttggagggggacaggctggaatatggagaatcgcccccaataaagcagcaggggggcgggcggcaactgcgactgcgctgaccgcagccaatgcacgaagaagggaaacagcaacaccatgatcggcgagactgagaagagctacatcaacaatgttgagatggatgctccacctgagaaccaaggcgagtgccaatgccggaccgggtggagctgc

SEQ ID NO: 19628 - DNA, 443 bp, Gossypium hirsutum
  Clone ID: uC-gsflnu33B094f06b1
tacataccaactcaggggcgctttgtgatcactttcgaaaaacttcccacattcaccatgtctggcacgtgcggcaactgtgactgcgctgaccgtagccaatgcacgaagaagggaaacagcaacaccatgatcgttgagactgagaagagctacatcaacaatgttgagatggatgctccagctgagaacgatggcaagtgcaattgcggtactggctgcagctgcacagactgcacctgtggccactaagccaacatacaatggtcatgcttcagatcatggcatttatagggatctaaataaatgaatttaaggttgaataatttgtgcctgctggagtttgtgtggtgacttatatctgtcagttaacctttcttttccttaacttgatgtaatggctatgcttatggccttatttggttaatgaaggatccttcctt

SEQ ID NO: 19629 - DNA, 285 bp, Gossypium hirsutum
  Clone ID: uC-gsflnu33B094f09b1
tccacgcgtccgaaaaaaaaaaaaaaaaagggggaaattttaaaaaaaaatgccgtttaaaccacccaaataagattaacgaaaggaaacccaatatctggggggggcccctctaaaaaaacacaactaattctccccgaccacgcagagggtgaagcttttaaatcgggttaccaaaaatcacccaaagggccccctttttacaacattcgcgattgggaaaaaccccgcctaccccaaaataatccacttggaaacaaaccccccctattcccccggtgccta

SEQ ID NO: 19630 - DNA, 89 bp, Gossypium hirsutum
  Clone ID: uC-gsflnu33B094g02b1
taataaataaaaaaaaaaaaaaaaaaaaaaaaaggaggaatattaaaaaaaaaatagcagaaaaaaaaaacaaaaaaaaaaatataggg

SEQ ID NO: 19631 - DNA, 370 bp, Gossypium hirsutum
  Clone ID: uC-gsflnu33B094g04b1
tattgcatacatgctagtatttctggtgatataggtcttgcagcagcttatggacatgagcttcctcactatggacttgaagttggccttacaaattatgcagcagcttattgtgttggactccttttggctcgccgaacactgaagcagctggagatggatgctgaatatgagggcaatgttgaggcaactggggaggactacagtgttgaaccaggagagagcaggaggcctttccgatctctactagatgttggtgttgtcagaacaaccactggtaatcgtgtttttggttgtgttcaagggagcctttggatggaggaaattgaattgcctatagtgcgaagaggtccgttgaatttaactatgt

SEQ ID NO: 19632 - DNA, 491 bp, Gossypium hirsutum
  Clone ID: uC-gsflnu33B094g06b1
tagtttgggtgtgaaacccaatgctaagtcatatgcgttgcttattgatgctcatctcatcaatcgagatcaaaaagctgctctctctatgattgacaagatggtgacctctggatttgtaccatccaaagaaacactaaaaagggtcagaaggcgatgataaagttgaatctctggctaagaaattcaggatcaggatgggctctgaaaatcgcaggggcatcctttttgatcttgactatggcactgaatatgcatcataggcaagttatgcagtcttaaggcttgggactacatgatgcttgaaattatcaagagcgacaattggggttaaccaggttccgatgaagtaatcaacccattttgtatagattttttgtcaattctgagcctttggaggataaatatccgtgttcttagcttgtgatttcccccctctaatatctcaattcttttttttttcaccctttattatgctttctgaggaatag

SEQ ID NO: 19633 - DNA, 440 bp, Gossypium hirsutum
  Clone ID: uC-gsflnu33B094h01b1
ttcttcttcgccagcggcgatgggtatagagtggaggagaattatgggtgtttaatgcttgggtggcatacaaggccacttatcgccacctcgggctgggcgactcgcttgtacttgatcaggtagtgagttaactaaggagctgagttgagaaaaggtaaaaaacctgttgaaaagaataagtgggggcttttttttacctggatttgcaaatggcccagtgaatgaaaaaattgggggtaatttaaaaacccggccccagggggtaatccaggttttctcttggctaattttttccccctttttaaaataggtttttgggcccttttagggggaaattttttttttaatggggggcccctttatatttttaaggggggggttcacttggggggggcttctttttttttaaaaaaaaaaaaaagggggcccgcttttta

SEQ ID NO: 19634 - DNA, 444 bp, Gossypium hirsutum
  Clone ID: uC-gsflnu33B094h06b1
cctatgcgtccggctacgcctactttccactttgaggataccactaacttacactgcctggaatcgttcaccaagcgtaagcgttccaagcgaccgcgtttcgatcatgttaccaccgaggaagaatacctcgctctctgccttatcatgctagcacgcggcggtgatgccaactccaccgacacttctgttatcccacagcgccatcgctctcctactccaaccgcctcaccaccgcctgcaccagcaccagcacctacctcaacagagcaaaaggttagctacaactgcagcgtttgcaacaagtcctttaactcttaccaagctttgggtggtcacaaagccagccaccgtaagctttcaggcggaaacgatgaccagtcaacgtcgacaaccacctctgccactgctggcggagttatttcatctgctttgaacccaagc

SEQ ID NO: 19635 - DNA, 141 bp, Gossypium hirsutum
  Clone ID: uC-gsflnu33B095a01b1
tcgcgaacttttatcttctaattctctatggactgtacaagcgggcgggttgtgtgtaccagcgaataccggccgttctggatagttcaatatcagggaatggaacaagtgtgatgtatagaaggctgttgaatggtaaat

SEQ ID NO: 19636 - DNA, 86 bp, Gossypium hirsutum
  Clone ID: uC-gsflnu33B095a02b1
ccggaccggaaccccaggttcgacccacgccaccccccactctaatttttttaacgaaccacccgaaccttaaagcgagcaggttt

SEQ ID NO: 19637 - DNA, 153 bp, Gossypium hirsutum
  Clone ID: uC-gsflnu33B095a03b1
ggcttgttgcactacttgtcttgcgttgctggctttggggattgcgtactaagctaatatgcgcagagcttcttccatatctgctcacagcacaccaactacattctgatcttatttcttccaggatgactattgcgaggttttactcctcat

SEQ ID NO: 19638 - DNA, 170 bp, Gossypium hirsutum
  Clone ID: uC-gsflnu33B095a05b1
acgcccaaattctcttttgacgaaaatgaaatgactgtccaaatgaggtgttgaaatgcaataattggtgtgtataaaatttcgtttcaatgcatatttgctcaaccgctttttttttaatgaaaaactaaaagctacaaacactcacaacttgcaggaacaataaactc

SEQ ID NO: 19639 - DNA, 137 bp, Gossypium hirsutum
  Clone ID: uC-gsflnu33B095a07b1
tttactcttccgcttagctccatattggttacccgtggggatcatattacaaggtctaaatcccatggagggcggctaagttacaatgaccttaataatgataggttagaccttttattatagcatgttatcagctc

SEQ ID NO: 19640 - DNA, 126 bp, Gossypium hirsutum
  Clone ID: uC-gsflnu33B095a10b1
ctcacgctaccggtttgatttaagttagtgagttgcttaggtttcctatgaagttaagcatggctcaaattaagaggatggagtgccaactcgtgatcaagcccttagctgatatattctttgttg

SEQ ID NO: 19641 - DNA, 380 bp, Gossypium hirsutum
  Clone ID: uC-gsflnu33B095a11b1
ttcgattctctatagcagctttcgtcattccaaatgagggtactataatcaagacacccaaagagtttatagatgaccaacatcctcggcttttcaaggacttagatttcatggagttcttcctttatgccttttccgatcctgcaaggcacatcgacaacggggagttgctccatgtctttgctggcctctcaccaccagtttccaattaaaatcatgctcatatagacaagtaaaagtttggttttggttttaaattaatgttacaaaataataaattgagtcctattctcgagatctacgttctcgaactgtattaccatgtcatattttgctataatcggggtcctactaaatctactatgctgagtaatgttggt

SEQ ID NO: 19642 - DNA, 95 bp, Gossypium hirsutum
  Clone ID: uC-gsflnu33B095a12b1
aacggtgtcttatccactcggattaactctaccacaacgggagcgtggtggttgaaagggggggcaacagccgcatacccacaaggaggctacaa

SEQ ID NO: 19643 - DNA, 447 bp, Gossypium hirsutum
  Clone ID: uC-gsflnu33B095b06b1
cccacgctttcgttccaactgaaggaacagacgatcgtcctcttcccgcaatggcggatgctcaaactgaaaaacccctttccctttccgagcaatatgcacttcaggagaaagaggaaaaatcagatgtgactacaaaaccagcagaagcaaaagaggttgaaaatcctgtaaatgcagccactggttctggggatgttgtaactgagaaattggaggagacttctgccgatccagttgagggaagcactgaggcccctcctcctgctgctgaagaaagcactgaagcaaatcctgctactgggaacagtggtgaagatgctgcagaggaaaactcgggtgactctgaggaaactccagagataaagcttgagactgccccagcggatttccgctttccaactacgaaccaaacaaggcattgcttcacacgatatattgagtacc

SEQ ID NO: 19644 - DNA, 78 bp, Gossypium hirsutum
  Clone ID: uC-gsflnu33B095b07b1
acctccggcgctgctactctgaagaaaggagagtgcttaaagcaggcatatactagtatacaccagcatgggataaca

SEQ ID NO: 19645 - DNA, 421 bp, Gossypium hirsutum
  Clone ID: uC-gsflnu33B095b11b1
tttttcttcaaattgtcacgttccttctcttcgtcttctgagcattatacttgccccttaccatgatgttttccagcctgttagagagaacggcgacctgcttatcgacggccgctctttatatgttgatcaacggaaccatggccaccatcttgctgatctcccggctatggcctcacaaaacgccctacgtggctgacgactacaactcttgatcatcccttaccggcgcactgcaccgacctcctgtcggtcctcagccgtatcaagtcttttaacttctcgacgtacagggttcctgtttacaacccagacatagctgacgactcaacagcctatcggctggagcggaccccgtcggttatgaacgagttgagtcctttaacttttactgttctactttctaacccttaaagggcat

SEQ ID NO: 19646 - DNA, 180 bp, Gossypium hirsutum
  Clone ID: uC-gsflnu33B095c01b1
cccactgctaccttccacgcgtccgttttggatcttcttgaggcacctgatccttgcacccttgagaagttccttgggagaatccccatggtgttcaatgctgtgattctcactccccacggctacttctctcaagacattgttttggggcatcccttcacccgttgccaggctcgtttc

SEQ ID NO: 19647 - DNA, 346 bp, Gossypium hirsutum
  Clone ID: uC-gsflnu33B095c07b1
ttcacgtgtccgcaatccatttacaggacttgccttattaagcacgacagaagaaagaggccaaccagaggtacgaacaccattcatatcttcctcctgtcgacgtatctccaaaccaaactctacaatctcgacgatggctcactctcattctacccaaaacccagtgattgagcagcagagaatgataattccgaacaagcatggtgaaaaactggtgggattattgcatgaaacagagtctaaagagattgtaatcttatgccatggtttcagatccagaaaggattacaatactatgacgaaccttgccgctgctttagaaatagaaggaatcagtgtcttc

SEQ ID NO: 19648 - DNA, 54 bp, Gossypium hirsutum
  Clone ID: uC-gsflnu33B095c12b1
ttttaattttaaaaaaaaaaaaaaaaaaaaaaaaaaaaaaggaaaaattaaaaa

SEQ ID NO: 19649 - DNA, 73 bp, Gossypium hirsutum
  Clone ID: uC-gsflnu33B095d01b1
aaaatatatttttttaaaaaaaaaaaaaaaaaaaaaaagggggaaattttaaaaaaaaatagagggttaaaac

SEQ ID NO: 19650 - DNA, 98 bp, Gossypium hirsutum
  Clone ID: uC-gsflnu33B095d07b1
ctcacgtgtccgcccacgcgtccggtaaaggggggaatatttaaatgattgaagccagtaatccacctaaaatgcctgatagataatataccaaaagt

SEQ ID NO: 19651 - DNA, 465 bp, Gossypium hirsutum
  Clone ID: uC-gsflnu33B095d11b1
tatattatataaaaaaaaaaaaaaaacaaaaaacaggaaagatttaaaaaaacaaaaaaatgggaaaaaaaaaaagagggacccccacagagacagcctcctccttccgcggccgggcattcggataactctctttttggggctgctctgttcgttcccttcgcccgccgtcgtcccccccgtcttgccttttccttccctggcttccccctattgtcgcgcctcggggtatctcctcctctcggcggctgcctctttacccatgtcgtccccccctcggttgccctttcccccctttgcccttatctggtgattcaacgagccccccctttctcccccctttctcccttgcctctgggcgtgctccctctctagcgccccccctcctctggtctcttcttttcggcccgtccttggccctccccttctctccctctgtccccttctgtcctcggctttctcccg

SEQ ID NO: 19652 - DNA, 296 bp, Gossypium hirsutum
  Clone ID: uC-gsflnu33B095d12b1
gtttgttttcccctgcttttttatctttgatagaaaaaaaaaagagaaagaaaaagtaggaatcagtcactttgggaaaaagaaagactgaaacagaggtatcgaaatatgcagagtaagaagcaagcattgtattgtaaatctttaaatgattgttttattgggtggtgaaagtagagatactatactttcaaaaatcacctaaaattgtaccaaatttcattatcattataataaccttattcatttatatatcattcctaataaattctctaatattatctttttacctcttt

SEQ ID NO: 19653 - DNA, 122 bp, Gossypium hirsutum
  Clone ID: uC-gsflnu33B095e02b1
cccacgctgttatagacttctatgtggtaacttctttgattcacttcgaatgagccttggaattgcataagaatggatttacatcattaagagagatcgacaggctttcttttcttgccatg

SEQ ID NO: 19654 - DNA, 70 bp, Gossypium hirsutum
  Clone ID: uC-gsflnu33B095e06b1
cccacgctaccttccacgcgtccgaaaaaaaaaaaaaaaaaaaaaaaaaaaaaaaaaaaaaaaaaaaata

SEQ ID NO: 19655 - DNA, 241 bp, Gossypium hirsutum
  Clone ID: uC-gsflnu33B095e08b1
ctcgcttgtccgaaagaacaacggagccatcgaacgaaccatttccatggccatgttctcagtctggttctcaatgagcgagccaaacactgatgaccatcctgatgacgagattgctcacatgaatgcgaccgagcggacgaatgatcaagccactgatgaaacctgtgcccagaggtggacccaggaatgacacatgggatgacagcagctgtagcaacttatctttattatatctatt

SEQ ID NO: 19656 - DNA, 314 bp, Gossypium hirsutum
  Clone ID: uC-gsflnu33B095f04b1
cccacgcttccttacgtgcactctctggcatgtctccacgaacttctatctttttcttctcttttgccaccatcaaaacagtcgatgaccattgcggattgatgcttcctggaaacccctttcatattttctttagaaacaattctgcatatcatgatattcaccatcagctttatgggaccaaatacaatttctcgcaaccgttcttcgtcatgtgggatagaattctgggaacgtacatgccttattcactcgagaagagagcagaagggggcttttaagcacggccaacgaaagagttcaaagacgattaa

SEQ ID NO: 19657 - DNA, 303 bp, Gossypium hirsutum
  Clone ID: uC-gsflnu33B095f05b1
cccacgctatctttcggagagactattgaccctgacaggagtgtatggattctggaagcatgtttccaaccttgaacgccgtgagagtcgtcgttaccttgagatgttttatgctcttaagtaccgtaagctggctgaatcagttccattggcagaggagtaaattgaagctgttaaataacattgggccggtttttcttggtgaataatattctgttttgtaattataattggagaagctcctttgtttttaatatttgcttttcctttttcttttttcgcctgcatctttttgaacatttt

SEQ ID NO: 19658 - DNA, 241 bp, Gossypium hirsutum
  Clone ID: uC-gsflnu33B095f06b1
cccactgctacctctccacgcgtccgcccacgcgtccgcttttctctgcatttttttgtttctcttacctatcaattgtcccttttttgcttgtaatttatcttcatggttgccatggtttctgcatatttcttcgtgtttctagctctatttggcatggttgcatctgaccctgatcatctacaggatctttgtgtagctaacaaagcttcattgaataaaggcgaattgattcccctgc

SEQ ID NO: 19659 - DNA, 405 bp, Gossypium hirsutum
  Clone ID: uC-gsflnu33B095f09b1
tttttatataaaaaaaaaaaaaaaaaaaaaaaaaggaagatttaattaaaaaaaaaaggggtggacgatttaggggatcctggtggcccttcgcgtgcttgcccgttatagcttttctatggtgttccttaggttccttttcactggctcgtcttttccattgtttcggcctgggatatccttggcgttccctgtcttttccggccttgttgtccctcccccttccgtcctctgtcattttatttttctctcttctactttcctcctctctccgccttctttctcttttttttttttttttttttctcctctctctccttctttttctctttcacttttctgttctcttttcctctgatttcctttctctttttgttttccccctttctcttcttttcttccctc

SEQ ID NO: 19660 - DNA, 54 bp, Gossypium hirsutum
  Clone ID: uC-gsflnu33B095f11b1
tttcagcttgactcgttcacttgtccaacactttagtgcccgttctttttcgtt

SEQ ID NO: 19661 - DNA, 311 bp, Gossypium hirsutum
  Clone ID: uC-gsflnu33B095g06b1
ggaagattatattgcgtttgtctcagatctcagaagatggcccggaccaagctaaaccgcccgtaagtctactggtgggaaggctccaaggaagcaacttgctaccaaggctgcccgtaaatctgccccaaccaccgttggtgcgaagaagcctaatagataccgttctgcaactgtagctcttcgtgtaattacgaaattccaaaatgaggctgtggctttttatcacgaaagagccttttcagtggttttgatagtgatattgcccaggacttcacgactgatatgctgttccagagccatgctgtaat

SEQ ID NO: 19662 - DNA, 209 bp, Gossypium hirsutum
  Clone ID: uC-gsflnu33B095g07b1
atattatatttgatagagaaaacttaaaaagagggggagggtttgactaaaaggtggggtgataaactttatgatacacaggaatgcgggtgcaagcatgtatttatagtacttaccctgtgtgtctatctctgggtgtcttttggcttctctgggctttgttttttcatcttctttggttttggttctgtgcttggccttgtttttct

SEQ ID NO: 19663 - DNA, 123 bp, Gossypium hirsutum
  Clone ID: uC-gsflnu33B095g10b1
gctaccataaaaaggttctttgtttttcttcaaacatttttgggtcgttgaacttctctgttccctatttaacacagattaattagttccctttcgtagtcgctatattaacttctattaaat

SEQ ID NO: 19664 - DNA, 446 bp, Gossypium hirsutum
  Clone ID: uC-gsflnu33B095g12b1
tttacgtttccgcccacgcgtccggacaaagatcgccatggcacctcctgcaaaagcaataactagtcccgtgcctgatgcgtggtatccaaccctagccgtcttcatgctcgccattggtcttgtcctcactgcttccttcttcatctacgaagcaacttcttccaaacgaaatcgcagtcttgcaaaggagctcacaactgggggagtggcatctgtcttcctgggattcgggtcactgtttttgctactatcagccggcgtttatgtctgattttcatatattttttcaaccattttaaaaatttgctgagcagaatggtgttgaatggaggatcatggcttcgaccttgttacctatagactttttcttttttgttattaatcagattaagagtgcttctatgagaatattttgatatctcttggggtttcttggtgcctgc

SEQ ID NO: 19665 - DNA, 228 bp, Gossypium hirsutum
  Clone ID: uC-gsflnu33B095h03b1
caaatttccaattgatctgtttcatttttcagcaaagctggaaaaacaatgactaaggatatcgagactgcagagcaacatggaggggagttctcggccaaggactaccatgatccaccacctgctccattgattgatgctgaagagttaaccaaatggtcggtttacagggcagtgattgccgagttcattgctacacttctcttcctgtatgacactgcgtttgcc

SEQ ID NO: 19666 - DNA, 283 bp, Gossypium hirsutum
  Clone ID: uC-gsflnu33B095h05b1
cccactctactttccacgcgtccggttacccaaatttaaggatggattcacaaattaagtttgctgtggtggtgaaaattatgggaaggacgggatcgagaggtcaggtgactcaagtgagagtcaagtttttggatgatcagaaccgttttattatgaggaacgtgaagggaccggttagggagggagatattctcaccttgctcgagtctgaaagggaagctaggatgcttctttgataactttctttaatctccggtttgttacgtttttaacggatgag

SEQ ID NO: 19667 - DNA, 318 bp, Gossypium hirsutum
  Clone ID: uC-gsflnu33B095h09b1
ttcacttgttcgcccacgcgtccgggcttttacctgcaaatataagtgggaggttctcaacgctgccgatcgacatcatgtgaccttgctcggtctcgactaccgatcttcaccacctgctccattgattgattcttaagagttaaccaaatggtcgttttacagggcagtgattgccgagttcattgctacacttctcttcctgtatgtcactgtgttgaccgtgattggttacaaggtccaaaccgaccctgcttagaacactgttgacccctattgcgggggcgttggtattcttggtattacttgggcctttct

SEQ ID NO: 19668 - DNA, 193 bp, Gossypium hirsutum
  Clone ID: uC-gsflnu33B095h12b1
tgtaagtttaacggcagctctctaagcgtattttcaaggggtgaacaagggcttgcggtggtctgaggacgaggacgaatgatgatggcaacagggactgcactatttaaccctatccttataaatgccaccaatgttattatggaatttaattttactgtattttattactaagatgttatttacagtactc

SEQ ID NO: 19669 - DNA, 324 bp, Gossypium hirsutum
  Clone ID: uC-gsflnu33B097a01b1
tttataaaaaaaaaaaaaaaaaaaaaaaaaagggggggattatattaaaaaaaaggggacaaaaaaaaaaaaaaaaaaaggggggccacccttacggggcgccccttctagaggccccaagcttccgtccccgggcttgcgacgttttacctcttcttttggggcccccacttgccattcaccgggccggctttttccaaccccgggcctggcaaacccatgggttatcccatctaattcgcctttggacagatccccttttcgcctgtgggcgtaatcccaaaagggtcccccccgttggcccttcccaactgttgaccggcc

SEQ ID NO: 19670 - DNA, 293 bp, Gossypium hirsutum
  Clone ID: uC-gsflnu33B097a05b1
ttgatccaggaaaccaaaccaaactagtgagccggagcttctcttcttctgtatcccaaaatggttgcttttaggtttcatcaataccaagtggtgggcagaggtcttcctacagacgcagatgagcatcccaagatttaccgtatgaagctttgggccactaacgaagtccgtgccaaatccaagttttggtatttttcgaggaagctgaagaaggtgaagaatagcactggacaagctttggccatcacctgagatctttgcgaaaaaccctaccctagatccataaccct

SEQ ID NO: 19671 - DNA, 188 bp, Gossypium hirsutum
  Clone ID: uC-gsflnu33B097a09b1
ctcgtctcacgcgtccgcccacgcgtccggcaaggcggtgctcgtgtcattgttactgagattgatcccatctgtgcccttcaggctctcatggaaggacttcaggttctgaccctagtagatgttgtcttcgaggctgatatctttgtcaccacaaccgtttacaaggacatcattatggtttgatc

SEQ ID NO: 19672 - DNA, 484 bp, Gossypium hirsutum
  Clone ID: uC-gsflnu33B097a12b1
tcttttttttaccttttacatctgttcatgtgcagtgtcaggttattgtccggccgattagagcctcagtgtcggggaaaccatccgtatcagagccgcccgtgacgacgctttccgaaaagcttccgctgaagaaaatcccagggaattatgggattccttttgttggtccaatcaaagaccgacttgactatttctacaaccaaggtcgagatgaatttttcaagtcaaaaatccagaaataccagtcaacggtgtttcggactaacatgccaccgggtcctttcatctctcccgacccaaaggtaatcgccttactcgacggtaagagtttccctgttcttttcgatgtgttcaagattgaaaaaaaagacgttttcaccggtacttacatgcccttaaacgacctcaccgggggcttccggatcctgtcttatctcgaccctttcgagccaaacacgccaaagctaaacaactatttttt

SEQ ID NO: 19673 - DNA, 95 bp, Gossypium hirsutum
  Clone ID: uC-gsflnu33B097b01b1
gccggaccgacccagtgcgtccctcacgcgatcgaccttactactgacgagcggaaggtttataatgccgttggcttcaccacgaaccaacaagc

SEQ ID NO: 19674 - DNA, 135 bp, Gossypium hirsutum
  Clone ID: uC-gsflnu33B097b02b1
cggaatgtacccgggtgcgacccacgcagtccgctccatgcgaaacgaccacgcagtgcggggacaggggggggctctacttcaaacgccgaggctaatccccgctccggactcgcacccgtaaccaaaattatc

SEQ ID NO: 19675 - DNA, 66 bp, Gossypium hirsutum
  Clone ID: uC-gsflnu33B097b06b1
atacgctaattaatggcaatacaattgcgaatcgggggggggggttttttaaaaaacggggggggc

SEQ ID NO: 19676 - DNA, 198 bp, Gossypium hirsutum
  Clone ID: uC-gsflnu33B097b12b1
tcgtccacgcgtccgccgagttgcagttagacatggatttctttaggaatggattaataaaaaaaagttaaagcttttgctttttaaccttccttcaaaaaaaaaaaaaaaaaaaaaaaaaaaaaaaaaaaaaaaaaaaaaaaaataaaaaaaaaaaaaaaggacccccaaaataaaaaataaaaaactcttgtcccc

SEQ ID NO: 19677 - DNA, 60 bp, Gossypium hirsutum
  Clone ID: uC-gsflnu33B097c02b1
tcttttaaaaaaaaaaaaaaaaaaaaaaaaagggagaatttattaaaaaaaagggctgaa

SEQ ID NO: 19678 - DNA, 94 bp, Gossypium hirsutum
  Clone ID: uC-gsflnu33B097c05b1
ctcactcgtccgcccacgcgtccgggaactcataactcctcaaaagtcttcttcaatggcagctcgagttcttgttttggcttcaattcttatt

SEQ ID NO: 19679 - DNA, 293 bp, Gossypium hirsutum
  Clone ID: uC-gsflnu33B097c08b1
ctttgactgcttccctactcatcttgttatccggcatagttgccgatggatcatttaatccgaagagcagaccgtacacgaacaaccgcaccttactcctgatcttcaaagactttctttttcctctcttcgcatctcaatcaaaccaagaacccacaaaaagcttcagatacaagcaattcaatggttcgatggaaaccagctggctgaggcggatgagtttgaggacaagatgaaggagctggaaggcatttgcaacccaattattgccaagatgcaccagggcgctggtg

SEQ ID NO: 19680 - DNA, 172 bp, Gossypium hirsutum
  Clone ID: uC-gsflnu33B097c10b1
tcctaaaaaataaaaaacaaaaagagaaaagagggatattttaaaaaaaacgggggttaaaaaaaaaaaaaaaatataaaaaaaaaaaaataataacaaaaaacaaacaaaaaaaataaaaaacaaaacaaacaaaaaccaaaaaacaataataaataaaactaacaacaat

SEQ ID NO: 19681 - DNA, 90 bp, Gossypium hirsutum
  Clone ID: uC-gsflnu33B097c12b1
ccctcctctgctttccttcaatccaatccaatccaggccaggttagggctaaggcacgagggagcgaaaatggtcgagaaaccaagatgt

SEQ ID NO: 19682 - DNA, 479 bp, Gossypium hirsutum
  Clone ID: uC-gsflnu33B097d03b1
tttttataaaaaaaaaaaaaaaaaaaaaaaaagagagagttatttaaaaaaaggggcggttaatatagaggaacacaggatccgttacgggtggatgcaacttttttcctcttgtctagtgccaccttaattctttgttctggccgctgttttgcgtcgttttggctggggtaaccggggtggtgccgaccttttttgctttggctcacattctcctttcgccagctggtcgttcttgtgttgggggcctgtctgtttgtctttcccgtccgtttgtttgcctgtttgggttttgggcccctccttttatcggccgttttcgtcctggtggttgatgtgtttacctcgccgggttcctggtttctttgggtggggtgttgttttctgtttttctttttcttttcccttccttttttgtgtctttccccttttttttcctccctttcttttttcttctgttgttccttttttgttcccgt

SEQ ID NO: 19683 - DNA, 146 bp, Gossypium hirsutum
  Clone ID: uC-gsflnu33B097d08b1
tcgtgatgacattccaaaagaaattccagatcctgatgctatgaagcctgaagatcgtgatgacgaagaagatggttattttttcatctttcccttcttcccattttttttttcctttttctcctttcctttcctatcaattattc

SEQ ID NO: 19684 - DNA, 472 bp, Gossypium hirsutum
  Clone ID: uC-gsflnu33B097d12b1
tctgttcctatactcaacttcttccacttaaaagcgggttagctagctagggttttgtgagccagagagatgggttcaaaaagaacggcatcactagccctcttctttgcactcaacatcctcttcttttccctggtgagtgcttgtggttcctgcccttcccccaaccccaaacctaaacctaaaccaaagccaaaccccactccctccccatcttcttctggcaagtgccctagagatgctcttaaactcggtgtatgtgctgatttgctcggtggcttgctcaacgtcaccattggtacgcctcctgttcaaccctgctgctctctcatccaaggtcttgctgatcttgaagctgccgtttgcctttgcacggcaatcaagcttatattttgggcattaaccttaatgtcccctttcccctaacttgtttcttatggctggtcaaagaaagtcccctctggcttccaat

SEQ ID NO: 19685 - DNA, 95 bp, Gossypium hirsutum
  Clone ID: uC-gsflnu33B097e04b1
cctgcttaagaaaacatttccttagagcataaaagaaatgttacgaacatgccgggtgtcaatcctgaaattgagttcccagccattgtgctccg

SEQ ID NO: 19686 - DNA, 82 bp, Gossypium hirsutum
  Clone ID: uC-gsflnu33B097e06b1
ccacactctcatttttatgcaacaatatccaagcatgtgggggggttatctatacatgcctgtcggatcccacaacatttac

SEQ ID NO: 19687 - DNA, 352 bp, Gossypium hirsutum
  Clone ID: uC-gsflnu33B097e12b1
tctctgatccgacaatagccatgcatgtggtaccaatatttagacaggtgtctcagattgtggatcatttacaaagcatgtccacgacatctgcctcagaaaccggcagcatccggattcttaagtttgtcataaacagtgtgttgaactgtaaatgatttttgtgctaatttttgcaagattttcccttttttccccctttacatatataaatctaggaacatacggtgaaaaaggtggatatttcgtaaattcagttgtatgtttcaatgtgtgaaatagttgagtttatttgtttatcaattttcaaaattaattaaccatttcaattccattaatcttttacatttct

SEQ ID NO: 19688 - DNA, 151 bp, Gossypium hirsutum
  Clone ID: uC-gsflnu33B097f01b1
aaatggctctctgagagtggcaaattggttgcgaagcttttcaaaaaaattcacgaaatgacagaagaagaaaacaatctagcatttgtcctaatctgatgaaccagaaccacgacaagtgaggtactccaccctgaccagcagagatcga

SEQ ID NO: 19689 - DNA, 183 bp, Gossypium hirsutum
  Clone ID: uC-gsflnu33B097f05b1
gctaaccgctttcattctccttagcgccgcattgggtcctatgctccaattcaccgcctaccatgccttcacacaagactttcatgatcaagaagaagtcggccaagaagatgaggcagaataggcccatcccttactggatccgtatgcgcactgataacaccatcaggttcattgcgacgc

SEQ ID NO: 19690 - DNA, 241 bp, Gossypium hirsutum
  Clone ID: uC-gsflnu33B097f08b1
gttctaaaaaaaaaaaaaaaaaaaaaaagagaaggatttattaaaaaaaaccggcaaaccaaccccaaaaaaaaaaccagcctcgggggggcccccttgaggccccaggcttcccccgcccgctgccacgccataacttcccttcgggccacccaacccaaccccctgccccctgttctccaccccctcgcctggctcacccccggctttccccaccccaaccgccctgcatcaattcccc

SEQ ID NO: 19691 - DNA, 177 bp, Gossypium hirsutum
  Clone ID: uC-gsflnu33B097f09b1
tcgtccacgcgtccgtgttaatcaggagcgagagaaagttgaacagttgctacttgaatcaactacaagttatcccatcatttgtgacaacctcaaaaagatatatccagcaagggatggaaatcctgcaaaaattgctgtgagaggattgtctcttgctttgcctagaggggagtg

SEQ ID NO: 19692 - DNA, 191 bp, Gossypium hirsutum
  Clone ID: uC-gsflnu33B097f12b1
tcgtctgatatagtatgttcatcatggatggattggttccatggtggtttacagtcccagattgagcaccatttgtttccaaggtttccatggtgccatctcaggaaaagttccccattcgttcatgatttgcctaagatacacatcttacattacaatccctttccttttcgaaaggctaatgctctttt

SEQ ID NO: 19693 - DNA, 78 bp, Gossypium hirsutum
  Clone ID: uC-gsflnu33B097g08b1
ccctcccacacgtccggagaaaatgaagggagtgcaggctctatataaaggcaacggccatgaccaccgccacaccta

SEQ ID NO: 19694 - DNA, 384 bp, Gossypium hirsutum
  Clone ID: uC-gsflnu33B097g09b1
tcgtgggtttgaaaaaaatgcagatcttcgtgaaaaccctaacagggaagaccataaccctagaggtcgaatccagcgatactatcgacaatgttaaggccaagatccaggacaaggaaggtattccaccggaccagcagagattgatcttcgctggaaagcagctcgaagatggccgtactcttgctgactacaatattcagaaagaatcaaccttgcatctggttctgagacttcgtggtggcattatcgagccttctttgatggcattggctaggaaatacaaccaggataagatgatctgccgcaagtgttatgctcgtctgcacccccgtgccgtgaactgcaggaaaaagaagtgtggacacagctatcagttgaggc

SEQ ID NO: 19695 - DNA, 82 bp, Gossypium hirsutum
  Clone ID: uC-gsflnu33B097h04b1
cctactcccactgtccctgttactatccaggggactcttattcaaggtaacggtcttgcacaatagcggggaaagaagaccc

SEQ ID NO: 19696 - DNA, 198 bp, Gossypium hirsutum
  Clone ID: uC-gsflnu33B097h11b1
ctcgtccacgcgtccggaaagtttggattggtggaggccgattattactggtacagggtttgtgaaggagagactgaatctgttgttcaaaggccatggcatctgttatggaaatcaaggaggttgatggatatagtgttggcgattgcgtcaaagttgaactgggattatgactctgttcacattgtgagaggggag

SEQ ID NO: 19697 - DNA, 378 bp, Gossypium hirsutum
  Clone ID: uC-gsflnu33B098a10b1
taattctgatcgacccacgcgactaccagcgatcgtttttactacacggacgggatttatagagatatgtagtaatctatgagtaaatgaagttatagatatatttattttttatattttaatattttttttttaatttttatattatttttttttttattattattttattttttttatttttttatttttatttatttattttttattttattattctcatttatttataaatttttttatttttttatttttaattttttttaattttatattataatatttttttttttttctattttttttttaatttttttattatattattatattatttttttttatttctaatttttatctattttttttattattttt

SEQ ID NO: 19698 - DNA, 84 bp, Gossypium hirsutum
  Clone ID: uC-gsflnu33B098a12b1
atctctcacgcgtccggttgttttcgatgaacatacgagagaggtggtttatggtgacaaatcagttacagagaatactagtgc

SEQ ID NO: 19699 - DNA, 275 bp, Gossypium hirsutum
  Clone ID: uC-gsflnu33B098b01b1
actaatgacccatgattccattggtcttggggaagatggatcaactcaccagccaattgagcacttggcaagcttccgtgcaatgcctaatgttttgatgctccgtccagctgatggaaatgaaacggctggagcatacaaggttgctgtcctcaagaggatgacacccttaatttattgtctttactagacaaaagttacttttatttgctggatctcctttgtgggtgctttttaaggtcttttctttcttttaatctattttattttttttt

SEQ ID NO: 19700 - DNA, 74 bp, Gossypium hirsutum
  Clone ID: uC-gsflnu33B098b05b1
ctcctcgtccggttttaagtaaaaaaaaaaagggggtttttatgaaaagaatatcgaggggcccccgcacaaga

SEQ ID NO: 19701 - DNA, 218 bp, Gossypium hirsutum
  Clone ID: uC-gsflnu33B098b10b1
acctgacgatccggccaaggaagctgccaacttcacctcttaggttatcatcatgaaccaccctggccaaattggaaatggttatgccccagtcctcgactgccacaccttttacattgctgtcaaattttccgaactgttgaccaagattgacagacgatctggcatggaactcgtgaaggaacccaagttcttgaagaacggtgatgcaggtatgg

SEQ ID NO: 19702 - DNA, 69 bp, Gossypium hirsutum
  Clone ID: uC-gsflnu33B098c01b1
cgtactcgtgggtcgatctgggacttcgggccggcatctggttgttattctagggaaagggggagaaag

SEQ ID NO: 19703 - DNA, 147 bp, Gossypium hirsutum
  Clone ID: uC-gsflnu33B098d03b1
gttacacactgtgctgatctccacccagcatgatgagactgtcacaaaggatgaaggtgctgctgaccataaagagcatgttatcaagccctgcattcctgagaagaatccttgatgggaagacaattactacaccttaacctatat

SEQ ID NO: 19704 - DNA, 81 bp, Gossypium hirsutum
  Clone ID: uC-gsflnu33B098d04b1
ccctcgcgtccggcgaaattgaaataccactacttttaacgttattttacttattccgcgaatcggaggcggcgcacggcc

SEQ ID NO: 19705 - DNA, 95 bp, Gossypium hirsutum
  Clone ID: uC-gsflnu33B098d05b1
gtccttctgcacctcagcagcctgattccatgattcacaacatagttttctggaccaacggtttcaccggggatgatggccctttgaggaggatg

SEQ ID NO: 19706 - DNA, 170 bp, Gossypium hirsutum
  Clone ID: uC-gsflnu33B098d06b1
gtccttggcatctattattcagatgataagttgcttcaaactagaatcttctcctattctgacactcaaaggcaccgtcttggaccaaattatctgcagcttccagctaatgctcccaaatgtgctcatcacaataatcaccatgaaggttttatgaattttatgcatag

SEQ ID NO: 19707 - DNA, 92 bp, Gossypium hirsutum
  Clone ID: uC-gsflnu33B098d07b1
tacacacatgcgggcactatcatcttggactgggatgcatttatataatttaactcttgccaccacaaaacaaaaaaacagataaattacta

SEQ ID NO: 19708 - DNA, 108 bp, Gossypium hirsutum
  Clone ID: uC-gsflnu33B098d08b1
tactaaaaaaggagataacaatggcttgtcctacaacttacaaagtggtataaaggtgagcttatgaatggttctgatgactgacttgcgagcttgatgtattcgaat

SEQ ID NO: 19709 - DNA, 93 bp, Gossypium hirsutum
  Clone ID: uC-gsflnu33B098e12b1
cctctacgcgccgaaaaaaatgcaaaaaggagaatttatataaaggcactaaaaaaaagaaattaacaaagggggtgccctcttgaggtccag

SEQ ID NO: 19710 - DNA, 200 bp, Gossypium hirsutum
  Clone ID: uC-gsflnu33B098f03b1
cctgacaaagcttcatattatcttttttagttccgacattagaaaacgaaaaaaaagaagaagaaatacaatcgttttctttttgaagtcgggttttagtttttcgccaccttaggcgtcttgtgtctcttccatctctgttcacctgtttactccttcttctatgcctccagtttatctcttcactatgcctccatcct

SEQ ID NO: 19711 - DNA, 98 bp, Gossypium hirsutum
  Clone ID: uC-gsflnu33B098g04b1
caccggtccggactaaccggcgggacccacgcggccgcataatttcacttaacgcggaccaagcaatgcggaaagacttcgatgcctttcccggtagt

SEQ ID NO: 19712 - DNA, 71 bp, Gossypium hirsutum
  Clone ID: uC-gsflnu33B098g05b1
cctactcgtccgaaaaaaaaaaaaaaaaaaagagaaaattttataaaaaaaattccaaaaaaaaaacaaaa

SEQ ID NO: 19713 - DNA, 165 bp, Gossypium hirsutum
  Clone ID: uC-gsflnu33B098g08b1
tgcacattaccgtaatttgcatattagtaaccatgaattcaattacttggcatctctagaggatacatggctccagaatacgctgttcgtggcatgttgactcaaaaggctgacgtttatagtttcggtgttctcgctactgaaatttcttgcgggaagaggaac

SEQ ID NO: 19714 - DNA, 148 bp, Gossypium hirsutum
  unsure (1)..(148): unsure at all n locations
  Clone ID: uC-gsflnu33B098g09b1
taanggtcgaagagaggaagacacttggaagcacaaaatgcatgaacaacgatggattgaaatgtgccatagatcatattttggatgcttaacagtagggggaaattaatgaggacatctttttttatattgtcgagaattttattgt

SEQ ID NO: 19715 - DNA, 115 bp, Gossypium hirsutum
  Clone ID: uC-gsflnu33B098h02b1
gaataggggaggggacaacaaatccacaaccggggggacttttgaggacgaaacgcccaaaacaccacccacaaaaggcccgggtaaacaaccaagaacactaaaaaacacaaca

SEQ ID NO: 19716 - DNA, 70 bp, Gossypium hirsutum
  Clone ID: uC-gsflnu33B098h07b1
cttcgtgaaacggcggacgacgatcataaaatcgagggcaaggtttgatgccggcgcatccaaaacccaa

SEQ ID NO: 19717 - DNA, 172 bp, Gossypium hirsutum
  Clone ID: uC-gsflnu33B098h09b1
tcggtcatcctaagtatctggagaaaaacgaggatgatattgttacccgtgtcgatggagctgataaagcagctgaaactgtcaagagattactggaagatatggttcaaagataaacggaactaaacttgatccgcatgcaccataggatataaatattgttcacctgcat

SEQ ID NO: 19718 - DNA, 78 bp, Gossypium hirsutum
  Clone ID: uC-gsflnu33B099a04b1
gtaactcgaagttcattggctgttttctggtgtttcttgctattttaggcattgcctcgcttaatggggcacaaggag

SEQ ID NO: 19719 - DNA, 515 bp, Gossypium hirsutum
  Clone ID: uC-gsflnu33B099a09b1
ttcttcacgcgtccgctcttatccacaagtcaggcaatagagggtttcattcaactggagtgaagaggatgggaggagggcatgggcatgatgaaccatattacctccatgctaagcatatgtacaacttggataggatgaaaaatcagaagctgacaatgtcgcttggagttttgacagccttcagcattggcgtgtttgttcccatctatgctggcattttccagcagaaaaagactgcatctggttgattttttatgcttgcctccatggcggtatggctgcctgcaataacggaagcaactgcctctgggatcttcagcttttgagccgatgtaggttgatgagtatgacgatacttgcaggattttagtatttctgatggcgcttacctgttgattattatgggaatctgttaattggtcatgaatttatcaacaaggcttctgattttgcaaaaaaaaaaaaatgggtgtctcgtcataagatccagcttacgttccctcttttgctac

SEQ ID NO: 19720 - DNA, 313 bp, Gossypium hirsutum
  Clone ID: uC-gsflnu33B099a12b1
ttttacgcgtgggcgcgagggccgccctttttttttttttttttttgtaaagctagctgcaatggggtttttggcagttgcagtggcatgtattttaggttattaagagtctgctaatgaatggaagtgcttgagttcataagaatttgtgatcttctccatgctgggcagcttgttttttttcttgctgaacaaacggtgaaatttgctagtgtctataaaaaaggttgatagcttttgtattttgggccgaacaaatggtatttatggtggtgctttcttcaattcctgattcctggaagagaagagcttt

SEQ ID NO: 19721 - DNA, 269 bp, Gossypium hirsutum
  Clone ID: uC-gsflnu33B099b03b1
tttattttcattcaccgcttaatggctcgttcactttgccaaaccgcaatcaagctacgacccttcaccaaaccttgcacattatcctctcgtctcgtttcgttgcgaacccaatcgagccaacccaatcatttcgatcagttcgatgctttttccgagtcttccttcgatccgtctcttgcgaatactagttgatgccatacattggatctttgtctgccatatttttcttctttttttacttctattactttcactcttcctccatc

SEQ ID NO: 19722 - DNA, 94 bp, Gossypium hirsutum
  Clone ID: uC-gsflnu33B099b07b1
ttgtgtacgcgtggggtgccaggaccaaccaagcacctgtagattacagtgaggccatcttttatccacaagttttattcaaggatccacttta

SEQ ID NO: 19723 - DNA, 185 bp, Gossypium hirsutum
  Clone ID: uC-gsflnu33B099b09b1
ttcgtataaagacaggaaaagaatgaaaaaaaagagggaaaaaatgaaaaaaaaacaccccaaaaaaccatcaaaagagcaagattaaaatctttctctgcgttttaccaagcttcgcagaatcgatccctcctaaccaacttattgggggggcgcttgctctcggggttcatgttccctcccct

SEQ ID NO: 19724 - DNA, 147 bp, Gossypium hirsutum
  Clone ID: uC-gsflnu33B099c02b1
ttctttgtctgttaatacactgtttaattcttattttatcaacttttaatattatttattctattcatatactattttattatttttttatatcataaaattactttatttttacaaatatttacttcatacacatttattacttat

SEQ ID NO: 19725 - DNA, 333 bp, Gossypium hirsutum
  Clone ID: uC-gsflnu33B099c04b1
tttactcgtgggctgtttggtccttttccaagggtgagtgtcatctgttaacattcactctattaccctacccaatgatatttataactttagtacttgaatttctttaaccgaccatccaatgcttgtgccatacaaatattcttttaacttctaagacatactacctcgctgagtatggtccgaggtggaaaactgctttcttaacctgcaaaacctccccatccttggtggcaaagccctttaggaatggctccaagtccgggctgttgagctaggccacatgctcttggccatgtgggagtctagccgaaagggcgagccagtggtggt

SEQ ID NO: 19726 - DNA, 152 bp, Gossypium hirsutum
  Clone ID: uC-gsflnu33B099c09b1
tcgatgagctctcatatggacattgataaaactgatgagaagtaatttgagaaaatcctatcatacatcgagcatgtctaatgtgaaggcgctactttactattaggtggtaaccttatagctcactaaggcatatttcacactttcttctt

SEQ ID NO: 19727 - DNA, 361 bp, Gossypium hirsutum
  Clone ID: uC-gsflnu33B099c12b1
ttgctctcttgttctcccccctcctctgtctttctggcaacatgggttcaccaccactttggattctgcttctgggtgtgttgtttatggcttctggaacaatcgcagctccccctaggaagcctgtagatgtcccattctccagaaactatatgcctacttgggcttttgatcacattaagtatttcaatggtggctctgagattcagctccaccttgacaaatacactggtactggtttccagtccaaaggatcatacttgttcggacacttcagtatgcaaataaagctagtccctggagattctgcggggactgtcactgccttttatttgtcttctcaaaactcagagcatgatga

SEQ ID NO: 19728 - DNA, 72 bp, Gossypium hirsutum
  Clone ID: uC-gsflnu33B099d03b1
tcattcgtccgcgataatctatttctttctgtactctgatgaatgctatatttcgctgggggctaaaccctt

SEQ ID NO: 19729 - DNA, 106 bp, Gossypium hirsutum
  Clone ID: uC-gsflnu33B099d04b1
ctcatgttatcacaaccagtttccaatggcacccaatgtcttgatgaagccagccgagaataagccagccgaggtgaatatagtctagaaagtcccagctgaaaaa

SEQ ID NO: 19730 - DNA, 96 bp, Gossypium hirsutum
  Clone ID: uC-gsflnu33B099d11b1
ctcgttagaaagggatctacagtcttcataattatttgcaggtaaaggcagttgttactcttttgaagaatccagcatggttgttttatttacatt

SEQ ID NO: 19731 - DNA, 219 bp, Gossypium hirsutum
  Clone ID: uC-gsflnu33B099e06b1
ctcactcgtccgcccacgcgtccgctcattttcagcagcaactttttcctttcgacagttaagtgaaaagatgccgtactactcgaggggtggcgaagatgacgttgacgagatcgactaattagaaccgacgccacacggtggcggaattcttatatagcgctacattaaccctgctgtgatggatgctccagctgataaccattgcaagatgcaagt

SEQ ID NO: 19732 - DNA, 263 bp, Gossypium hirsutum
  Clone ID: uC-gsflnu33B099f11b1
ctcgtccacgcgtccggagagagaagagtagatcttggcttctctccttcgttcgattccgcttaattatagcccgcgtttctctcagacgtgaaaaatggggctgtctttcacaaagctatttagccggctcttcgccaagaaggagatgcgtatactcatggttgggctcgatgctgctggcaaaactaccattctttacaagcttaagttgggagagattgttactaccattcccaccatcggtttgaatgctgagaccg

SEQ ID NO: 19733 - DNA, 297 bp, Gossypium hirsutum
  Clone ID: uC-gsflnu33B099f12b1
tcgtgtattccgacgtggaccctttcgcgtggttgtaagcactgatctgttagatcgtggaatcgatgttcagaaagtctttatggagactcaatcatggaacctcaacacagccagagagctacgctcattgaatacgtgcgtagcggaagacctggacagaaaaggtgttgacatgacatcttatccacaaatattgagaggatgctatataacagacaaagggatgaaagggttgtcgatgcagagctgatgtgaacagtggcatgagataaattgtgcggatgggaagtggct

SEQ ID NO: 19734 - DNA, 97 bp, Gossypium hirsutum
  Clone ID: uC-gsflnu33B099g02b1
gggcctgctcatgagaagctaaacttgactgaagagagattgagtgctacatcatcgcctcggcagttggcagaacaaatgacacttgctaaagatt

SEQ ID NO: 19735 - DNA, 123 bp, Gossypium hirsutum
  Clone ID: uC-gsflnu33B099g03b1
ctcctcgtccgcccacgcgtccggagatggtatcgcttaagctccagaaacggctctcagcgagcgttctaaagtgtggaaaaggaaaggtttgtcttgttccatattgaagtcttcctgatc

SEQ ID NO: 19736 - DNA, 108 bp, Gossypium hirsutum
  unsure (1)..(108): unsure at all n locations
  Clone ID: uC-gsflnu33B099g07b1
ttgatgntccgggaaaacatacaacgaaaaagaaaattttgatgagagagagaaaaaatgttcgcataccatcgcgatagccactcgtgtgccaacatggctgatgat

SEQ ID NO: 19737 - DNA, 82 bp, Gossypium hirsutum
  Clone ID: uC-gsflnu33B099g08b1
ttgctcacacgtccgagaattatgtattaagagacggccttttttgaaaaaaacacccctacttacaccccacaccaaacaa

SEQ ID NO: 19738 - DNA, 200 bp, Gossypium hirsutum
  Clone ID: uC-gsflnu33B099g11b1
gttaccatccagtatttgatcggttcaggaatggatccggttacggagaatagtccttatctgggattcatctacacaacattccaagaatgggcaactcttacctcacatgggaatacagataggtttgccaaggtgcatggttaaaataaatttgttacatatttattatcttctttatattgtattttttttatata

SEQ ID NO: 19739 - DNA, 509 bp, Gossypium hirsutum
  Clone ID: uC-gsflnu33B099h05b1
gtagttcctgataggaggagatgatgaatataaatttataatacagtgacgatttaagcgaaggtgggtcttggggggacaaacttgaaaaaattagctttgagaacaagtttgaggaagttgttggtggaggaagtatttataagattttaattactttttttattattatttaattttttatatctttatttaaatttttttttttttttttttattatttaaatattaatttatattttatttattatatatctttctttttttatttaaatatattttcttttattttataatttttaatttttttaccttatttattatacatattattttctttttattataacattttatattttattttaatttgttttttatttgtttttttatattttttttttattactattcttatatttcttattatttattttcttcttttttttatttttattttctaaattttttctgtattttctttttttttttatttttttttttcttaa

SEQ ID NO: 19740 - DNA, 168 bp, Gossypium hirsutum
  Clone ID: uC-gsflnu33B099h08b1
taatttaaaaccacacctaccaaatataagagcgggagtttataaaaaaaaaaaaataaaaaaaaaaaaaaaaaaaacaaaaaaaataaaaatattaataactaataaataaataaaaagggggcgcgttcttaaggggaccaaggctaaccaccaggggaatgaaat

SEQ ID NO: 19741 - DNA, 183 bp, Gossypium hirsutum
  Clone ID: uC-gsflnu33B099h09b1
ttgctgacgcgtgggcggacgcgagggggagaatgaggttgctaacaaagatagggacgctgaataaggagaggaaattgacaagagattactggaagaattagttcaaagaagaaaggaactcaataggaactcgatccaaaatagagctgttcaaagtacacatggataaagacaacaact

SEQ ID NO: 19742 - DNA, 77 bp, Gossypium hirsutum
  Clone ID: uC-gsflnu33B099h11b1
atcgctaacaaacagggagactataccgctaagtgaggtttctggtagtgaacagatctaagaacagattgaagagt

SEQ ID NO: 19743 - DNA, 455 bp, Gossypium hirsutum
  Clone ID: uC-gsflnu33B100a01b1
tgtatagagggggtgccctgatagggtttcgaccctagaccataaacgccgtcggcgaccttgtggagccaccgagataagcgctgagacaccaactgctagtaccagatgaggactggaacgagacatgcgcgacgtggatagtgacatgtgcgttagtgcgtggagatagccagatgcgacgggtggacaatgggtggaaccaagtgagtacgcttaggtgataggcatatgttagacttggagaatatgggccacaatgaaatctgggctgtattagtgcaaaagctaacggcgtgcaggagcactggtcccactgcagcaattgagaattacaacttatatctctgaaatgattgatttatgagtgggctagatttagctttggaatgtactggatgcaacttcattgtccatgttagatgtcgaccataacaatttaactgggcgtattc

SEQ ID NO: 19744 - DNA, 453 bp, Gossypium hirsutum
  Clone ID: uC-gsflnu33B107a03b1
tccacgcgtccgtgcacttgctcctcctgaagtacacattgacttggctgcacagcaacagcatgaggctgagcttgcagcagcagccagtcagccccttccagatgatgatgatgatgcatttgaatagagaggggtttgagttgccagagaaccatcaacaatttctgctgctttttcattttcactcctgtctggatgtgtgctctctcattttcgtatttaaattgcaagtagggaggagtgacggaggatgaatttgtagtgtaggattttacgaatataattgttgttatggtggatctttggtcgtgttttcgacttttgctttttgttgttatgggttttgctgcctttagtgaaatctttatgttatagttactctatatgtttttgaatatgaaattcttgagaagaatattggaattcactaataaataatatatttttaat

SEQ ID NO: 19745 - DNA, 541 bp, Gossypium hirsutum
  Clone ID: uC-gsflnu33B107a07b1
tcttccacgcgtccgcccacgcgtccgctcgatttccattcctttgacttcctttcatcatgttagaacaaatccttctctattttactcttttcttataaaacttgtcaatttctgcacttcactgtgctttttctgttgaatttatctcttttttttttcttttcattttgtagttcaagaaatgggttcaggagaaaaggtatttgtttatgaagatctggtgaagcacaaagacagaaatgattgttggcttttgatctctggaaaggtgtataatgtaacccaattcttggaggaccatcctggtggagatgaagttttgctagctgctagtggaaaagatgcgaccgatgatttcgaagacgtacgtcacagtgatgatgcatgagagcagatgcacaagtactatattggtgaggtcgatgccaccaccattccggcacgaaggacgttctaagcacagacgtcaaccgcggtaacttaacaagacgagcctggctttctgtttaagatatacagttcctggtccccctctgat

SEQ ID NO: 19746 - DNA, 552 bp, Gossypium hirsutum
  unsure (1)..(552): unsure at all n locations
  Clone ID: uC-gsflnu33B107a09b1
tttttgtctcagatctcagaagatggcccgtaccaagcaaaccgcccgtaagtcgactggtgggaaggctcctaggaagcaacttgctaccaaggccgcccgtaaatctgccccaaccactggtggtgtgaagaagcctcatcgataccgtcctggaactgttgctcttcgtgaaattcgaaagtaccagaagagtactgagcttcttatcaggaaattgcctttccagaggcttgttcgtgaaattgcccaggatttcaagactgatttgcgtttccagagccatgccgttcttgctcttcaggaagctgcagaagcataccttgtgggtctctttgaagacaccaacctgtgtgcgatccacgccaagcgtgttactataatgcccaaggacattcagttggctcgtaggatcaggggcgagcgtgcttaatttccaagtgtgttaatcacacacttagaatggagaaactattgtttggtgttaggcaaatgtgttgtactanttttttatgtttattttaatcctctttaggacaagattaaatgata

SEQ ID NO: 19747 - DNA, 453 bp, Gossypium hirsutum
  Clone ID: uC-gsflnu33B107b01b1
ttctgcgtgtttgggaggagatgcagagagatgggctggaaccggatgtaatggcttatgtgacattagctgcagggttgcgtaagggaggaagagcacaggagagggtatgagttgtttaatgagatgacaaagaaagggatattgatagagagggtaatgaatggaggtttaatagaagggttcgtgaaggatgggaaggtgggatctgcttgtggcattgggaaggatttgcttgatggtgcatacgaacatgagccagcggatatatagtgtcgctgtttgaaggcctgtgcttgatagaacatatttgtaccgcagtcatgcgtattctagttgctgctgcagagttgtcctcagcagaacgtacaccacactagcccaggctgatagcgttctatcatgcgtaacctgtttcggagggtgtcgacactgttcaagggaaacatacat

SEQ ID NO: 19748 - DNA, 423 bp, Gossypium hirsutum
  unsure (1)..(423): unsure at all n locations
  Clone ID: uC-gsflnu33B107b07b1
tctaatgacctgttgatggaagcagggccattaggaaatgttcaatcagaggtgcttctgaggaaggacaaggatacctttactttcaaacaaggatgggcatttcccaggaaagtgtatttcaatggtgatgaatgcatgctccctccacctgatacatacccatttctaccaaactctgcccatcaacacctatccttcaccagctttacattcattgctgcaatgtttttcttatttgtaaccttttggtgatcgtttctcatgttgtatgagcacaaatgacagcgagaaagtacacaattttacaattttcgaaattgtttcaatgaatcggaaaagggattttgtnaaaaaaaaaaattataatattataattataattaataaaaaaaaattataaatataaattaatttttataa

SEQ ID NO: 19749 - DNA, 572 bp, Gossypium hirsutum
  Clone ID: uC-gsflnu33B107b11b1
tcttaatgttcgtcttcagaagacgttatgattaaagaatcagctgaatgggctaagttggccattagccgtgccatttctgtttgatgaggttgccattcagcttcagcatgtttattttcttacggaagtccatgcatctgggtgtgttgagttgagggtctgggattgcatgtgtcaagtcatagccgttgtccgacaacagaaattgtccatcttcaagttgtcactaactcttgcatcatcatcatcatcatcatcatcgggtcggattccatcactgatcatggaggaagtcaatggagatggagaagttcgtaaacctctgcttgtcattgggagagattgctagtcaggtaacccggtgacttgcagtttgtataagggctatgtttgaatagaagcatcattttctgccatgggagtggttttctgcggtgaaattgtaggttactcataaaagatgactaatgatgagaatgaaagtgctgcagcagatgaagacatcttatatgcttcgcatcttcatagctttcccatctctgattttggttctgagttttctcactcct

SEQ ID NO: 19750 - DNA, 556 bp, Gossypium hirsutum
  unsure (1)..(556): unsure at all n locations
  Clone ID: uC-gsflnu33B107c01b1
tttttgagagaaagaagggaaagactctgatcgaaaaatggagaaagccaccaacagacaacaagttttgcttaatcattgacaaccctattatgagtctcatcaatcacctgctgctattctatttccttacaactgcgcggcgggggatagcgctgcttatcaccggacggctgctttcggggatgatgttgtgattgttgcggcatgtcgcactgcaatttgcaaagcaaagcgtggaggcttcaaagatacacttgcagatgatttgcttgcccctgttttaaaggctgtgattgatagaacaaagctgaacccaagtgaagtgggggatagttgttggtacagtgttggcacctggttcacaaagagcatcggagtgtaggatggcagctttctatgctggttttcctgatacggagcctattaaaactgtcaacaggcaatgttcatcgggcctgcaagcagttgccgatgttgctgcttgcatanaaacaggattatatgatattggcattggtgctggacttgaagcatgacaactaatggtagtgct

SEQ ID NO: 19751 - DNA, 580 bp, Gossypium hirsutum
  unsure (1)..(580): unsure at all n locations
  Clone ID: uC-gsflnu33B107c02b1
tttgcttggggaaaagaagttccggaccttctcaaagacgattacaagaatgacttgggtgaagaagatgaggaagatctcgatgacgatggagataagtcacaacatgctttagcaccggaatataaacgtttaattgctattcatgccggaaagccaaagggaggattagaagagtgtctaagggtggatcccgataaagtaagacgtcttagcatgagtgagcaacaacttgaaaatgctgcgattactcacggaaaagaaattgtcaggtttacacagcggaatattcttagggtatatccgaggggtacacgtgtcgactcttccaattacaacccattaatcggatggatgcatggagctcaaatggtcgcatttaatatgcagggttatggaagatctttatggttgatgcatggaatgttcaaagccaacggtggatgcggatacttgaaaaaacccgatttcctattgaatcctaacaaagtctttgatccatatgtcaagttaccggttaaaaaaattttgagggtactatgtatatgggcgaagggtgtaatatgatnttatacactca

SEQ ID NO: 19752 - DNA, 128 bp, Gossypium hirsutum
  Clone ID: uC-gsflnu33B107c06b1
tctcgcgtccgctcacgcgtacgtattagcattttttctagacccgttagattggtttctccaaccgaacaaactaaatggttgcgatttacttcattgttcttttttcaaccattttattgcttctc

SEQ ID NO: 19753 - DNA, 514 bp, Gossypium hirsutum
  Clone ID: uC-gsflnu33B107c08b1
tcttctttttcctccttccttcgtttcttttcatattcttgtgcttgttatttgtctccttttgtttcccttttatttatttatttatttatttttatcttttttataaactttaccttttatctccttaaaatcaatcgttatctttctcttctttgttcttctgcaactttcatggcggttttacccaccggctcttcacacttggagttgacgatatctgttcctggtttcgcttcttccccttctttcccttcttctggtgatcaagggggttgtacggtgagagatttggatataaaccaagtaccagcagaagatgtatggatcacagcaagcatggaagatgaagaagaaagctgcaataatggtgcccctcctcgaaaaaagcttcgtcttacaaaagaacagtctcgccttcttgaagaaagtttcagactaaaccataccctaaaccctaagcagaaaggggcattggctttgcagctgaagcttaggccaaggcaggttgaag

SEQ ID NO: 19754 - DNA, 183 bp, Gossypium hirsutum
  Clone ID: uC-gsflnu33B107c10b1
ctggtctccgtcgagaatccaagagacgagctcttgcgccgtgtgaaaggattagcaccgcgcttggtgacattagtggaacaagaaatgaacacgaatacggctccgatcgcgttaagagtgtgagaagcatgctgatattacgaagattattttgtcttttgttgagatgactatgcttat

SEQ ID NO: 19755 - DNA, 77 bp, Gossypium hirsutum
  Clone ID: uC-gsflnu33B107d02b1
cttaaatttggactttaaatttactttttgtgagacttgttgatttgctttttaaacaaattctagttttatgtttt

SEQ ID NO: 19756 - DNA, 567 bp, Gossypium hirsutum
  Clone ID: uC-gsflnu33B107d08b1
cggtctatctgttgttttacccattggccaattgccatcacctaaaaatttactaaaatttacaaccaatctctcctttttttttgaaaagaaccatggaatcgcttttcatcatgattgtttatttatgcccatcattcctaatcttccagaaaccctaattttattgttttctcttacgatacctcgtttcgttgttgaccctgcagttttcttaacccatggaccttcaacagcttgatcccttgcaaatttcaattccgaaagcctcggatccctacagtatcatgaacaattcctccgtatggcttgaaatccgtctcttttacgttcggatagcgccctgcgtaatcgatagcgcgccggaccacctcaccctctgctacctccgccgcgaaatcggtttctccctcgaagtcaacggctctcgtgtcccggcttccgattccgcttcgttcacgctccgccgcgaccgtctcgaccgggagtcgtcggaggtcacttatttgagcaccgatagcgttcgcgtcaccggaggggttgaattcgagtgtacgagaatgaaaa

SEQ ID NO: 19757 - DNA, 579 bp, Gossypium hirsutum
  unsure (1)..(579): unsure at all n locations
  Clone ID: uC-gsflnu33B107d12b1
ttttgaaaagcggtccttatttttcccaccctttgaatcccttcttctctgttttcacaaaaccatctcagaaaattttattattactatcacttcaaatcaaccaataatcctcactcttgaattgtaatttacaagttgatcaaataggagatactcattagagctgtgatagaaaggatcaataaagatcgttttgggaatggcttgtcgaggatgcttagagtgcttgttgaagctcttgaactttttgatgactcttgctggtctggcaatggttggatacgggatctatttgtttgttgagtacaaaaatgctgccgatactgcaatgcttttgtcacctgttggtagtgatcgagatttgatacagtttggtcgccccatgctcatggctgtgtctctttcgtctagtatttttgataatctgccaaaagcatggtttatatatttatttattggagtaggggcggntctctntgttatctcttgttttggttgtatgggagctgcaacacggaatatatgctgcttgacttgtattcagtttggtgatcttgctgatcttggtgagctgga

SEQ ID NO: 19758 - DNA, 460 bp, Gossypium hirsutum
  Clone ID: uC-gsflnu33B107e06b1
aacccaacttctccttcactcccctcttatctatatatctccttttcttcttcttcttcctctcctcaccaaggaaatcacaatttagcttctaactttgcctcttttttttttcttttcatctgcaaatctggtcctttttttctgatgctggagagtttgggtattagatttaaattagtttgaagggctttcgagttctgggttttccattttggggtaacacccaggttagtcaaattgtggacatcacggctatacacagagtttaccggcctcttcttattcatgcccgatctgtacgacgtaagagttgtgtgatcgagaggaaccctgcgccgcacggcgggcgtggagctttgccttctgaaggcggtagtccttccgatctcctcttccttgctggcggcggtgttgtcttttagagtttcagtagttggtataggtagctttttagtat

SEQ ID NO: 19759 - DNA, 584 bp, Gossypium hirsutum
  unsure (1)..(584): unsure at all n locations
  Clone ID: uC-gsflnu33B107f04b1
tttacggtgaaaatcgaacacaaagcagctcgcgactccatcagcatatcagactgcaagcggatttccaaaacaaatactagaaaccctactcccaaatagaagtttgattgagctctctcatggcgttttctactcgtctcctctacaaatctcgccagctttatggtaatcaagctgttctgcggcaggaggttgccattcctgtccggttttactctaaagaggcttctccccctggtttaaaaggagatgagatattgaaaaatatctttgtggaggttaagaacaaattcgagacagcattgggaatatttaggaaggagaaaatcaccattgacccagatgacccagctgctgtctctcagtatgcaaatgttatgaagactgctagagaaaaggctggcttgttttcagagtctcaacggattaaatacaccatcgaaacacgaactcagggcattccagatgtccgaacatatttattgacactngaggaaataagatccaagagaggactcactgatgaacttggtgctgaggctatgatgatgggtgcgttggataaagtgaaaaagaatcaa

SEQ ID NO: 19760 - DNA, 545 bp, Gossypium hirsutum
  unsure (1)..(545): unsure at all n locations
  Clone ID: uC-gsflnu33B107f07b1
tttttccttttcacccattatggcttcaatattgagttcacaaggagtggtcttagcaacagctatggcagtttctggtactgtaatcctccttgcttttcgtcttcaaaaatcttaccttttggatcaaatctcacagccttctcaacaagctctccgttcctgcatatcttctggtacataacagttgcgtgcatatgtttcaaaatggggtgtccgtgttcctaattgtttttaacaattttttctttgattttttttttaaaagaggggaagaagagggaggaaaaaaagaagaaaaaagtgcactttgctgaagatgtggttgatccaagaaaggacggagaagaattcagaaaacagctgaaaaatcgtgttagaatcaacaattcagcagctttgaattcatcgactaaattcaagaaatttggtggaggtaaagatagaggaatgcctgctaatagagttgctatatacactggaattctcagggatcgtggtgttcaacgattagcttactcctgcttatttttntttaaagtaca

SEQ ID NO: 19761 - DNA, 484 bp, Gossypium hirsutum
  Clone ID: uC-gsflnu33B107f10b1
ttttgtagctggagatgtctttagattttgtggtgaagatgaagtttgtttattttgtcgattgaaccatagttggactagtaaaagatattaaatcttcaattacacagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgttttaaaagaaccaaattttacatcccgtgcattgaaaagtaaaattttttttttgggggacctaaaataaaataaatgggccgggttttaaaaacgtgggaaggggaaaaaccttgtgttaccaaaattaaatggtttggagaaaaatccctttttacaaagttggcttaaaaaaaaaaaggcccaaccaattaccttttccaaaaattggtaaccttaaattggaattggaatcccccctttaagggta

SEQ ID NO: 19762 - DNA, 511 bp, Gossypium hirsutum
  Clone ID: uC-gsflnu33B107g02b1
tttttaatgttgcatctgcctttctgcttacgaggatggagttgagctaagggaacttccttgtcgccaccatttccactgtgcctgtgtagataagtggctatacataaatgctacctgtcctctctgcaagtacaacattttaaagagtagttcccaagaggaagtgtgaagaaccaaaaataaaacaatcatttacagtcacgtctaagacctttgcatagggattttagctcgagagcattataatgcagaatatttcatatagaccgatccaggctattctgttattgttgttcttgttgttgtggtagatgcagatgttgatgtagtttctcttagtgccggtgacagtcaatgatacacttgttttagctaggtccttcatggagttgtcgggtatatcgatgtttcccggggcatccaaacactaaccaagttgagaatgggttacggtttcagcttttcttttttgtgttgttaaaatctactatatttatactaatttatt

SEQ ID NO: 19763 - DNA, 413 bp, Gossypium hirsutum
  Clone ID: uC-gsflnu33B107g08b1
tctatttggtctgaaatggaatgtggtttaaaggttaaaaaaaaaaaaaataacagaaaacacaaaaaaaacaagagaagaggggttatcagattttaggttccgggcggtcgttctcgtgcatccatgcttaccgactgttgcttcgcgacagcttattttttttttagggccgcctgcattcaattggctggcctgggaaattccatcggattagcttgggctatcctgtgggctgacccttcttattctctcttgggggtcttttctctttatgccggctggcctattctcgtttgggcccggacggattcccctattggacaggggccctgcctgattggggatgggtaccccccttgtgttgtttcattaccgccgttgtgttctgttacttcgcccagtgcgtcccc

SEQ ID NO: 19764 - DNA, 233 bp, Gossypium hirsutum
  unsure (1)..(233): unsure at all n locations
  Clone ID: uC-gsflnu33B107g09b1
tgntggtttctgtttatgtatttcttttaataataatataaaatgtaattaaagttataatttagggataaattttaaaactatttgtcaatttttatttgagggaagctaattttgattttaaaaaaaaaaaaaaaaaaaaaaaaaaaaaaaaaaaaaaaaaaaaaaaaaaaaaaaaaaagaatatcaaaaataaattatccaatatttacaatcacttacaataataaata

SEQ ID NO: 19765 - DNA, 439 bp, Gossypium hirsutum
  Clone ID: uC-gsflnu33B107g10b1
ttttccacgcgtccgcccacgcgtccggttttaggctggaaatacgagcgagcttacgaggtgtcacagaagtacaaggaagggaaatttatactcgagaaggcgaagattgttaaggaggattggtaacaagcaagcctcatcgtttttttaaggttttcttattccatttattccccgtgtttgatgtaattgttatcggtgcccgatgttcgtcttgttcagaaaaagacgtcgccctcatttcggaaaaaaattgtcattgtttcgaaccttgcattcttaacgatgatgcacgacggattggcaattctctgtgttaataaattatggtattcttaaccatcgttcatgaaaaaaaaaaaaaaaaaaaaataaataattatttttttaaaaatataaatataaattaattttaaatattaaattatatattttg

SEQ ID NO: 19766 - DNA, 146 bp, Gossypium hirsutum
  Clone ID: uC-gsflnu33B107h01b1
ttccacgcgtccgcccacgcgtccgcccacgcgtccgccttgtggtaataaactaaaacatatatgtacgagttacttcttcttttgttatttctgttttccttttgaagatggaaatgcataaattatagagcttgttttcttct

SEQ ID NO: 19767 - DNA, 526 bp, Gossypium hirsutum
  Clone ID: uC-gsflnu33B107h04b1
tttttggaactttgatgatttccctgccatggcggagggtgttttctgaacgaactttccataataactagtgtttgtaaataaagcaacatgaatttggtcaaaatctgttgtgaagttgaagtaaaaaccaagctatatgcatgcataagccttgcctgcactgctttcagaggttcttaaggccggtgttgtgttatggaaattggtgcattatgttggcaatgtgcagcagcagaggcacgtgaagtcatatgcgtggcagagcaatgtgcagctgcatgggacaggacatagataagggtcatatggaaagtaggaaaattttacagtctttttctgatctgccctgccttccatttagggtcgtagagcatttggtggagcatggcgaagttattatcgacaaaggaacgtgtcgataaggtcacccatgtatgatgggattttgtttggtagctgagggtctgaatgtcaagggatatatgatggaggggggggtcaagttaggtgcagtaagccccat

SEQ ID NO: 19768 - DNA, 583 bp, Gossypium hirsutum
  unsure (1)..(583): unsure at all n locations
  Clone ID: uC-gsflnu33B107h05b1
tttacgcgtccgatggcttccgcggatagcaatctccttatcctcaatttcctaaccttggcttcattgtccctattctatgccgacaaagctttttgtattcggattccagatcgggcctccaccacgcctcgggaactgtcagatcagtctctgaaaaccgcggtttttgccctcggtagtttctggagatcggaagctgtcttcgggtgcttaaacggtgtcgttcgaactacttctggttatgctggcggatccaaaatcaatcccgaatacagaagcttaggtgaccacgccgagtctgtaatggagattaatttcaggctacttctggaggttttttggtctagccatgacccaagacaggtttttggccaaggtcctgatgtaggtccccagtacaggtctattatttttacgaatgggactgaagaggctagattagctgccatgagcaaagaaagggagcaaaccaagtcgcggagcagcattttgacaacccaaatcaacaacttgaatcatnttatccggcagaancctgacatcagaaattngagctcanacgccacccgatgcttctaca

SEQ ID NO: 19769 - DNA, 382 bp, Gossypium hirsutum
  Clone ID: uC-gsflnu33B107h07b1
tttgaactcgtaaattatattatttaatatttacgagccaaatgtagtttttaaaatatttttagaatagtaaattgtgttttataaagatttatttggtcaataaattgagaaaaagaggtatcgagatctcgatgttataaaaaaaaaaaaaaaaaaaaaaaaaaaaaaaaaaaaaaaaaaaaaaaaaaaaaaaaaaaaaaaaaaaaggggggcggcccttttagaggctccattctttcctccgcctgcctgcgacataattctttttttatggggccacctaaaattaatctgccggccgtttttcaacaacgtcactgctggaaaaaccctgtggccccacaaattaatcttgttgcacaacaccctcttttcagct

SEQ ID NO: 19770 - DNA, 555 bp, Gossypium hirsutum
  unsure (1)..(555): unsure at all n locations
  Clone ID: uC-gsflnu33B107h08b1
ttttacaaaaggaccaaggcactgttggtaaagcttttaacaaacccctctttggttgggtgtttaaacaaggaaactcaccgaagtgaaagggttcaaaacaaaaggaaaagaagagagaaagcaacttttttttttccttcttgtgcgtgtggggaacttatttttgaaggatcagaggcatatgaaattgaactaaatttttgttggtcttttttttttgcaacaaatgatggcaggaaaccctagctggtggagcatgcatttgcatccaccttctcaacacccttcaactttgttaaccacaccatccccatccctcttccctcaatatgttgttgaatattcagctacttctttgcctgataaccaagagcttcctcagtcatgtagccaactactctcgggtggattctccggtgaagaagaaaggttatgtccaagtaatttccagccaaaaaagttggaaaattgggaaaaccaaatcctgaatccatctctgagggttcccgtagttgagttataaagcangaggttactcacaacatagcaact

SEQ ID NO: 19771 - DNA, 557 bp, Gossypium hirsutum
  unsure (1)..(557): unsure at all n locations
  Clone ID: uC-gsflnu33B107h10b1
tcttgaaacgcaaaatcgaggcactggactcggagaccaaggcttcactcgactcactcaagaagcgggaactcagtatcgaggacagtgtcaagatcgcactcagccgagtcgagttcaacaccaaagctgccatgaggacccttggcgatgacgttgaagacaatccggacggtgaggtcgacgacggagacggacttttgcagcacctgaaatcaacgtgcttgaaaatggaagctaaagagttctggagcttcgtgatcggaaaaaagaaagaaatagatttgttaagagagaaaatccctgcagcgttgtcggaatgcatcgatccggcgaggtttgttatggaggccatatcggaggtatttccggtggacaaaagaggaaatgagggaggaagtgatttagcttgggcttgtgttttgattctggaaagcttaatcccggtggtggttgatccggtgataggaaaatcaaggatcctttgtacgcctagtatgaaagagcaggccaaagaaatcgcggagacatggaaaaagagcctngaagagagagga

SEQ ID NO: 19772 - DNA, 397 bp, Gossypium hirsutum
  Clone ID: uC-gsflnu33B108a05b1
tttacgcgtccgaatggagaccccttcatctacaagacgagtcaccaggtcccagactttggctgctttgaacaacagcaatatccctctttccaaggggaaataaggaaaagccacacgaaaggtctgctcttattgatataacaaatgactcccctattgttgggcttgcggcggaaacaccgccatctgttataggtaagcaccggagtagtagagccaagagcatgatgatgactcctggttctggtgaggctttgttgaaaggtcaagtcaagactctgttgcaaaaagttgaagaggaagctgacgtttcaaaagtttcaatggaaagccgtcctttttttttattttaggctggatgtgggaattccccaatgggacttatggaccctac

SEQ ID NO: 19773 - DNA, 76 bp, Gossypium hirsutum
  Clone ID: uC-gsflnu33B108a08b1
ggaccggccgaatacccgggcgacccaccgctgtctacgcgccgccacccgccgaaaaagggatttttacaaaggg

SEQ ID NO: 19774 - DNA, 84 bp, Gossypium hirsutum
  Clone ID: uC-gsflnu33B108a11b1
tttttcacgcgtacgaccacgcgtccgtaagcaccttgatgagaaggtggctgctcttcaccttggaaagcttggggctaacct

SEQ ID NO: 19775 - DNA, 455 bp, Gossypium hirsutum
  Clone ID: uC-gsflnu33B108a12b1
tagaatccctcgaactctgttatttttgaaattttcatggcacccatccctttcttatcacttcttttgctcttctcattaactttcccatcttcttgctcagccttcgaacaacaacaatcacccctccttaaataccatcatggtcctcttcttaaggggaatattactgttaatctcgtttggtatgggaagttctcatctacgcagcgatccataatcggcgactttttgaactctctcagcaaccccaagacgacgtcatccccctttgactcctcccggtggcgaacgactgccaaatacaagggagggtccagcagcgttgttggagggaagcaaactctggatgacaagtacttcttaggcaaagctcttaaacttccaactcaaagttttggctttaaaaatggatatggagatggtaagctgtcaacgttgttttgactttcctt

SEQ ID NO: 19776 - DNA, 299 bp, Gossypium hirsutum
  Clone ID: uC-gsflnu33B108b02b1
ctctcgcgtccgcccacgcgtccgaaaaaagaaatatatttaaaaaaaataaaaaaaaaaaaaaaaaaaaaaaatataaagattataatgtttaagtattgttttttttttaaggggggggtccgtttttgggggcccccgtttccttgccctctctttcgtttccctggcttttgtttgggttcccctttttttttttccctggccgtttttttccttggcctgcctttgcacctccttggcttttcccacctttttcgttctcgatttcatccccctttagcccgttcccctttttt

SEQ ID NO: 19777 - DNA, 415 bp, Gossypium hirsutum
  Clone ID: uC-gsflnu33B108b05b1
ttatcgcgtccgttttggtggagattttcagaggaattcatccatggcaaccaaagtgtatattgtatactattccatgtacggacacgtagaaaaacttgcagaggaaataaggaatggggctgcatctgatgaaggtgttgaagccaaattatggcaggtctctgagactctatcggaagaagttctcggaaagatgagtgcacctacaaaaagtgatgtaccaggtattacaccgaacgatcttgctgaggacgatgggtttgattttggtttcccaacacgattctgaatgatgtccgcacaattcaaagcttttctggatgcaaccggaggtctatggagaactcagtaacttgcaggaaaacctgctgggatcttctatagcaccggatcaaaggcggtggacaagaga

SEQ ID NO: 19778 - DNA, 266 bp, Gossypium hirsutum
  Clone ID: uC-gsflnu33B108b12b1
gtctttgtcacgcaggcaaaacgagcatcagtctgagggccttcatcacacttgtggggagagaccccacggacacgaggtaggacccaggggccggtggtccttaaccggtgaattggtctgacgatgccatgggtgctcaggtcggacttgatgatgccttagctacgatccttgcctaagcccgaaccacctggccggcatgacttggcaggacactgcatgatggtcaagattgactatcattcggcaagacagatcctatg

SEQ ID NO: 19779 - DNA, 351 bp, Gossypium hirsutum
  unsure (1)..(351): unsure at all n locations
  Clone ID: uC-gsflnu33B108c01b1
tttacgcgtccggctgatttttgctgggaagcaacttgaagatgggaggacccttgcagattacaacatccagaaggaatccactttgcacctggtccttcgcctccgcggtggcttttaagtgtggtgccgaacacctgtccagttattgttgatgtgttaagtttgtatgtgtgtgggtcgtatgctaatgtgagctggccactaggctggggaagcttacgagtaaaaataattgcttttatcaacgcttttagttgttctttaggtttcaaggttctatggcattgaataaatatgtttttgcattttgcagtcnaaaaaaaaaaaaattatataataaaattaaat

SEQ ID NO: 19780 - DNA, 474 bp, Gossypium hirsutum
  Clone ID: uC-gsflnu33B108c08b1
tttttcacgcgtccgaccacgcgtccgcaattttgacatgggagaacctgatacacgcaatcctgctggaagtggcttgccaagtgaggaggcttcggttaagacagcaaagaaaattcatgatcagaaattcgctgagctctcaggaaatgacatatttaaggatgatgttcctccaggttctgctgagaaaccactcagtgctgcaaaactgcgggagatgagtggcagtaacatcttcgctgatgggaaggtagagtctcgagactactttggtggtgttcgcaaaccccctggcggcgaaagcagcattgcttttggtttaacttagctttctctaaccctgtcaaattgcttcagccgtgtctggtgtttgtctttaggggcggtgggaattgtgttatgactttttccattgtgggttttggaattatgtctttagggttaacttttccacatgaggtatggacatat

SEQ ID NO: 19781 - DNA, 266 bp, Gossypium hirsutum
  Clone ID: uC-gsflnu33B108c09b1
ttcacgcgtccggtaaagatcattaacaaggttggtggcgttggtggtggcggcgacaacggcggcggtagtggtggtgtgctccaggcttgcaaaaagttttgttttaccatagttttaaattttaataaataaaaatgatgtatctttttatctgtcagagtcttttgtttttaattatatgaaggaattcatttgacatcataaaaaaaaaaaaaaaaaatataaaaaaaaaaatatatataaaaaaaaagaaaataataatg

SEQ ID NO: 19782 - DNA, 397 bp, Gossypium hirsutum
  Clone ID: uC-gsflnu33B108d02b1
cacaactttcctcctcttgacatacgccaaatatctcagtacaaatggtggagtcgtcacatgtgggacttcaactgtaacagctgagagcctcatagcacaagcaaaaaagcaggtggactacatcttaggcgataatccagccaaaatgtcatacatggttgggtttggagagagatatccacaacatgtgcaccataggggttcatcggttccatccattaaggcgcaccctgatcgtataaactgcaacaatgggttccaatacctttacgctaactcacctaatcccaacgtccttgctggagccgtcataggtggacctgatagtaaagacaactttgctgatggatcgtaacaattatcaacaatctgagccagctacttatattaatgc

SEQ ID NO: 19783 - DNA, 232 bp, Gossypium hirsutum
  Clone ID: uC-gsflnu33B108d06b1
ccggtctcctgcattgcggcgccctgcttgtggtctcgggtcacctaactccagattctctggccgtcgtcctacaccttcgggcctgggaaatccctggcgttgcccacctttgttcccttgcggttcgtccccctttcgccggttgccgtattagcgaataggcccgagccgatcgcctttcccaactgctgccctacctgagtggccaatgggacgggccctgtaccgg

SEQ ID NO: 19784 - DNA, 510 bp, Gossypium hirsutum
  unsure (1)..(510): unsure at all n locations
  Clone ID: uC-gsflnu33B108d07b1
ttccacgcgtccggcatggccgaaacaatgggaagaagcttatggcagtcaggattgtgaagcatgccatggatattatttatctcttgactgatcagaaccccaattcaagtcattgttgatgctattatcaacagtgggccacgtgaagatgctactcgaattggttctgctggtgttgtcaggcgtcaggctgttgatatttctcctcttcgtcgcgtgaatcaggccatctatcttttgaccactggtgcacgtgagtctgcattcaggaacattaaaacaattgcagagtgtttggctgatgagcttattaatgctgctaagggatcatctaacagctatgccatcaagaagaaggatgaaattgagagagttgctaaggctaatcgttgaggaattggaagaagattaaacacctgggagtggagatttttgttgttttagtcagtacttataagccgnttttgtattctggacatgcatggatgtttcggttttatttgagta

SEQ ID NO: 19785 - DNA, 369 bp, Gossypium hirsutum
  Clone ID: uC-gsflnu33B108d11b1
tatttgtcttttaagggaaataagtggtcccctacctgtagttatagtttgaattgtagggtggggatattatgtagacttaattttcttagaaaatgcaatggggtgctgggatcattttgtaaaaacataccagtcattgtcataattaaaatagtttcttctattacgtaaaaaaaaaaaaaaaaaaaaaaaaaaaaaaaaaaaaaaaaaaaaaaaaaaaaaaaaaaaaaaaaaaagggaaaaccatataaaaggaatccaagctaacaaacccacaaacgcaaaggcaaaacttttttatagggccaccataattttaattaattggccgtttttttacagcggccccattggaaaaaccctgtt

SEQ ID NO: 19786 - DNA, 487 bp, Gossypium hirsutum
  Clone ID: uC-gsflnu33B108e03b1
ctactattcagttttgtaagagctatggctaaggacattgaggttggtggtgagttccaggccaaggactaccatgatcctccacccgctccattggtcgacgctcaggagttagccaagtggtctttttacagggctgtcatagctgagttcattgccactctcctctttctctacatcactgtcttgactgtgatcggttacaagacccagaccgaccctgctaagggcggtgaagattgtggcggcgttggcattctcggcattgcttgggcttttggtggcatgatctttatccttgtttactgcactgccggtatctctgggggacacatcaacccagcagtaacctttggacttttcttggctaggaaggtgtcgttggttcgagccatattttacatgggtgctcagtgtttgggagccaatgtgggtgtgggctggtcaaggccttccaaactcgtactacaaccagttggaggaggag

SEQ ID NO: 19787 - DNA, 458 bp, Gossypium hirsutum
  Clone ID: uC-gsflnu33B108e07b1
aatgagccaattgtggttgatgctgcacgtttgcaacctcttggccctgctgccatctttatgcaaggaaccaaaagaatgcctggcacagcagttacaaagtctgttgtagcaaatgagcctggaggccggaagagagaggaagtttttgtggatataattgagaaaatcagtgtcacatttagctctagtgggtatatactgacttccgagattgatggcactattcaaatgaaaagttatttgtcaggaaatccagaaattcgactagctcttaatgaagatctgagcataggaagagggggaacagtctatgactataggagttcatctggttcaggcgctgtgatactcgatgattgtaattttcatgaataagtgcgtcttgatagttttgacatggacaggactctatctctggtaccaccagatggtgaatttcctgtcatgaactaccg

SEQ ID NO: 19788 - DNA, 496 bp, Gossypium hirsutum
  Clone ID: uC-gsflnu33B108e09b1
ttttcacgcgtccggagcgatgttcaaacatgggttagtgcggcactgacagatgaggatacttgtatggatggatttgctgggaacaacatgaatggatatgcaaagacaatggcgaggaaacgtattattaaagttgcacatttgacaagcaatgccttggctctcattaataattatgcctcaactcaaggttactatttaccttaatttctcatgaaaacttcaaagagaaaaatgatcaatatgtatataggtatatcttaggatcgaattcgggattggtgtcaaccaaagattagatatcaactgtgattcggtcgactaggctgcttttatgtttattttgctttgcgtgttgtatgcttatcatcaaacaatcagggcaattagaaaatgttgtcccaaactaagatggtaggagattgcagattgtgttgtgaactgtatttatttcttaatttctgcactatattgtaccaaaggaatatgaaat

SEQ ID NO: 19789 - DNA, 429 bp, Gossypium hirsutum
  Clone ID: uC-gsflnu33B108e12b1
tcccacgcgtccgtttttttttttgataaaaattaaatattttagaaggatagtagttttcgagttgagatgggcatcaatgaatatgaagaaaattgtggtttattaaacatagaattcatgaaagactgaaaagccatacgtctaaaatggagcagatgcatcttggcttgctcgcaaaattttaaccatatggaatttggagaatccaatggtcatacatggagaaccgtcaccatggagaaagaaagttcatttcgtgggtcctcggctagactttgtaggatctctttattgacgactatgacctgattgaaccccctgtcaacttcaatttggatgatcgaaattgcaactggagtgtggtacttctactggatctgttttaacggaccgatttttgttttagaaggtttcatgtcttgttta

SEQ ID NO: 19790 - DNA, 483 bp, Gossypium hirsutum
  Clone ID: uC-gsflnu33B108f04b1
ttcagttcttcaatataggtgccatcaactggcaaactgatatcgaaaagtgcttaacatgggaagtttatagtcagcttgcaagaggaatgactatacagttcctcgacactgctgccaaagaattaggatgtaatatttccatataacatcgattaactttcggattatcagtataaataccctttctttttcttcttttaaaactgagaatacaaagaagacttaagacttgcttcaatttgcttgaaccacatggttggggcagaaaatgcagctcatcgagtagtcctaggggatgaggatgaaggctttgaatgccatgaaactcttcaagcaaggttagtgtatgataaaaatgccacactgaggtttcatgtgtctaatcttactttgctttaagcttagctttgtacgatatttagactgagttttcgatttgtttgtcggattacgatatataatttcagtttaacttagttt

SEQ ID NO: 19791 - DNA, 516 bp, Gossypium hirsutum
  Clone ID: uC-gsflnu33B108f05b1
ttataataaaaacaaaaccgataactaagaatgacgaacaccaaataaataaatggaaaaaaaacctttttgtattcaaaaatctctttatatctccccccttttacactgaaaatattggccttttatagccgaaaatggaaaagaaaactaaatccaaacaaatctattcggttgtttgttggctcgatttttgctcttctctttcgcttgttgcaggtacgtgcttgaggagcgacatttgcggaggtgtggcgtgcgtagaggagcgcgaagaggcagtagttgcggcgccagattgctagtggccgctggggcagaagctgctacggcgctgaagcagaaagggctaagggtttctgcactgggctagggttaatgtaattgggctgaatttttgggtttagtctgcagatgggtaattaggttaattttgggccttaaatgtcttacgggcctgggcatagaatttgggtattacaggtatcaaattggaatatttgttatagtaaaaag

SEQ ID NO: 19792 - DNA, 417 bp, Gossypium hirsutum
  Clone ID: uC-gsflnu33B108f08b1
tgcaaatcttcagtgtgcaaaatttcaggatgtggatgccgagggctccatctttcacaatgcaactttgcgtgagtgtgaatttactggtgcaaatcttcgtggggctttactagctggtgctaatcttcaaagtgcaaatcttcaagatgcttgcttgataggttgtagcttttgtggggctaatctccgttctgcacacttgcagaatgctgatcttactgatgccaacttagagggagctaatcttgaaggagccaatttgaagggcgctaaattaagtaatgccaacctgaagggtgcgaacctccaaagggcttattttagacatggtaatcttcgtgatacacatttggaaggtgctaagcttgatggtgcatacctacttcgggctcttatgtgatacataaattttta

SEQ ID NO: 19793 - DNA, 506 bp, Gossypium hirsutum
  Clone ID: uC-gsflnu33B108f10b1
ttttgatggcgagtgtgcgatctggtctcctccgagcagcccttcgcggcggctctcgtcgtactgctcctcccaagcgtggcttcgcttcctcttctcatcacgatgatgcttatgaaacggcaaaatgggaaaagataacatatttaggtgctgctacctgcactgttttagcgatttataatctatcaaaaggtcatccccaccatgaagagcctcctgcatacccatatttgcacattcgcaataaggagttcccatggggtccggatggtctgtttgagacaaaggagcatcactagggatggccagacagatgcatatctttccgagttcggcgtatttttatcatttctctgagaaatcaatcagataattctgtggatcttttgtaattttagcactcgatttccagtttctggactttgaattgcaagttcatcaggttttctatatggggtgtgcctgcctaccatactctgtttcgaaataataagattactgaa

SEQ ID NO: 19794 - DNA, 481 bp, Gossypium hirsutum
  Clone ID: uC-gsflnu33B108f11b1
tttgagcagaagcaaagagcctccaaaaaacacttcaaccctctagccatgacattcaagcgtaggaatggtggccgaaacaaacatggccgtggccatgtcaagttcatccgctgctctaactgcggtaaatgttgccctaaggataagtcaatcaagaggtttcttgtgaggaacatcgtggagcaagctgctgtcagggatgtccaggaagcctgcgtctatgacacgtacactctgcccaagctgtatgtgaagatgcaatactgtgtttcatgtgcgatccattcccacgttgtgagggtccgatcccgcactgacaggaggaaacgtgacccgcctcagcgcttcattagacgcagggatgatatgccaaagcccggtcagcctggtcaggctcctcgtcctggtgttgcggctcctgctcgtgcataaggcttttgaagtttaagatgaatttgtatttcgtgttttgctttga

SEQ ID NO: 19795 - DNA, 330 bp, Gossypium hirsutum
  Clone ID: uC-gsflnu33B108f12b1
tttggctactgcgttgagcgtggcgaacactctgtgattgagaccatgtgcggagcagggagaattagggttgctagaattagtttacgattaggttaattgctgtaggctaaattcgggctggacttaatgaaattgtgctatattggtccgaatctatatggatcatggcgctgctcacatggttttgggccccgggcagcaattgggtatcacaattgctgacattcgatattctaacagtttgcttgatttaatatctaagactatcattgttatggtttgctcgatttaatatcacgacctttgatcttttaataaagaaagaag

SEQ ID NO: 19796 - DNA, 435 bp, Gossypium hirsutum
  Clone ID: uC-gsflnu33B108g08b1
ttataaaatctctgaaagggaaaaaaaaactcaaaatcaacagatcgaagtgaaaatggagtgcgtgttcggtttagtgggcaacgactttgccatagtggcggcggacacgtcggctgttcacagcatccttgttcacaaatctaacgaagataagatcatgatcctcgattctcacaaactcatcgccgccagcggtgaatccggcgacagagtgcagttcacggagtatgtacagaaaaatgtggccttgtatcagttccgaaacggtattcctttgacgactgccgccgccgctaatttacttcgcggtgagcttgccactgccttaaggaagaatccatactttgtgaacatccttcttgctggctatgacaaagagacaggcccatctctgttctatatcgactacattgctacacttataaggttgat

SEQ ID NO: 19797 - DNA, 515 bp, Gossypium hirsutum
  Clone ID: uC-gsflnu33B108g11b1
ttttgcagcaacagggagtgcacgatgctgctctacgagtacatgccaaacgggaacttggacgacttgttgcatggtaagaataaaggggagaacttggtggcggattgggtgacaaggtacaaaatcgctcttggagtggctcaaggtatttgttatcttcaccatgactgtgatccggtgatcgtccaccgtgatctcaagcccagtaatattttattggacggtgagatggaggccagagtggcagatttcggggttgccaagttgatccaaagtgacgagtccatgtccgtcattgctgggtcctatggctacattgctccagaatatgcttatactctccaagttgatgaaaagagtgatatctacagctttggggtggtgttgttggagattttaagtggaaaaaaatcggtggattcagaatttggagatgggacagcattgtggattgggtgaggtctaaaatcaagaacaaaaacggagttattgacattttggataaaaatgca

SEQ ID NO: 19798 - DNA, 336 bp, Gossypium hirsutum
  Clone ID: uC-gsflnu33B108g12b1
tttgaatcagcgagttgagaggcttaagaatcgcgattgagataagtgctgcgaattttagatctgttgtatttgggctacttctttttcttttctttttaataatctttttgtttgaatttcatctctgatgtgtttggatgatttgagagatttatcttgaaagaattatatgttgttattattggatctctgttattcaatttcgatttgattaaaaaaaagttggggtttggttcaaaaaaaaaaaaaaaaaaaaaaaaaaaaaaaaaaaaaaaaaaaaataaaaaaaaaaaaaaaaaaaaaaaaaaaaaaaaaaaaaaaaaaaaaaataaa

SEQ ID NO: 19799 - DNA, 496 bp, Gossypium hirsutum
  Clone ID: uC-gsflnu33B108h05b1
ttttctaaagcctctgaataaagttgaaggagacacagaatcatccccgacggcagctgatgctaaagttcataagattggtactcttccaaattatgggttcagtttcaagtgcgatgaacgggctgagaaaaggaaagagttctacaataaactcgaggaaaaaattcatgcaagggaagtagaaaagagcaatttgcaagccaagtctaaggaaactcaagaagctgagattaagatgtttaggaagactttgaaattcaaagcgactccaatgccaagcttctatcaggaacctacacctccaaaggtggaattaaagaagataccacctacaagagctaaatctccaaagcttggtcggaggaaaagctcaactccttcagacattgatggtaacagcaataacaatcaccaaccaggccggctaagtctggatgagaaagcatcttagagcatctttgccaagtgatttctcctgtccatgcgaaagagt

SEQ ID NO: 19800 - DNA, 433 bp, Gossypium hirsutum
  Clone ID: uC-gsflnu33B108h09b1
ttttcacgcgtccgccaccaccaccgccggcggatcaccaccggaatcatactcatcatcctagacggcggccaccgcaatattcacaaaatcacaagcctagtactgggaacaagctcaatactgggaaaaagcttgggcttttgttcatcggcattgttatcatcctgcaatttggtgttgctgggttcttggttttcaagagaaggcagctcttgaaagttaatggcacatacgaggcttgctcttcttcttcatgaaatcaccgccaagtttttgggtctgcaattcaattcattttagggagttcttttattggattgagaaaaaagagttatctgctgagcttagaaagggattacgtttattttggatatgggtccttgttgagatcttctgtaatgggtagttcttttattgacttttttcttta

SEQ ID NO: 19801 - DNA, 494 bp, Gossypium hirsutum
  Clone ID: uC-gsflnu33B109a04b1
ttgttaccaaacaacataggtctggtcaattcaatcctcctttgatctattcaaccatactgttgtgcttcattagcaaatacgccgatgagttggctaaaaacgctgcttacattggcacccctggaaagggtatacttgctgctgatgaatccaccggcaccataggcaagcgtctttcaagcattaatgtaaaaaatattgaagaaaacaggcgtgctctccgtgagctcctcttcactgcttcaggagctcttaagtaccttaatggtgatattctcttcgaggaaaccctttataaaaaaacccgtgtgggcaagccattcgttgatgttttgaatgaaggtggagatctccctggcatcaaagaagacaagggtaccgttgagattaatggaaccaatggcgagacttttacccagggtctggatgggcttgcacagcgatgccagatgtactatgaagctggtgctcgctttgctaaatggcgtgct

SEQ ID NO: 19802 - DNA, 487 bp, Gossypium hirsutum
  Clone ID: uC-gsflnu33B109a11b1
ttttccacgcgtccggctgattgagcttaagaagacatttccttagagcatactagaaaagttacgaacatgccgggtgtcactcctgaaactgagttccgagccattgagtttcgtttatcggattagaagcgaggaactgaaggatggaacctgatgtgcaagagggttcaagaggcttgtgagactttcggactgtttcgaggaggtatatgaaaaggtctcgactaaactccgagaggatgcgtttgggttgatgaaagaaatggttgagctcccagtggtgacgaaacagaagaataatagtcccatgccttaccatggttgggatggaccatgcaagcaggtttctgtgttgtatgaaggctttggagttggagatgcctccaactatgactctgctaaaagttttgctcaacttatgtggcctaatggacacccacacttttttgacactgttcataccctagggacacaaatggaggag

SEQ ID NO: 19803 - DNA, 425 bp, Gossypium hirsutum
  Clone ID: uC-gsflnu33B109b03b1
cgtacgcccccgatcttagaccgacagcttagcgctaaggctcgccgtaactggctcggcatcggtgagccacaaggaggggtggataaagggcggaacggctcgacttccggttaccactcatcggccgcggctgttgcttggtaagcgctcgtggcctctgtccttgtctcagacggagaggtaagacgtagaccgaagccttgccaccgatcgtgcacagattggggaggcagaggactacagacactcttaaacgagctgcgatggcagcatcagctgggaggctggctgaaagattaggattgcggcatacttcactgaagccatgactgacttcagaggcaaagacttgcggatattgaagcaagaaaactgatgagctcagggactaaagcgaaaaacgcgatacatgacctgaatgt

SEQ ID NO: 19804 - DNA, 275 bp, Gossypium hirsutum
  Clone ID: uC-gsflnu33B109c03b1
ctcacgcgtccgcccacgcgttcgtaaaaaggaacattttaaaaaaaatgggaaaaaatataaaattggtgagagattcttgaatgtatctaatctaattctgggtgttgttcttgtttaggatttgggtggggtcccctcttattgttgccccgtttttttctttgggtggctcgttattggtgttctgtggcgttgcgtttgttctcttcatgggggtgaattccctttttccccccatggtgtttttctggagggcttcttccccttttgct

SEQ ID NO: 19805 - DNA, 435 bp, Gossypium hirsutum
  Clone ID: uC-gsflnu33B109c09b1
tctgtccacgcgtccgcccacgcgtacgtccacgcgtccgggggaagatgaggatgaggatgatgatgaagatgatagcatgagtgcagacatcgcggcaaacatgatggtggatgtaccaaactctcagtcaagtttgaatccagtcagtatgctgacagatgagccaaagcaaaaccagacagctgaagctgaagacggttgggttgtagtctcatcccggaaaaacaaaggtagaaggaattaagtcgtaatttttgttacccctgttccctattcctggtatatacatcttttctcaagacatttttggtgctctaattatttctgtttgtaacttttttttaaaatcttatatcgaaagaaggatactgtactggaatgttactggattgaaatagatatgattttccttggattttgttttcaaataaa

SEQ ID NO: 19806 - DNA, 64 bp, Gossypium hirsutum
  Clone ID: uC-gsflnu33B109d02b1
tccacgcgtccgaaaaaaaaaaaaaaaaaaaagaaataatacaaaaaggagggataatttattc

SEQ ID NO: 19807 - DNA, 516 bp, Gossypium hirsutum
  Clone ID: uC-gsflnu33B109d07b1
caaaatgaagccactgtttcttttagtttgtgttctcttagcttcctctttctttattcccatttccgccatgcctatccaggaccagcccttgggtggtgaacgcaaaggaaatgaatgtggtcgtggaatcaaatgcataccaaagccaacgccacggtctactaagtgtaaaagaaacaatccttactgcaggcctccctgaatgtggtaaaaaataaagctatgggcctatggacgatatggatatgggtgaagttatgctagtaataaattaacaaataaacaaagtttccccccatgcttcatgacccatggcaattaccaatgaagttcttgtaatgatcatatcattactttcatgactactagtttgtatgtgttatgtttatgtttaataaattatggagtggttttatgttgaaaaatatcaagtactactttgattgtgataggtttatatgtttatgtttgaggaaattattttaaaaatgaacatcacataaaccatgattt

SEQ ID NO: 19808 - DNA, 537 bp, Gossypium hirsutum
  Clone ID: uC-gsflnu33B109f01b1
tttttgaactatgggagtctgctgagcatgaatgtggtgttgattcaaaaatcaatgacatgcaagaacgggtgtttgtaccgggggagatcattgcctgtcatcagtccagtgatctagaacctgaaaacgagagttctttgggagcattggtggagaaagagttgagcattgataagttagagatatctaccagcattagagaaccaaagaaacgagctaaaaaccgaaaggtcttagacagacttgcttctgatgctcataaattgatggctcttcaaacctctgtcaaacaactgaaaaagagaatggaaatcaagaagaggaagaaggcgttcgatttagaatacggacaagtcaaagaacaattgcaagaggtggaggatgcaatcaaggagttgtgcaacgtcaatggtgaattgaccaaagatgtcgaagggagttcttcatctttagacgggacaaactcaaaggaattggaaggacctggaaagagcaacttgaaaaaggtacgtgagcaggcaacaaaagggtctg

SEQ ID NO: 19809 - DNA, 519 bp, Gossypium hirsutum
  Clone ID: uC-gsflnu33B109f08b1
tgcaggcaccgattagtatgtagttgagagaaagcttcacatagggagcttcattgtcattgtgtcttacatttttgtttttggttcagtgtgtacattgatggaataagtaggaactttagatgagatgtttggagggtgaattttcaaattagggctaatttttagcgatgcttatagctcttgttaaagacatttatgtatcagatatgccaccctatacatagagactcctataatctaattttatatgtttatgtctggactagtatctactgtctagttagttttttttaactttgtagccgcattgaaaattcaacatgtacttatataatatttgaaaagggcctctgctagcgggggatatgattaattatccattcaagattatgtttaaacctgcattggaagatcttacttgtggaactgttactttttttaaattttttttatcgagaaacacagtgttcctccaatttaacgttttacttatatttatatttaaataaggttttt

SEQ ID NO: 19810 - DNA, 520 bp, Gossypium hirsutum
  Clone ID: uC-gsflnu33B109g01b1
ttttgtgttggctagtaacagtgagcctttgtttaacctgtttgggttcttggtttgtgttggttctactgctggtcgtgctttaaagtctgtagttcaagggatcttgttaactagtgaagctgagaagctacattccatgaacttgctgctgtatatggctcctatggcagcaatgattttgttaccgtttactctatatattgaaggaaatgttgcaagaatcacacttgagaaagccaagactgattctttcattgttttcttgttggttgggaatgctacggtggcttatttggtgaacttaacaaattttttggttaccaaacatacgagtgcccttactttgcaggttttgggcaatgccaaagccgcgttagcagcgatcgtgtcggttatgatcttcaagaatccggtgaccgtgatggggatggctggattcgctgttacaataatgggagttgtgctttacagcgaagcaaagaaaagatcttaggtcactacacactgacaataaggt

SEQ ID NO: 19811 - DNA, 482 bp, Gossypium hirsutum
  Clone ID: uC-gsflnu33B109g02b1
tttacgcgttcgcccacgcgtccgtttcctcctagcccaaaaaaaaaaaaccctctttcctttctctcgttctttttcccgttcaatcatgtcttgcttcattagcaaatatgccgatgagttggctaaaaacgctgcttacattggaacccctggaaagggtatccttgctgctgatgaatccactggcaccatcggcaagcgtctttcaagcattaatgtagagaatgttgaagataacaggcgtgctctccgtgagctcctattcacaactccaggagctcttcagtacctcagtggtgttattctctttgaggaaaccctttatcaaaaaaccgcttcgggcaagcccttcgttgatgttttgaaggaaggtggtgtcctccctggcatcaaggtcgaccagggtacccgtgagcttaacggaaccaatggcgaaactttcaccccaggtctagatggccttgcacagcgatgccaga

SEQ ID NO: 19812 - DNA, 311 bp, Gossypium hirsutum
  Clone ID: uC-gsflnu33B109g03b1
tttggctgcgggcgttatacgcggtccatggttactgtcctacgcatgcagccaaccttttgaattttagtgttatcaaccccatagctactgagggccttattgcatgtggcagaccggcacctccagggcgccactgaccagcacagtgatgaaacacatacaaaccccatgtgttggtttaattttcgaagaggcacatatcgaccggccttaccatcagttgctcagaatgaatgatggagggtacgcgccctatgacgatccttaaaacgcggctgaggtgggggtttctgcactagatgaccgtt

SEQ ID NO: 19813 - DNA, 523 bp, Gossypium hirsutum
  Clone ID: uC-gsflnu33B109g05b1
tctttttgccatgggaagaattgctcagggaacaaaggttttagcagaaggtgggtatgagaaaatttttagacaaacttttgagacggtacctgaagagcaacttcaaaattcttttgcatgttacttgtccacatcggctggtcctgtcatgggagttttatatgtatctacagcaaagcttgcgtattgcagtgacagtcctctttcctatcaaaatggtagcaagactgaatggagctactacaaggtagttatcccattacatcaacttaaagcaattaatccttcaacaagcagagtcaatccttctgaaaagtacattcaaattagctctgttgatagtcatgaattttggttcatgggctttttaaattacgagggtgcagttcaatgcctacaggaagctttgcaacagcatagcttacaatctgtgtgataatgatttgaccagtatatcggttgaacatgttgtcaatgcaagcatttggtctgctgcttgaggcatttgatggtaaatgct

SEQ ID NO: 19814 - DNA, 504 bp, Gossypium hirsutum
  Clone ID: uC-gsflnu33B109g06b1
ttttactctgtttttcatcttctcgctcctctcaacagccgcagttgtttacaccatcgcctgcatatacacagctcgggaactcaccttcaacaaagtcatcagcgtcgttcccaaggtctggaagcggctgatggttactttcttatgtattttcatcgccatgtttttataccacgtcgcagcattggctatcttgattggttgcgtagtttcaatcggaggaagcaatttgggcttcgcggtgttcgttgttctagcgattttgtactcagtggggttttttgtatttgacccgaatctggcacttggtcagcgccgtctttgtattagaaaaggcctacggtttcaacgccatggtcaaaggtaaaaacctgctaaaagggaatctatggctggcgatggtatttttctgacgttggaattgcgtcgccatatccagtttgctttcaaatctggggtggaggaagcgctccggatggctatagattggttgcaatattt

SEQ ID NO: 19815 - DNA, 289 bp, Gossypium hirsutum
  Clone ID: uC-gsflnu33B109g09b1
tttgtaagatcgtggactcaaggtagcagtgggtctgattcagtccttccgccccccttgactcgcaacacgagaacaagaacgagcgtgaacattgcatgacaatcggaagagccacccgagcctagctcccggagtgatttcccaaagtattcccgctggttcgtccttagcggcggaggccacgaaacccatgcacggaacagaagtagtcactgggacagcatgacatagacgcaagaccctactttgagtgctaaaggcaccaagcccctgtatgaaccgaact

SEQ ID NO: 19816 - DNA, 527 bp, Gossypium hirsutum
  Clone ID: uC-gsflnu33B109g10b1
tcgggcaaatatgaatttccttttcagaaggaggacattgttccttttgatcctaaatcagtatgggaagcaatggaggagtgtcaaggtcttggcctaacgaaatctataggagtaagcaatttctcatgcaagaaactcgaaaccattctttccactgccaaaatccctcctgcagtgaaccaagtggagatgaacccactgtggcaacaaaagaaactgaggaagttttgcgaggagaagggcatacttgtggaggcttactctcctttgggggccaaaggaacggcgtggggaacaaatcgggtgatggaatgtgaggtactcaaagaaattgcccatgccaagggaaaatcgcttgctcaggtttgtttgagatgggcacatgaacaaggagtgtgtgcgcttgtgaagagcttcaacaaggaaaggatgaaacaaaaccttgatattctttattggaagctcactgctgatgagtcgcataaaataagccaacttccacagtgcaaagggttttcaggtgc

SEQ ID NO: 19817 - DNA, 538 bp, Gossypium hirsutum
  Clone ID: uC-gsflnu33B109h01b1
ggaaaacaatctaagatcccaagcaaaacccgatatccttagccttttaaattcattcattcattcattcacttcctctagtttcgtttccgtccaacgtaactaccacgccgaccgtcgtaaccaccgccgtaaattctcccaaaatggcgaaactacccttacagatcctcctcctcttcctcctttccctcatttcctcctccaccgcagagatcaaaaccctaaccatcaccttcgactctcgccccatgatcctcttcgagaaattcggcttcacccactccggtcacatcgccatctccgtctcctccgtctcggtcacttcctccgccaatgcccccaatcccgacgcttcccgcctcggcttcttcctcttatccgaggaagctctccttcaagtcctcctcgagattcaacagaatccttacttttgcgtcctcgattctcgctacatccagcatcttttcaccttcggggacctctccccaccttcccctttgcgtttcaccacacttaccctgttttttacccaatg

SEQ ID NO: 19818 - DNA, 518 bp, Gossypium hirsutum
  Clone ID: uC-gsflnu33B109h06b1
tttttggtttctactctccaaaacatcatgcctcagggaaagcttcaagttgtccttgttagtgccaaaggtctcgagaacacagattttctctgtaacatggatccttacgtgcttcttacttgccgaacccaggagcagaaaagcagtgttgcatcaggaaaaggatcagaaccagaatggaacgaggatttcatattcaacatctccgaaggtgcttcggaactcgcactgaaaataatggacagtgatgctggttctcaggatgatttcgtgggagaagtagctataccactggagcctgtatttattgaaagaaacatttcccctgactccatatactgttgtcaaggatggagaatatcgtggggagattaaatttggtctcactttcacccccgaggaacgtgaaagcagggattttgaagttgaagaatcttttggagggtggaagcagtcttcatacactgattagggaggccacttatagttttcagccttaacttcctgtttcaaga

SEQ ID NO: 19819 - DNA, 440 bp, Gossypium hirsutum
  Clone ID: uC-gsflnu33B109h07b1
tccacgcgtccgaacggctgcagtctgtatttacggcatgcatctctctacacgtcgaagccagtctctttcacttccacgatctcagcacatacccaaggtttttaagcgtctttctataaccttgacatgggttgctctcttgatgtttgtttacaatgccttgtggatcggttggctggtcttgtttgtcattgccgttgattcccggaatgcctagttgtccttcttctcttttatggtgatcttggtgctgtttttgggcgttcatgtttacatgacggcgctgtggcatttggccagtgtggtgtcggtgcttgagccgatttacggccttgcagctatgaagaagagctactagttgttgaaagggagggcgaggatggctttcattttggtttttggatatttggcaaattgcggcgtgattgggggtattt

SEQ ID NO: 19820 - DNA, 522 bp, Gossypium hirsutum
  Clone ID: uC-gsflnu33B109h10b1
ttccacgcgtccggtctattgaattctttccttcactttctcgagaaaaaaaaatgtcttcaggttgcaattgcggatctagctgcagctgcggcgacagctgctcatgcagcaggaaccttaaccttggatactcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagcaaaataacaggcctctgtaatgatttattttcaaggatgaatgcctgcaaggtctatgactataattatgtctctgtctgagtcttgtgtaatagaagctctgtttgtggtgaaaataatgtataagccagttggttgggagcaaattttcttttgtccaaaggattttttgctgctcattcatggtgactgggtttat

SEQ ID NO: 19821 - DNA, 342 bp, Gossypium hirsutum
  Clone ID: uC-gsflnu33B110a03b1
ttattgggtctcgaaagatgctccattgcagaggatggtaggtatggtgttactgaattgtagtatattatacaagcatttcattgatttgagtacttaatagtgttacagcattttcacactgagggagtgcgtatgatgtgatccacttcgtggttgaaacccctaaaacctgaattcttttgttgtgtttgtaaatcagctgaccatacatcagtaattgctgcagggttaggagctccttttcttattgattaggaacatacttgaggtgttcgaagaacacatggtggctgtggttgaaccttttgggagattggcgtggacagatgatagatatgc

SEQ ID NO: 19822 - DNA, 500 bp, Gossypium hirsutum
  Clone ID: uC-gsflnu33B110a07b1
ttttctctcccaagcttccccactccttctctgctccctttctccctttccctcaaaccagacgatccatttccctttacacacgccccatgaacatccccaaaaatctaggcttcggagccaacaacaagcctgccccgtccatggagggttcctccatcgctcagggtccagacgacgacgtccctgctcctggtcaacagtttgcacagttcggcgcgggttgcttttggggtgttgaattggccttccagagagttccaggggtgaccaaaacggaggtggggtatagccaagggtttatgcataatcctagctatgaagacgtgtgtacggggtccaccaaccataatgaagttgtgagggttcagtatgaccctaaagagtgtagctttgacactttgcttgaagtattctgggctcgccatgatcctactacccttaaccggcaggggaatgatgtgggaacccagatagatctgggattacttttacacacc

SEQ ID NO: 19823 - DNA, 385 bp, Gossypium hirsutum
  Clone ID: uC-gsflnu33B110a08b1
tttgtttcatacactcaaagggcacgtcgagtccgtggtgaaactcaaggggctggatatcgatacgatccagcagcattatactgtttagaacactggaaaccgacgccggaaaaacgaaaggatggcagttcattgacatttacagatgatgaagagaaaaaaagtaatttagttttcaaaaaaagaacattttaacatgtctatggtttaatttgccaatcatgtaatgttctgtgttttacagtttcttgcttttcaatcgagcactcaagcttggtgtcttttcccattttcaaaaaaaacaaaaaaaaaaaaaaaaaaacaaaaagaacagaaaacacaaaaattaatgaaaaataagagggttcaatatgacccaaaa

SEQ ID NO: 19824 - DNA, 104 bp, Gossypium hirsutum
  Clone ID: uC-gsflnu33B110b01b1
tgtggcacggtttggtataatcatcaattattgttgaaatgtttaaaaaaaaaaaaaaaaaaaaaaaaaaaaaaaaaaaaaaaaaaaaacaataaaaaaagaac

SEQ ID NO: 19825 - DNA, 169 bp, Gossypium hirsutum
  Clone ID: uC-gsflnu33B110b03b1
tgtgatgatgaagacgcgatatgagtaactaatatgggtataactcgatcatgagaacttcaagattgatcatggatcattccttaatgccgtctgttgagaatttcagaagccactgacatgtcatttaaatacagagtttactgatataagcgaatctaatgatgta

SEQ ID NO: 19826 - DNA, 281 bp, Gossypium hirsutum
  Clone ID: uC-gsflnu33B110b05b1
tctacgcgtactgacaagaaagcattgaaaaaggcagtagcgaatcaaccggagagcgatgccatggaggcctgaggaaggagtttacagctatctgaatctggcctattcgatggagaatgtgaaacacaactagaccacagtgtaactgctgcgggatatggcacagaaaaaggtcaagactattggattgttaagaactcatgtggtagcagttgaggagaagcaggctatctcaggagggcaaggaatgttggcaataccgtgactggcatatgtgg

SEQ ID NO: 19827 - DNA, 282 bp, Gossypium hirsutum
  Clone ID: uC-gsflnu33B110b06b1
ttcacgcgtccggaaacgcgaaggtccagggaggctttagaagggccaccagatacaaactccaagcccagctgaggaggcagccaacgaccatgagcacaggaccatttgagcactgagttccattaaggacctggtggttgataagttgctccgaactatagtgcaaaacgctggcagcaacagcgattgtactccttacaagtaaggaggcggtagagtgtgaccaactagttcgtcggggctcgactgctgatagcatctcaaggtcatggtttttgg

SEQ ID NO: 19828 - DNA, 499 bp, Gossypium hirsutum
  Clone ID: uC-gsflnu33B110b09b1
ttagaaaagaaaaattacagtgaaaatggcaacccttaaagttccagctcatgtacctgccccttctgaggatgctgagcaacttcgtaaagcttttgaaggatggggtacaaatgagcaattgattatcgacattttggctcacaggaatgcagctcagcgcaatttgattcgtaaaacttatcgtgaagcttatggggaagatctccttaagtctttggatgaggaactttcaagtgactttgagcgagctgtggtgctgtttactttggaccctgcagagcgtgatgcatttctggctcatgaagctacaaagaggttcacatcaagccattgggttctcatggaaattgcttgcactaggtcttcacatgaactgttcaatgtgaggaaggcgtatcacgatctttacaagaaatcccttgaagaagatgttgcgcaccataccaagggagactaccgcaagctcttggtcccacttgttagtgcattccgatac

SEQ ID NO: 19829 - DNA, 200 bp, Gossypium hirsutum
  Clone ID: uC-gsflnu33B110b12b1
taatttacactcaagtttgtatccgcccgcggtttataatagaatctgaggcttcatgatgggattttatcgaacctggaaatgtgataacttgatagctctagcatatgtataattgggagactttacgctgacattttgaaatatacagcttattgtgcctggaatttctattaaaaataaaaaaaaaaaataatatt

SEQ ID NO: 19830 - DNA, 396 bp, Gossypium hirsutum
  Clone ID: uC-gsflnu33B110c02b1
tttttatggactccgcgaagaaaaccgccaagaagtcacgcgtcaagtgcttcatcaagctcgtcaattaccagcacctgatgcccacgcgctacaccctcgatgtggacttgaaagacgtggttaccgtcgatgctctccagaccaaggacaagaaagtggccgcttgtaaggcaactaaggagaggtttgaagagaggttcaagactgggaaaaacaggtggttctttactaagctcaggttttaagtgttttattggaacatgttttatgcttatgtagttttatcgaacaattttgaatttaatgacgggttttgaatctgtttggataagatatttctgggttgctttaaaaaaaaaataattcatctttcatttctatgttcaatcaaat

SEQ ID NO: 19831 - DNA, 289 bp, Gossypium hirsutum
  Clone ID: uC-gsflnu33B110c04b1
taataaacaaaaaaaaaaaaaaaaaaaaagggggaaaattaaaaaaaaaaaaagaaaaaaacaaacaaaaatcccaaaaacggggggccccctttgggggacccaggttttcgcccgcggccatggaacgtccaagtttcttcatggggtcaccaaatttcaattccctggccgcggttttccaccgtggggcctgggaaaccccgggggttccccatcttatttgtcttgcggcacatccccttttggccgggtggtgtattagcgaaggggccggaacggattgcct

SEQ ID NO: 19832 - DNA, 239 bp, Gossypium hirsutum
  Clone ID: uC-gsflnu33B110c07b1
tgccacgcgtccgaagacccgaagggcgggggacctgttaggggtgctccgatatttccaccccaagcccatctaagttggctgttagggagcatgggctcatgatcactacagtacagtgttacattaaggagcaggtggtttgaaagttactaggaactatagagcataatcctgacagcagcacaaagggtatgtctctaaagaaggaggcgggagcgggtgaccaaaaagtggat

SEQ ID NO: 19833 - DNA, 509 bp, Gossypium hirsutum
  Clone ID: uC-gsflnu33B110c09b1
ttcaagcgtatgtcgatgatcacttgatgtgtgatatcgagggcaaccatctctctgccgccgctatcattggccaagacggcagcgtttgggcccagagctccaatttccctcagttcaagccagaagaaatcactggcatcatgaatgactttgctgaacctggatcgcttgctccgactggattgtaccttggtggcacaaaatacatggtgatccaaggtgaacccggagctgttattcgagggaaaaagggccccggaggtgttactgttaaaaagaccaacctggccttgatcattgggatctatgacgagccaatgactccaggccagtgcaacatgattgtggaaaggcttggtgattatctcatagaccagggtctttgatcactttggtgtaaccttaattgttgcaattcttcctggcttcttctatacaaaagtgcatctaccaccacctcttgtaatggttggctgcaattaaataatagtattactagtattaaa

SEQ ID NO: 19834 - DNA, 515 bp, Gossypium hirsutum
  Clone ID: uC-gsflnu33B110c10b1
tgttgctgttgtcatggcttctctgccttgcatcttcttcttatctttctttataatctccacaacattgacgtcagccggcgccgccgccgccaccatcaaactctccctctatcccttccctcacccttcttcctcccatccttaccaaattctcaacaacttagtcacttcttctgttgcaagagcccaccacctcaaacatcccaaagccaaggccgataatactacctcttctcttctcagggctcccctattttctcacagttatgggggctacactatctccctcaaatttggaactccgcctcaaacccttcctttcgtcatggacaccgggagcagcctctcctggttcccttgcacctctcgatacctttgttcccaatgcgcattccccaatgttgaccctgcaaaaatccccacttttgcccctaaactttcatcttccagtcagctcgcaggttggagaaaccccaagtgtagttggctctttggccccgacgttgagtctc

SEQ ID NO: 19835 - DNA, 378 bp, Gossypium hirsutum
  Clone ID: uC-gsflnu33B110d09b1
tttataatctcgaagcttccttttccgttttagatctcaaaattcaaaaggctctctttttcatctcatggctgctactattgtctccgtcaaagctaggcagatcttcgacagccgtggaaatcctacggttgaggttgatgtggaaatatcgaacggtataaaggctagggccgcagttcctagcggtgcatccactggaatttacgaggctcttgagttgagagatggaggttccgattacctcggtaaaggtgtatcgaaggctgttgctaatgttaacacaatcatcggccctgcattgattggaaaggacccaaccgagcagactgcaattgacaatttcatggttcaacaactggatggaacccaacatga

SEQ ID NO: 19836 - DNA, 404 bp, Gossypium hirsutum
  Clone ID: uC-gsflnu33B110e03b1
tggtctggtacacggatcgtgatgaacacgaggtggttattgaaggcactcttctgaatcctaacatgtctacctctggatccgcctcccaagaggacgcgttccaggttatggctgcttacaatgcaccagccatgcatgaagccgtcccggctgaagaacatggtattgtgctctcgactgatgaacaaagcgaggaaggtgcatcccataaccttaaagtcaagaacaacgctgcatgccaataaaccatggccacattgacggatatcttgttgtgcccctctgcaaacacctataaggtctgtgtttgaaaggatgaaaacctaaagaaagcacaccttgctttgaatgataggagcaaggtctacttcttggccactttcattcttacaaagttgaca

SEQ ID NO: 19837 - DNA, 166 bp, Gossypium hirsutum
  Clone ID: uC-gsflnu33B110e07b1
tgccacgcgtgcgataacgccaaggttgggggatacttcaggtgggttactatattttactccaaagcccatctcagttcgctgccaacgagtattgtctcatgactattagagcactgcctttcactaaggaccatttggttgctcatttgttacgaaccatatt

SEQ ID NO: 19838 - DNA, 482 bp, Gossypium hirsutum
  Clone ID: uC-gsflnu33B110e12b1
tttggttcccttgctgggtatttggggagctgctggatatgccccattattggtactaaggtaatataggtcaaggcaatttatacttgcgacccaagggatagctgattatgaatttttgtacaaggatgatggttatagaaagaatattcaagagatgtctagtgcgtgaaaacagactcgccgaatgaagaggctagctgtgggtcctatgacaactcctgagtatcatgaatggtgggctaggaggattaatgataatacacctaagttaaatcaggaagacagccagtcaatagaagagtatttgtgaatcattccttctgagttggaaatcataaagcaagattttgagaggagaaatgcggatttggagaaaaagatagagcaaatggaggcggaaagtagttaataagggagataaagttccagcgaagacaatttgctttctttcatacttctcttatcaagaaagttagaag

SEQ ID NO: 19839 - DNA, 378 bp, Gossypium hirsutum
  Clone ID: uC-gsflnu33B110f08b1
tgataccctccatttctctctgccaccagcggcacccaaagatgcaaatcttcgtcaaaaccctaacggggaagaccataaccctagaggttgagtcttccgacaccatcgacaatgtcaaagccaagatccaagacaaggaaggcatcccacccgaccaacagcgcctcatctttgccggaaagcagcttgaggacggccgcaccttagccgactacaacatccagaaggaatccaccctccatctcgtgctccgtcttaggggaggcgctaagaagagaaagaagatgacctacaccatgcccaagatgatcaagcacaagatgatgatggtctagctcgttgcgcttcagttctacaaggcggatgaatctgttt

SEQ ID NO: 19840 - DNA, 519 bp, Gossypium hirsutum
  unsure (1)..(519): unsure at all n locations
  Clone ID: uC-gsflnu33B110f11b1
ttccacgcgtccgcccacgcgtccgtctaacttgggcattggatcccaaaaccggtgctagccttccaacatctactcggacagtgaaggctttaactgaggtcgaagcttttgccctcatagctgaggaattaaaatttgttgccggtcaattcaggcgtcttcacagtagacaggtacaacatacattccgttttcattcacagcagtggagaacctgggcagcttgctttatccaagctgcttggcggcgttattccaagaggaagatcatggaggagcttcgtcgtaaggaagaagaagaggaagcagcagcagcaggatcagatggaacccgcaataacagcggtggaggttcatacagcatcggtgctactttcttagcttccaagtttgctgcaaacgcacttcgtggcattcatcggaaccggaacgctaagagcgcaaaggagttggtgaaactacaaaagcctncggaacctgattttactgctgaagacggagattgatatgtaatcc

SEQ ID NO: 19841 - DNA, 74 bp, Gossypium hirsutum
  Clone ID: uC-gsflnu33B110g03b1
tctacgcgtgcggccacgcggagggccacgggggcgacttaaaggatattatgtattccttcgtggccatgttt

SEQ ID NO: 19842 - DNA, 184 bp, Gossypium hirsutum
  Clone ID: uC-gsflnu33B110g04b1
tgctacgcctacgataacgccgagggtcgggggggaaataggatggctactagcggctaacccaagagacaagtatgctgatcttcagtgagcaagggcgcatgggcactagtccgttacgatccaccaatggcatatttttttaacataagcaacgatccctttaatagaagttggacatggg

SEQ ID NO: 19843 - DNA, 187 bp, Gossypium hirsutum
  Clone ID: uC-gsflnu33B110g05b1
gtctcgcgtgcgaataagcggagaactagcgaggggtttgacgggatactaggtttttacaccaaagcacaggtaagttggcttcgggcgagaaagggcgactgggcccatgaaccaactccgaatgtggccgataagtatttaccgacatgaccggatgaattcagaaaataacagggccaaaatg

SEQ ID NO: 19844 - DNA, 235 bp, Gossypium hirsutum
  Clone ID: uC-gsflnu33B110g07b1
ttcttcacgcgtgcgataacccgaagtgcgggggatattacagggcggttcctacttttctaaccaaagcccatctctgttggctggcagtgggcaggagtgcatgcctactacagcactgcctttcattaaggacctggtggtttgaaagatgcttggaaccatagtgcataactttgacagctccaacaagggtatgtcgtatacaaaggtgaagttagcgggtgacgctata

SEQ ID NO: 19845 - DNA, 389 bp, Gossypium hirsutum
  Clone ID: uC-gsflnu33B110h06b1
tcgtccacgcgtgcggagacgcggagggactggggcacgacagagggcctcatacgtttacagccggaacggattcctgaaagaacagtgttaatattatgaaaggagaactggatcggtgagatgctctaatggacgaaagggaaaccatttggaatgaggcagatggcaaaccgatgacttccacagtcagacttaaacacactcacactcagctgatatccagtcacaaattttgcatcgagatcgtctgattatgcatagctcagggaattgctgcctatctatacaatgtagtgaagaaatgaagctataaaaggatggaatcgatccgatcctttaaggtctgtaagaaaatctagcattgacgtccatcttgaggttttgct

SEQ ID NO: 19846 - DNA, 525 bp, Gossypium hirsutum
  Clone ID: uC-gsflnu33B110h09b1
tcttccacgcgtccggacattttttaataacggtccttgaatctccaaatataccacatgcatggaggctcaatgaaatccctaatcttactacttctaatccggcatatgcctccgccgcaaacggtgaggcaacatttgagtgaatgaccaactttaacgccaaaatttcccctcgcctatctctaaccaccagccctgtggcagatttggaagaatactggtcaaaagccgtattgaagtgaatgcttacgtttgtccttcggtcatcgtgattatgaagtctgcctgattcacagatacatagttttccctctaacccatgcacttctgagttatagcttattatttgtcttgaaatgtctctgttgtttgagattttattttcataaataaatttgtttctgtttgaccagagaagctagagccaacagcagaaaaggcgacatactcatttgtcccctgagtaaagacccatgacactgtcgaaaaacatgggtgctatcttcctctggttggttgcat

SEQ ID NO: 19847 - DNA, 334 bp, Gossypium hirsutum
  Clone ID: uC-gsflnu33B111a02b1
gtttcacattcgtttaaagacgttactaatatggtcaggggactagaacaataagacatgtgtttggaccgttcctcacatcttccacgatgttctaggatggattcggtatgactggaacagttgtagggcatagctacacgagataccggattttggtaatgggggagtcgaactatggatggggccatgcagatatatggccttctttggtccttgggcgctcacaacctatggagattgagtatccaccgccgtgtgagctccataccgaggctggcgtgcgtggctcgcagagaggcgttctgatgatcatacgctgacgatggtgtga

SEQ ID NO: 19848 - DNA, 519 bp, Gossypium hirsutum
  Clone ID: uC-gsflnu33B111a08b1
ttcacgcgtccggggccgcctcaaccgattgccatcggcttgtgttggagacatggtgatggctactgtcaagaaaggaaagcctgatctaaggaagaaggtcttgcctgccgtcattgtgaggcaacgtaagccttggcgccgaaaggacggtgtttacatgtactttgaagataatgctggtgtcattgtgaatccgaagggagaaatgaaaggttctgccattactggtccaattgggaaggagtgtgctgatctgtggccaagaattgcaagtgcagcaaatgccattgtttagggatttgaatttttctagagatttttgtttccttgagtcatggtttttgctggatcaagattttgttatatgtgtttttttaggggttcttgaaaaatatcgtatggatagctctgatttggattttgatactggaatgtagttaatggattgttctcccatgtttaagcttattatttcctttttctttgaagatcttgctgatcttagccatatttatc

SEQ ID NO: 19849 - DNA, 414 bp, Gossypium hirsutum
  Clone ID: uC-gsflnu33B111b08b1
ttcggctgtgcataagggtgaacttgcttgcgaggacttagatgttggcatcatagttgaagcaatgaagaaaccttcatgtaaaaaaggtttcattctagatggatctgcgaggactgttggccatgcacagaggctcgatgacatgcttggaaagcaaggagtcacaattgttaaggcgcttgattttgcgattgatgatgcagtattggaggagcggatcactggtcgttggatccaccctgctagcggtgggacctatcatacgaaatctgcacctgctaaagatgctggtcttgatgatgtgaccggggaacctttggtgcagcgaaaagatgatactgcagtagctctcatgtcaaggcttgatgcatttcacatgcaaacccaaccggtgattgattattattccga

SEQ ID NO: 19850 - DNA, 489 bp, Gossypium hirsutum
  Clone ID: uC-gsflnu33B111b11b1
tgttttcgcgtccgcagttccttgttaccttcaaaaaaaaaaaaaaaaatgaaagcgtctttgaaaggaaggtacgccaatgaaaagaacaccgcgggcgctacattggtcgtcaacgccggcgatgttaagctacgcgcttccatgagtgacgccactttcgtcgacggtcctagcctcaacggcttgactttagccgttgaaaaacccggttttttcatcgtcgactatgacgtccccaaaaaggattttcggtttcagtttatgaacacagttagggttgcggagatgccgttggagcttacttacagtcacagcagaggggataaccggacggcagtggagggggcgtttatgttcgattcggctaacacggtctcggctaattacgtgcttggtactaggaactgtaagttgaagtacagttacgtgcacggtggggataccaccttcgagcaatgctatgattgggggaaaatggcatgggat

SEQ ID NO: 19851 - DNA, 542 bp, Gossypium hirsutum
  Clone ID: uC-gsflnu33B111c03b1
tgtaagcattataatggcattctctagcaaacttggaagcctttttaggcaaaatgggcaaaccccaatgatatcttcgatgcttaattcacttcgttgcatgtcgacatcaaccaagaagcttttcattggaggtctttcatatggaactgatgaccaaagtctcagggaagcattctctggattcggtgacgttactgaagctcgggttatcgccgatagagacactgggaggtccaggggcttcggttttgttaactttgctgacgatgaatctgccagcaatgccttgtcagccatggatggacaagaactccaagggagaaatattcgagtaagttatgccaatgaaagacctagcggccctcgttcatttggcaacaatggtggtttcggtggcagtagaggctttggtggtggatccagagaagattcaagtttctaggctccagtattattatctgtccgtggacatgcgtccatagctaataggcatttagttttgagaatgtgttcatttggtttcaaggatttgcttgact

SEQ ID NO: 19852 - DNA, 374 bp, Gossypium hirsutum
  Clone ID: uC-gsflnu33B111c05b1
cttttgcgtccgcccacgcgtccgcccacgcgtgcgcccacgcgtccgcccacgcgttcgcccacgcgtccgcccacgcgtccgtgaaataataaattattattttctaaaaaaaaaaaatgaaaaaaaaaaagaaaaaaaaaaaaaaaaagaaaaaaaaaaaaaagggaacaaaaaaaaaaaaaaaaaaaaaaaaaaacaaagaaataaggggggacgcttttaggggatccaggtttaaaaccgcgggattgcaagactataatatttatatggggcaacttaaaataaattaatgggccgtgttttaaaagggttgaacgggaaaaacctgggggtaaccaaacttaatcgtttggaagaaaatccctttt

SEQ ID NO: 19853 - DNA, 543 bp, Gossypium hirsutum
  Clone ID: uC-gsflnu33B111d04b1
ttcacgcgtccgggaaagcatttcttgtcaaatattcgaactttccgggatcaaatgttgcaagggcagggagctagacatgtatattcttctgatagattgtggcgaggtagcccgctgagagcctacagtgatagaaatgactttttatcaaaggaaatgcagcagaatattccaggcggctacaatatggattctttatggctaattgatgctaatcaaaagaatcacccatatcttctagattggtactatacctctcgagcgcaacagatgcctagttatagaagagacactgcagcaaggccatttgaaccagctgaggaacagcataagaattactggggtccgatcaacacaacgcatgatgaagcaagagataaagaataccggccacggcttaaaatgtcttaagcccttattgattgattgattgaacatttcaaactatcctattcctatgaactgtagaattcttggatgattgtgatttacttcctgtgttggtaactaaaaacggaagatgatttcttatgatatttc

SEQ ID NO: 19854 - DNA, 543 bp, Gossypium hirsutum
  Clone ID: uC-gsflnu33B111d08b1
gtagttgattgcatatgcacgttccaacaataaggttgttattggcccatctaccgtcggaggaattcaggctggagcttttaagattggtgacactgctggaacaattgacaacattgttcaatgcaagctgtacaggcctggatctgttggctttgtctccaaatctggtggtatgtcaaatgaaatgtacaacacaattgcccgtgttacagatggaatctatgaaggtattgcaattggaggagatgtcttccctggctccactttatctgaccatattttgcgatttaacaatattccacaggtaaagatgatggttgtgctcggagagcttggtggacgagatgagtattccttggttgaagccctgaaacagggaaaagtgaacaagccagtggttgcttgggtcagtggaacttgtgcacgactcttcaagtcagaagtacagtttggtcatgctggagctaagagtggtggtgagatggagtctgcccaggcaaagaatcaggcactaagggatgctggagctgtagttcccac

SEQ ID NO: 19855 - DNA, 524 bp, Gossypium hirsutum
  Clone ID: uC-gsflnu33B111d09b1
ttttagagttccatgtttttcgctgccatttccaaagtcgattctactttagaaattttgatacaagtaaagtaatagaatcttaaagaagaaaaaaaagtgctaaaaaagctagcttttttttttttttctattggtccttctttactctgggttcttttttcaaagcataaaaacctaatttgtaacagagtagctgcaactatcatcacccatggcggcaccgatctgggtatgggctttttacgtagccctaactctatttccttccgtttggggaaactcagaaggcgatgctctttatactttgagaagaagcctatgggatccggataacgtgctgcagagctgggatcccacccttgttaacccttgtacttggttccacatcacttgcaatcaagataatcgagtcactagagtggatttaggtaattcaaacctatctggacatttggtaccacagctcgggaagcttgaacatttgcagtttctggagctttacaaaatgacattcaaggaac

SEQ ID NO: 19856 - DNA, 485 bp, Gossypium hirsutum
  Clone ID: uC-gsflnu33B111e04b1
gtttcatttgaagaggctcaatgcccccaggcattggatgcttgacaagcttggtggtgcttttgcacccaagccatggtctggtccccacaagtccagggaatgcttgccattgatccttattttgcgaaaccgattgaagtatgctctcacctatagagaagtcattgctattcttatgcagaggcatgttatggttgatgggaaggttaggacggataagacctatacagctggtttcatggatgttgtgtccattcctaaaacaaatgaggacttgcgcttactttacgacaccaaagggcgatttcgtgtccatgccatcactggcgatgaaaccaagttcaagctctgcgaggctcgatctgtccagtttggccagaacggtgttccatacttgaatacatatgatggtcgcactatccgttaccctgatcctttgatcaaggctaatgacaccatcgagctagaccttgaagcaacaa

SEQ ID NO: 19857 - DNA, 206 bp, Gossypium hirsutum
  Clone ID: uC-gsflnu33B111e05b1
atgcactgagctcatgccttatgatgggaatgtatggaatgacaagaaacccaatccggatccggcgacgctggacacagaggcaaggcatagaaatctccgaccttaaagtggttatgagaacataacacagagactgcccacaagccccacaacgagggccatgtgggaactggatctttcgatacttcgatgacaaaaacatt

SEQ ID NO: 19858 - DNA, 395 bp, Gossypium hirsutum
  Clone ID: uC-gsflnu33B111e06b1
gttttgtacaagatcgagagggccgcactattttggttgtttctaggaaaagcttgcttgagtagaaccacttaaacggtgaactaaagtccgaggatttatagatgtacaaaacttgcgggttgaatagaccataggggaatatgtatcataagtagagcaacagacagagcatttgtccatttgaggagcaagagtatagctgggctggatgatcgcaaaattacagaggatgtgatgactatctaaaggaaatgaaacataggcaatgaaccaagcgcctcacgcgttttggggcatctagaccactcatgttcccaacagtatacacacgaggctttgttgtgacctttacgcttctgcagattccccctgatattgagggatttgcttct

SEQ ID NO: 19859 - DNA, 526 bp, Gossypium hirsutum
  Clone ID: uC-gsflnu33B111e12b1
tttgaatctctgcaaaattcatgggcacttggaacttggggatctttgtgctgagctggtgaatcagctagatgcctctcgtttgaatgaccaatctaaagcaggtctcatacctttgaaagattcagaccttaaaaagaatgagaagaagaaattggcaagtcaaagtcctcttgaagtcagtagcagggtcaacgagtatcgggcaggagatacatcacatcctgagaatgatagaatctatgctctgcttagacgtttgaaagaacacatgaaagaagctggttatgttcccgaaacaagattttgtttgcacgatatagatcaggaaagtaaggaagaagctcttcttgctcatagtgagagacttgctcttgctaatggtctcctcaccagtccagctcgtggacagattcgtattatcaagaaccttcgtgtttgtggtgattgtcatgctgcatttaagatcatgtcaaagattggtggcagagagatcataatgcgagatgctaagaggtttcatcat

SEQ ID NO: 19860 - DNA, 479 bp, Gossypium hirsutum
  Clone ID: uC-gsflnu33B111f05b1
cgtgggcggacgcgtgggcggacgcgtgggcggacgcgtgggtttgtcagcgtttcacactttctaaaactccaatatcccaaaacaatgggttcaaccggtgaaacccaaatgactcccacccaagtcttggatgaggaagccaacttattcgccatgcaactcaccagtgcctcagtccttcccatggtcctcaagtcggccatagaacttgacctgctggagatcatggccaaagctggcccaggtgctttcctctccccaaaagaattggtttcccagctccccaccagcaaccccgatgcacctgtcatgctagaccgcattttgcgccttctggctacctactccatcctcacttgctccttgcgcactcttcctgatggcaaagtggagagactctatggtcttggccctgtctgcaaatttttgaccaagaatgaagatggcgttactctttccgccctcagtctcatgaa

SEQ ID NO: 19861 - DNA, 519 bp, Gossypium hirsutum
  unsure (1)..(519): unsure at all n locations
  Clone ID: uC-gsflnu33B111f09b1
cccacgcgtccgcccacgcgtccggttgtaacgcttcgctggaaaaataacaccggaaatcgagtttcttcaaagtgcatctcaacctggtgtgaaggtgtcctatgtattttcctagtggcatgctgtggttttgctgctggagttctttatcgttttggcactcactttatttttatgattgttgcggtggttatagccataatggcttgtgctgctctttgtttccgtcaggcttattcagatcctccagggttttcttgtccatgggttccgattgtgccatctgtttgcatctttttcaacatatacctgtttgctcagttgcactatgaagcgtggatcagattcatcatcctcagcatagtatctgtaggtatttatgcattttatggacagtatcatgctaatccccgtttagatgagacaattatttaccatatggcgcctgangaagatagacactgagcattaatgtacagtcaccaatagttattgtggngacttgtagtctatcat

SEQ ID NO: 19862 - DNA, 540 bp, Gossypium hirsutum
  unsure (1)..(540): unsure at all n locations
  Clone ID: uC-gsflnu33B111f12b1
gttgtcggttcggatgccgccgtcgatgagactcacttgcctaagttgcgctatctagatgctgcagtaaaggagaccttccgattgcacccaccgatgccactccttgtaccccgttgcccaggtgacttaagcaacgttggtggctatagcgtaccaaagggcaccagggtcttcttaaacatttggtgtattcagagggatccacagctttgggaaaatcctttagaattcaagcctgagaggttcttgactgatcatcaaaagctcgattatttaggaaacgattcccggtacatgccgtttggttccggaaggagaatgtgtgccggagtatctctcggtgaaaagatgttgtattcctccttggcggcaatgatccatgcttatgattggaatttggccgacggtgaagaaaatgacttgattggcttatttggaattatcatgaagaaaaagaagcctttaattcttgttcctacaccaagaccatcaaatctccagcactatatgaagtaactntactatngtatttctttt

SEQ ID NO: 19863 - DNA, 523 bp, Gossypium hirsutum
  Clone ID: uC-gsflnu33B111g07b1
tccacgcgtccggagaaatacacgaaaaacccatcgaaaacgaagttcaggctcggtggtctggttctcgaaggaagcgtggttcaacccagttcttctaaagaaatggagttcgtcattaccgatttgataactgatattctggttaggtacgaaggttcactacccgatttgtttagagaaggacattccgttgtggttgaaggattcgttaagccgttcacggaagagattaaaagggacgtttcgacaaggggcgtttcttcgaaagcaaggagcggtgattgttacttttcggcgactgaagttcttgctaagcatgatgagaagtatatgcctcaagaggttgctgctgcaattgagaagaacaagaagatgattgaggatgggctggaaggagctaaggaatctgtagtttgattggtatgattggttttttttttttatagtggaatttacattatttgaggactattcaatttgggtagttaaacttactggttgggattggatagatagatga

SEQ ID NO: 19864 - DNA, 538 bp, Gossypium hirsutum
  Clone ID: uC-gsflnu33B111g11b1
ttcacgcgtccgcccacgcgtccgattgaaactcgctcaggtccataaacaaaggaaagcaaagagaaagaagcttttcatttcaagggttttagcaatggcaaccaatacgcaagagcagcaatctcaggctggtaggcaccaggaagttggccacaagagccttttgcaaagtgatgctctttaccagtatatcctcgagaccagtgtgtatccgagggagcctgaacccatgaaggagctcagagagttgactgccaagcacccatggaaccttatgacaacatcagccgatgaaggccagttcttgaacatgcttcttaagttgatcaatgccaagaacaccatggagattggtgtctacactggctattctctcttagccactgcccttgctatccctgatgatggaaagatcctagccatggatgttaacagagaaaactacgagctgggtctgcctgtaatccaaaaggctggtgttgcacacaaaattgatttcaaagagggccctgctttgccagttcttgatcaatta

SEQ ID NO: 19865 - DNA, 137 bp, Gossypium hirsutum
  Clone ID: uC-gsflnu33B111h02b1
cttactcgtccggaatttgtaaattccatagttttttgttaatataaaaaaaaaaaaaaaaaaaataaaaaaaaaaaaaagggaaacctgtatagaggattctgggtttcctggccgtcctttccgggggttccttt

SEQ ID NO: 19866 - DNA, 507 bp, Gossypium hirsutum
  unsure (1)..(507): unsure at all n locations
  Clone ID: uC-gsflnu33B111h03b1
gttgtaaagagcattgattgggaagggatggcgaagcttttggtctccgatgaggctcgcaaagagttcgccactcttcgtcgcactttcgatgaagttaactccactttacagaccaagttcagccaggaacctgagcctatcgattgggaatattatagaaaaggaatcggctcgcgattggtggatatgtacaaagaggcttatgagagcgtagagatccccaagtttgttgacacagtcactcctcaattcaaaccgaaatttgatgcattgttggttgaattgaaagaagcagaagagaattctttgaaagagtccgagcgtttggagaaagaaattgccgacgttcaggaactgaagcaaaagatcagcaccatgacagcagatgagtactttgagaaacatcccgaactgaaaaagaaatttgatgatgagatccgcaatgacaattggngctattgagacatgtttggtaatataagggtcaggctataaaacagtccc

SEQ ID NO: 19867 - DNA, 378 bp, Gossypium hirsutum
  Clone ID: uC-gsflnu33B111h04b1
attttggggaaaaaaagtgcggatcaagcatagatggaaaacatgggagttttaggcaaggtggtggattaccttctattgctatcattctttagcatcacattaacagctcagttggacatccccgagtccatcctcccccacgcctacaaggccttgtatcaagtttataccacgttaacccaggattatttggggcttgagcagcctggttttttcaaggcacttatgacggaggaacttggttaccaactgcctctcgctttgctgaacatgtatggattgatatactccacgccctgggtcaacaccacctgcctgctgtttggggccacgatcgttgtctttacgacagctatggcgggagacattctgaat

SEQ ID NO: 19868 - DNA, 543 bp, Gossypium hirsutum
  Clone ID: uC-gsflnu33B111h08b1
gttggattcaatgtcaagaacgttgctgttaaggatctcaagcgtggtttcgttgcttcaaactctaaggatgatcctgcaaaggaggctgccagcttcacctctcaggtcatcatcatgaaccaccctgggcagattggaaacggatatgccccagtccttgactgccatacctcccacattgctgtgaaattttccgaattgctgaccaagatcgacaggcgatctggaaaggagcttgagaaggagcccaagttcttgaagaatggtgatgcagggatgataaagatggttcccaccaagcctatggttgtggagactttctctgagtacccaccacttggacggtttgctgtcagggacatgcgtcagactgtggctgttggtgtcatcaagagcgttgagaagaaggacccaacgggtgctaaggtcaccaaatctgctgccaagaagaaatgagattgcatttgatagtatcagagccttttgatttggttatccttgtagttcggtcttgcagtttttagaaccattttgatgggg

SEQ ID NO: 19869 - DNA, 528 bp, Gossypium hirsutum
  Clone ID: uC-gsflnu33B111h09b1
ttcacgcgtccgcccacgcgtccgcccacgcgtccgaaagcttctggaacatacaagaggactactgttattactcagggtgcagatccggtaattgttgccgaggatgggaaagtgaagcaattccctgttattttgttacccaaggaaaagcttgttgatacaaatggtgcaggtgatgcctttgttggaggctttctttcacaattggttcaagggaagtccattgaggattgcgtaagggctggttgctatgcatccaacgttatcatccaaaggtctggatgcacatacccagaaaagcctgaatttaaataaagctattccactttcctgatctcctctccactgttgttttcaagtttctgattgttaagaaccctcttgctaattgaattttgtttttatttttcctatttgccggtgtcatttcgatgcctgcatcttgaaatggcatatgagaataacattttatgtctattcatgaaaggagccaatcgtttcatttcataagcttatggttgagat

SEQ ID NO: 19870 - DNA, 478 bp, Gossypium hirsutum
  Clone ID: uC-gsflnu33B111h12b1
ttcacgcgtccggccatgcgtccggccacgcggccggggaggatcttatcatactgtcttctgcttgtaactcttccaaacggcactggtgttagcaaagaaagatagacagcacaagacgatcacagcggctgactgactttagagaagaaaaatggcactgtgggctgttcacttgaagaacgcaaaccctgggaatgcttctgcttctgctgctctgtagatgaagaggaatgcgacacctgaacgacccaattgttgtaaggttagcaacttcggagttcttccgaacgccgtttcaagaacatgcctcccttcatcgtgcatgcgatctttcaccgttacgtatatggctaagaacaataatcacgagagtgcattatcccctgatttgggaaatggtgatcaatccattactgaccgggacagctcaagaagatataattattgatagagcaataaatctaatggtgatgct

SEQ ID NO: 19871 - DNA, 474 bp, Gossypium hirsutum
  Clone ID: uC-gsflnu33B112a01b1
aaaattctctgaacgagagcctggggtgagttctcggagtgccatcgtgcctccgtccaatgggctgcacgcgcttacgcgccactgtcaatgccgtcacatatggcggccggaagccaaaaaacctcatcgtttaccccgcatcaaaaggtattccattttttatctatttttaatatttttatatgtataaaatgcaaatattttgaaaaagaaaaataaaaaacaaatcacctttgctttctttgtgaaatctttctgatgtcttattgcaaaaaaatatttggtgtacaatcatccttttctgtgtgtgtgtatctctttatagatcaaagaaaaaggctttataacctcagtctattacatattttggaaagaaatccttgatttctttccatatttgcttaatctgatatttgggttctttctttccatatttgctctttgtctgtcgcgatttcttcctttgttgaa

SEQ ID NO: 19872 - DNA, 323 bp, Gossypium hirsutum
  Clone ID: uC-gsflnu33B112a02b1
atctttctttcctgtttcatcttggtttcatttggttattgtatatgctgcagttttggttcttttctagaggtccaagtatcgatcattgtttgtcgtaagagtagtccccctagatatgtgatttcatgggggggtcatagaatctgtaaggtgatgtcaggcggttactttattatcatggatgtatcatacatttggatataaatacccttcataatggatcaaaacaaaaaaagtagtattactgttaagataaaaagcaagaataatcaacctacatttcactgattaatcacgctcgtagagattgaatagacatt

SEQ ID NO: 19873 - DNA, 422 bp, Gossypium hirsutum
  Clone ID: uC-gsflnu33B112a03b1
ccacggctgttgagagtgccattggccatgttatcaccttttgccccttgctttcccctcgaatatatatatttttgcttgaactgtgctttgctagtgcttctgctctatagtgagcatagatgaaagggattttcaagtatttaatgatgttctatgttttgatttagttaaagcttgcccaaagtagttttagtgacattgcagattgcataagcggaaatggaagtcatgactgttttgaatgttattaaatgatttgatgcaagttttagcaacttaattatcagtggtggatcacgcttgtggtgattgatagttcattaataagaaaaatatttcaggaataccactactcttaacgttattttacttattccgagaatcgaaagcggggcacggaccctctttttggacccaag

SEQ ID NO: 19874 - DNA, 273 bp, Gossypium hirsutum
  Clone ID: uC-gsflnu33B112a12b1
cccacgcgtccgcccacgcgtccgcggacgcgtgggtttttattttctgatggaaaaataagctgggaattatttttttctgctgcgttgctttccattttcttaggaatcaaacatagtagccgagaatccgccatgttcttaaatatttatccagtttgttttcgaaacccttagtttgttctgattcttattttattagttgattctttgtttttgctgattgaactttccttttgatttttttggtttaaaaggctggtaaaagaaaac

SEQ ID NO: 19875 - DNA, 353 bp, Gossypium hirsutum
  Clone ID: uC-gsflnu33B112b06b1
gttgattccaccagaccagcagaggttgatatttgctgggaagcagttggaggatggtcgaactctagctgactacaatatccagaaggagtccacactgcatcttgtccttcgcctccgtggtggtttctaatcgggtgtctattttggttgatttcgcaattttcttttctatgaactgtttgtgttttaaagtgaactatgctttgcggtgcagaaatggtcagtgaaactatatgaataaagttttatgtttatatttaacagagaagaaaaaaatacaaaaagaataaaatgaaaaaaaaaagagttcaaaaaaaaacaaaaaaaagtaaaaaacaaaaaaaacaaag

SEQ ID NO: 19876 - DNA, 473 bp, Gossypium hirsutum
  Clone ID: uC-gsflnu33B112b08b1
tttacgcgtccgattatttctgtggcacatttttattctcctttcaagtttctcccgtctatccgcatgaggcacccaaagttaagtgcaagaccaaggtctaccatccaaatattgatttggaaggaaatgtttgccttaacatcttacgtgaagattggaaaccggtgctcaatataaacactataatctatggtttatatcatcttttcacggaaccgaattatgaggatcccctcaatcatgaagctgctgcagtgttgagggataatccaaagatgtttgaatccaatgtgaggagggcaatgtctggcgggtatgttgggcaaacctttttccacggtgtgtctagctttagcaaggtcgctgaatgcgcaaatgcacgtcataaacacttgagcttcatgggttgtataatttacctgcaaattgccctctattgtctgctttgattttctcacttttcctgcaag

SEQ ID NO: 19877 - DNA, 347 bp, Gossypium hirsutum
  Clone ID: uC-gsflnu33B112b11b1
tgttcggtcgtacatgcgatcgtgccttaataacatctaatagcatttttgatcagggagagtatagttaatggatgtggaaaaagcaaaaaaactgtggatgaaatgcttggcttatagaggagcgaacacagaagcaatgagaacatgcctgtctcttgtggtgtaatatcgcacgacttggggccgacattatgtacattcaaacaaatgagcaatgcagattaggtcgcacaaacatgtaattctgaaccgctagaataaaaagaacattgatgaattttcaaggttatgatatgataatgaggattttcccttgaaagacacagaaaggaaaaatcgaggag

SEQ ID NO: 19878 - DNA, 372 bp, Gossypium hirsutum
  Clone ID: uC-gsflnu33B112c09b1
gatgttgatgagatgatccgcgaagctgatgttgatggtgatggccagataaactatcaggagatcggcaaagtcatgatggcctctttaagctcaccctggaaaccagtcagccgaagcacgtgttcagcgagacaaagagcacctcacgatagaagaccgtcggcgcgcaactcacggaccattgaaaattctgaggacacggagcctttcgcgccctgtcacactgataaccatagcaggattactacgaaagcactctctactgaatggcacactgtaggctagggccgtactcagactggattcctagccttgagcaaaggattggctgttagggctgaggccagcggtcctagtcccgaacccgtt

SEQ ID NO: 19879 - DNA, 491 bp, Gossypium hirsutum
  Clone ID: uC-gsflnu33B112c11b1
tcgattcttggcacccgaaatcattaaaggtgaaggccacggaagtgccgtagattggtggacatttgggatctttttgtacgaacttttgtttggtaaaaccccattcaagggggccgggaaccgtgcaactctatttaatgtcgttggccagccattaagatttcctgagtatcctagtgtgagctttgctgctaaggacttgatcagaggtttactcgtaaaggaaccgcagcatcggcttgcctataggcgtggcgcaactgaaattaaacagcatccattctttcaaagtgtgaattgggctctcattcgttgtgcaaatccacccgatgtgccgaagcaagttgtgatggactgttctgctggaacaaactcggcaaaggtaccaccaaccaatgacaaggttccgggtttagatgtgaagccttcttgtaattatttagagattgatttcttttgattctcgtaatattttctttcttagaaca

SEQ ID NO: 19880 - DNA, 493 bp, Gossypium hirsutum
  unsure (1)..(493): unsure at all n locations
  Clone ID: uC-gsflnu33B112c12b1
tcggtatacttaccaggattcccctagtaacggcgagcgaaccgggaaactttgtcaaaacccattagggtattcattagagctagtgaaacaagcgaagaatgatgtaacagaagaatacatgaaatcattagcagatttaatggtgattaagggtcgaccacatttcacggttattcgatcttacctggtgtcggatgtgacacgtgccgggtttgatgatgcggatttcgggtggggcaaagcagtttatggcggaccagctaaaggtggagtaggggcaatacctggagtagcaaggtttttaataccattcaagaacaagaaaggagaggctggaattgtgctaccaattacgttgacaggcgaagctatggaaatatttgtgaaagaattagatgggatgttaaagggaaagccaatagaacgtaaacccggnttcatttcatcttccttggaaaattaacaagtgcaaatctaaagttcagcattg

SEQ ID NO: 19881 - DNA, 446 bp, Gossypium hirsutum
  Clone ID: uC-gsflnu33B112e09b1
atttataggatccattgatgcttgcttattgctcaaggctgtcactggtggcttgacagatcctatccacggtcttggagctggagttggagctcttcaaggagtggtgatggagatcatcatcacatttgcattggtttacacagtgtatgcaaccgcagctgacccaaagaagggatcactcgggaccattgcacccattgccatgggcattattgctggagccaacatcttggccgctgagacattctcatgggggatccatgaacccagctcgctccttcggaccatgcttggctatgggcgacttgaacagcatatggatctactgagtgtgaccactgatacggggcggattgtctggacttatatatggaaatgcgtgcatgaactctgaccatgcaccattgatcaatgactgttattcaagctatgctcagacagac

SEQ ID NO: 19882 - DNA, 314 bp, Gossypium hirsutum
  Clone ID: uC-gsflnu33B112f04b1
atatttaaatgctgaggaatggagaagtagctaaaaggaaacaaaaggaaatggaatttttatacaacggcttaaagctataataacaaataagaagagaatattttgagcatgccaaggaaagtacgctccatatggaataaaagagagctggattcgcaacttcttattatctcataaaattggcatgcttataatatggactacaaatttaatttagaggatacaaatcatagttgaattgacaatgacaacttgaagtgaagattaaatattggttaaaaagcataaagagagagggaaaatgggaatac

SEQ ID NO: 19883 - DNA, 488 bp, Gossypium hirsutum
  Clone ID: uC-gsflnu33B112f05b1
gacccacgcgtcctgccattcgtccgatgcgaaattgggtggctatgatatccctgctgagagcaaaatcttggtaaatgcatggtggcttgccaacaaccctgctaactggaaaaatcccgaagaatttaggcctgaaaggttctttgaagaggaagccaaggttgaggccaacggcaatgatttccgctacctaccctttggcgtggggagaagaagttgcccaggaattattcttgcattgcccatccttggtattactttgggtcgattggtacagaattttgcgctgttgcctcccactgggcactctcaaattgataccaccgagaaaggtggacagttcagtcttcatattctgaagcattccaccattggtgctaagccaaggcaattttaactcgttctctgctatccattgtagggaactcttgaaagacagtatgaaacattattcagttgaaaatatttgtgacgtgtgacaatgt

SEQ ID NO: 19884 - DNA, 472 bp, Gossypium hirsutum
  Clone ID: uC-gsflnu33B112f06b1
cccacgcgtccgcaaccagctgcggctggagctgtgtgcatactgcatggggctaactatgaatactcaaccgacagcatgctaatgatggcaataaatagaacaggcaccagcaagggcactgatttctttacacccaccatgagctgagagtgttgaataaccagtaggctggaaactagaggtggcactcgacttacatctccatctaagaaagagaagcacgaacctaaaccatcagacattactttcccaagagaccaacgactggacactattccagacaccctgcattggggaagactaagtagagagaacccataccgtagccatcgcatgaaccgagctattagtgactagctaaatagataaataagtatccatgtaataagagctgattaatactaaggttgtgatgactgtcatgtagtaattaactaggcctgtgactagcgagagggcttatggcagt

SEQ ID NO: 19885 - DNA, 473 bp, Gossypium hirsutum
  unsure (1)..(473): unsure at all n locations
  Clone ID: uC-gsflnu33B112f08b1
aataatgtttttgcgaatgatatcgcggccgttgttggctaaggtgaaggagacaacggggatcgtcggattagacgttgtccctaacgcaagggaagtccttatcggtctctacaacaagactctgaaggagatccaggccgtacctgaagacgagggttaccgtaaggccgttgaaagcttcacgcgccaccgtctgaaggtttgccaagaggaagaagattgggaaatgattgagaagcgccttggatgtggccaggtcgaggagctcatcgaggaagcgcgtgacgagctcactcttatcggaaaaatgatcgagtgggatcaggngggtgttcctgatgactatgaatgtgaggttatcgaaaatgatgctcctattcccaagcatgtgcctcagcaccgacctggtcctcttcggaggagtctttcaagactctagaagctctttttaagaaagacgagcctaaagt

SEQ ID NO: 19886 - DNA, 482 bp, Gossypium hirsutum
  Clone ID: uC-gsflnu33B112g01b1
gttttattgtattacctgttttgagggtttattcatttgtagccatgaaattcagaagcttttgtttttgcatcccaggatcaaagcaagaagattcagacagttcttctaacaaagcaaaatcccataaaaagtccgacaaaagtgggaaaaaggaagggaatgtggatgatgctgattatcagggtgccactactactactacggcagccagcagtgatgctggaatggctgctgctgtagcagggggtgccactacagcacatgcctccgctgtggaatgaagtggttgcgatggttgtcatgcaggtggtggtggtggcggctgatagccggacactatttcaaaaaagctggttcagtttttggcctttggcgttcttcatcatattgatttcagaatctttctttcatcttgcatgaaaagtgcttggttttttcatctttatattttgtggtgttcttttttataccccgagtct

SEQ ID NO: 19887 - DNA, 230 bp, Gossypium hirsutum
  Clone ID: uC-gsflnu33B112g06b1
cttattcgtccgcatttttcaggggcaaggatctagggttagttaatggaaatcaataagttggaacaacttcgtaagtctatttgtgatatagaaatcgaaaggatccgattcaaactattttcaaatcaaaaagaaaagttgttggaattggtaaaactctttcgatcaaaagtgtatcatgcgggaattaatcgttcatatgattctttgatggaaaaacccaaaaa

SEQ ID NO: 19888 - DNA, 472 bp, Gossypium hirsutum
  unsure (1)..(472): unsure at all n locations
  Clone ID: uC-gsflnu33B112h05b1
atgtatgattacttgttggatctctttgagggatctcaaaaatcattgcataatccccataggaggtgaaaaaaaccaatgatactcaaactcaggttttagtgtcggatatggatatgatctgaaaaactatgttacacgaactcgagtatgattagatttttttaaagttttaccgaaggtcatattctcatactgcatgtacgtatgatagcagagtagttatatatatatatacatgtttgtaatcttctatgtatgaagggcatttgtgttgtatttttagccctttttttccctctttagtttgatgaataaatggattggttaaagccattgctcgcctgttagaagtttgggtcttcctgtttgcttccaaatatatgaactgatgacttaagtagagcagaatttttaccgtttgtaaaataggtcaanggtaaacagcatactgactgggaaaaccttgtca

SEQ ID NO: 19889 - DNA, 474 bp, Gossypium hirsutum
  Clone ID: uC-gsflnu33B112h06b1
cattcgcgtagccggacgcttgggaaagaaaaatcggaataccaagctgattggaggccgaaaaacagaagaaaatggcaagacaatggaagatgcacatggactccatgccgatactgcaatgagtggtgcgtaactcatggaagctggctgctattactgcggttgtgctctgttcggatccatatgattctttcgcttaaaggcatatcatcgttccaatacatggaaaagaattgcattgcttaagaataacagttactgagtattgcacttggaaattgtgactgccttccctgcttttgcatataagaaggcggccattattatgatcggcattaacatatatgatggcatattccgagtgcctattgaaagtgcctgtgacattatctttgacatgtacaacgcttaaaacgtgattgtagactctcaatgccggaggctaccgacaaaatcacttttttaagtttt

SEQ ID NO: 19890 - DNA, 409 bp, Gossypium hirsutum
  Clone ID: uC-gsflnu33B112h08b1
ctaacatcctcggctgttcaaggactacgagttcatggatgccttcctttttgccttttccgacccagcaaagcacatcgacaacggggaggggctccatgtcttcgctggcctctcatcaccagtttacaatgaaaatcatgcccatatcgacaagtaaaatgcagtaaaatcaatgttacatataatagactgagttctatactcgagatttgcgttcttggatatggctactatgttatggattgtagtagttttataattgcattgtgccaaaggatactaaatattgcacagtggcgtttatacatatgaacttttcgatgaagcaattatatcgagctctttctgatatatggagtttcagaaacagaaaggtggagctattggtgaaaaaatatgaacctat

SEQ ID NO: 19891 - DNA, 475 bp, Gossypium hirsutum
  Clone ID: uC-gsflnu33B113a01b1
gaaaatgtctacgtcaccgtccgtcaccgaactccaggtggagaactttacgttccctccgacggtgaagcctcctggttccaccaaaaccctgttccttggtggagcaggggagagaggattggaaatccaagggaagttcataaagttcaccgcaattggagtttacctggaagatagcgccgtgaattgcctcggcgttaagtggaagggtaagagcgcggtggagttaacggaatccgttgagtttttcagagacgtggttacaggtgattttgagaagttcatacgggtgacaatgatattgccattaacgggtcaacaatactctgagaaagtatcagagaattgcgttgctatttggaaatctcttggaatctacactgatgcagaagcaaaagccattgaaaaattcattgaagtcttcaaggatgaaaacttcccacctggctcgtccattcttttcactatttca

SEQ ID NO: 19892 - DNA, 469 bp, Gossypium hirsutum
  Clone ID: uC-gsflnu33B113a05b1
cccacgcgtgcgctttctttcataccttctctactttgccttttggttctctgtttatttacggctataccattcagctaatgatagcttactgtgatcggaaactcgagagccgtcgctctgtccccgctctcggtttccctcggtttaggtttttccgccaccggcgattgcggtaacccttgtctcactctccaacctaaaaaagcagcgaagagaagttttatttatttatttatttatttaagatttgaatcactgtataatataccacggtcgatcatttcaatccgatgaggaattcaaaaaataaccgtaaggaaccggagaagagccgcagggtaaggttatctgaagggcgtcgtcgtttcacgggagaatccagacgatggaaccggtggagctgaggcggccgaagacgcttcccgacctgcttcagagaggtctacttcactctcatccgatgcga

SEQ ID NO: 19893 - DNA, 471 bp, Gossypium hirsutum
  Clone ID: uC-gsflnu33B113a08b1
ttttgtctattgaattctttccctcactttggcgaaaattaaaatgcttcaaggttgcaattgcggatctaactgaacctgcggtgacaactgctcatgcaatacgaaccttaaccttgactcttaccagaagacaaccagctctcaaaccatcatgttcggagtcgctccagagaagatgacctttgaggcaccacagatgagcactactgaatcacgacatgcatgcaagtgtggatcaaactgatcttgtgatccatgcaactgttgacaagctcgatgaacgccatgaattatctataaatgaaagcatccaaaataacaggcctatgcaatgatatattgacacggatggctgcctgaacagtccataataatggctctgcctgtgtactgtggaataaaagctttgcatgaggtgaaaataatgaatgaagcccttcggttgagagcaaattgatcttttctgca

SEQ ID NO: 19894 - DNA, 403 bp, Gossypium hirsutum
  Clone ID: uC-gsflnu33B113a12b1
gcattgccaacttgtggttatgccatgcttgctattacatctttcgttggcatgggagatattgtaacaccagaaacctttaaatgggcagccaatgaccctaagataattcaagcttccacaattatttgtaggtttatggatgatgttgctgaacacaagttcaaacataggagagaagacgattgctcagcaattgagtgttacatggaagaatatggtgtaacagcacaagaggcatatgatgtattcaacaagcatgttgagagtgcttggaaggatgtgaatcaagagtttctgaaaccaacagagatgccaacagaagttttgaatcgtagcttaaaccttgaagggtgatggatgtactctacaagaaggtgatggctaacatatgttggaaagc

SEQ ID NO: 19895 - DNA, 245 bp, Gossypium hirsutum
  Clone ID: uC-gsflnu33B113b08b1
cctccgcgtccgatttagtattaaaaagcccgcagaaaaaaaaaaaaaaaaagaaaaaaaaaaaaagaacttatattggggggggggcgatatatgggaacccgtttcgggctgacgcgtcgtggggtctgttgcatcccctctattgccttcccggtccgcggccttgcatgggctttttctcggccttgcttcgtggagccctcttgcttcgtccttcctgggaactccgtggcgcgcccctt

SEQ ID NO: 19896 - DNA, 404 bp, Gossypium hirsutum
  Clone ID: uC-gsflnu33B113c02b1
tatagatgaagcactggatggagaaagggcctggttcaagttccataggcctgggcaacttctacagcccgacgacgatcaagctgccgacatgcggggcgtggctaccactaccggggctatttgactcattcagcctattgattggacgacgcagaccatcttggagaaaccacagacggattagagacgaaagcaacatttggcgcctcattgcgggcttgaacatcgcgtatggtgaagaacaactcatagaaagaataaaaataataatgtactaagggacatgatttgtgatggattgaggaaagaacaagcctgtttgcttctggagacaatgactgggacgttgtgatcccgcccgagaaagctgcaaaaagaggaggctacgggcgggcgagata

SEQ ID NO: 19897 - DNA, 319 bp, Gossypium hirsutum
  Clone ID: uC-gsflnu33B113d09b1
cataatctctcattttattgcttcttaaatttgtttctttgtttcttgtctgttttcagagttgggaagttaatctgtatttagagctattcatagaagtaagtttctggcaatagcatgaatgtttagatactttaaaaccaattgataatcctccatattatagttttatgagatggactattaactgcaaaaaaaaaaaaaaaaaaaaaaaaaaaaaaaaaaaaaaaaataaaaaaaaaaagaaaaaaaaaccactattacatacatgaaaaataaaaaataagatataccgtaggccatttaaatcaaatggccc

SEQ ID NO: 19898 - DNA, 439 bp, Gossypium hirsutum
  Clone ID: uC-gsflnu33B113e02b1
tatgtttcttactaacaattgcgcaatgatctggtgttttctgtctcgacagacaatggacgcgttctttgaatctcgatcgagaagcaactggagttacgatacactcaagaatttccgtcagatttcttccgtcgttcaatctcatctcaaaagggtttatttgaccttatgttgtgccctggttgcctctgcttttggggcttatcttcatatcttatggaacattgggggttacctcacatcattcgcatgcttcggaaccatgatttggctcctctctatccctccttatcaggaacacaggagagtttcccttctgatggcatacgcagtgttcgaaggggcttcaggtggtactctgattgacttggacattcagattgatccaagtgtttaggtagctgcatttgtgggaactgcaatagcctttgcatgt

SEQ ID NO: 19899 - DNA, 72 bp, Gossypium hirsutum
  Clone ID: uC-gsflnu33B113e11b1
ttttgttaatttctgctgtaaatctgatggagacatgcggatttgaagtagcaatgaagtagttttaatgcc

SEQ ID NO: 19900 - DNA, 464 bp, Gossypium hirsutum
  Clone ID: uC-gsflnu33B113e12b1
cccacgcgtccgcccacgcgtccgcccacgcgtccgcccacgcgtccgcttttgcaccatccaagccagctgcaccatctattacatctgctccaacaccctatgaactatcaggactcggagttccagaagatgggcagaaaatgatcagtgagctcatgtcaatatatgataacaacattcaaggcaacaaaaacatgaatcccggtaacaatccaggtactgaaggtcaaaacctcctccagtcgaaaagccaacctcaacaagatgaattcttcaacggtcatcaaggagtcatgatggaggggaatttcttcgaggagtccagcatgcctcgtaatcatcagatgtttatgcaaggggaaggtcaatttgaccgttttaagggtttgaattctccgttcgaggctagccacaataacaacagcttccagttgatgtttggttctccgttcgatctggct

SEQ ID NO: 19901 - DNA, 482 bp, Gossypium hirsutum
  unsure (1)..(482): unsure at all n locations
  Clone ID: uC-gsflnu33B113g06b1
cccacgcgtccgggattacccgctgagtttaagcatatcaataagcggaggaaaagaaacttaccaggattcccctagtaacggcgagcgaaccgggaaaagcccagcttgagaatcggtcgccatcggcgtccgaattgtagtctggagaagcgtcctcagcgacggaccgggcccaagtcccctggaaaggggcgccggagagggtgagagccccgtcgtgcccggaccctgtcgcaccaagaggcgctgtctacgagtcgggttgtttgggaatgcagccctaatcgggcggtaaattccgtccaaggctaaatacgggcgagagaccgatagcgaacaagtaccgcgagggaaagatgaaaaggactttgaaaagagagtcaaagagtgcttgaaattgtcgggagggagctttgtattttcttgcatgtttgtctttttaattctgtatgaattcaatgtatcctatgctnttattt

SEQ ID NO: 19902 - DNA, 254 bp, Gossypium hirsutum
  Clone ID: uC-gsflnu33B113g11b1
ggcaggtccgccacgtctggtgcgtagtcgtgctgttaggagggatcttgtgagagactggaactttgaagaggttgtgatggaacgctagtttgcttagtatgaggtgcaagactgtgggggctctctccatttgggctctctattttgtattagtatgcaaaaactgaacttttcagcatatgtaacacactgagtaaagattattgaatgtgaagaacatatcacatgtcctaaaaaaaaaaaaaaatata

SEQ ID NO: 19903 - DNA, 109 bp, Gossypium hirsutum
  unsure (1)..(109): unsure at all n locations
  Clone ID: uC-gsflnu33B113h02b1
cccttttaataaaaaccggccaatacaccccccncggggggggtttaaaaaaacaaaccggtggtttcacaacccaaccaacaagaaaacacaccggaccaaaacctcc

SEQ ID NO: 19904 - DNA, 484 bp, Gossypium hirsutum
  Clone ID: uC-gsflnu33B113h06b1
ccctctcgtccgcccacgcgtccgaaagaaatcgatgaaaatggcgatggcgagtgttcgatctggtctcctacgagcagcccttcgcggcggctctcgtcctactgctcctcccacgcgtggcttcgcttcctcttctcatcacgatgatgcttatgaaaccgcaaaatgggaaaagataacatatttaggtgttgctacctgcactgttttagcgatttataacctatcaaaaggtcatccccaccatgaagagcctcctgcatacccatatttgcacattcgcaacaaggagttcccatggggtccggatggtctgtttgagagaaaggagcatcactagggatggccggatggatgcatatctttccgagttcggcgcatttttatcatttctctgagaaatcaatcagataattctgtggatcttttgtaattttagcactcgatttccggtttatggactttgaattgcaagttcatc

SEQ ID NO: 19905 - DNA, 302 bp, Gossypium hirsutum
  Clone ID: uC-gsflnu33B113h07b1
cgtaaaaggtggccaattcaccactttcatcaagctattgaaagccacacaggtggctgatcaactaaacaaccagctaagcacaccggaccctaacgacgggttaacggtgtttgcgccgagtgacagcgcgttctccggactcaaacccgggacgttaaactcactttccgacaaagagaagcttcagttggttcagttccatatactcccgacgttaatgtcgacgtcccagtttcaaacggcgagtaaccctttgagaacccaagctggggatgttaaaggtgggaagtttccgctta

SEQ ID NO: 19906 - DNA, 478 bp, Gossypium hirsutum
  Clone ID: uC-gsflnu33B114a08b1
ggttgagtgtagagatgaggaaaatcatgggtgccaaagttcttttcttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgttctgtctgctagggaaggcatcgtttcgttgggaggcccttatattcctctcaaaactggaagaagaga

SEQ ID NO: 19907 - DNA, 481 bp, Gossypium hirsutum
  Clone ID: uC-gsflnu33B114a10b1
atttcatactcatttagcccctttcattagcatcgaaatcactccagttttctttatcactgaaaaatgtcttgctgtggtggaaactgtggctgcggttctggctgcaagtgtggcagtggctgtggaggatgcaagatgtacccagacctgaacgttgccgagatgaccacaactgagactctggttcttggtgtagcaccccagaaagcacactttgagggagctgagatggaattcggggctgagaacggctgcaagtgtggagacaactgcacctgcaacccttgcaattgtaaatgattagagaccaaagccaaagctccctggaagcagagacgcctttgtctttaagaaataatatgttttgctgtttatgtgtttttagaataaaagagccatggcttgtcgtaggttttgcctgttgccgccacggttacttggtgcttgccaatagatagagtgaagtactaatatttac

SEQ ID NO: 19908 - DNA, 476 bp, Gossypium hirsutum
  Clone ID: uC-gsflnu33B114a11b1
ctcacgcgtccgggggattccagaaggcatgatacctgttcagcttctgtgggttaatcttgttactgatggacctccagcaactgctctagggttcaatccccctgacaaagatataatgatgaagcctccaagacgaagtgacgactcactaatcactgcttggatcttgttccgctacctggtgattgggctctatgtggggatagccactgtcggggtcttcatcatatggtacacccaccatagcttcctgggcattgatctgagtggagatgggcatagtcttgttacctactcccgacttgctaactgggctaaatgcgattcttgggaaggtttttctgtgtcaccattcacagcaggttcccaagtgttcaaattcgattccgacccatgcgactactttcagtcagggaaaatcaaagcctcgactctttccctctctgtcttggtagccattgaaatgttcaact

SEQ ID NO: 19909 - DNA, 516 bp, Gossypium hirsutum
  Clone ID: uC-gsflnu33B114a12b1
cccacgcgtccgttttgtttcgttgaaaaaccaaatctctgtttcgatcttcaaagcccccccaatccatagtgaaaatcaaataaacaatttgatccagttagtctttcttgggttgaattttattgctattatagaaatttcaaaaaaaaaaaaaaaccctcaatggctcaagctattgaagaatggtataagcagatgcccgtcatcacccgttcttatctcacagctgctgtagctatcactattggctgttctctcgaaataatatcaccttatcatctgtacttgaaccctaaacttgtggttaagcattatcaattctggcgcctaattactaacttcctgtacttccgcaagatggatttggatttcatgtttcacatgttctttctcgcccgatactgcaagcttcttgaagagaacacattcaggggaaggactgcagattttttttacatgcttttgtttggagcttctgtcttaactggcattgtgcttataggaaggatgata

SEQ ID NO: 19910 - DNA, 495 bp, Gossypium hirsutum
  unsure (1)..(495): unsure at all n locations
  Clone ID: uC-gsflnu33B114b05b1
gcaaaccagttaataattaaaaaactacttttttttagtgaaagaaaacacccagaaaaagcctttcttttttttttctttatcaggccataatcatttcacaaagactcctcctttaatatcataggaaggaagaaaaaaacactaaaaagtcagatccccttctttggttcctcgtttcattctccaatggcagagtccaagatgtatatttctcaaacagagcttgaaaaccacaaaaaaccaggagatctatggatctctatacagggaaagatctacaatgtcactgaatggagtcgagaacaccctggaggagcacttcctttgctgaatctggctggccaagatgccaccgatgcctttgtagcctatcatcctggcttagcttggncatatcntgacaagttccttactgggtattatctcaaagattactctgtctccgaggtatccaaagatttcagaaaacctgctgctgagttttcaaaatgg

SEQ ID NO: 19911 - DNA, 436 bp, Gossypium hirsutum
  Clone ID: uC-gsflnu33B114b07b1
gtgaaatcttgcccttgtgaagatgtgcatgttttatggtcaatactggtggaatcaaatgcacctgctaaaacattgaactgatcaagaaccctttttctgggtatgattttttctaaagaagcagatctattgtacataagtatgtatatgatatatccgttttcaggtgagtgtattatacgagtatgtatcctatatgagaaagtttaagttttttttatacttatattcgaatatatgttgaatgtaaatattaaaaattaaaaaaatataagaaatttgaatgactcagcataattatttatgattcaaaaaaaaaaaaaaaaagaaataataaataaaaatatatataaaaaaaattaaaacatatttaatataaaaaaaatacatttttaccaatccatttttcttaaagggggccctctttaaagat

SEQ ID NO: 19912 - DNA, 413 bp, Gossypium hirsutum
  Clone ID: uC-gsflnu33B114b08b1
gctcattgatatgggggtgctttttgagaaactgaatttaaattacgaggagggtgagagatggattgtgaatctcatccgaaactcaaaacttgatgcaaagattgattcaaagactggaaccgttattatggaacctaatcgaccgaatgtttacgagcagctgatcgaccacactaaggcccttcaagggcggacctacaagctagtcggccagcttctcgaacatgcacaagcacagcctgcacgttaagttggacggacgaggaagctgttttgaatttatatgcaattttgagctattttctggttgtttatttctttcagacaagtttaacagtgattttagtttttgagtaggaacaagactgataaattattatctggtcactcaattattaatttaatatttt

SEQ ID NO: 19913 - DNA, 421 bp, Gossypium hirsutum
  Clone ID: uC-gsflnu33B114b11b1
gctgcataagagttttaaggaaaatgcagatcttcgtgaaaaccctaactgggaagaccataaccctagaggttgaatccagcgacactatcgacaatgttaaggctaagatccaggacaaggaaggtatcccgccggaccagcagaggttgatcttcgccggaaagcagcttgaggatggtcgtacacttgccgactacaatatccagaaagaatcaacattgcatctggttctgaggcttcgtggtggcattatcgagccatctttgatggcattggctaggaaatacaaccaggacaagatgatctgccgcaagtgctatgctcgtctacacccccgtgctgtgaactgcaggaaaaagaagtgtgggcatagcaatcagctgaggccaaagagaagatcaagttgattggatatctt

SEQ ID NO: 19914 - DNA, 481 bp, Gossypium hirsutum
  unsure (1)..(481): unsure at all n locations
  Clone ID: uC-gsflnu33B114c01b1
cccacgcgttcgctccaccaccaacaccctactagatctaaaaagatcgaccacacaccgttcatattctagtttcgccagcaaaataaaggaaggcgccaagaaggaagggagatttggacatcaaaacagttccttttcaagtccatggaataagggtctaagcattacagtggagagatacaattttgataattcaggcctacatgtaacttccacttctttggttgccatgttacacatgctctttatttattttagtggcataagaaggaagtgagtgttttttctattttaattattggtttttcactttaatttattcgggtatagaaatgtggccttccgtatgattgatgaagctttttctatttattgtgggcatgcatttgctatttggtggataatttggtgtactatgtgcactattagcaataaaagaatctatttgtttcctnccataaaactttttccccttttc

SEQ ID NO: 19915 - DNA, 222 bp, Gossypium hirsutum
  Clone ID: uC-gsflnu33B114c03b1
acgcccacgcgtccggaattttttttcttgggtaaatgtcgaataacatttgtataagcattattatttttggaatgaaatcatgaataaatattttattcaaaaaaaaaaaaaaagaacaaaaaaaaaaaaaaaaaaataaagaacttaagcctgaaaaggatgtgacctttggtccatgcggtcggacaacgaaattaaagttgttgagatgcaccatga

SEQ ID NO: 19916 - DNA, 416 bp, Gossypium hirsutum
  Clone ID: uC-gsflnu33B114d04b1
tttacgttttcgcgtccgatcggctatggtttcatttgaacaaatttgaaattaggtgcaggttcttaactcaccaagtgttcgacgatattccccaactagcaaaagtagaagctgatcatcttttttctctggtttaaagcaaacccgttgacactctctttcaaatcagagccttggactgcgtacaatattccatctatttactttcagcaagtgttggaacaatatttctccataagcgaaagtagagataaactatactcttgttgaaagtagccgacaatctctctcaagataaatgatgcctagatggaaaggaaaaggcttacaagccaaagctaatgctgatcccatggataaaattggctcacaactccaacccctcttttgatccaattggagactcggggttt

SEQ ID NO: 19917 - DNA, 486 bp, Gossypium hirsutum
  Clone ID: uC-gsflnu33B114d12b1
cttttaccgacaacctattgatccttccgaaggcatcaaaagagtacaacaacccgtgacaatttacagtccagtttccccaccacaatccagcagcgacgtttccacaagcgaaaacaacagcaacagccacaccttcaccaccaacactgaaaccaacgaagacgtctctgaaatcgatgaaaacttctggtccgaagtattatcggctgataactcaagcatggccgccgatttccgagtggttggttcggaccaatatttcccaagctctccgtctcctccattaccagcattggaaacagtgaatggctgtggttccaatctttatgataccgatgctaacatggatttttggtataatcttttcaccagagccgcggatttacctgaactacctgaattttgagttgcctatttttggaattaactttagtggtaaccccttagtttctttgattattcagattggagctggataaaatg

SEQ ID NO: 19918 - DNA, 563 bp, Gossypium hirsutum
  unsure (1)..(563): unsure at all n locations
  Clone ID: uC-gsflnu33B114e02b1
ctggacgcctgccgcccggggcccgaattccgaattcgacccacgcgcccggcattggtgtggaaacactggagaaacataggtctatttttcaactgcacttttgtgctgttctggatcagagattcagttaattgcctgtgctagcaacatctactatataaatgacaaccttgataagagaacttggacgtacatttttggagcctgctgtgcaacaactgtgtttattccttcattccataactacagagtttggtcatttcttggccttatgatgacttcttacactgcatggtacctgacaattgcctcccttctccatggacagattgatggagtgaagcactcaggtccaaacaagatggttctctacttcactggagccaccaacattctttacacctttggtggtcatgctgtcactgtggagatcatgcatgctatgtggaagccacaaaagttcaaaatgatatactcgatagcaacactntatgtgttaaccctaactttaccatcagcttctgctgtttactgggcttttgggatttgcttcttaccca

SEQ ID NO: 19919 - DNA, 407 bp, Gossypium hirsutum
  Clone ID: uC-gsflnu33B114e08b1
ggaaaaagaagccaattttggatgggctcaaggagaggcaggaacaggagaagagactacaaaaggttgccaaaacaatggaccatctagaaagggcaaagagagaggaagcagcccccttgattgaagctgcttttcaacggcgattggtagaagagaaggtgcttcatgaacgtgagcaacagctggaagttgagttgagcagacagcgccatgatggggacttgaaagagaagaataggctggcacgtatgttagaaaacaagatgattttccaggagagtgtaataagtcgtcggcaagctgagtttgaccaacggagagtggagagagaggagaggatcaaacaaataattcaagctcggaagcaggaaagagatatttagagaaagaaaatattttatgtg

SEQ ID NO: 19920 - DNA, 466 bp, Gossypium hirsutum
  Clone ID: uC-gsflnu33B114f03b1
cccacgcgtttgcccacgcgtccggaaaaacatggtgttacatgaattctacgagcttgttgctgcaactgaggtaaacagtgagcatcccttagccaaagccattatcgagtatgccaagaagttcagagaagatgaagagaaccctgcatggccagaagcacgtgacttcgtctctataacaggacatggagtgaaagccattgttaggaacaaggaagtaattgtgggaaacaagagcttaatgttggaaaaaaaacattgctattccagttgatgctcaagacatgttaaccgaaaccgaatcaatggctcaaaccggcattttagtatcgatagacggtgaaataacgggagttctcgccatatccgatccagtgaaaccaggtgcacaagaagttatttccattctcaagtcaatgaatggtagaagcatcatggtgactggtgataattggggaactgc

SEQ ID NO: 19921 - DNA, 322 bp, Gossypium hirsutum
  Clone ID: uC-gsflnu33B114f11b1
gttctatactatcagtgacatattctgggcaatgatcaaattcattgaagcgtgctcctgatccatgtactagaaggaaaagaccgatgactacagattaggctctggttgatgcacgaaatgcgatgatggttcacgaggacctgaaagcggaccatatggtggaggtggaagcccacgacgaccaactgggttaatgaacaatgttaccggaattgaccatagttcccttactgtctaccgctcctgatgcggaggataaatgcatgaagcatacatgttggacatggacactggaatataaatgaagtcctgttattat

SEQ ID NO: 19922 - DNA, 385 bp, Gossypium hirsutum
  Clone ID: uC-gsflnu33B114g01b1
agtcacgcgtctgcccacgcgtccggcagccatggaaattgatgctaatattgcaaaatggttgtatccaagacttggttacggtgtttaccttcctccagctgaggaagctgctattgctgcattgaagagagcccttggcgctttgaacactcatcttgcttccaacacatttcttgttggacattttgtcacccttgctgacattatcatgacatgtaacctctacttgggtttctcccagatcatgactaagagttttacctcggagttccctcatgttgagaggtacttttggaccttggttaatcaaccaaaaatcaagaagattcttggtgaagtgaagcaagcagtctctctaccacctgttccttcaaagaagcct

SEQ ID NO: 19923 - DNA, 504 bp, Gossypium hirsutum
  unsure (1)..(504): unsure at all n locations
  Clone ID: uC-gsflnu33B114g03b1
ctttcgcgtttgcccacgcgtccggcgaattcgcgttttgttagttcgtgagtgaaacaggtaataaaaggaaaaaaaacgatgggtgttttcacatttgtttgcaggagcaaaggcggtgagtggtctgccaagcagttggagggagagattgagagctctgctgcttccacttacgagctccagcggaaacttgtccaggcctccaccggctgcgactcctctggtggtgtcacctcctctttctctgtcgttacccctaattctgccgttttccaggtggttattggaggtgctgtaggcggagccttcatcgggggtggaggagctgctgccgctccggctggaggcgctgccgctgccgcttgagctcctgcagctgaggagaaaaaggaagagaaagaggagagtgatgacgatatgggattctctctctttgattaagctcctttactgacttactgnctgtttagatcttagcaagttgttacattttcatttttc

SEQ ID NO: 19924 - DNA, 509 bp, Gossypium hirsutum
  unsure (1)..(509): unsure at all n locations
  Clone ID: uC-gsflnu33B114g04b1
cccacgcgtccgcgtaagtctactggtgggaaggctccaaggaagcaacttgctaccaaggctgcccgtaaatctgccccaaccaccggtggtgtgaagaagcctcatcgataccgtcctggaactgttgctcttcgtgaaattcgtaaataccagaagagtactgagcttcttatcaggaaattgcctttccagaggcttgttcgtgaaattgcccaggacttcaagactgatttgcgtttccagagccatgctgttctagctctccaggaagctgcagaggcataccttgtgggtctttttgaagacaccaacctttgcgcgatccatgccaagcgtgtcacaattatgcccaaggacatccagttggctcgtaggatcaggggagagcgtgcttaatttccagaagtgtggatcagtcgcttagaagacactattgtttatttctaggcaaatgtatngggtttttgttttttctaatcatcttttaagccatgatggtagtggta

SEQ ID NO: 19925 - DNA, 257 bp, Gossypium hirsutum
  Clone ID: uC-gsflnu33B114g07b1
tttacgcgtcccataaaaaaaggagagaggtagggcttaacgtttcccggtggggagcccggacaccttccggacgtgggaccgtctcctgctccggcgcacggtggctggaaaggagtagatgaacggtggtggtgatgggggcgcaaagggcaggtggcccgtgctgcaagctttggtggtagaggcagcacaagctggagccgaatggggctagggtatttggtgggcttggctggcttatgatagtgggtatg

SEQ ID NO: 19926 - DNA, 415 bp, Gossypium hirsutum
  Clone ID: uC-gsflnu33B114g09b1
ttatgcgtccgcccacgcgtacggtggaatcaggcgtaccggaaaatcgacgatgcggaggcaggaggaaggctcttgtaccccatgatgttagagcggccggagatgagatgggcttttatccggaaaatttactcaatcgtagtcattcaattgttagccacaatcgcggtggccgccacggtggttaccgtccatccgattgctcatttcttcgtcagcactggaactggatttgcactttacatagtcctaatcatcacgcctttcatcactctttgtcctttgtattactatcaccagaggcatcctgttaattatcttcttcttggggtttttacgatttctttggcgtttgctgttggattgacgtgcgcttttaccagtgggaaagttattttggaatctgtgattc

SEQ ID NO: 19927 - DNA, 518 bp, Gossypium hirsutum
  Clone ID: uC-gsflnu33B114h06b1
agtgggcatcaaaggaaggtgcgatggctgaggagaacatgaggggtatctgctttgaagtctgtgatgtggttctccatgctgatgctatccacagaggtggtggtcaaatcattccgactgccaggagggttttctatgcttctcagcttacggccaaaccaaggcttctggagcctgtttacttggttgagattcaagcccctgagcaggcacttggtggtatttacagtgttcttaaccagaagcgtggacatgtgtttgaggagatgcagaggcctggtactccactttacaacatcaaggcctaccttccagttattgagtcttttggattctccagcactctgagggctgcaacctccggacaggctttcccacaatgtgtgtttgatcactgggatatgatgtcatcagatccattggaacctggttcccaagcagcagcccatgttgctgagatccgtaagaggaagggattgaaggagcagatgaccccactttctgagtacgaggac

SEQ ID NO: 19928 - DNA, 451 bp, Gossypium hirsutum
  Clone ID: uC-gsflnu33B114h07b1
gttacacatccatgtgactccctgggggctttggcactattacggcttacaatggtggcccttatattcaacagcaaaaatggcaactgagcggaactgctactgtagcatcgagcacacatcagtcccgaccgattcacgagcgcacattggctagtgcccaacacttactgtgggagaacatgaaaacctctccaaatgtcttgggccaaaaggcaccaccaatcacagaacattaaaggcttcttacaccattaagcttgtaacacccactggtgaggacagccattttccagcccctgtcgatcaatacactactgatgctgccgaagaagggagaggtgcactgccatacccttgccacgctggaccttgcatcacatgtgccggagagactgtgtacgactcagttcgtcaacactacagtatcgtccttgatgaaaaacaaatt

SEQ ID NO: 19929 - DNA, 517 bp, Gossypium hirsutum
  Clone ID: uC-gsflnu33B114h11b1
cccacgcgtccgcatcgggcagttcgagctttttcggggcacggagatactttgaaaaatgcgatcttgcatcgcattcgggcggtcaatccggttatgcgacccgctatgttttccagatcacttacatctgctaggatggaagaacatggcttagagagcaccactatttcagacgttttgaaagccaaaggcaaaggtgcagatggatcctggctttggtgcactacggatgactctgtgcacgatgctgtgtaatcgttgactcaacacattgttggtgctctggtggttgttaaacctggagagcagaagtcaagtgcgggtatcatcacagagagagattatcttatgcagataatagtacatggtagatcatacaagtgaactaaagttggtgacatcatgactgaagagaacatgctcatcacggtgacacctgagaccaatgttcttgcagcaattgcattgatgacaagaaaccgaatcagacacattccagtgatcaatgagaagg

SEQ ID NO: 19930 - DNA, 491 bp, Gossypium hirsutum
  Clone ID: uC-gsflnu33B115a01b1
ttttcccaggaatccgatatgcacattcatagagccttgatggatattaatgaaagtcctctctatgtgcttctcaatcctgcaatcaatcccacgcaaaaagatcttccagtcaccatttatgaaagtgagctgcacgttatagatgggattccgcagcttatttttgtccgttcgagctacacaattgagactgttgaagctgagaggatctctgtggatcatgttgcccatctaaagccatctgatggaggttcagcagcaactcaattggctgctcatcttactggtatacatagtgccatcaagatgttgaatagcagaattagggtacttcatcactatcttgttgggatgcaaaaaggtgatattccttgcgaaaattcactattaaggcaagtatcaagtctcctcagaaggttacctgccattgaatcagaaaaatttcaggatgactttctgatggaatacaacgacacattattgattac

SEQ ID NO: 19931 - DNA, 445 bp, Gossypium hirsutum
  Clone ID: uC-gsflnu33B115a02b1
ttattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaataaataaaggggggggcctttttaagggaataaaatttttccccccatggtcagcggtgaactgttttttttttgggcccctataaaaaaacttggtggggggttttttaaaaactggtggggggaaaaaacggggggtccccatatttatattcctgtgaaaaaaacccctttttgccctatgcttaaaataaaaaatagggcccccaattgccctcttccaaaaggttgcccctttttaggggaaagggggcccccctttttggggtttttaaatagggggggggg

SEQ ID NO: 19932 - DNA, 505 bp, Gossypium hirsutum
  Clone ID: uC-gsflnu33B115a03b1
gttttgctttccatactcatttagcccctttcattagcatcaaaatcactccagttttctttatcactgaaaaatgtcttgctgtggtggaaactgtggctgcggtactggctgcaagtgtggcagtggctgtggaggatgcaagatgtatccagacctgaacgctgccgagatgaccacaactgagactctggttcttggtgtagcaccccagaaagcacactttgagggagctgagatggaattcggggctgacaacggctgcaagtgtggagacaactgcacctgcaacccttgcaattgtaaatgattagagaccaaagccaaagctccctggaagcagaggcgcctttgtctttaagaaataatatgttttgttgcatatgtgttcttagaataaagtagccatggcttgtcgtacgttttgactgatgccgccacgggtacttggtgcttgccaatagatagagtgaagtactaatatttacttgcttttctggccagt

SEQ ID NO: 19933 - DNA, 487 bp, Gossypium hirsutum
  Clone ID: uC-gsflnu33B115a04b1
tttttattccggtttgctgcagcaaattattgtctcgtttctgatggtcattttgctctacgaaaatgtcattagaagaagttttgaaggttgtttttccttttttagatggtgtagaccttgcagcttgtatggtggtctgtaagcaatggagacacatagctaaagatgattacttttggaaatgtgtatgtgcaaagagatggccctccatttgcaaacgacccaatcctcctactgtaacctactataaactatatcaaacgttttacaaacggaagcatcagcgaacgctcctccctccaagactttcctttgatgatttggaattcttcattgacatttggactgaagataaattgattttctccgaagttgtccccggtcctgtcctccaaagaggaatcaagatcccacctgctggaatctgcgacatgcttaagtttcatcttcaaggccccgagtacaagatgatcttacctgttga

SEQ ID NO: 19934 - DNA, 441 bp, Gossypium hirsutum
  Clone ID: uC-gsflnu33B115b01b1
ttgtttctataaacatgtcccagtggtgtttctgacgggccacccagctgttatggtgattatcaacctgtgctaaggcggattaagggctcatgaccctggtggcacatggcatgctgcagtgatcactttcatctgacagttgatttatttttgctatggcctcattgatttctgaggccggatcagaacggaatgcataccacacaaaataccggaccatcttcagcgagcagccaccgtcttgtgaaactttgaaagaaaaggagtgttgggcgcacgttctgacttaaccatcttgactgccattgtcaataagctctactatttttgctactgaaacgctaaggaaaacagctgccggccattcaacagcggcggacaggccaaaccccggctggtcaccaacaaataagctatgacctcatgaactttatgcca

SEQ ID NO: 19935 - DNA, 306 bp, Gossypium hirsutum
  Clone ID: uC-gsflnu33B115b02b1
tttcctcgcgtccgaaataatctaggtggtgttggtaatgccagcaacagaactgttcatttattttgggggtttgttgtttatgtttaatgatgttattcaagagtgtaaaagagcacttcggccccgcttttttctttgcttaaataagggaaatagaaggcggatgtgtacattttttttgttcgaaaacgctggctgctaaagccttatcctttctgactgccgtttattcggaactactgatgttttgaaatgcattcgagactaaataatggaaaatgctacaacaagaataatgtgttg

SEQ ID NO: 19936 - DNA, 433 bp, Gossypium hirsutum
  unsure (1)..(433): unsure at all n locations
  Clone ID: uC-gsflnu33B115b03b1
tttctcgcgtccggttcgagtgtgtcccaaaggcagacgctgctttctttttgtgggtgttgcatgactgggatgatgaggaatgcatacaaatcctaaagaaatgtagagaagccatcccacaagacaaagggaaggtcataatcgttgaagctgtgcttgaagaagataaaaatgacaagctagaatttgtggggttgatgttagacatggtgatgatggcacatactaaaaaaggcaaagaaaggactttaaaggaatggaagtatgttcttggagaggctggattcaccagaatcaatgtaaaacccattcatgctgttcaatttatcattgaagcttatatttagaaattccaccttgcctgctttctttnaaaaaaaaaaaaannaaaaaaaaaaaaaaaaaaaaaaaaaaaaaaaaaaaaaaaaca

SEQ ID NO: 19937 - DNA, 460 bp, Gossypium hirsutum
  Clone ID: uC-gsflnu33B115b04b1
tttatactaagacgtttcactgggatcatggtttatcgggttggatgtcgatcatatagatgaccgcagactctgctgtggtaccacagattgcgaatggaaggctcaagcgggcaacatctgtgttgcttcatttgactggacctgcagcggtatttgcaggtcagttgacaggatgaaggatgttcaccggcggtgcggagaagggaataatgctttacggactgcaactttctaatgaagcccagttcctccaacctcaggagggaagcaagtgaaacaaaacgagcttggtttttgggcattgagagttgagaaaaaaaaaagggactgtaataactgtagaaacatgaatgggttgaggggaaaagaagaggttgaagctgctgaatgtctgctccattttatatagggagaaagagactgcaaacagcagttatatatagagagaggaagagag

SEQ ID NO: 19938 - DNA, 358 bp, Gossypium hirsutum
  Clone ID: uC-gsflnu33B115b05b1
tttgttattgctggttcaaagtgattgtacggagagggcgaagaggaaggcccaaatgcttcttaagttgcttcgggattcgtggcccgaagattccatcggcaattcggatgattttgcttgcagtgaaatcgtacccttttgaccatccctctcgcctcacaccgaaaagtttgtaacagaaaaatataagccttttaaatttcgataatacctacaacattttttaagagatgggtgtatataaacaaggattgtaatttttgttaagcaaagcaaatgaatcatacatctgttttcctgggaaaaaacaaagaaaaaaaaaaaaaaaaatttacgcacttataaagtacaaaaa

SEQ ID NO: 19939 - DNA, 511 bp, Gossypium hirsutum
  Clone ID: uC-gsflnu33B115b07b1
tttggacgcgtgggttttttttgtgcattgacatctggtttttagggtttaaaaactaggatcatgtagtcatatatatatattaaaatgctttttttaccaacatcacttcatatcttaaatgtaataatatgtgaaaaaaatcaaaacaccatcttcccttagggaaagggaagataatggtttttaagtacaaacttaccctagctttgttttcttttgtaaattcattaatggtggctaaaactttgggagtatttagcccctttctgattgaactatggtaaatagtttcttcttttgtgattttaatatgcatttagcttttttctaacatttcatcatgaaaaaggagctccattaatggatatggagctcgcaagcattttgcatgcaaaccctaggagatatttgggttccttagggttcttctcttctaatgtaccaaccatggttaggaccttctctctctaccctctcttgaacttggaacttgttattttatatatat

SEQ ID NO: 19940 - DNA, 384 bp, Gossypium hirsutum
  Clone ID: uC-gsflnu33B115b09b1
tttcgtgctaagaacaaggccagcagggagagaaagttggccagaagagaggaacgccttgcacagggacctggtgtgaaggcaacacccacagcggcaccccaacaagccgagggagttaagaagacgaagaagtgaataaataaggaagatggctcgacttaatatgttaatggcttttgttttctttataggagtttgtttgcaaaacgctggttccatttatgttgactcacataactataaattagggaattttggaaacccgggtgctgttttatttaatcaggatgcttatgatattgagtgtattattattattcaatgacgatgcatgcggtatgaattagaaaaaaaaaaggtgaggagttagaaataaaactc

SEQ ID NO: 19941 - DNA, 488 bp, Gossypium hirsutum
  Clone ID: uC-gsflnu33B115b11b1
tttaaagaaaaagcaaaggggagggcctgttttcttcacaaccaccatgagctgcgagtcttcaataaccaagaggctggatggcaaggtggcactgataactggtggtgccagtggcttaggaaagtgcacagccacactatttgtcaaacatggagccaaggttctcattgctgatattcaagacgaattgggcgactctgtttgccaagagcttggaactgaaaacatcagctatgtccactgcgatataacgtgcgaatccgatgttgaaaatgccgtaaacttggctgtctccaagtacggaaagctcgatatcatgttcaacaatgccggcactcttggtgacaacgaagcaagagtgacacacgccagcacggaagacttcaagagagtgttcgatatcaatgtgttgggtggtttcttgggtgccaagtatgctgccagggtcatggtttcggccaaagaaggttgcatactattcactt

SEQ ID NO: 19942 - DNA, 504 bp, Gossypium hirsutum
  Clone ID: uC-gsflnu33B115c01b1
ttttataaaaaaaaaaaaaaaaaaaaaaaaaaaaaaaaaaaaaaaaaaaaaagaaaaaaacaaaaaaaaaaaaagaaaaaaaaaacaaaccaaaatgagagcatatataaaatggggggccggttttggggggctgggttttgggacccccggttttgtcgcccggctgggtgctttcagtgtcctttttttttactgcggggcgctggttcatcgggcggcgtttggaaaagtccctgtcttgacccccgttcttgttccacactttcttcctttttgcccttgtcccttttcagacgggtgggccatcccgtaggggcctccccctggtgggtcacccaaagttgttgaaggggcactggctccggggcgtgcctctttgccggggctttttggggtggcccttgtattgtctctccccctttggccctcccttttggggggcctttgtgcccgttcctttttttttttccccttgttttctcagggcgggtgctttttttc

SEQ ID NO: 19943 - DNA, 511 bp, Gossypium hirsutum
  Clone ID: uC-gsflnu33B115c10b1
tttagaaatggcatcaaaaaagggttctgaagaggtttcgtgtgtctttgaaagggggacactgtgcaacttttgggtggctcctaaattttgcaaaggtttagacaaagtagaactagatgaggtgtgctctttccatggcttggttttcgctcctccggcgccatttccgccatttattgtagctgctgatgttgcctatgcgttctttcactatggtgataatataggttccagttgtggtttttcctttgttattaaagaaaataatctagagcctgagctaaagtggattattgcttggaaaaatggaccatgcaatgacaacaaggtctatacaaatatccttcctctttcagatgacgttgattgggatcaaatcaaatgcaatttgaagtcggagaattgtggacccaaaagttgctgcgacctatcgggaataaaagctgaggcttttatcgagccgggtgttaagacacctatgaaggcaaaactgataaaacaataattt

SEQ ID NO: 19944 - DNA, 370 bp, Gossypium hirsutum
  Clone ID: uC-gsflnu33B115d02b1
aggctctctgaaccttacaagggtattggcgattgtatcaagcgaacactcactgatgaaggattcggctctttgcggagagggaacactagtcatgctattcgttcattccccactcaggcctcgaactttgccttcaaggattacttcaagaagctttacaacttcaagaaagacagagatggttactggaaatggtttgctgggaacttgtcatctggtggtgcagctggtgctccttcccttctctatgattactccttggatttgctcgaactcgtatcacaaatgatgcacaggctgccaaaaagggaggagagagacaattcaacggttttgctgatgtctacaggaaaaccctaaaatctga

SEQ ID NO: 19945 - DNA, 455 bp, Gossypium hirsutum
  Clone ID: uC-gsflnu33B115d05b1
ttgttggacagggcgtgccggtaaaacaggattggcaacagctttctttaacgaaggcaatttgtcaatggcaaggccgctagctgagctaatgcaagaagcaaatcaagaggtacctgcatggctcacccgatatgcatcccgggctccttatggtggtaataaaaaccgacgatatggaggaggaggagggcgttttggtgggcgtgatttcagaagggagggttcagtcggtaggaacctagatcactacggcggaggtaatagtggcactgcatacggagttcccgggaattatggtggaggatatgctccggggatgacaagtgcttgggattagatcccactttatactggattatatattttgtatttcgctgagtatatatatttgtcgtcagattttcaaggatcattctctgtttttcagtatttagcatttgcatcaaacaaaa

SEQ ID NO: 19946 - DNA, 513 bp, Gossypium hirsutum
  Clone ID: uC-gsflnu33B115e05b1
ttcttttacctttcccccccaaatttctgatacttgtaccggtgaaaatggaggcattgggcggtaattgcgcgttttggggttggaaacttccggagataagaaacacaaagaggccgtttccgtcaaagtcaaaatcctcggattcatccgcagagtcaacgggcagtcgaggctaccgtttcccgttgaagcaagcggtgacagcttcctcactcgctctcacgggcgatactattgctcaactaagctcccattggagaaaacggaaagattccatttctggttccagtgatacaagtaaggatatcatgccaagcgtcatttcagatcatgattggcttcgtgccttgaggatgacttcttatggtttccttttatatggtcctggctcatatgcttggtataaatatctggatcactgtttgccacatcagacaccacaaaatataatgttgaaggttttactaaaccagatagtgcttggtccttgtgtaattggtgttgtctttg

SEQ ID NO: 19947 - DNA, 483 bp, Gossypium hirsutum
  Clone ID: uC-gsflnu33B115e08b1
tgaatctatcaatggaaggactcactttggtagtacagaaccattatggtattctcatcgttgcagtgctttcaatagcaataacatctcttctattgaaagcgtggggaagcactgtcgacaccaccgatgaagatggtattcctggccgattgggattacctttcttcggcgaaaccttctccttcttttcggcttcttacagcacaaaaggatgctatgattttgttaaacagcggagaaaacagtatgggaagtggttcaaaacaagaatactcggaaagactcacgtgttcgttccgagtgttgagggggcaaaaacgattctagccaatgattttgttcatttcaacaagtcatatgtgaagtcaatggcagatgcaactggcgcaatgagtgtgttctccgtaccgcacatgatccacacatgaatcagacgtcttctcttcgatccttttccatgagttctttgtccaggttgct

SEQ ID NO: 19948 - DNA, 461 bp, Gossypium hirsutum
  Clone ID: uC-gsflnu33B115e11b1
tttcacgcgtccgcccacgcgttcgggccgaagagactaagaaccctgctcacgatatccctattggtcttgatggatccatggtaataaccacagctgcatattgttcgcttgctgtagcattgtgcttaatgcaaccgttccgtgagattaatgcggatgccccattttcagtagcatttgaagctgctgggatgtcatgggctaaatacattgttgctgccggtgcattgaaaggcatgacaactgttttactcgatggtgccgttggtcaagcacgatatctcacacatattggacgaacccacatgatgccaccatggtttgcacatgtgcattccaagactggaacaccaattaatgctaccgttgtcatgcctttccgaacggcaattattgctttcttcacagaacttgatattgttgcccatcttctatcgaattaacattattaatcttca

SEQ ID NO: 19949 - DNA, 486 bp, Gossypium hirsutum
  Clone ID: uC-gsflnu33B115e12b1
ttccacgcgtccgatttccccatctctctcgtctctgggtctcgtaagttggtgaatagtgttgtaattagtgccaatggctcggattgggacctctgcagctcacattgtgttggcaatatttgctgtggccatgtttgttgtgtccgggaccatggcacaggatattgctccttctcctgcaatggctaccggagcaggctctgctttgccggtttccgctgtcttcttatgctcttccatgttggtctctttaattgctctcttggtgcattgaattcaaagcttttcaagactttatgacattggctacccttaatttcactctcactggtgatgaggggagtagcctttaatcttctccgagataatatttgggtgttatcaattttcaatttctctaaaggtttaaatatctctatatatatcatgttacattagtgacataaatttgatttttgtatggaatggggtgattttcttata

SEQ ID NO: 19950 - DNA, 506 bp, Gossypium hirsutum
  Clone ID: uC-gsflnu33B115f02b1
tttatctttcttggttctaaacggaaccaacaaggatttaatgcaaaaagcactccaaaaatcctttcttttcatgatcttcttgatatagcgggtaacgtaacagagtttccctcggtttccgtcaagcagaccgatacagcagtgctgctttactcttcggggacgacgggtgtcagtaaaggtgttgttctgacacatgggaatttcattgcatcatctttgatggtgacaaaggatcaagaacttgcaggggatatccaccgggtttacttgtgcatcttgcctatgtttcatgtgtttggattggctgtcatggtgtacgcgcaggtacagatgggaaatgctttggtgtcaatggcgaagttcgattttgagatgtttttgaggaatgtggagaagtataaagccacccattcgtgggttgtgcctcctgttgtgcttgctatggctaagcagaatgtggttgacaagtttgatctttcctcattgagcaaattggatct

SEQ ID NO: 19951 - DNA, 487 bp, Gossypium hirsutum
  Clone ID: uC-gsflnu33B115f04b1
tctgtctcgtacgtagtaacagtagcgggaaagagagaagcctcaccgccgctgccgcagccaccatgggtcgtatgcacagtcgcggtaagggtatttcagcctcagctctgccttacaagaggaccccgccaagctggctcaagatctcgtctcaagatgttgaggaaaacatacgcaagtttgcaaagaagggcttgaccccatctcagattggtgtcattctccgtgattctcatggtattgctcaagttaggagcgttactggcagcaagatcttgcgtatcctcaaggctcacggtctggcccctgaaattccggaggatgtgtatcaccttatcaagaaggcggatgccatacgaaagcatttggagagatacaagaaggataaggattccaagttcaggttgatccttgttgagagccggattcacaggcttgctcgctactacaagacaacaaagaagcttcccactgtctggaaata

SEQ ID NO: 19952 - DNA, 491 bp, Gossypium hirsutum
  Clone ID: uC-gsflnu33B115f06b1
tcttgtttcatgatcttggaactgatgggaatcctgatgagaggaggaggtatggcgatagacgtggacctgtacgttcttttaggtctccttacggtgttgctgatagtgaaaattttcatcttaatgctgagggtggccctagatccttcaggttctgtcctgaagatgatccagagttgcatgaaagagggaatatgagggaaagagagtttgatagacggatcaaaaatcgaccagggaatgcccctaggaggacaagaaacttggaggagcaggaaggaaatttcaggcacggtggtcaggtttggcatgatgatgggtttgatgatatgtcacaagctaagcgaaaacgattttgagtaggtttttttatgccattagtctactgtcaatggtgtaagttatcagagcagcagggcagaatctgttaccattctctattttctgcaaacgcagtaaccccttgtttaaggtgtagaataaaatct

SEQ ID NO: 19953 - DNA, 451 bp, Gossypium hirsutum
  unsure (1)..(451): unsure at all n locations
  Clone ID: uC-gsflnu33B115f07b1
ttggacagcagctcagtcccaagatgataaggattacactgagccacccccagcacccttctttgagcctagtgagttgacttcatggtcgttttaccgagctggaatcgctgagttcgttgctactttcctattcttgtacatctcggtgttgaccgtgatgggagttgttaaggacaaaaccaagtgtacaactgttgggattcaagggattgcttgggcttttggtggtatgatctttgcccttgtttactgcactgctggtatctcaggtggtcatatcaatccggcggtgacatttgggctgttcttggcaaggaaattgtcgttgacaagggcaatattctacatggtgatgcagtgcttgggagctatatgtggggctggtgtggttaaagggttcatggngaagacaaggtatggtgctttgggtggtggagctaactctgtg

SEQ ID NO: 19954 - DNA, 298 bp, Gossypium hirsutum
  Clone ID: uC-gsflnu33B115f10b1
tttgggaatgataagcacctcccgaccagcaaaccacagaggaatgctgggcgagagacccacaaacagtgtctcaggaagaccgcgacgatggacaggaccaacaggactatcaggaccgtccaccgaggcctctgattgacatggatgatctcatcagatggtctttatacagacccataataactctgttgataaccactctactatttctgtatgtcactgacggtactgacattggtcacaagacacaacaagatgcatgagacggagcagtcctcatgggaattgcatgaac

SEQ ID NO: 19955 - DNA, 511 bp, Gossypium hirsutum
  Clone ID: uC-gsflnu33B115g01b1
ttttctcaatgagtttgttggagacaaagtagcgtatgcactttctcaaggcttgaaggttattgcctgcattggggagactcttgaagagcgagaatctggctctaccatggctgttgttgctgcacaaaccaaagcaattgctggaaaagtaacaaattgggacaatgttgttttggcttatgaacctgtttgggccattggaacagggaaagttgcaacccctgctcaggctcaggaagttcattgcgagttgaggaaatggcttcatgagaatgttggcggtgacattgctgcatcaactagaattatatatggaggttccgtaaatggagcaaactgcaaggaattggccgcacaacccgatgttgatggctttttggttggtggagcttccctaaagcccgagtttgttgatatcatcaaggccgcgatggtgaaaaagaattagaagtttgaaagcaggaattaaaggtgaaacagaaacaaccttctgggaaactttaatttt

SEQ ID NO: 19956 - DNA, 521 bp, Gossypium hirsutum
  Clone ID: uC-gsflnu33B115g02b1
ttaacgtcgtaaggggattgcttggacagaggatgagcacaggttatttcttcttggtttggaaaaatatgggaaaggtgactggcgaagcatatcccggaactttgtggtcacaagaacgccaacacaagttgcaagtcacgcgcaaaaatatttcattcgcttaaactccattaacaaagataggaggcgatctagcatccatgatattactagcgtgggcaatggagagattctagcaacccaaggaccaatcaccggtgaaccgaatggtgcggcaactggaggttcctccgcaaaatcagccaaacaaccctctcagcttcctgctgcaccaccaggtgttagcatgtattcttctccaactatagggcagccaataggagggccccttgtctcaacagttggcacgccagttaatctttctgccccgccacatttagcttatggagcagtggttcctactgcaccgatgaaacatggtcctgtcaaatactcaattgcctcataatctgatcata

SEQ ID NO: 19957 - DNA, 364 bp, Gossypium hirsutum
  Clone ID: uC-gsflnu33B115g03b1
ttcctcgcgtccgcttgagggacctatgggaacaagtcagaatgcccttgctatcgagacaagaagaactccaaacaccagcccaagtgcccttgaacttcaaactcttctccatcttttaaccttcatatatatatagatatatacgcatgtacgatttagctatttagcctccaactcttcatcgtcttaggcttcttcttattataattctcttgccattacactatcacttctgttctgtttatgatgtactgcttctgccacattttatctgccttctccgacctcataaggaaggaatattataggaataataaaatcattaatctactataatgaaaaaaaaaaaaattattcctct

SEQ ID NO: 19958 - DNA, 513 bp, Gossypium hirsutum
  Clone ID: uC-gsflnu33B115g04b1
ttaagaacgaggcgcttaggttgtatgcggcccatgtaactcaacttcgcaataaaggattgcctacgattccgactacgttaaagacagagaaggcatgcaatcccttccttcggacgtcaagtacagaaatccggcaggcattagatattccagccaccatgaatgaagcagaagccttgggtgtcatccgtcgagcaaaggacaatttctaggattacttttggggttaatacaaaaattggtccccgaatgcaatccggtaaatccgatccctcaacatatattattttagctacgaatgagttagttctgttacataaaatactgatgtgacataattgatcaaatattaaattgtgattttagtattagttgatcatgtcacgttagtattttatgttttgtttttaagtgtatagtttagggatcaatttacggaataccccttagttatactcggttcctctttgtgtataggttatgtaataatgtttagcatgtcaatacact

SEQ ID NO: 19959 - DNA, 490 bp, Gossypium hirsutum
  Clone ID: uC-gsflnu33B115g06b1
tttattataaaaaaaaaaaaaaaaaaaaaaaaaaaaaataaaaaaaaaaaaaaaaaaaaaaataaaataaaaataaaaaaaaagaaagagaaaataaaaatgcctaactgggggggccgttttgggggacccaggtttccttcctgtgtgggtcgcggtgttttgcttcttttttggggccacctaattctgatgagttggcggtgtttttacaccgctcagattgggaaacccggggggttccccaatttaatgggtttggggaaaatccccgtttccccacttgggattcatgtgacaaggccctccctgttggattttccaaaagtttccccagcttgattggcatttgtgccccgccctgtggcggggctttaaccccggagggtggtgctttttcccgcactgtaaccgtttctttgggggcgttctttccccccttactttgggttttttcttttttttttagccagttgggctggttttcccc

SEQ ID NO: 19960 - DNA, 499 bp, Gossypium hirsutum
  Clone ID: uC-gsflnu33B115g10b1
ttccacgcgtccgaagctttttgaaatttattaacaaacatttccatggctttaacaaagagaagatttgtttggggggggtgatgttttagataactccgtccattaaaaaaaaaaagggtttcatgatcgttggctgttctactttgggtgttgtttggattttgcattttgattacaagatacgaagatcatctatgcgcttttgagctttgaagaatatgttggatgaatataaagcctctttgaagaaacttttttctttcaggcaatgggaaccgaacttgagcactgtggtataaacccaataatagaaagctcagaaagtaattccacggaaattagggttaataacatggaatccatcaaagagacaatgcaaatgcatgaagacatgttcaaacaccaggtacgagaacttcatcgggtgtacagcgttcaaaaggcactaatggaggaactgaaaaagggaattaaatcaaacaggttgtgggcaact

SEQ ID NO: 19961 - DNA, 377 bp, Gossypium hirsutum
  Clone ID: uC-gsflnu33B115g12b1
ttccacgcgtccgcccacgcgtccgctcaccctctcttttgcactttaaaatgaacttccctttcacttcccaatcccattgtgaaataaaaatggctacttcaaaattctttttatcttctcttcttctgttactttttgttcatggagttttgccaagagcagaatccaagacgtactggggagatgttgatgccttgaaacaactcaaaaatggagtccagcctaattctgtgagcccgggttcttgcttgggttcttgggatttcacattcgacccatgtgacagcctcttcagtgaaagattcacctgcggtttcaggtgcgaccttacagtttctgggttgagcccagtcactgaggttactctcgactct

SEQ ID NO: 19962 - DNA, 327 bp, Gossypium hirsutum
  Clone ID: uC-gsflnu33B115h01b1
tttcatgcgtccgaaaccatagagtccgacatggctactgatgccactccaaccgttcctctcgctgatgtgatgaaagcctcgattcgacccgacatcgtcaccttcgttcacgacaatatatccaaaaacagccgtcaaccctatgccgtctccaaacgcgctggtcaccaaacttcagctgaatcctggggtaccggtcgtgccgtctcacgtatccctcgagttcctggtgggggtactcaccgtgcaggccaaggtgctttcggaaacatgtgtcgcggtggacgcatgtttgctcctaccaagatctggcgccgctggcac

SEQ ID NO: 19963 - DNA, 523 bp, Gossypium hirsutum
  Clone ID: uC-gsflnu33B115h03b1
tttcctttcgtccgcccacgcgtccggaacagagtactcggatattcttcgagtacccttcagaacagaaaagggaattgttcgtaaatggatctcaagatttgaagtctggccatacttggaaacctacacagaggatgttgctcatgaaatctccaaagagttgcaaggcaagccagatctgatcatcggaaactacagtgatggcaatatcgtcgcctccttgctcgcacataaattgggtgtcacacagtgcaccatcgcccatgctttggagaagacaaaatatcctgattcagatatctactggaagaagcttgaagacaaataccatttctcttgccaatttacagctgatctttttgcaatgaaccatacagatttcatcatcaccagtactttccaggaaattgcaggaagcaaggacactgttggtcaatacgagagccacactgttttcactcttcctggtctctaccgtgttgtacatggtatcgatgtgtttgatcccaaattcaacatt

SEQ ID NO: 19964 - DNA, 495 bp, Gossypium hirsutum
  Clone ID: uC-gsflnu33B115h04b1
cctctagactcttccctagacactggcaaaatctctgtcactgtgatcattaatggccaccgctaaacctgaagttccagctactgatcaagacactgcggaggcagaggagccaaagccggagccaaagcctgtgaaggagaagatacccaaaactccacaggagaaaaagcctaagcaaccgacatccacagcacgtcctacatattgtcatatgatcaaggaggcgctcatggctgcgcaagagaatagtggatcaagtacggacgctatagccaactacatggaagagaaccacaaggagaagcttacagcgaatctcaggaaaatcttaagtcttcagcttagaaactcagctgacaaaggcaatctgataaacatcatggtctattacaagctctcttacaccggctaagaagacaaagcccctgttacagacgctaatacagagaataaggctgagccagcttctaagccgaagaaagctgaggctac

SEQ ID NO: 19965 - DNA, 317 bp, Gossypium hirsutum
  Clone ID: uC-gsflnu33B115h05b1
tatttcttgatgaaagccatacattatgaaaaaaagacagcagcaaaaataacaggcctctgtaatgatatattgccaaggctggatgcctgcacggtctataattatgtctctgtctgagtcttgtgtaatagaagctttgtttgtggtgaaaataatgtataagccatttggttgggagcaaattgtcctttactccaaaggatttttgctgctcattcatggagactaggtttatggaattatctgctgttgctaaaatcttataaaaatatatatcggttgctgctcttggcttgtatcaaaaaaaaaataac

SEQ ID NO: 19966 - DNA, 353 bp, Gossypium hirsutum
  Clone ID: uC-gsflnu33B115h10b1
tttagactaaaggagatcgaaggaaaaaagccggggctttacgtgaaatgcaggccaaagtcaacgaaaggagctgggcgctgtccaaggtttatctcctttcttttttaggtcttctttgctggggtatccaatctgagttccgcgggatatctacgaacaatcttttttattgattcccctaatataatgacactgaccgcatttttactacttttgaaatgtaaaatccactgctttaccaataatattaatattgatttacaaaccatttattcgcgctgtgtgttatgaatagaaaggccctaaaaaactgacttgcccaacatttggccatcttatatggcaatgtg

SEQ ID NO: 19967 - DNA, 531 bp, Gossypium hirsutum
  Clone ID: uC-gsflnu33B126a02b1
gagtgttgagatgaggaaaatcatgggtgccaaagttctcttcttctttgctttgctttccttttcagctgtgtcggcatttgcacaggatgaggaagaccaaggtcttgttatgaacttctacaaggattcttgtcctcaggctgaagacattatcaaggagcaagctaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagctgtttcttgagctgatatccttgttctgtctgctagagaaggcattcgtttcgttgggaggcccttacattcctctcaaaactggaagatgagacggtagaaggagcagagcagatgctgtggaagagttattttcccgaccacaatgag

SEQ ID NO: 19968 - DNA, 574 bp, Gossypium hirsutum
  Clone ID: uC-gsflnu33B126a08b1
tcgtttccacaaatcaactgtttcttctcaaatctaaagcaaagcaaagcacgcagcaatcatggcagatgatgaagtgaaggatgaggtgccggaaatcacatcatttgatcctagtaaaaagaagaagaagaagaaggttgtgattcaggaccctgcagatgaatctgttgacaagttggcagagaaaacggaggcattatcagtttctgaagggcttgactttagcaatctgaaaaagaagaagaagaaaccagtagaggccaatacattcactgacgaaagtggggatgcaggagatgattttgatggtcatattgatggggatgaagaaggtgaaggcattgtcttgcaacaacggtacccttgggatggaactgaccgtgattatatatatgatgagctactcggtcgggtgttcaacattctccgggagaacaaccctgagcttgctggagacagacgtagaactgttatgaggccttcacaagttcttcgtgagggcaccaagaaaactgtttctgaaatttcatgatctatgcaagacattgcattgacaaccagaccatgtcat

SEQ ID NO: 19969 - DNA, 420 bp, Gossypium hirsutum
  Clone ID: uC-gsflnu33B126b01b1
taatgctcttcggcttgagagacgaactttaagcaagctaatgcgtaaaaggttttcagaagaagagagacaaaaattgtatcagaaatggggtatttcgttaaactcgaagcagagaaggttacaactggtgaaccagttgtggagcaataacaaggatattgatcacgtcacagagagcgccaccatcgttgcaaagctgattaggtttgtagagcaaggaacgtccactcaaggaatggtccggcctaactttaactcctccacggcctaggcggagatcctatggtgggaaaaacagaagggtttttttattataaccttatatatcaacatctgtatacagccttagaaggtaattttttttaaaaaatattggccctggtaagaatttttttaatgaatggaaatggttaacag

SEQ ID NO: 19970 - DNA, 473 bp, Gossypium hirsutum
  Clone ID: uC-gsflnu33B126b12b1
tcccagttagaggacatcctcgaagaaccattggtaggagccctgtaaggtcccggtcccgaaaaagcccaagtaggagcccacccaggtcaacattaaaatcaactagtagaagccctgttagactttcaaaaagaagcacaagtaaaagtcctgcaagatcttttcggagaagcattagcagaagccccataaggtctaggagaagcactagcagaagtcctgtaagatcttctaggagaagcataagtaggagctctgctagggctcctcctaggagaagcatcagcagaagtcccttaagggaaccaagtaggaattatcgtcgtagttattcaaggagccccaccaccgtgcggtgggtaaggtcacctcctggtcgaggtagaagtttgtcaacaagtgtttctcctgacgcatcacctaagcgtatcagaaggggtcggggttttagtgagcgctacttttatgca

SEQ ID NO: 19971 - DNA, 521 bp, Gossypium hirsutum
  Clone ID: uC-gsflnu33B126c01b1
tttctttcgtccggatgtctgatgctgggatcaagtacatccccagcaatactttctcttactatgaccaggtgctcgatgccacatcgatgctcggagctgttccacctagatacggctggaatggtggtgagatcggatttgacacttacttctccatggccagaggaaatgcctctgtccctgcaatggaaatgaccaagtggtttgacaccaactaccacttcattgttcctgaattgggacctgatgttaacttctcttatgcatctcacaaggcagtggatgagtacaaggaagctaaggcgcttggagttaacacagtcccggtccttatcggccctgtctcatacttgttgctctctaaacctgcaaagggtgttgagaagaccttttctcttctctccctcctccccaaaatcctccctatctacaaggaagttatatctgagcttaaggcagctggtgctttctggattcagttcgatgaacctaccctggtcttggatcttgactctcac

SEQ ID NO: 19972 - DNA, 522 bp, Gossypium hirsutum
  Clone ID: uC-gsflnu33B126c03b1
tttttctttgagtttcgagctttgaagtgcagaatcaagggattgtgggtggagaagaagcggtgacggatctaacttggaactccgttttctcttcttaccgctattcccgacctatctctaaccccctcaatttctctcaggtagatattccttgtgttcaagcgtcttcatggcttcaaagcggattttgaaagaacttaaggatttgcagaaggatccaccaacttcctgtagtgcaggtcctgtagcggaagacatgtttcattggcaagcaacaattatgggcccctccgatagcccttttgcaggaggcgtgtttttggttaatattcattttcctccggattatccattcaagccttctaaggttgcatttaggaccaaggtcttccatccaaacatcaacagcaatgggagcatttgtcttgatatcctaaaagaacagtggagccctgcactgaccattttcaaggttctgctttctatttgctcgttgctgacggatccaaaccctgatga

SEQ ID NO: 19973 - DNA, 350 bp, Gossypium hirsutum
  Clone ID: uC-gsflnu33B126c04b1
tctttatgcttatctctatcagtttgtgctgtgtgacccacggaggctgtctacttctttatattaataatactattaaataaatttgacagccaccccataatatactactggattcctacttcttctaccttacctattcaacattgtgtgccttgtttctcctttttcttttcttttctgtaatagtatatacacacacgattgtgtgaattaataaaaaaatgtctatgtctgtgtctaaaaaaaaaaaaaaaaaaaaaataaaaaaaaaaaaaaaaaaaaaaaaataaaagaaaaaaaaaaaataaaaaaaaccatattaaaaactattcaaacaaccacataat

SEQ ID NO: 19974 - DNA, 335 bp, Gossypium hirsutum
  Clone ID: uC-gsflnu33B126c05b1
ttatatttctggtaatacttcttctgtcccagctgctcttccagtcacaagcacccctgaagctgtagtagctgcttagatagttttcattttaacttatcagcttctgtaataaaaaaaaaaaagtatctataagactatatcttgtgagtagactgatgtttagctggtcgtcatcctcagcagtagtagggtacatagttggttttatgaggttataaattaagagtttgtctatgcacgaaactttgtcgtttggatggaatgtagtaataatgtacgccgctattttactcaaattcggatatatctgatgcgagtatatgtttggaatg

SEQ ID NO: 19975 - DNA, 62 bp, Gossypium hirsutum
  Clone ID: uC-gsflnu33B126c07b1
tcgtatacgccaccgcagactagcaactgggggggagctttatcgcaggagtcgtagtgata

SEQ ID NO: 19976 - DNA, 262 bp, Gossypium hirsutum
  Clone ID: uC-gsflnu33B126d03b1
tttgttttgataacatatgatcaattactcattgtaaaggttcaagataaatgggtgtacagagatgggaaagcaacatcaggcagtggtctttattcgtgagatgaataaagaggctgggatctatgtttccctttaaagctctattcaagctgctgaaaacactatcggcgtttgatacatgctgaaaagatttgagagcaaccaaacgaacctgcattgctggggctacaatggggatggcgggatccctgactgtaag

SEQ ID NO: 19977 - DNA, 482 bp, Gossypium hirsutum
  Clone ID: uC-gsflnu33B126d04b1
ttctttccattgctacaagtccatagagatgaagtttttcatttcagtattggtcctttttgttctcttttcttatgcagctgcatatgatcctttggatccaaatggaaatgtaacaatcaaatgggatattgtgtcttggacgcctgatggctatgtggtagtggttacaatgaacaattttcaaatgtatcgccacatcatgagtcctggttggaccttggggtggacatgggctaagaaagaagtaatatggtccatggtaggggctcaaactactgagcaaggtgattgctcaaagttcaaaggaaatatacctcactgctgcaagaaaacccccacggttgtagacttgctccctggggttccctacaattaacaattcaccaattgctgcaaaggtggagtgcttgcagcatggagtcaagatcctcaatctgctgtctctgctttccaaaatagtgttcggattagccggtact

SEQ ID NO: 19978 - DNA, 87 bp, Gossypium hirsutum
  Clone ID: uC-gsflnu33B126d05b1
tattttcgttcggtgaaaggtaatagaaatggagaatgatataaaaaaacagagcaaaacagaaatgagaagtaatgtgatggtata

SEQ ID NO: 19979 - DNA, 95 bp, Gossypium hirsutum
  Clone ID: uC-gsflnu33B126d06b1
tcctttcgtccggtgacacgtaatagaaatggtcaaggatattatacaacagagccaaacactaatgagatagtaagccaagggatattatcagt

SEQ ID NO: 19980 - DNA, 82 bp, Gossypium hirsutum
  Clone ID: uC-gsflnu33B126d07b1
tcgtccacgcgtccggaaacacgcaataaggaggggcatttttacaatacgagggggccaaccccagacagaaagctatctc

SEQ ID NO: 19981 - DNA, 549 bp, Gossypium hirsutum
  Clone ID: uC-gsflnu33B126e03b1
tcgttattacccgctgagtttaagcatatcaataagcggaggaaaagaaacttaccaggattcccctagtaacggcgagcgaaccgggaaaagcccagcttgagaatcggtcgccatcggcgtccgaattgtagtctggagaagcgtcctcagcgacggaccgggcccaagtcccctggaaaggggcgccggagagggtgagagccccgtcgtgcccggaccctgtcgcaccaagaggcgctgtctacgagtcgggttgtttgggaatgcagccctaatcgggcggtaaattccgttcaaggctaaatacgggcgagagaccgatagcgaacaagtaccgcgagggtttggttgagaaggactttgaacagataggcgagttcctccaccgagccgtgacaatcactttgaacatccaaaagcaatatggtaagcttttgaaggacttcaacacagggttggacaacaacaaggagatccaagagctgaaggttgatgttgagaagttcgcattctcattcgatatgcctggcttcaaatgtccgaatg

SEQ ID NO: 19982 - DNA, 530 bp, Gossypium hirsutum
  Clone ID: uC-gsflnu33B126e04b1
ttatttttatacgtaaaattctaagagaaaaaagaaatgagtggtggaaatggtcccaagctggagttgaaactgaacctatcaccgccgagggttaacccaacagaggaatcatcgacgacggcggagaattcttcttccgcaagttcatgtgtgctgtcagagacgaaccagatgcatgaagttgacacttccaccgatgctgcggcggatgtggcggcggcgacacccatgatgctagttgggtgcccaaggtgcctcatgtacgtgatgtcagagaatgatgaccctaaatgccctaagtgcaagagcactgttttgcttgattttctccccgccattaaaaattagaaagagttcgagatttatggtttaattatgatatcagcccctgtactttttaattttataaattaagtccatttttcttttagttaaaagaatctagtcctttgctaaattagatcttcaaatgtttaaacgtcatatattcgaatttaatggaagtttattgatagctttgctaaaaa

SEQ ID NO: 19983 - DNA, 159 bp, Gossypium hirsutum
  Clone ID: uC-gsflnu33B126e11b1
taaaaaaaaaaaaaagaaaaaaaaaatagataaggaataattaaaagaaggggggaaacagcaggggcatatgaaatgggcccccctgggggggccggcggtgggctttctggggggtgtccttcggggttccttcgtctttcttcgctgggggggggg

SEQ ID NO: 19984 - DNA, 328 bp, Gossypium hirsutum
  Clone ID: uC-gsflnu33B126f05b1
ttccattcgtccgcccacgcgtccgcccacgcgtccgcccacgcgtccgaatattttcatgtcttattatatgtttcttttaataatttatggtgttttgctggttcatgaagatcataaagacgtgtctgaggttagattattttaatagatgtcgatgaatccacgaacgaatcaatgtagtacgatgttgtgattttagttagttcataggatcatattaattgtgcgtgtgtgttttatttttcttatttcaaagctaagcttgttttgtatgaactttgctttatttttaaaaaaaaaaaaataaaaaaatatataaataaat

SEQ ID NO: 19985 - DNA, 83 bp, Gossypium hirsutum
  Clone ID: uC-gsflnu33B126f06b1
tctttgtgtccgctcacatgtaatacaaatggaaaggtttgatcaaaaatcaggctatacagcaatcggaagaaaacctgaag

SEQ ID NO: 19986 - DNA, 62 bp, Gossypium hirsutum
  Clone ID: uC-gsflnu33B126f07b1
tctgtccacgcgtacggagaaacgccactggaggggtcatttatagaatagcagggggcaaa

SEQ ID NO: 19987 - DNA, 570 bp, Gossypium hirsutum
  Clone ID: uC-gsflnu33B126f08b1
tcgttcacgcgtccgcggacgcgtgggtgaagcatccatacaactcccttggcggtggtgcaaacacggtggcttctggctacaacaacggaactgttttgggagctgagattattggaactttcgtacttgtctacactgttttctcagccaccgaccccaagagaagtgctcgagactcccacgtccctgtattggctccccttccaatagggttcgcagtgttcatggttcacttggctaccatccccatcaccggtactggtattaaccctgcaaggagtttcggtgcttgctgtaatctacaacaacgacaaagtctgggatgaccactggattttctgggttggcccatttgttggagcacttgcagcagctatatatcattagtacaatcttagagcagcagctttcaaagctttgggatcctttcgcagcaacttctccaactaaaaaaaaattaacccaaatagctgtggcgcacttcactctgttttattttttcatttgttcgttgcgtgttgagaagatattattatgaagatgagatgaccctctcatgtttcatgt

SEQ ID NO: 19988 - DNA, 376 bp, Gossypium hirsutum
  Clone ID: uC-gsflnu33B126g04b1
tttttataaaatgagtaggagctgtggcatgtccaaatgtatgaagtatttaataaaatgagtaggagatgtggcatgtccatcaaacttgcgaatacattgttgtataatataggtgatatttacgagtactaagagattctgtgatcgttgcatcatcttttgttatcatcaacctattggttctttgtgttaagtgtgtaatcaatattttgtagtggaagttaatcatgaatgagaatcttcccttttgttggtgtcaaaaaaaaaaaactagaaaactgtgaaaagacttactttgcatgatgtcagtgcttgaagtggtaaaaagggaggggggaccaacagcatatgcaccgtgaagtttatgatgaag

SEQ ID NO: 19989 - DNA, 546 bp, Gossypium hirsutum
  Clone ID: uC-gsflnu33B126g10b1
tcgttctctcctatactcaacttcttccacttaaaagcaagttagctagctagggttttgtgagccagagagatgggttcaaaaagaacggcatcactagccctcttctttgcactcaacatcctcttcttttccctggtgagtgcttgtggttcctgcccttcccccaaccccaaacctaaacctaaaccaaagccaaaccccactccctccccatcttcttctggcaagtgccctagagatgctcttaaactcggtgtatgtgctgatttgctcggtggcttgctcaacgtcaccattggtacgcctcctgttcaaccctgctgctctctcatccaaggtcttgctgatcttgaagctgccgtttgcctttgcacggcaatcaaagctaatattttgggcatcaaccttaatgtcccactttccctcagcttgcttcttaatgtctgctcaagaaagtaccctctggcttccaatgtcgctaaatcagttctctaaattctctctcttcttagtgctgcgtgggtttgatgttcttaaggtcta

SEQ ID NO: 19990 - DNA, 341 bp, Gossypium hirsutum
  Clone ID: uC-gsflnu33B126h02b1
tacatacttacagggttagtgtcaaaggggcggaaggaagcccatttgtggggatcggtcgagtggttatgctggccatgatgacgggtggaatcaatctttcagctattgctacggacagacgcctgaagtatttgaaaatgctagacaaagcaatgcaaggactagacagtgcaaagcaactgggaaaagcatgactcatgagacaaggagaagaacccatagttgccctaaggctaggaccaataggggcttcgtgctaaaattatgcaccagattttgcacatacctccacattgcttctaagtaaggggctacaaggacaaactaaatacaggagg

SEQ ID NO: 19991 - DNA, 318 bp, Gossypium hirsutum
  Clone ID: uC-gsflnu33B126h03b1
ttcattctacctatgggagtgtgtccacgctgagagggaaccgaaaattggggtgccgaagtggggaacggatattgctgaataccaatgaagccaattttacggggatcgttgaggacagcctccacagatatgtctatcactgagtgccgctaagccagcggctgttgatggaaagactcctattcaaggctaccatcaattctcaaagagcggaaagatcacatgctcatgtaccatggttaacagcatcatcggcataacagagcggctcagaccagatactgagctccagattgcctcacacatcaaggctga

SEQ ID NO: 19992 - DNA, 522 bp, Gossypium hirsutum
  Clone ID: uC-gsflnu33B126h12b1
tcgttctatgtgggtttcagtttgccctgactcaccttgatggcaggcagctcttaattaaatcgaaccctggcgaggtcattaagcctggtcaatacaaggctatcaatgatgaaggtatgcctcaccatcagagacctttcatgaagggcaagctagtcatccagttccatgttattttcccagaatctggggtattttcacctgagcaatgccggaagatcgagagtatattgcccatgaggcctagtaagcatttgacagacatggagcttgatgactgtgaagagactactttgcatgatgtcagtgctgaggaggtaaagaggcggaaggaacgacagcataggcaccgtgaagcttatgatgaagatgacgatgacgatgagtcagcaccaagagtgcaatgtgcccagcagtaagaaatgtttgcgttcaatgttttgcccctcttattttatagcagcagctagcttagataactacatagcccagaaacttgtatgcggtttgtctgcaacc

SEQ ID NO: 19993 - DNA, 464 bp, Gossypium hirsutum
  Clone ID: uC-gsflnu33B127a01b1
tttattattggatatgtggtccaaggactatacaaagacaatgtgtgaattagacatacttatagcaaatgctatccgacatttacgttgcatgaaacagacaaactgtcaaagaccgaagggtattgatgctcgtgtaagaagaaagttcaagggctatactttgatgcctaacatgggctatggctcagacaagaagacacgtgactatctacctaatggctataagaaatttgatgacacaatgttggagagttcaaactgttgatgatgcacaacaggacatactgtgcagagattgcacatgagtgttcaacaaagaagagaaatgagatcgttgaacgagcagcccagcttgatgttctggttactaaacagcttgcgaggttgtgcagtcaagaggatgaatgaacatggaacttgggatcttgtgcaccaattccattggagaattagcttgttat

SEQ ID NO: 19994 - DNA, 502 bp, Gossypium hirsutum
  Clone ID: uC-gsflnu33B127a03b1
ttctttgcagacagactagaaaagaagagaagatggagcaaacattcatcatgatcaagcctgatggggtccaaagaggcctggttggtgaaatcatcggcagatttgagaagaaaggcttcaatttgaaagggttgaagctcatcagtgtggatcgatcttttgccgagaagcactatgctgacctgtctgcaaaacccttctttaatgggctcgtagagtacattatctccggtccggtcgttgctatgatttgggaaggtaagaatgttgttaccacaggtcgcaagattatcggagccacaaacccagctgaatctgctccgggaacaatccgtggtgactttgcaattgacattgggaggaatgtgatccatgggagtgattccgtcgagagtgcaaggaaggaaatcgccctttggttccctgaatgcccctgtaactggcagagcagcctttacccttggatctacgagtagagatcattttgtcgaagctattg

SEQ ID NO: 19995 - DNA, 231 bp, Gossypium hirsutum
  unsure (1)..(231): unsure at all n locations
  Clone ID: uC-gsflnu33B127a04b1
tttctgctgaagagaaatttggttctcaacttgacatccttgcgcctgttaagtactgaattttctagtgactagcttgtttttcttacaattttgttatttgaatggattagatttcattgttgtatctattcgaggtgttggcagttgcaacattgttggttaattgatacnttgctagaaaaccactgcattgactatcaaaaaaaaaaaaaaaaaaccagaatatta

SEQ ID NO: 19996 - DNA, 493 bp, Gossypium hirsutum
  Clone ID: uC-gsflnu33B127a06b1
tagtataatgaagggtctgcaggcacttatattggcaatggtaatggttatggcgatcgctacaactgatgctcaaagcatttgcaacatgccagcttcaggtttgatggcatgcaaaccagcagtgaccccccccaaccctccgacgcccacgtcaacttgctgatacgccctctaccacgctgacatgtatgtgctttgctcatataagaactccaagctctcgccttacctaggtattgacccaaaccttgccatgaaattgcctagcttgtgcaagcttcctcatcctgcaaattgttagttcctggttctccatatatgatctcaaatgtgagggaaaatcatgcttattataagcctctacttcacataattgtactgacctttgggttttctttttcctttatttctttttatgcgatgtgctttgaatggtatcttatagtccggtgatttcttaccaataatcatatattagattggtttcacc

SEQ ID NO: 19997 - DNA, 227 bp, Gossypium hirsutum
  Clone ID: uC-gsflnu33B127a12b1
tcgttccacgcgtccgcccacgcgtccgctactgtaccttttcttttataagttgttaggatacttaaactttgatgcttgttgtgaatttaatagcatatgtaactacaaatacaaaacttctgccatactttttgttaaattccttgtttcctcattctgggaatatgttgtgaaacattgtcatttatatgtatctaaaagttctattgtgcatgcatttgcag

SEQ ID NO: 19998 - DNA, 473 bp, Gossypium hirsutum
  Clone ID: uC-gsflnu33B127b04b1
ttctttttcgtccggtacgttttgcgtatagtccggctgtataaattattaaaagtcaaaaaaaataaattatattttagtttggttcaatcatttcgtattagttcacaagtcaactggtttaatgttttcttttggaccgatactctggccggttcaaacaatcatggctttaagtctctacattttgtacaattgaaatttagtcctcctagttttatttccaagattttaatctctctactttttgaatttataaatctactttcaaattatatataaccacataaaattttaactgaaaatataaactatttgaactaattaattacattataaaaatattaaattaattaataacattataaaaatataaaactaaattatcttagaaattaaaattagaaaaatcaaaattggcatttgtatagaatgtgatgataggtatatgctctgtgaagatgacttggacc

SEQ ID NO: 19999 - DNA, 516 bp, Gossypium hirsutum
  Clone ID: uC-gsflnu33B127b05b1
ttctttgtatattgaagtttcctttctcgattttctatttagccaaacaagatgcagatcttcgttaagactctaaccggcaagacgatcactctcgaggtcgagagctccgatacgatcgacaacgtgaaggccaaaatccaagataaggaaggcatccctccagaccagcagcgtctgatcttcgccggaaaacagctcgaagacggccggaccttggccgattacaacatccaaaaggagtcaactctccacctcgtcctccgtctgcgcggtgggatgcaaatcttcgtgaaaaccttgactggcaagacaatcactctcgaggtcgagagctccgacacgatcgacaacgttaaagcgaagatccaagacaaggaaggcatccccccagaccagcaacgtctcatctttgccggaaaacaactcgaagacggccgtaccttggccgactacaacatccagaaggagtcaactcttcaccttgtccttcgtttgcgcggcgggatgcaaatc

SEQ ID NO: 20000 - DNA, 374 bp, Gossypium hirsutum
  unsure (1)..(374): unsure at all n locations
  Clone ID: uC-gsflnu33B127b10b1
ncttataaattaaaaaaccctaactcatagatggcgttcttgtaaccgtacaatcatggctggcttcattagaaactatgacgctgactgggctagaagccctgccagccttgacaccgctggaaaggttgaacttgacactgatggatccacggctactattcacaccactcaataaaggcattgatgaagataatgctgaacatagaaggcttgcaaagagcaagcttgtttacagacttccaggagcatatatgaacctccatggtgtaagacacgatgacgagaccttgtaatacaaaactggttcgatccaacgctgacctgatggggacaaggaaggtaaaatcacccttgacatcaaggttgacaag

SEQ ID NO: 20001 - DNA, 359 bp, Gossypium hirsutum
  unsure (1)..(359): unsure at all n locations
  Clone ID: uC-gsflnu33B127c07b1
ttgcttggcagatacactggcacattctccacttttgctctttgtggatttgtccgtgcccagggtgatgctgacagtgctcttgacaggctttggcagaagaagaaagctgaagtccgacagcagtagttggatacctttttaccctagtctatctccgagcttgggaaagaaaaatctcatggcagcgactattatgttctaggttttttcaggttaaactatgtcaaatttatatttttgttgaatggatgacatttcagacttggttttcttatatttgaacctaatatatatgccttcggtcatgttaatcgaanaaaaaaaaaaaaaaaaaataaaaaacaaaaaaaataaaa

SEQ ID NO: 20002 - DNA, 512 bp, Gossypium hirsutum
  Clone ID: uC-gsflnu33B127c09b1
taagccttcagtggattgtattgcaaactctcctcagtccttgttaactggcatgaatctgttcctatctcatctggacatcacttttaggcgggacccaaccaattaccgaccgagaatcaacaaactggactcaaccaaggatagagagcaaaagtctgctgggtcatattattacctagatgattgatcgacacatctactggcagttgccaattgtgatgagttgaacaacaagacgtgaatgtggggaattcccgggatctctgagtggagttgtgatggtatgttgatgataagctgagaagaggtccgttgatggtatccatgaggtggcatgccatttgttttagaaaaatatttcaattatcctacagtgtgcttttctttatgttttagcaattttggttgatattttatgagtcagaggaatactgatactcctgttttatttacttttaagaaccaaggtatgctgttgacatgagagagctttgaattatccatgtagc

SEQ ID NO: 20003 - DNA, 65 bp, Gossypium hirsutum
  Clone ID: uC-gsflnu33B127d01b1
actttaatatagcaagccactagggactaaagagaagggcaatttggattcaaaaggggcagctg

SEQ ID NO: 20004 - DNA, 489 bp, Gossypium hirsutum
  Clone ID: uC-gsflnu33B127d08b1
tgttttccttgttctcttctacattcagcgaaggggtgctctgagatcacataccaaaatggtgaaggccgttgccgtccttggcagcaatgaaggtgttagcggaactgttttcttctcccaagaaggagatggtccaactaccgtgactgggaacctttctggtcttaagccgggactccatggcttccatgttcatgcccttggggacacaactaacgggtgcatgtcaactggaccccattttaatcctgctggcaaagagcatggtgctccagaagatgagaaccgccatgctggtgatctagggaatgtcactgttggtgatgatggctgtgcaagcttctccatcaccgacaaacagattcctctcacaggcccaaactccattatcggaagagctgtagttgtccatgcagatcccgatgaccttggcaagggcggccatgagctcacaaaagcacaggaaatgctggcggcagaatagct

SEQ ID NO: 20005 - DNA, 282 bp, Gossypium hirsutum
  Clone ID: uC-gsflnu33B127d09b1
ttttcttgtacattagattaagtaacaaacaagttttttcttttaaaatttttatttatttctactattaaaaattgacatggccaatagaataactaaacagtgacatgtggcattacatgtcccgccgtgaaaatagataaaacttttttatagaaagactaatttacttttaaaaaaaaaaaaaaaaaaaaataaaaaaaaaaaaaaaaaagggtgaccgctactaaaaggaaaccaagataaatacacaaataataaaaagggggggcccttttatag

SEQ ID NO: 20006 - DNA, 513 bp, Gossypium hirsutum
  Clone ID: uC-gsflnu33B127e02b1
tctttttttcaagcaatctaaacacttattttctcatcaaatcgctttgacatatggctcgtaccaagcaaactgctagaaaatcaaccggtgggaaggctccacgtaagcagctagccactaaagctgctcggaagtcagcaccggcgaccggaggagtgaagaagcctcaccgtttcagaccaggaactgtggctcttagggaaatcaggaagtaccagaagagcaccgagctcttgatccgaaagcttccattccagaggcttgtgagagaaatcgctcaagattttaagactgatttgagattccaaagcagtgcctgtgccgctcttcaagaggctgctgaagcttaccttgtcggactgttcgaggatactaatctgtgtgctattcatgctaagaagggtaccattatgcctaaagatatccaacttgctaggaggattagaggagagagagcttaagtctgttagtttttagttgaatgattcctagaaatagaaatctgtactt

SEQ ID NO: 20007 - DNA, 461 bp, Gossypium hirsutum
  Clone ID: uC-gsflnu33B127e09b1
tattagagaaagtggatatgtaattccacggtattctccatactgtaattttaatttttgagggcaactgtagattccataatttcttgtagaaattttttgtatcagtctgtaaataagcattaggctcccctctctaatagtttataagcgcttctaactgaaaagactccagtagcctcccctctccatacttggatgtcttcttgggcagactttgaaagtggaatccgcagaatcttctttgcgatatctgtattaaaggtattgacaatgaagactcttttccatgttctactcatatgagagaatattcaattgaacccaacaacaaaaaaagctatagttaagtttccaagttattggaatttcaaagccttggaaaaaggtcttaagttatagggtggggcttttgactttttcctttttgtaaaataggattctgaataatgtaccccttc

SEQ ID NO: 20008 - DNA, 401 bp, Gossypium hirsutum
  unsure (1)..(401): unsure at all n locations
  Clone ID: uC-gsflnu33B127f02b1
tctcctcgcgtccggcaggtggagggagtatttgcaagagctcaatgaaattctacactataggcgataatgttatcactgaagacgaaatcaaggctctcattaaagggagtgagggagtttacaagcctgttgaagcttacctcttggctaatcccnaatcctgcaactaggatataagttgcttaatttgaattcttatgcttgcttttaaagaggggtttgattttaatgttgagcttttgatattttctttttcatcttaaaacctatattgtcttctggttgctcagtaagaatgatggtggtggtgatcgaactttgatcatctttgatatataatgaaataaataaatatataaactggcttatcaattattactttttttagataaaacatt

SEQ ID NO: 20009 - DNA, 508 bp, Gossypium hirsutum
  Clone ID: uC-gsflnu33B127f04b1
ttcctctcgtccgatcgattcatcagtcttcttctgtaagttgaggttttggatttgtaagcatatacaatgtcttcgtcctatctcccagcaaccaccgactcaattgctcaggccttagaagccaaaacaccatctgaagccatctcgatcctttaccatgtaatagaaaatcctgcatctgctcctgacgctctacggattaaagagcaggccataacaaatctatctgatcttcttagacaagagaaccgagcagaggagctcagaagccttctgacccaactgaggcccttttttgcactaattccaaaggcaaaaactgctaaaattgtccgtggtataattgatgatgtagctaagataccaggaacatcagatctccagatttttctttgcaaagaagtggtgcagtggactcgtgctgagaagcgaacttttcttcgccacgagttgaggcaaagcttgcgcacttttgatggagaacaggaagactctgaggcactga

SEQ ID NO: 20010 - DNA, 450 bp, Gossypium hirsutum
  Clone ID: uC-gsflnu33B127f09b1
tgtcttttggcctttaacaagttgactgacaacggagcaaccaccccggctggtctcgtagccgccgctctagctcatggcttcggtcttttcgtcgctgtctccgttggcgccaacatctcaggtggccacgtcaaccctgccgtcaccttcggtgcttttgttggcgggaacatcactctcttgcgcggcattctttactggatcgcccaactcctaggctcaaccgtcgcttgcctgttgcttaagttcgctaccggcgacctggctgtacccgcttttgggttgtcatcaggtgtgggcgtgtctaacgcattggttttcgaaatcgtgatgaccttcggattggtgtacacagtgtacgccacagccgttgatcccaaaaagggaagcttgggaacaatcgcaccattggcaattggtttcatcgtgggggccaacattttggca

SEQ ID NO: 20011 - DNA, 243 bp, Gossypium hirsutum
  Clone ID: uC-gsflnu33B127f11b1
tttagtttcaaatttaagtagtttcaaattcatttattgcaaatcttagatggaaccataaaagactttggtagttctaaatgcggttttgatgttttatttgggtttggatagaaaaaagagaataacaatataactagtttcttgttgtgctatggattactgttttgcttttccttttcaataatttttattatctcgtcttaaaaaaaaaaataaaaaaaaaaaaaaaaaaaaaaataa

SEQ ID NO: 20012 - DNA, 400 bp, Gossypium hirsutum
  Clone ID: uC-gsflnu33B127g01b1
tggttgctcaacattataggaggagatgcaagattcgagcttcatgttgcaacgaggttttctcgtgtcgccattgccataacgaagctgtgaacctgttaagtaacccttttgacaggcacgagcttgttcgaaaagatgttaaacaagttattttctcggtttgtgacacatatcattcggttgctcaactttgttcaaattgcggagtcaatttgggagaatacttctgtaaaatttgcaacttctttgatgatgatactgagaaagggcagatccattgtgatgattgtgggatctgcatagttggtggccgagagaatttttttaactgcaagaagtgtgggtcttgctactctgttgccttgcgagggaatcatacttgtgtggagaattcgtt

SEQ ID NO: 20013 - DNA, 98 bp, Gossypium hirsutum
  Clone ID: uC-gsflnu33B127g04b1
tattatctttgtatctaagtcattgatcatcaagttttcatttaaaaaaaaaaaaaaaaaaaaaaaaaaaaaaaaaaaaaaaaaaaaaacaatcaacc

SEQ ID NO: 20014 - DNA, 474 bp, Gossypium hirsutum
  Clone ID: uC-gsflnu33B127g06b1
ttcctctcgtccgaatgagcctcttaaaacttggggtctactatcaacgctttcatttgcttcgctttattccaccacagtcttccaatgtctacccatctaccttttgggtgcaaaatctgaccaacaatgacaccaccaaccactcatcgttatcttgtactcccaggattaatcctgtaatagccaaggcactgcgtactgaagcagctgccacagcacagtccataaaaatggtgatagctatcagggttcatcaacttggtggaccttaagtccttaaatgggaggatgtggaacttggggaacccaaagatggtgagatacgtattaaaaacaaagctatcggactgaatttcatcgattactattttcggaaaggagtttataaggctgctaccatgcccttcacttcaggtatggaaagcctgtggagaggtgactgctggtggacctggactgactggccagaaa

SEQ ID NO: 20015 - DNA, 517 bp, Gossypium hirsutum
  Clone ID: uC-gsflnu33B127g07b1
tctttcctgtccttccattctaagtaatacattctatacaagtcgtcgaccgccgcaaactagctgaaacgaagatggagcttggcttggaaactatggcggcggcaatcggcgtatcggtgccggtacttcggttccttttgtgtttcgtggcgaccattccggtgagttttctgtggcgatttgttccgggtacactacctaaacacgtctactcagctttttcaggtgtcgtgctttcttatttgtcgtttgggatctcttccaatctgcttttcttggtgcccatgctcttgggttatgctgcaatgcttctttatcggcccaagtgcgggattatcacatttttcttgagtttcggttatttgattggctgccatgtatattacaatgagtggggatgcatggaaggaaggaagcattgatgccactggagcattgatggtgttgacactgaaagtgatttcatcttgcattaaatacaatgatgggttggtggaagaagaagacttcccca

SEQ ID NO: 20016 - DNA, 380 bp, Gossypium hirsutum
  Clone ID: uC-gsflnu33B127h01b1
tgtcacgcgtgcgcgtgtgatgtgggcttgttcatttgtcgccatgagaggcagaagatgtagattttgcatgccatgatcaaagcaggaacattcagacagttcttataacaaagcagagtgccataaaaagttcgacaaaagtgggaaaaaggaagggaatgtggatgatgctgattatcagggtgccactactactactacggcagccagcagtgatgctggaatggctgctgctgtagcagtgggtgccactacagcacatgcctccgctgtggaatgaagtggttgcgatggttgtcatgcaagtggtgggggtggccgctgatagccggaccctatttcaaaaaagctgggttagtttttggcctttggcgttc

SEQ ID NO: 20017 - DNA, 150 bp, Gossypium hirsutum
  Clone ID: uC-gsflnu33B127h02b1
cctgcaccgacccggactgaacttctgggcccacccactttttcttatcataacgaccacgcgttacgtaaaggatctaagaatatgaatggaagcatggttgctgtcacaggcaattccttgtgcttgaaatgagagtggcccccgctt

SEQ ID NO: 20018 - DNA, 475 bp, Gossypium hirsutum
  Clone ID: uC-gsflnu33B127h04b1
ttccttgcgttcgcccacgcgtccggttttctttgtctttagtttacgtttattggccttttggaatttttgatactaaaaaaaggaagcagcgaataagggaaatggagggcaaagaagaggatgttagattgggagccaacaagttcacatagaggcaaccaattgggaccgcggctcagagtcaagatgacgggaaagactacactgaaccaccaccggctccatttttcgagcctggcgagttaacctcatggtctttttatagggctgggattgccgagtttgtggcgactttccttttcttgtatatcactattttgactgttatgggagttgttaaggaaaaaactaagtgcccaactgttgggattcaaggaattgtttgggcttttggggggatgaactttgctcttgtttactgcactgctggcattttagggtgggcatatcaacctcgcagtgacttttggac

SEQ ID NO: 20019 - DNA, 424 bp, Gossypium hirsutum
  Clone ID: uC-gsflnu33B128a01b1
ttgttggtgtatgattacatgccaaatgggtctttggatgcccatcttttccatgaagagaaatctaaagctctaacgtgtaaaacaaggtaccagattgcacttggtacggctagaggcttagcttatcttcatgagaagtgcagagattgtattattcactgtgacatcaagccagagaatattctcttggatgctgaactctgtcccaaagtcgcagattttggcttggcaaagcttatcgggcgggacttcagcagggtcctgacaactatgagagggacaaggggctatcttgcacccgagtggatttcaggagtcccggttacagctaaagctgatgtctacagctacgggatgatgttgtttgagtctgtgtcaggaaggagaaactctgaacaatctgaagatggaaaagttagat

SEQ ID NO: 20020 - DNA, 489 bp, Gossypium hirsutum
  unsure (1)..(489): unsure at all n locations
  Clone ID: uC-gsflnu33B128b04b1
ttgattatcatcaaccccatttcttggatgcttgtttcctttgcaagaaacctcttgggggtaacaaggacatcttcatgtacagaggggacacacctttttgtactgaagagtgtaggcaagaacaaatagacatggatgaagctaaagaaaacaatttgagcttttcttcatcaatgaaagcattgaggaagaagaaagaccaaaggaaatcatccaaatctccaaccaaagctgaagattatccttttagaacaagcactgttgcagctgcttgaaaccaacatatctaccatataaatagttgaaaatatatatatatatatgaagatccatgaagaagcctatttttaggggtttctttgtttttttaattgtgaatgttatataacacactatatgagaatgtgatataagcttgtattaaccctattatgctgngttttctttttgggatattttttgccaacgttaatgcataaatgaaaa

SEQ ID NO: 20021 - DNA, 480 bp, Gossypium hirsutum
  Clone ID: uC-gsflnu33B128b05b1
agaatgtcgaatatcttcctcagaaatggtgtatactcagtccaaatactaatgacctaagcaaacttgcggacaacataaactatgcctgcaccttctccgattgcacagcacttggctacggatcttcatgtaacatcctggatgcgaatgggaacgcatcctacgcatttaacatgtactaccaggtgcaaaaccagaatgacatggcctgtaattttcaaggtcttgccaaggttacaacacagaatccttcacaagggacttgcaattttatcattcaaattgcatcttcttcttttgctattggtccctcactgataggaatgacattttttgctgtaatagcatctgtattactataaacttgattctgtagataactgggatgatactctctctctctctctctctttttttcaattcatttttgctagtcacttttgtatgtcatagattcttgggttatttttgaatcga

SEQ ID NO: 20022 - DNA, 326 bp, Gossypium hirsutum
  Clone ID: uC-gsflnu33B128b06b1
ttctacgcgtccggtgatatgatcacggaggaagcccttccaacttaccaaactatgcttaataccttggatggaactcgtgatgaaactggtgctagccctacttcttgggcaacttggaccagggcctggactgccgaagaaaacagacacactgatctacttaataagtatctctacttgtgtgggagagtggacatgaggcaagttgagaagaccatccagtatttgatcggttcaggaatggatccgggtacggagaatagtccttatctgggattcatctacacaacattccaagaaagggcaacttttatctcacatgg

SEQ ID NO: 20023 - DNA, 394 bp, Gossypium hirsutum
  Clone ID: uC-gsflnu33B128b09b1
tctttggtcagtattgtagatcattaagatggagaagaaaggttttgtcagattgatgctactttttctgggtttttcttatcttcttctttcctgtgctgctgttcccagtactagaagcctcaaatcaaacaaggaactcccttcttctgtccaagatttacttgctcaggatgtaatggaattgagttatggcgaggaagtgatagcggaaggtgacggattcaatggggaaaggatgttaatggaaagcactgattatccagggacaggtgcaaacaagaaccatgatcccaaaactccagggagagcttagaaaacattaagatccataacctatttgttttatgtatagcttaagacatgacaggataaaagccaagtctttgaatct

SEQ ID NO: 20024 - DNA, 389 bp, Gossypium hirsutum
  Clone ID: uC-gsflnu33B128c02b1
cggacgcgtgggcggacgcgtggggtcatccctttcttctcttctttcaactcaaaaactcccaagtaatattagaatcatgggtgttgtcacttataactatgagtctacctctccagtcgcccctgccaggcttttcaaggctttttctcttgaagctgacaaggtttggcccaaggctgctcctcaggcagtcaagagtgttgaggttgaagctaatcctggccctggaagtatcgtaaagatcaactttgctgaaggccttccattccaatatatgaagcaccagattggaggacatgacgacaagaatttgtcatacagttatagtttgatcgaaggtggacctttgggggacagcttgagaaatcagctatgacaacagtttg

SEQ ID NO: 20025 - DNA, 449 bp, Gossypium hirsutum
  Clone ID: uC-gsflnu33B128d06b1
tattcagtccctccacctacaagctatactggtggacctacatcataccctccatcttatggtggccctgcgggtggctatgctggtgagggtttgagtgatgcacggactggtggtcgtggtggacctcctggtggatatgacggtgggtatggttctggtggtcctcgaaatcagggaggtggttatggtggtcctcctgttgaagcaccagctaagatcaagcagtgtgacggcaactgtggggattcttgcgacaactcaagaatatacataacaaatttgccacctgatgttactattgaagaattaagagacctttttggcggcattggacacgttggaagaattaagcagaagcgtggctataaagatcaatggccatggaatattaaaatatacacagatgagaaaggaaccagaaaggtgaagcagttttgtttatgaag

SEQ ID NO: 20026 - DNA, 437 bp, Gossypium hirsutum
  Clone ID: uC-gsflnu33B128d08b1
aaaaaaaaaaaaaaaaaaataaaaaaaaagaaaaaaaaaaaaaaaaaaaaaaaaaaaaaaaaaaaaaaaaaaaaaaaaaaaaatatcaaaaaaaaaaaaaaaaaaaaaaaaaaaaaaaaaaaaaaaaggggggggcctttttaggggacccaggtttacgcccgcgggtttgcaacttaaaactttttttttggggcccctaaaattaaattcatgggccgtgttttaaaaacgctgggttgggaaaaacctgggggtacccaaattaaatcgcttggaaaaaaatccccttttcgccaggggggaaaaaaagaaaagggcccgccccaatggcctttccaaacagttgccccccttaaagggcaaaggggacccccctttaaggggcccataaaggggggggggtgggggggtatccccccagggggcccgttaca

SEQ ID NO: 20027 - DNA, 469 bp, Gossypium hirsutum
  Clone ID: uC-gsflnu33B128e06b1
ttcccacgcgtccgcgagttttcggcttcaagatccacaagccctgacatgattgatacatgagttgcaccaagccagaacttatacactcatatcaatttccggtcagtgagattcgcggtgattctcaattagcctggtgcttcttctatcaaagcagtgggttcccaacaatgcaaggtgaagtggggctccaaaagaaacaaagaaatggtaccattgattgattgattgatatggcaaatgaaatatggactgctagtggagcacaaggaatctctaggatttggttttttatgaagtttaagtgagcatatatttttgtttggaagtgtgcgttttgccgtagtcgataatagattatgtgaatatctctttcttttgttcaagtggtttgatgacctagatacatacatattccatctctctaatgtagactttaaccttgttgtttacatgaatttcctac

SEQ ID NO: 20028 - DNA, 412 bp, Gossypium hirsutum
  Clone ID: uC-gsflnu33B128e08b1
cgagactgcagagcaacatggaggggagttctcggccaaggactaccatgatccaccacctgctccattgattgatgctgaagagttaaccaaatggtcgttttacagggcagtgattgccgagttcattgctacacttctcttcctgtatgtcactgtgttgaccgtgattggttacaaggtccaaaccgaccctgctaagaacactgttgaccccgattgcggtggcgttggtattcttggtattgcttgggctttcggtggcatgatctttattcttgtttactgcatcgctggtatctctggagggcatatcaacccggctgtgacattcgggttgttcgtgggacgcaaggtgttactcatccgagccctgatgtacatggtggctcagtgcttgggtgccatatgt

SEQ ID NO: 20029 - DNA, 412 bp, Gossypium hirsutum
  Clone ID: uC-gsflnu33B128e12b1
tcccacgcgtccggagctttcgtgtttgtctattgaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctttgtaatgatatattgtcaaggatggatgcctgccaggcctataattatgtcctctgcct

SEQ ID NO: 20030 - DNA, 393 bp, Gossypium hirsutum
  Clone ID: uC-gsflnu33B128f01b1
tatggccttgcttgacatgggagctgagtacagtttctatggatctgatattacatgcacattccctgtgaatgggaagtttacaagtgaccagagccttatatataacgctgtccttgatgctcacaatgctgttatagctgcaatgaagcctggtgtgagctgggtggatatgctcaaattagccgagaaaatcattctagagtcgctggaaaagggcaacatccttgttggaaaccttgatgatatgatggttgaacgagtgggtgctgtttttatgcctcatggtcttggccatttattgggtattgattctcatgatcctggtggttatccaaagggcatagaaagaccaaaagaacctggtttgaagtctttgcgtactgctagaca

SEQ ID NO: 20031 - DNA, 463 bp, Gossypium hirsutum
  Clone ID: uC-gsflnu33B128f03b1
cttttcttctcttcaaccccacctgctaaaatgcaccaatttccggtgcttcctagcctcatcgcagtgtctgtactgctgatggtaactccagtcattgggtaccgtccatggcctcacttaaaacccaacagctccgatttaacgttgggaagctccaagaaattcgagggctcatcagagttcgtccaaatgagataccatatgggaccagttctcaccgccaacatcaccgtacacatagtttggtacggccgatggaaaaaatctcagaagaagatcatccgtgagttcatcaactcaatctccgccgttgatgccaagcacccttctgttgccggctggtggaagaccgtacaactttatacggaccaaacgggcgccaacatctcccatactgtgcatttaggggaagagaagaacgaccgattttactcgcacgggaaaaactgacgcgcttgtc

SEQ ID NO: 20032 - DNA, 484 bp, Gossypium hirsutum
  Clone ID: uC-gsflnu33B128f05b1
tttatcgtcaggtcaaaatgcttccaggtctgaatcttcttcaaggctacatgcttcaaggccagatgcaacaccaatggattttgttgtgcgtccgcaatctaagattgatccagatgaaattagagctcgagcaaaacaagttgtacaagatcagcgtcgtttaaagatgaataagaagttgcagcagttgaaagccccgaagaagaagcagctgcaggcgtctaaacttagtgttgagggtcgtggtatgcttaagtacctgtaaatgataatccacagtccacataccgaaactataagctctctatttcgcagaagaaacctcctttgaagcaaatgtttctgttttccttatccaattgattccaatcattgagaagggattaacggtgggactatcatgatgtttcattaattctgtcttgggaaaataccttcactgcagttcaaataaatatggtataatgtttcaagtgcatgc

SEQ ID NO: 20033 - DNA, 406 bp, Gossypium hirsutum
  Clone ID: uC-gsflnu33B128f06b1
tttactcgccctgggactgggaaagcagatatttgacgacaagaattcgcttggcgaaacactgaagaacaaacaaaatgcttagctagcctaaatgggagaccaaaagagtgctatgaacgatgttataacagaatatggtgtggctgttgaagggttctgcatgagccgctgtgggactcagggttctggctagagctccaccgatagggtggtcaaggccatgaagcactccaggttcggttacatttgggtgggtcactcccaaacccagggcctaggacaatgtgcctggacgacccaccagccaatctacagaccacatagtgcgcctacgattgcaccaaacaacaacggggggctagatggcatgtacatcaacttggttagcctctctgtcgggacc

SEQ ID NO: 20034 - DNA, 365 bp, Gossypium hirsutum
  Clone ID: uC-gsflnu33B128g03b1
gattaccgtggagtctgcagttaacttgggtcctattgcaactgtttgagtccttcagtgagtgaagagcgatgggttttaattagcagtgtgtttctgttaataagtttagtcggctgatggatatattctgttaattatagttctggaattagtgagtgcctgcaggtgtggagcttagtagtttaaaataagctgaaaaagcttgtactaagaattcctcagttatatatggtgcctgatcgctagtggctgtgctttaaatgagatgttttggctgtcggaagtgaccaaactatatttgatatgaaaaattgtccttaagattctgtttttggcttaaaaaaaaacacaccctcttttat

SEQ ID NO: 20035 - DNA, 315 bp, Gossypium hirsutum
  Clone ID: uC-gsflnu33B128g04b1
tacggctttgaccgcaccaaggggaacaaaagagtgtgatccaataaagcgacagagaaagagagcagtgagaggtcgcctagtctccgcgtttcaagagaagaaaaagaaaacaagaatgatgtagacaagtagtagggtcaataaaaaacaaggggttcatcgttttcacatttgtattattcagtggttctcgtatttcttgctgctttagtatacaatgtttcctagattttatgtgtttttcttttccgacctttttgcaaatgcaggggtgatgggttttgatctttaataaaataaaggtttttactt

SEQ ID NO: 20036 - DNA, 474 bp, Gossypium hirsutum
  Clone ID: uC-gsflnu33B128g06b1
tttatcgcacaaaactcaccgccttacccaactcagctcccaacaccaagaaaaggaagaagaaaaagaaaaaagacaaggaagaatagaatttacatgaagaagatggtttctctcaagaagaagaaacgaaaccctacctcctccatctgcatgccttcttcactgagttaaagggttctctcttttcttcatcaatgaacaaaggcctttttcattttacttcatcttttcttcttttctcttctttcttggggaaatgaagcatcatggtccgatttgtatgctacatatcaactaaaacctaatactataccatatatttactgctgcacatgtttggggagctgtttcctttttttttttctgtatggatttttctttgattttacagcatctgagatcttatctatgctccaaagcagacttttgtttgcctttggtttaggtgattgaagatggcttgagttaata

SEQ ID NO: 20037 - DNA, 368 bp, Gossypium hirsutum
  Clone ID: uC-gsflnu33B128g07b1
tttggacgcgtggggggaatactacgcccagaagttacctgaaaaaccacaaccggtgaccgtacaacagcatgtgccagcgacagccggaatctggccggataaacaaatttcatccgggggtttcccagcaaccgtaacggcagccccaggaccaccaccgccggcggatcaccctgtttacatgatcccagctccagttccaggatcggctccggccaacctctatcacgcacctccaccagttccagctccagcacctgcatcagcatcagcagcaccacaaatggttcgaccagtaaccggacaagccggtcaaggctactacaccaacgtacagagaatgccttatgaagtttaccgggagc

SEQ ID NO: 20038 - DNA, 411 bp, Gossypium hirsutum
  Clone ID: uC-gsflnu33B128g11b1
aaaaaaaaaaaaaaaaaaaaaaaaaaaaaataaataaaaaaaaaaaaaaaaaaaaaaaacccaaaaaaaaaaaaaaaaaaggtcttctctctttataggttctcagcttggggggtcggttttgcgggtccctggtttctttttggtgccttgcaagttcatttctttgttttggggtcccctaatgtcattcctggggccctctttttgtaccccagttttggggaattcctggcggtcccccttttaactgttgttggaatagttccccttttcgcagggtgggtcttttccaacagggccccaccctatctcttttttgaaaagttccctttcttgattgattaagggcccccgctttggtggtttccttcatccggcccggttgatttgtttactccctagggcccg

SEQ ID NO: 20039 - DNA, 481 bp, Gossypium hirsutum
  Clone ID: uC-gsflnu33B128g12b1
ttctttatcagatatcaaaaggagtaaacctcagattccaaatcggaaaaaagaaaatggtgaagggacgccaaggggagcgagtcagactctatgtaagaggaaccatcttgggttacaagaggtcgaagtcaaaccagtatccgaacacttcattaatccaaattgagggagttaacaccaaagaggaagtagcttggtatgccggcaagcgtatggcttatatttacaaggctaaggtgaagaagaatggttctcattatcgctgcatttggggcaaggtaactagaccgcatggtaacagtggtgtcgttcgtgctaagttcaagtcgaaccttccccctaaatctatgggagatagggtcagagtcttcatgtaccccagcaacatttgagttgtctagacgcctgacggcattcaatcgatgactcaagtgactctgccttttcaccaggttttacaaacttcgtcgaaatgttt

SEQ ID NO: 20040 - DNA, 475 bp, Gossypium hirsutum
  unsure (1)..(475): unsure at all n locations
  Clone ID: uC-gsflnu33B128h01b1
tttcactttctctttccaaaggatctgaaaaaaaaaatgtcgtcaaatggaactgacaactcaacttctaagaagcctccaagtccttctcctttgagattttccaagttttttcagtccaacatgagaattcttgttactggtggagctggattcattggctcccatttagtggataaattgatggagaatgaaaagaatgaggttattgtcgtcgataactactttaccggcacaaaggacaatctcaagaaatggatcggacatccgagatttgagctcattcgtcatgatgtcactgagccgttgctcattgaggttgatcagatctaccatcttgcttgcccggcttcgccaatcttttacaaatacaatcctgttaagacaataaagaccaatgtgatcggtacattgaacatgttgngtctggcaaagcgtgtcggagcaaggattntacttacctcaacttcagagg

SEQ ID NO: 20041 - DNA, 482 bp, Gossypium hirsutum
  Clone ID: uC-gsflnu33B128h04b1
tgtttttccctttcaactctttgaaacccactctgcaactctgttgttgtctcatgcaatcttcaacagctttagaaccccttttgtttaccgctcacttatccaccatgctcaaactccttaacaagagaatcaagcgcctctgttctcgcctccggtggccgattcgccgccggtctaggtctgtggttgtcatcagaaggcttggaaaattaaactccaaggctcgtactgatagtatcaccaaggatcgtgctattgtcgtcaatggatcttcaaaagttcaccaagatggccatttgggtggtttagtaaactcgtcgagacctatacgtgtagcgactttcaatgcttccctgttttctatggctcctgcaatgcctaaagcagataagtcttcaagttttgactatgacaatggtggttttggtgatggtgggcgctccatggatcttggttacccgcaaagtctacaaaatgat

SEQ ID NO: 20042 - DNA, 456 bp, Gossypium hirsutum
  Clone ID: uC-gsflnu33B128h05b1
tggtattagaagaacgcataggagatgtgagcactggactgagcgaggaaatgattctgaagttgatggaacaacggaagcattcatctacttcaacagaatcccaacaagatctggaaccgtgttgtatctgtcaggaagaatatgcaaatggagatgacactgggatactagattgtggacatgacttccactctaactgcattaaacaatggttaatgctaaagaacttgtgccctatttgtaagacaacaggcttgcttaaatgatagcaaaagctgatgttagagcctggaaatttcgttatcttttgattgtcattaagatcctataataagggtttaggcgcgcgtgaaccatacaaaatttgaagatgctgctgctaattttatgtactgcaggatgagttgtttgtcgaataactttgcataaaagcatcaatgacaatgataacat

SEQ ID NO: 20043 - DNA, 263 bp, Gossypium hirsutum
  unsure (1)..(263): unsure at all n locations
  Clone ID: uC-gsflnu33B128h06b1
tttttatgcgatcgaggacgctcggacttgtcctgaacagtgcacaggatatgcaaacacagcatgaagcttacctcgcatccttnncctccccatctattgtctatgaacagattggcgcgatatataactgttccacgattgttgaggagcttgctatacatcggtgtcagacatactttaacaactggttccttcgagagaatggactaagaaggtgatgcctaaactgcatataccatggcatggatatatggaaagat

SEQ ID NO: 20044 - DNA, 488 bp, Gossypium hirsutum
  Clone ID: uC-gsflnu33B128h09b1
taaaattttccccagggagtgaaaaggaacaaaaaatcttctactcaagaaaagagagaaagatcttccttagcgaaactatttgcaggaaaatcaaaaagaacagggatgagttattacaatcaacaacagcctccagttggtgttcctcctactcaaggttatccaccggaaggatatccgaaggatgcttatccaccaccgggatatcctccacaaggatatcctcaaggttatcctcctcaaggatatcctcctccttacgcccctcaatatcctgctcagcctcctcctcagcaacagcaaagtactggatgcttgcttttgagaatccaactatgccaaatgcctcaaatgttgaaaaatcaaatgttcttactgtctcgcctgcttaattttttttgtttatggtctttaaaaaataaaattgacccttgtttggaataaactaaacccttgtatatttataataagtcctagttcttagt

SEQ ID NO: 20045 - DNA, 430 bp, Gossypium hirsutum
  Clone ID: uC-gsflnu33B129a05b1
ttccttgcgtccgcatattcctcacttttgcaacaaaatccaccaagagactacaccaacaaatggaggcattgaggataagactattttcggctatgatgggggagctgatggccatctcagcggtccaatatgttgcgtgaggtgatgcaccggcccctactcctacctcagatgccacctgattcgtgccgacggcatttgcttcccttgtcgctcttgcgtttggtctcctcttttaaaacggatgaattgtattggttgctgatatttcaatattggggggtatgcagaagctcttttggcttcttatattctttctctctaaaggccatacaattcttatgagtgcttcgtgtatggagatggcaaaaagaaagagaaaaggtggagacactttttctttttctactttattcttccttatgac

SEQ ID NO: 20046 - DNA, 489 bp, Gossypium hirsutum
  unsure (1)..(489): unsure at all n locations
  Clone ID: uC-gsflnu33B129a06b1
ttcaaaccatctcctacattaccggctctcaactccttccccttaaacgccttccgaatatcgccatcatagatgttagggatgatgaaaggagttatgatgggcatatagctgggtctttgcactatgccagtggcactttcactgataagatctccaatcttatccaagatgtcaaaggcaaagatactcttgtttttcattgtgctctaagccaggttcgtggcccaacttgtgcacggaggttagcgtatcatctagaggagttgaaggaagatactgggatcaagaacattttggctttggagcgcggcttcaatggctgggaagcttccggacgacctgtttgtcgctgcactgacatcccttgcaagggcgagagtgcataaccaaccatccattagaattaattcgggctgataaggagcaaaaacatatatcatctacttggtgcccaccattttttggntattctctcttctgattgat

SEQ ID NO: 20047 - DNA, 61 bp, Gossypium hirsutum
  Clone ID: uC-gsflnu33B129a09b1
tcgtaataaagacaaaataaaaaacaaaaatgaggagaaattttaaaaaaattaatttttt

SEQ ID NO: 20048 - DNA, 404 bp, Gossypium hirsutum
  Clone ID: uC-gsflnu33B129b06b1
ttctcgcgtccgaaccacaggctggtagaagatcgaatggctatacaacaagagcttgtggctgcaaaggaggaaattcatcgtttgaatcttgtcattggtgaaattcgtgcagaacaggaactgcattcaaggggacttattgaaaaaggcttgaaactggaggcagatcttcgtgcaactgagccactgaaaaaagaggctatgcaactccgctcagaagttcagaaactgaataacgttaatcaggatctaactggccaggttcagactctcaagaaggatattactcggctgcaagctgataatcagcagattcctattctcagagcagaagttgatggcttgcaccaagagttgatgcgtgcaaggactgctattgattatgaaaaaaaagccaacat

SEQ ID NO: 20049 - DNA, 476 bp, Gossypium hirsutum
  Clone ID: uC-gsflnu33B129c05b1
tttcctcgcgtccgcccacgcgtccgtatccttataaatccttaatcaatcatctcattcctttgtcatctaattattaaagcaaagatagatggctaaacttgccacctttttcgtcttaacccttctcttcgtttccactctatcctttgccgcccgccctggtccagctttccctaaccagtctcctaccaaaactcaagctaagggtattactgcggtggagactgaggttgagcggccgactgaagctgctgaagatagctgccaaggagttggagaagaagaatgcttgatgagaagaactcttgctgctcatgttgattatatctatacttagaatcacaagccatgagagctttttatgaatttatggacatggtcttttaaaatttaaataacctaatcacctcaggtaattcgtgtctggctcttcttcattattaattcttcaatcttctggttttttttttttt

SEQ ID NO: 20050 - DNA, 234 bp, Gossypium hirsutum
  Clone ID: uC-gsflnu33B129c08b1
tcgtgaagccctagcaacaaccttaaaaataacgacattttctgtaatataactggcacgatgcacaactggatgggctttccaagtcaagactctgcttaaaaggctccttatcttgcttgtatcacttcttactatatgagatagagatttcacgtgtatgattgtgttgtctctattacccttaaacgacatcctcctgtcagttgggtttactctataaaataaactaca

SEQ ID NO: 20051 - DNA, 530 bp, Gossypium hirsutum
  Clone ID: uC-gsflnu33B129c09b1
tcgttcacgcgtccggccgacaacgtttccggcaactctaagtttgactgatttatcagtaacagaaaataataactcgacggagaatcgcatatcaaggccgccgagccccaaagtaaacacctcttcttatcttatccgtccaataccggttcttcccgttcctccatcatcgaaaatggctgatcttaatttaaaccagaaagccgaagaagaccgtttacctctatcgctaaaactctcgacaccatccgccgatgagcaatcaacagcagcggcacactcgtctactctcgtcgtcatgtcaaatggggataacaatagcatcatcagcgttgcttgaaaattagatgaagtaaataattaggtgaaaaaattattggactatttggtaattaggtgaaattccttgttttgtacagcataattattactgagattgcattagattgaaaaaaattattagactggtgggtaattaggtgaaattccttggttagtacatcatacttagtgcagcaggagtctaa

SEQ ID NO: 20052 - DNA, 484 bp, Gossypium hirsutum
  Clone ID: uC-gsflnu33B129c11b1
ttcatacagccactgccccgaccagaaagaaacccaccacacagctaatcctgcaccgggtactcctacgccagctaccccacctaccgcaactcccccaccggcttctccaccgcaggctaccccaccacctgcttctccccctcctgctactcctcctgcagctaccccaccaccagctcctttggcttctcctcctgccacggctccagctccggcccctagcaagaccaaagctaagtctccagcgctatcaccttcggcctccagcccaccgtctccatcaactgcggcccctactcccagcctcggcgcttcttcaccaggccctgctggaaccgatacgagtggagcagagaaaacatgctccataagaaagatggccctggagcttggtgattggatcgcgtatcctcactctaatgctctacaccatgaagtcttcccttcaccattagcgcctctagctatggttcccgtttca

SEQ ID NO: 20053 - DNA, 490 bp, Gossypium hirsutum
  Clone ID: uC-gsflnu33B129c12b1
tcgttacaaaatcagcatcggtcctcgtaaaagcaaagaagacgacgaagatgagaaggatgccggggttgtttactacggtccgatttcttctacaatcaagaaagtaaagatgctttcactttcgacctgctgcctctcggtatcgttaggccctgtcattacattcatgacttctcctgatatgaatgtgattgtgaaaggtgcggtagcatcctctgtgatattctttagtgctacaacaactgccgcacttcactggttcgtgagcccttacatccacaaaatccggtggcagccttgttcagacagcttcgaggtgaagatgatgtcttggttagcaacatatattccacgaaccattaagtttgcagacatccgtccagccgagaccaacaggccattcgagacatttaaggccaatgggaacttctactttgtagatgctgagcattgccataacaaggctttgttggcatgacttacaccc

SEQ ID NO: 20054 - DNA, 180 bp, Gossypium hirsutum
  Clone ID: uC-gsflnu33B129d02b1
ttctctttcgtccgcccacgcgtccgcccacgcgtccgcccacgcgtccgaaaaaaaaactgtctcagatctgaggtgccgttgctgatttgttcatcagcttgattgaatctgacgcctattatcgtcgccggcaccgatctgttgctttaaaaagaaatgtagattcctgcttcttcc

SEQ ID NO: 20055 - DNA, 374 bp, Gossypium hirsutum
  Clone ID: uC-gsflnu33B129d08b1
tcgtttagacttaataagatccttggttatgatgatgttttatgggatgtaacgagcacggttcacaacttgatggcctatacgagcgaggacttgttctacaaagcttgagactgtgattgtattactgcttactatatgctctagtgatatcacgtgtaacactgcgttgattctctaacgttaatggggtgcttactgcaagttctgtaaagtcatcgaattgaagtacaccggagtggcgttatgataattttatgatgctagttgttatgcctatcaatacatctgtgaagataaagttgcatgtggatctcaaggattgagccactatcgaaacttgggtagttctcaccatataaatttgtgctttt

SEQ ID NO: 20056 - DNA, 391 bp, Gossypium hirsutum
  unsure (1)..(391): unsure at all n locations
  Clone ID: uC-gsflnu33B129d09b1
tcgtttcacgcgtccggaaagtattggttgctgttaagcaatattggaccgttgggggaaatacgacatcggcacagtaaacagcagacggcaacaaacttaaaccatggcatgaactgagtttgtggattatatgagtttgacatgaattgatgaatttccagcctgaaaatttttgccagcaggattgttttggtgtagggaggtgggtcacaggattaggtgaactaaggatcagtctgtgttcatttgtattaatttgtgaacagatagctataaactatgcttccaaagtttaatgatgattgaattaatcttattttttgttttccccaaccaaaacnnnaaaaaccaaaacataaaatttctcttttaaaaaaaacaataaaaa

SEQ ID NO: 20057 - DNA, 369 bp, Gossypium hirsutum
  Clone ID: uC-gsflnu33B129d11b1
tcttttaagtatttgctcttgtgcatgtttaaataaaggttgaagttacatgtatgatgctttacttactatttcaacttcctacattcagtactcactgtaattgtatcaggtatattttttagcatctacattaggtctttgtgtctgttatttcatattagaatccttcacctatgtcctcgaggaaaaaaaaaactttagattgattagtatcatacataatctttcgaggctttctccctaaattatcatgtatgtaggatgattagcttcacaccaatcaaatgctacgtataatgtaattaagatcacttcacaattgtgggatctgttttccttattgattaatgtgataatttcttgctg

SEQ ID NO: 20058 - DNA, 296 bp, Gossypium hirsutum
  Clone ID: uC-gsflnu33B129e03b1
ttggtttttctgtaggaagaaaaacatggttagaaacattgaactccttagtatggtatcaaaaagctgataccatattacatagtcaaaaagctaatgaaaaaaaaaacaaaactaaaaaaggagttaaaaagggaatcaatcatacataatttttgtagaaaatttatgtagtggtggaattggcagatcaaattcacactttgtaaacagtgtgttgcttgaacttgatttgaatttttttttatgggaatgaaaaaaaaaagtttattatttaaaaaaaaaaaccaacaaaa

SEQ ID NO: 20059 - DNA, 478 bp, Gossypium hirsutum
  Clone ID: uC-gsflnu33B129e04b1
ttagtacgtagcggaactgtctcgcaccctctcgttttcacattttcctattttatgctctcatcctccgccgtgccttccgccgtcggcttccttcaccaccgccatcaatggagacccaccggcgatcttcgactaattccgttcggtctcacaagccggcaaggccaattgctttggaagatgattccaccaaagcttctgacgcattgccacttcctttgtatttaacgaatgctgtgttcttcactctctttttctcggcggtttatttccttctttgccgttggcgggaaaagatccgatcctctacgcctctgcatgtcgtcaccttttccgagatcgttgcgattcttgcttccgttgcgtcgaatatttaccttttggggttctctggtatcgatttcgttcaatctttggttctccggccatcggctgacgtttgggctactgaagatgatgaagtggaaagtgaagc

SEQ ID NO: 20060 - DNA, 515 bp, Gossypium hirsutum
  Clone ID: uC-gsflnu33B129f02b1
tttctgggtatggagatgagctcttatgggcagcaagctggctctatcatgcaacaggtgatcgatcgtaccttgactatgcgactggtgaaaatgggaaacagtttgcttcatggggaagtccaacctggtttagctgggataataaaaatgcaggaacccaggtcttgctttccaggttaagcttgtttggtgccaaaggagtctctgggaactctggcctcagaaactataggagctctgctgaaggtgttatgtgtggtcttttgccaaagtctccctcagccacatccagcagaacagatggtggtcttgtatggatcagtgaatggaatgctctgcagcaccctgttgcctctgcatttttagctgctctttacagtgattacatgcttacatcacagactgcaaaaataacctgtggtgaccattcattcaaaccgtcggatcttataaaagttgccaatcacaagctgattatgtattgggcaaaaacccttttgaaatgagctttc

SEQ ID NO: 20061 - DNA, 370 bp, Gossypium hirsutum
  Clone ID: uC-gsflnu33B129f03b1
ttgtaatactccattcaacagcccgaaagaaggtgtaatttccaagagcatggcaaattgtgtgatgatgagacatgtttctcttgcaatagtattcgggaagcagaatctcagattgtcaggggaacacttttaataccttgtcgaacagcaatgagaggtagctttcccctaaatggcacatatttccaagttaatgaggtattcgcagaccatgattctagtctgaacccgattgccgttccaagggaatggctatggaacctgccaaggagaatggtctactttgggacatccataccttcaatatttaaaggcttaacaacagagggaattcaacactgcttctggagaggatattgttgtgtgc

SEQ ID NO: 20062 - DNA, 310 bp, Gossypium hirsutum
  Clone ID: uC-gsflnu33B129f08b1
tcgtgaagacttaatgacatccttggttataacggtgttttcttggatgtaaggagcacggtgcacaacttgatggcctacacaaacgaatacatgttctacaaagcttcacacagtgcttgaatcgatgctgactatatgcactagtgattccacgtttaacactgagtgaatacttgagggtatacgagttcatcactgtaactattataaagtcactgaattgaaatacactgaagaggctttatgaaaatcatgcgaaaatgaatgtaaatcctgacaatacacgtgccaagagaaacttgcatgt

SEQ ID NO: 20063 - DNA, 509 bp, Gossypium hirsutum
  Clone ID: uC-gsflnu33B129f10b1
tgttcgaaactaatagaaagccaagacggttccccaatatttcttcttcttgaaaacccagcaactgtttatcaaaaagattttatatattgccttgtttctttctttgtttttggggttttgcaaaaatggcaacaagtaggatcttttttggttcaaaaccacgatatatctacccaactatggaatttgatgatgggaatctcatcaacaacccttcatttgatcatcatcatcatcatcatctgctggagttcgatgaggtggatgtatggaacaattcaaatgatcaagcaacaaccaacttagaagccaaaaaaccattgccaagttaccgagcttcctctaagaaagctttcaaaaagaaggagtttcagattagcgataataataaccataggagtgcccaaatgactgctgcttctgcttcattgccggtcaacatccctgactggtccacgattctcaaagcggagtacaaggaacatgggaagaccgatgaagatgct

SEQ ID NO: 20064 - DNA, 218 bp, Gossypium hirsutum
  Clone ID: uC-gsflnu33B129f12b1
tcgttaagcccaatcgcgcagaagtggaggcggtggcggaggatttggaggaggaaacggtggttacagccgcggtggaggcggcggcggatatggtggtcgccaaggaggatatggtggcggacgccgtgaaggtggatacggaaacggtggggggtatggtggaggtggatacggaggttgacgcttgtatcgatgctactgttattttgaccctt

SEQ ID NO: 20065 - DNA, 523 bp, Gossypium hirsutum
  Clone ID: uC-gsflnu33B129g01b1
tttgtatcaaggcatgcatctttgatctttgattagaacggattgcttggtgcatttaagttatccagcctttttaagctctggctcaattttgtccaaggattggctcttgtaatttccatagatccaaaatggaattaattctctgattgtcaggtttttgagcactctgatttttttgatgcataaagttggcaggtctgctcactggaatatgttgaatgctaacttcttcggaagatttctgagtttaaggtgctatttttcctgtttaaagtttagttcatcaatatctggttatgtccatgattgactccttaaaattcttatttgatctaggtgataataccttgattgcattatgcagactgcagagtgatatatttccttacacctttcttaaacattcttaaacagcttttgagattgagttcacaagatctcagatcatagctgcaatcccttggacctttttctgtgcatggtatgcctcgcagaagcattggcttgctaataatattct

SEQ ID NO: 20066 - DNA, 305 bp, Gossypium hirsutum
  Clone ID: uC-gsflnu33B129g08b1
tcgtacactacagtgccgattttgggaaagaatagagcttttctgttcttcccgaagctatcgctaatttcctcaagtcgagcactcagttcgtttatcaacacgttagagaagtcaactatgcatttaaaatttttacatagcttttcataccaaaagggttgcacacaatgttgttgagaccattgtatgaaggggcctctgcatgttataccgaattgaaatatttgaatctggattattgaatgatttttagcattagctcaggttgttatatttctatttcatttcaaatgttcaacccc

SEQ ID NO: 20067 - DNA, 564 bp, Gossypium hirsutum
  Clone ID: uC-gsflnu33B129g11b1
ttcttccacgcgtccgattgaattctttccctcactttctcgaaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgccaaggatggatgcctgcaaggtctataattatgcctctgtctgagtcttgtgtaatagaagctttgtttgtggtgaaaataatgtataagccattcggttgggagcaaattgtccttttctccaaaggatttttgctgctcactcaatgagactggcttatggttctatctgtggttgtaaaaacttaataaaaatatatcgggtgctg

SEQ ID NO: 20068 - DNA, 590 bp, Gossypium hirsutum
  unsure (1)..(590): unsure at all n locations
  Clone ID: uC-gsflnu33B129g12b1
tcgtatctgagaaagggtggagtactaaggaaaaccagaatagcaacaactattacaatggtaacaatgaggccatgttcactgagaaaggatggagtactaaggaaaaccagaacaacaacaactattacaatggtaacaatgagtacaacaatgttgagaagcaaggtatgagtgatactaggtacttggagaatgggaagtactactatcgtgtgggttctgagaacaactactacccgaaccggttcgagaactcgaggggagtcggttcgaggaacgagttcaacgagaaccgttacaataacatgggaaagtacaatcagaatcaagaggagttcgaagaagagttcgagccatgaaaccatacgtatatgctaattaattagcaaaatgagagtaaagaattaaaggctctatttattgggttttgtgttttactttgtgatctttttatattttatttgcagggtttgatagcatccttngcttttgatattgaaatgctaaaagatatgatatgggagccttatgcttttacttttcttaacaatgtatgcaataaaatgaattatatgtccatatatata

SEQ ID NO: 20069 - DNA, 237 bp, Gossypium hirsutum
  Clone ID: uC-gsflnu33B129h04b1
gttattttttttgggaatttttatattttttttttctttttaaagaacgagcaaccagcataccccaaaagcaaaaaagcaaacacaacagcgcaaagaccaaggaaaaacacgcaaacaccggccgaatgcaaaaagatgcccagcccgaccaaacccaaaccaacgggacccctaaacataacggaaagacgagaaccaaaactccaaaccccaaagctttacccaccgacctca

SEQ ID NO: 20070 - DNA, 324 bp, Gossypium hirsutum
  Clone ID: uC-gsflnu33B129h09b1
tcgtttaaggagtgctgggtttcaaggtttccaagtaaaatgctgcgcgttcggcacatacatcatggagtttgtcaaaagggtttgaactttgaatctacgtgtcttggttacatgcttcacactgttacttgggcgattgtctcaaaggtggcttgcaaataaggacgagattttgtgctgcttatgtatgataaatactgctgttttatacgtatgctcataattctatcccggcctcaatgtaaagtaatacgcaaatgttgattaatgtcataaaacctcgagtttgagcaaaaaaaatcatgaagaagctgattgtat

SEQ ID NO: 20071 - DNA, 128 bp, Gossypium hirsutum
  Clone ID: uC-gsflnu33B130a01b1
ttgttggacggtttacatttgctagggggggtggggaacgattacatattgaagagaatttccacactttttactctcaaaaaaaaaaaaacaaaaaaaaaaaaaaacaaaaaagtggaatgaaacaa

SEQ ID NO: 20072 - DNA, 471 bp, Gossypium hirsutum
  Clone ID: uC-gsflnu33B130a03b1
tctgttcatcagcaaaaccccaacagattgctgtggtttttttccaagtcaatggattctgcctccggagggagtgacaatagcatcaaagaggctataccagcaacagcttcagccctgctgtccgcggcttcacaacaaggaggaggaggtggtagtgagtcgtctccttccccagctccaccgagtaggtacgagtcacaaaatcttctagactggaacactttcttgcagtacttgaccaaccataaacccccattaacactagctcgttgcagtggcgcacacgtaattgagctcttgaaataccttgaccagctcggcaagactaaggttcacataacggattgtccctatttcggacatgtaaacccacctgctccctgcgcttgcccactgaagcaagcgcggggtagcctcgactcgctgatcggacggctcagagcctgttatgaagaaaacggtggacgt

SEQ ID NO: 20073 - DNA, 479 bp, Gossypium hirsutum
  Clone ID: uC-gsflnu33B130a04b1
tttctttggaacgctttatgctaacgaaacttatgagcttcaggttgattatcctgagcattatcctatggaggcaccccaggtgattttcattcctcctgcgccattacatcctcacatttatagcaatggacatatttgtttagatattctgtatgatagctggtccccagccatgactgtaagttctatctgcatcagcattctctccatgttatcaagctcaactgccaagcaaaggccagctgataacgatcgatatgttaagaactgtcgcaatggcaggtctcccaaggagacgagatggtggttccatgacgataaagcataataatatgaacttattatctataatctgtgcataaaaactgaggctacagggataggtaatcgtttacatttgtcatgctgtgtatgaaattatgaattaaaccgagatgtattttgaatattggtacctaatgcatgaagcagactga

SEQ ID NO: 20074 - DNA, 442 bp, Gossypium hirsutum
  Clone ID: uC-gsflnu33B130a09b1
tcgtataaaaaaaaaaaaaaaaaaaaaaaaaagggggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggctttttaggggtccaagttttcctacccggggagggaagaaataatcttttttttttttgccccaaaattcaattcaggggggggggtttaaaaaccgggggggggggaaaaccctggtcttccccaaattaaaggggttggcaaacaacccccttttcgggggggggtaaatataaaaaggggccaaaccgaaggcctttccaaaaatttggcaaacctgaaaggaaatggggtcccccctctttactaccataaaggggggggggggtgggggttacccccaat

SEQ ID NO: 20075 - DNA, 371 bp, Gossypium hirsutum
  Clone ID: uC-gsflnu33B130a12b1
tcgttcatcctctcaggaatttttatacaaaccatcatcatcacccccttggaactaaccagtgaatctggaggagcaatgttgactcgagttgatgcacatcctaatttgttgcatgtaatctcatttcttatcttttactctctttttttccctttggattgagaaggtgatcggagttgtaatcagaatgttctaaattttttatgggacattgtaaagaaaaccagttacattgtggatagcatatggagcttacgaggtatgcatgcatgtatgtatctgaacgaatatctttgaagataaaacgtttttgccattctgagcgcttaaggagctcttcactagcggttcgaatgccatgggacggt

SEQ ID NO: 20076 - DNA, 460 bp, Gossypium hirsutum
  Clone ID: uC-gsflnu33B130c07b1
taagtttaagctctgtaaagttcggtctgtccaatttggtcaaaagagtatcccctaccttaatacgtatgatggacgcaccatccgctacccagatccactgatcaaggctaacgataccatcaagcttgacctagagagcaacaaaattgtagatttcattaagtttgatgttgggaatgttgtcatggtcactggaggaagaaacagagggcgtgttggagtgattaagaaacgtgagaagcataagggtagcttcgagacaatccacatccaagatgctgctggacacgaatttgctactcgtttaggcaatgtcttcacaattggtaaaggaacgaagccatgggtgtcacttccaaagggcaagggtatcaagttgtccatcattgaggaagccaggaagaggcttgcggcccaagctactgtctaaattttatgattaaagatataatatctg

SEQ ID NO: 20077 - DNA, 476 bp, Gossypium hirsutum
  Clone ID: uC-gsflnu33B130c08b1
tgttaaaaaaaaaaccctcaaagttagaaggagatacgcaaatattgttctcctcagcttttgatatattcttcttcttatctagatctacaatattgcttcaagaaagaaaattctttgttgttattactagcgattttaaaaggaaaaaagtggttgattccttttcaagtaatacgattttatagcgcttgattcttgcccagaatcgaagcgtttcatcaccaaaagtgatagatattgacgaaaattttaagtttattgaagaaattgaaacaaacaaacaaacaaacaaaaaactgaatcgtaatatgtttgtttggtgatggggtcaggcaaaggcgcgacttcttctgcccaacaaatggaatcgtctgtccaagatcttcgtgagagatataggctagaattggaaaatttaacattgactacacagccagtcaaaacatcaaggtttttccttctggctatccttc

SEQ ID NO: 20078 - DNA, 476 bp, Gossypium hirsutum
  Clone ID: uC-gsflnu33B130c09b1
tcagacccagtttgccatggcctactatgtcatcaactattccaagctgcgtatctgggagtttgtggagtattccaagatgatatacttggacggagacatccaagtattcgataacatagaccacttgttcgacatggaagatggttacttttatgctgtgatggactgcttctgtgagaaaacatggagccacacccctcagtacaagatcggctactgccagcagtgccctgataaggtccaatggccttcgcagcttggtcctaaacctcctctttacttcaacgctggaatgtttgtatatgaacctagcctttctacatatgatgacctcttgactaccctcagagtcacccctcctaccccatttgcggagcaggattatctgaacatgtactttagggacatttacaggcccatccctcccatttacaacctggtgatggccatgctatggcgccaccctgagaaca

SEQ ID NO: 20079 - DNA, 475 bp, Gossypium hirsutum
  Clone ID: uC-gsflnu33B130c12b1
ggatacagcagtcagccaaggactacaacaatggtggtgaaggtgtatggcccagcctttgcttctccaaagcgagtgattgcatgtcttattgaaaaggagattgaattcgagactgtccctgttgatttgcttaaaggagagcacaaagaccctgaatttctcaagctccagccttttggaacagttcctgtcactcaagatggagattatgttttatatgaatcccgtgcaatcataagatactatgcagaaaaatacaaatcacaagggactgatctactgggaaagacagtagaggaaaggggtcaagtggaaaattggctagaggttgaggcacacaatttcaacccaccaatttacgccttgaccctacatttgatgtttgcttccaagatggggttccctcctgatgaaaatttgatcaaggaaagcgaggcaaaagctggcaaagttctggatatttatgaggaga

SEQ ID NO: 20080 - DNA, 462 bp, Gossypium hirsutum
  Clone ID: uC-gsflnu33B130d01b1
ttttctcgtccggtcaagaaaccctacaccaacgtcaacgaaacccttgaatggaccatcgaacgagacgtgccgacggcgacgttctttatccgagcctacgctttggactcctacgaccacgaggtggcgcacggtcaaaacacctacgccgagaagaaaaccaatctgtttgaaatccaagccatcaccggccgccatgtttcgctcgatataacgtcggattgtttcaatgctttctccgttgtgtcgttgatggggttcttctttatggagaaaagaaaggcaaggaaatctcagcagtagtgtgatatattatgggtttaagaaccctaattaaacctttgaaaggatttttatagtaatgggtttgatttggatgcattatttactttctttgggttttaatcctagatgacgggagataaagagttaagttgaatgggtgtgctttagggggaa

SEQ ID NO: 20081 - DNA, 437 bp, Gossypium hirsutum
  Clone ID: uC-gsflnu33B130d11b1
tttgacgcgcgggtttctcgcattgcagtaggatctgcagactgaggctggccaagctgatgccctcaaagcagctttagctgagtttatttcaatgctcatttttgtttttgctggtgaaggctcgggcatggcttttaacaagctcactgacaatggctctacaacaccggctggtcttgtagctgcatcggtggcccatgctttcgctctgtttgtggccgtttctgtcggtgctaacatctcgggtgggcacgtaaaccctgccgtcaccttcggtgcctttgttggtggccacattaccttggtccgaagtattttgtattggattgctcagttgctgggatccgttgtcgcttgcttgctcctcaagttttcaactggtggattgacaacatctgcatttgccttgtcatccggtgtgggagcatggaacg

SEQ ID NO: 20082 - DNA, 471 bp, Gossypium hirsutum
  Clone ID: uC-gsflnu33B130e06b1
tttacttgtatggcagccaatttgaagagtggtggagggatcgccagcttggggaagcgacttcttaaccgcacctccactcgcaccccttctcttttcatctccacttcttcacctaccaggagtcctcacgcgtcggcatacgacaagaacctggatgatcaggtccatgcgactgtggttcctgatgatgtgattcagcctcaatcggacaagtactgggctcctgacccgcggacaggggtatttggtcctgctacggagcaacttaacgcatctgcgggtggggagcagggcacccattccagtggtgcaaactcggtcctggaggaaaaggcgtggttccgccccacaagtattgaggacttggagaagccacaccatcactaagtcactgataatgagcctactactatatagtctataggtaaaacaaagacaattggtgtggcttgcttggatcacataaac

SEQ ID NO: 20083 - DNA, 451 bp, Gossypium hirsutum
  Clone ID: uC-gsflnu33B130e07b1
tagattgccgttcctccagaacgcttgttgtttaaaattccttcaacttggcaaggaatagaagcttcaagattgctcgaatctgagggtatacaaacacatttgacttttgtttatagctttgctcaagctgcagctgcagcccaagctggtgcttctgttattcagatttttgtcggccgtgttagggactgggcacgcaatcattccggtgaccctgagatcgaagctgctattcaaagaggagaggaccctggattggctctggtgacaaaagcttataactacattcataaatatggacataaatcaaagcttatggcagcagctgttcggaacaagcaggatatatttagtttgctgggggttgactatatcattgcaccattgaaggtattgcagtcactcaaagaatcaattacttctcccgacgagaagtactcttacgtta

SEQ ID NO: 20084 - DNA, 479 bp, Gossypium hirsutum
  Clone ID: uC-gsflnu33B130e08b1
tagctattacgtggagagcctttttttttgtgtagcgattctcagttagtcttttctttaagcttacagcttctctccagagttttataatgggtaaggagaaggttcacatcaaccttgttgtcattggccatgtcgactctggcaagtcgaccactactggtcatttgatctacaagctaggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactttatcaagaacatgattaccggtacctcacaggctgactgtgctgttctcattattgactcaaccactggtggctctgaagctggtatctctaaagat

SEQ ID NO: 20085 - DNA, 479 bp, Gossypium hirsutum
  Clone ID: uC-gsflnu33B130e10b1
tcgttctcacgcgtccggagatcctgactcggacagtgtggtgggtagtaccattgatatgggtgccggttgcaatgtggttcatctcaatctcttacacaatgggtcatacacttcccctagttgttttaatgtctgttgttggaagtttcatttggacattcttggaatactgtttccaccgattccttttccacattgaaacaaagagttactgggcaaacacttttcactatctaatccatggctgccaccataagcaccctatggatgggctaaggcttgtgattccacctgcagaagctgctatactagctataatgttttggaacttgtatgggattttattcactgtctccacaagacctgcattatttggaggtggactgattggatatgtgatatatgatatgatacattactatgtgcaccatggccagcctaccaaacaatctatcaaaaacttaagaaatatcact

SEQ ID NO: 20086 - DNA, 478 bp, Gossypium hirsutum
  Clone ID: uC-gsflnu33B130e12b1
tttttaagatcgaggccgaattgtccgagatttgcgccggaattttgaagcttctcgacgagaagctcgttccggccgccgggaccggtgattccaaggtcttttacctgaagatgaagggagattaccataggtacttggctgagttcaagactggcgatgacaggaaagcggctgccgagaatacgctcactgcgtataaatctgctcaggacattgcgaatgcagagctggccccaactcatcctattcgattaggattggctctcaacttttccgtcttctactatgagatcttgaactctcctgatcgtgcttgcactcttgcgaaacaggcttttgatgaagccattgccgagctggatacacttggagaggattcatacaaggacagcactttgataatgcaacttcttcgtgataacctcactttgtggacctcagacatgcaggatgatgggacagattgaatcaaaga

SEQ ID NO: 20087 - DNA, 309 bp, Gossypium hirsutum
  unsure (1)..(309): unsure at all n locations
  Clone ID: uC-gsflnu33B130f02b1
tcataccttccngaccagacaggcgcacatgctatcattccagggaccattacaggggagaacgaggaaggccgtaattgggggaaaatatggtacctaatatggttccattttgaggaaccaaattaagaagacggatgtgaattaacacaacaagtacttctcacagttctctttaaagcatacatttgaacataaaggctttattaatctcctcctgcactcatatcattaaagttaaagctgttggagcttatactctgaacactgccaccgctatgacctttgaggattactattaggaggttg

SEQ ID NO: 20088 - DNA, 442 bp, Gossypium hirsutum
  Clone ID: uC-gsflnu33B130f06b1
aaagtattagccccaagcagcatgaagattaaagtggttgcaccaccagagaggaagtatagtgtttggataggaggctccattttggcatccctcagcaccttccagcagatgtggatttcaaaggcagagtacgacgagtctgggccatcaattgtgcacaggaaatgcttctagagaagagctatacatacagtacacgttttgtatcacagcaaagcttataaatcaagtgggtgctttcttttcttttctgctccgttaatttatttcccccccttttctttttttctttttttttttttgccctctttgaggtggttcccaatgttgctttatggagggatacccccctttctttttttcttttattaggggagaaaaggcggggttttgattgattttgtacccgatatggtttggattgaacaaaaaatctttt

SEQ ID NO: 20089 - DNA, 484 bp, Gossypium hirsutum
  Clone ID: uC-gsflnu33B130f09b1
ttcttaactcataactcctcaaaagtcttcttcaatggcagctcgagttcttgttttggcttcaattcttattttctcttgttttgcagagacaacacggggtgatctctttctcatcccttcaaagaacacttgttgttactgcttctcatagacaaggacttttgaaagccggtgaagacaagatcacagtgagatggggattgaaccaaagtttcccggccgggaccgactcgtcttataagaccatcaaggtccagctttgctatgcacccatcagccaagtcgaccgtgcatggcggaaaaccgaggaccatcttaacaaagacaagacatgccagttcaagatcgtcaagaaaccctacaccaacgtcaacgaaacccttgaatggaccatcgaacgagacgtgccgacggcgacgttctttatccgagcctaccctttggactccgacgaccacgaggtggcgtacggtccaaacac

SEQ ID NO: 20090 - DNA, 420 bp, Gossypium hirsutum
  Clone ID: uC-gsflnu33B130f12b1
tggtctcgaaacggcggcaccgcttcggtctttgggtatcaacgtaacggatgccatcgtggttatagatagggagcaaggcgggagggaaacgttggaggagaatgggattaaacttcatgcactttttactttaactgagatggtcaaggttttaagagccaaagggaagctggaggaagagatggaaagtttgattatcaagcttaacatccacattttgacagttggcgtaattacgaataggcccgtaccgatcgcccgtttggggtttgaagaaaggtttattatttttaagaatctctctggtaaaaagctatttgagattattggtttaaaagataagtattctttgttggtgggtgatgttgccactgcttctgaattgcttgctattgctttagaaggtttgacccttaa

SEQ ID NO: 20091 - DNA, 433 bp, Gossypium hirsutum
  Clone ID: uC-gsflnu33B130g01b1
tttattaaccaaaacataaaccaattatcaggatttcaagagctatgggttcaaatgccaaggttgtgcgtcgacatgagcgggcggaggccaaaccgggcggccggatcgttatggagcttttcccatacgccactcctagtactgcctataacttccggtcactctgtaccggtgagaaaaggcaacttacgatccggataaccactccactacaaaaccatctaacctccaccgcttgaaccctgatttcatgtgccaaggacagaaagcttcacagtaccaccaccgacaccggaggtgaatccgatatacggatctaagctcgccgacgagagctttcatgaagaagcacagcggaccccgtatactaaccatggcgaacgccggtcccggaacgaaagggtctcagacatgtatttcgtacccgcta

SEQ ID NO: 20092 - DNA, 295 bp, Gossypium hirsutum
  Clone ID: uC-gsflnu33B130g03b1
tcctactcgtccgcaaaatccttgcccctgagccttgaatggtgggtccacgggcccccgactcaccagttcttgatgctcctgctcaccggtgcttcatcctaccattctttccttttcgaggttgatcccctttcggctaccacctttgggcccaccgtcatcgtccaaggctgctatcacacccgttcaatctcttgggttcacgcttgtaccgtaacccacttcataattacccaagtgagggaatacttgaacacttctctcaccgttactcgcccttgaaaactttacc

SEQ ID NO: 20093 - DNA, 453 bp, Gossypium hirsutum
  Clone ID: uC-gsflnu33B130g05b1
tttcaatcctctcacagaccctagcctttggcattattcacttcgggagataccatggcaccaaaaaaagacaaagcccctccttcttcatacaagcctgtacagtctgcaggtggcaagcagacgaagacgaagtgctgcaagggaaagcaaaaggataaggcgaataacatggagctgatagatcaggctacctatgacaagctaatatatgaagctgctaaatacaagctaatgactccctatatgctatctgaacgaatgaggataaacggatcactagcaaggaagggtattagggaactgatggcacgaggaatgcttaggctggagactgcccattgaagccagcagacttacactagggatacatacacctacatggtgcggtatgtttttgctcagttccatgacatagtgccgtacattgatgacacgcactctaagtgaaac

SEQ ID NO: 20094 - DNA, 386 bp, Gossypium hirsutum
  Clone ID: uC-gsflnu33B130g10b1
ttgtttcacgcgtccgcccaatcaagagggaggagcatcatgataatcgggaccctcttaaacagtaaacctttgatttttacattatttactttacttttattttattatttttatatgtttttaaatctgttttttcgtggaattatcaaagttgtgcaagtagtaaatttattaaggtttttcgggaatatgatttagaatttggactggacatagtgtgctaattggaattgagagttagtggtaaaaatgcaatttttatcattgacaaattgaggttttgttattcttaccgcgttgaagctattggattctcaaaaggaatttgggtgggttagaaggattcgattcagattaaaattatccaaaatcacctacaattc

SEQ ID NO: 20095 - DNA, 272 bp, Gossypium hirsutum
  Clone ID: uC-gsflnu33B130h01b1
ctccatcagtataaggattcaggatcgaaagactcgtgaataatactgcgaacgctatgacttgtcatcgaagttttgatcagatgtggttggtttgtaagttaacctaattcacattcttctcttaaaatataaaaaaaaaacattacaatgtccgattcgcttcaccataaccaacaacgtaaacgggcgctatctttatattatccatctttcctctctcaagcatgcgacgatcccattataattttgtgccgcctcaaacacgttct

SEQ ID NO: 20096 - DNA, 336 bp, Gossypium hirsutum
  Clone ID: uC-gsflnu33B130h02b1
ttttatataccagctttcttagtcttccttcaccattcccctgttgtgtaaaaatgggggtaaatgtcctttttacccttatagttttatcattccttgtttgattcttatttaacctaattctcattcaaccattaaaatataagaaaaaaacattacaatgtccgattcgcttcaccataaccaacaacgtaaaccaacactatcttcttcttcctcttcttttttctttaaattattttccgatcccatcaaaattttcttccgatacaaacacgtttttatcccagtcctccttttcttgacccttcccctctctttccttcttttttccct

SEQ ID NO: 20097 - DNA, 55 bp, Gossypium hirsutum
  Clone ID: uC-gsflnu33B130h07b1
tcgtgagagctagcttctacagttcttaattcagattattgcatttcaattaagg

SEQ ID NO: 20098 - DNA, 391 bp, Gossypium hirsutum
  Clone ID: uC-gsflnu33B131a02b1
tggatgcgtgggtggagtttatggtaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaacaaaaaaaaaaaaagaaaaaaactaaaataaaaaaaaaaaaaaataaaaaaaaaagggggggggggccttaagagaaaaaaaggttcaacacgggtgtaaacagaaagcaatttttttttatggggaccccaaataaaaatcagggggggggttttaacaaaggagaaagggaaaaaaccctggtcccccccaaataacatgctgcggggaaccccccctttttggcaggtggttaaaaaaaaaaaaagggccgacatttacc

SEQ ID NO: 20099 - DNA, 284 bp, Gossypium hirsutum
  Clone ID: uC-gsflnu33B131a04b1
tttgtcttcgctcgaagtcatgctgccagagatgggttgtcaagcatgaagcttctggttgatgatacaactgagacaaaattccaaagacaattgcaacttgtcatggataaagcgactcttgattccattgtcttgcatcctgatggacctatcaaaaggatgatgtactgggactcactctcgaagttggctgccccacgtggagtgttagtgatttacatttgggaaccatacacaagatgatttggttcaagaggtggaaaatttcaattccttgaaac

SEQ ID NO: 20100 - DNA, 106 bp, Gossypium hirsutum
  Clone ID: uC-gsflnu33B131b01b1
ttccacgcgtccgacacaatatgctgtttggtatggtatagactaccatggaaacacaatatgctgtttggtatggtatgtgttgctggtttctgttgatttgatt

SEQ ID NO: 20101 - DNA, 433 bp, Gossypium hirsutum
  Clone ID: uC-gsflnu33B131b04b1
tttctctcgtccgcagtcatatgtctcatgcctatgacttttacaaacccaaccttgctagtgaatatcctgttgttgatgggaaactttctcaaacgtgctatctcatggctcttgatacttgctataagtatttctgttacaagtatgagaaactagagggcaaacaattttccatttctgatgctgactacattgttttccattctccatataacaagcttgtgcagaaaagctttgctcgtttgttgttcaatgacttcatgaggaatgccagttctgttgatgacattgctaaagaaaaattgagtccattttcaaatttgactggtgatgaaagctaccagagcaagggatcttgagaaggtatcccaacaagtttcaaagtccctttatgatgcaaaggtgcaaccaaccaccttgataccaaagc

SEQ ID NO: 20102 - DNA, 184 bp, Gossypium hirsutum
  Clone ID: uC-gsflnu33B131b06b1
tcctttcgtccgtctaaacgcctttagagtacgggcgtactagggtcgcgggccaataattcaaccgacgggatgcacggcgccggccaccatagaagaatatccaagatcctaagataacatgttctaaaagaaacgaggtaggtggacagtatcttgttagcgagccaagggagccgaccct

SEQ ID NO: 20103 - DNA, 433 bp, Gossypium hirsutum
  Clone ID: uC-gsflnu33B131b09b1
tccacgcgtccgatgacatacagaccctattgaatcacaacttcggccatcgtattcaagaaaccaacatccaacactgcaatcagagcaggctatttatatatatatactatatgcatatatctatcttttgccaatcaacaggcgacaggcggtgtggctggttttacaggagggacattgttagtagctgcaggtttgaaagcagcggcagtggtttccaggcgttcccatgctagtttccgcttctcagctgcttcaatcaattgggagttttcttcctccaacttgtgctgacaggcgagcagaagctcttcatccatctcgcagaacatctttcttatgttctgggtcaggttaagcactgcttgattcccatgattctgggaattccgctcaagggacggaaagatgagagggaaaatcacatgac

SEQ ID NO: 20104 - DNA, 445 bp, Gossypium hirsutum
  Clone ID: uC-gsflnu33B131b11b1
caactatctagctaccacggctcgtgctgatgcttacccttacggtatcgactatcctactcatagagctactggccggttctccaatggccttaacatcccagatcttataagtgagcaaattggctctgaaccaacattgccatatctgagcccggagctaaacggacaaaggcttcttattggtgccaactttgcttcggctggaatcggcattctcaacgacaccggagtccaattcgtcaatataattagaatcggcgagcaattacagtactttaggcaatatcagcaacgagtgagtgcacttattggacctgaacaaacacaacgcctagtgaatgaagcacttgttctaatgaccctaagtggcaacgacttcgtaaacaactactactttgttgcccgtctcggcacgatcacgggaattcgcactccctgatta

SEQ ID NO: 20105 - DNA, 487 bp, Gossypium hirsutum
  Clone ID: uC-gsflnu33B131c01b1
ttgataagctggtggaatcatcttcaaagatgaatatgccttcagatttgccacaaaacacagctccatatcctctcacaatgcaccctctagaccagaatgggagaataccttctgaaggaatatttggtacaactatgcatcttctgaagcaaaattctcaagtacttagtcaaatcacatccaacctttctgcatacaagttacaggataacgttgatctcttttgtcatgcaaagaacaatattactgccatgctaaaagacatgagagatatgccgggtttaatgagccatatgctgccattgcctgtgtctgttagtgaggatttagcaaatagcatgttttgtagtgcaactcaggcaacgattctcggggatcaatcttaagcaggagccaagggtgctgattgggaattgttgagggtcgagtttcgatgtatctgggattgataaattacggaaaaaaaattctactgaaaaatcat

SEQ ID NO: 20106 - DNA, 377 bp, Gossypium hirsutum
  Clone ID: uC-gsflnu33B131c04b1
tttgttatcagagatggtgtcagctataaaggtgttaggagatgggttcgtaaggatggagcagatgaagatggaaatggcgagggagatagagacgatgaggatggagatggagatgaagaggaccgaggtgatattggagtcacagcagagaattgttgaagctttcgctaaggcagtttcagagaggaagaagaagcccaaaagaatgcccttacctcagtcctaatggattttccttactgcaatgtgtccaatccttttgactacggatttgcaagtgtaagttggtggaatgttagggggtttacttcaatttttatctttctttgtttgattattgagtgatagcaatagtgcatcctgatctgctgtag

SEQ ID NO: 20107 - DNA, 312 bp, Gossypium hirsutum
  Clone ID: uC-gsflnu33B131c05b1
tcttttctgaaatatcccattgagcatggtattgccagcatctgggatgatacggaaaagatctggcatcatacattctacaatgaactccgcgttgcttcccaggagcacccaatgcttctcacaaatacacctttcaaccccaaggccaacacacaaaagaggacctaaatcatggttgagaccttcaatgtgcctgccatgtatgctgccatccaagctgctctctctctgcatgccagcggtcggaccacaggccttgtgctggatctctggcgatggtgtaactcacactgtgcccatccctgaagg

SEQ ID NO: 20108 - DNA, 112 bp, Gossypium hirsutum
  Clone ID: uC-gsflnu33B131c06b1
ttcttttcatccgtataaacgaatttaaaatacagctgaaattcgatcccggtcccattggtcaaccaacaattggcatttcgccgggcacgatagatcaaggcattacatc

SEQ ID NO: 20109 - DNA, 178 bp, Gossypium hirsutum
  Clone ID: uC-gsflnu33B131c08b1
ttcacgcgtccgcgtaaacgtcttgagaggacagctataatagtttctcggtccgatagctcaaacaacggattgaaatgtacagggcgggttagaggacaacactacatcgtcacctaacatcttctcagagaggctgccgattgctacaggacctgattcccgagatgatgaagat

SEQ ID NO: 20110 - DNA, 376 bp, Gossypium hirsutum
  Clone ID: uC-gsflnu33B131c10b1
aaactacagctgccctcaccttgtggaatttgtgtcttctgaatctatacttgtttcgaacattactttccttaacgcacctgcatataacattcatccagtctattgcagccatgtgcacattcatcacataacggtctatgcttcgccaggatcaccatatactgttggtatagtcccagattcttcggataacatttgcattgaggactgtagcattagtatgggtcatgatgcaattgccctcaaaagtggctgggatgaatatggcattgcttatggcatacctaccgcaaatgtccatatcaggaggggccaacttcagtcattctcaggctcttctcttgcttcggtagtcaaatgtccggtggcattt

SEQ ID NO: 20111 - DNA, 326 bp, Gossypium hirsutum
  Clone ID: uC-gsflnu33B131d01b1
tgtactgttcagggccataagaccgaatagtgttggaagtatggtggaaaaggggtgaagtttgtaggagaagatgggttcgttttggtgttcatgaaatcccaaaaatgtctctcttccatgttttaaagtgagagaagggtgggtcctctctttctttaagtgcgcctcttgctattatgccttattacttataggtggcgacatggtatatggaggatgtgattgatgagacttagaggtatctatgtattaacatatggttagatttctttaaagttttcacaggatttttttagtttattttcctatatccctttgctgga

SEQ ID NO: 20112 - DNA, 355 bp, Gossypium hirsutum
  Clone ID: uC-gsflnu33B131d04b1
ctcgctctctagggttttcgtggtcaagtaaaaaaaatgaaggtggtagctgcctacttgcttgccgtcttgggagggaacctttccccttctgccgatgatttgaaggatattctcggatctgttggagctgaggctgatgatgataggatagagttgctattgtccgaagtcaaaggcaaagatatcaccgagctaattgcatctggaagggagaagttggcttcagtcccttcaggtgggggctgctgttgctgctgctcctaccgcaggtggccggtggtgccagtgctgcaccagctgctgaggccaagaaagaggagaaggtcgaagagaaggaagagtccgatgatga

SEQ ID NO: 20113 - DNA, 313 bp, Gossypium hirsutum
  Clone ID: uC-gsflnu33B131d05b1
ttcctttcgtccgcggacacgtgttttcaagtgggtattcattggaggtgctggccataccccaatcctcagacataaagtgtcaaaatcatttaaaggatttttcgaattacacagatataattgacatatactgagtggggggttccttaatattttttaacggctgtgaggtttgtgaagcactttgcaccaacctgtttgaggaatggcttctatgctggtcgccaggattataatgccacaagctggggctcgtggttctacgcatcatgggatgagctgcaggcagtctacttttgcaacatggtca

SEQ ID NO: 20114 - DNA, 257 bp, Gossypium hirsutum
  Clone ID: uC-gsflnu33B131d09b1
tccacgcgtccgaggaaccgtcttgagagtacagggtacattgattatcggcactatagatcaaataacagaatggaggtgacatggcagggaagatgataatgctagatcgtcagctaacatgttctcaaagaggctgcctattggtacaggacctcattcccaagatgataaagattacagctgaacctcctccatggcccatgaatgagcctattgtggggacctgatggactatccaccgagctggaaacgct

SEQ ID NO: 20115 - DNA, 371 bp, Gossypium hirsutum
  unsure (1)..(371): unsure at all n locations
  Clone ID: uC-gsflnu33B131d11b1
tttcttccacgcgtccggtacttgtcgacctctcattttgcagatggttcattaccgttctgcacttgagcctcgttgtcgctttcaggtcttgacagaaacagatcattgctattgtgttcttgttaatgcgcttgatggggaagcttttcctagtgaaaaggatacaaatgatagcagttccagtaacaaagtaccattgagagtagatactaattccatgaagacgaaaaatagtaagctcacacttttttctggatttgtcagctatcaaatggtccgggatgcatatgatgtggngagttctggacttggaaagtcttctatcaatgggtcattcctctggcaaaaaagacagactctgcatgaaa

SEQ ID NO: 20116 - DNA, 343 bp, Gossypium hirsutum
  Clone ID: uC-gsflnu33B131d12b1
ttctgagatcatcaagtcagaccccgttgtgtccttccgtgagactgtccttgagaggtcttgcaggactgtgatgagcaagtctcctaacaagcacaaccgtctgtacatggaagctcgacccttggaggaaggtcttgctgaggccattgacgaaggtcgcattggtccaagagatgatcccaaggttcgttccaagattttggccgaggagtatggttgggacaaagatcttgctaagaagatttggtgttttggccctgagacaactggtcctaacatggtggttgatatgtgtaaagggagttcaataccttaatgaaatcaaggactctgtagttgc

SEQ ID NO: 20117 - DNA, 391 bp, Gossypium hirsutum
  Clone ID: uC-gsflnu33B131e02b1
tttctctcgtccgtttttgagctttcgtgtttgtctattgaattctttccctcactttctcgaaaaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattggcaaggatggatgcc

SEQ ID NO: 20118 - DNA, 273 bp, Gossypium hirsutum
  Clone ID: uC-gsflnu33B131e04b1
tccatgcgtccgcccacgcgtccgggccgtcagcaggtgttagtgaggataagcaacagagagaagaaagggaaatgagtgagaaaccattggctgatgaagtttgggatgatcatgaagaatattattattatgatgatgatgatgattattagaaaaaatgtggttgaagtttgggttgttttttgccctgtcccgttctttctctttaaggggcaaatgggaaaaacacaggttttttcccgtttaagggaatggaagggaaactttttt

SEQ ID NO: 20119 - DNA, 457 bp, Gossypium hirsutum
  Clone ID: uC-gsflnu33B131f01b1
tcctcgcgtccgcccacgcgtccgcaaaagtcttcttcaatggcagctcgagttcttgttttggcttcaattcttattttctcttgttttgcagagacatgctatggggtgatctctttctcatcccttcaaagaacacttgttgttactgcttctcatagacaaggacttttgaaagccggggaagacaagatcacagtgagatggggattgaaccagagtttcccggccgggaccgactcgtcttataagaccatcaaggtccagctttgctatgcacccatcagccaagtcgaccgtgcatggcggaaaaccgaggaccatcttaacaaagacaagacatgccagttcaagatcgtcaagaaaccctacaccaacgtcaacgaaacccttgaatggaccatcgaacgagacgtgccgacggcgacgttctttatccgagcctacgctttggact

SEQ ID NO: 20120 - DNA, 234 bp, Gossypium hirsutum
  Clone ID: uC-gsflnu33B131f05b1
ttcctttcgtccgcctaaccgtctttaaagaacgggggagctagcttgtcggccctatagctcaaaggacggaatcaaggtgggaaggcacggtagatcttatcacttcatccacaaataacattttctaagagacaccacggagatctaaaggacatggagctcgagctaacattgcctaccctcaagctgagatcgggcacaaaattgacgcatccaagttgcctcaaccat

SEQ ID NO: 20121 - DNA, 201 bp, Gossypium hirsutum
  unsure (1)..(201): unsure at all n locations
  Clone ID: uC-gsflnu33B131f06b1
tttctttcgtccggcaacccgacggtagaggcgggggctacttgaatttcggatccttctcacaaccaacgtacgcaaagggtcctgcccccggagaggcatacaggggatcctcatctcccttttcacaagcttaaccaaacngatataaaggtggtagtgagcgagccgatgaccagaacagaagtcttgttgacgccc

SEQ ID NO: 20122 - DNA, 452 bp, Gossypium hirsutum
  unsure (1)..(452): unsure at all n locations
  Clone ID: uC-gsflnu33B131g02b1
tcctctcgtccggctggttccgtgttttacgtcctttaccgccctaatcgaccttcgtttacccttgcttccctccgtatccaccgcttgaacttaacaaccaccgncgattcctcttcctcccatctgtcaacccttttcaacttaaccatttcctccaaaaaccccaactcccacctttccttctcttacgaccctttcgtcgtttcatgcgtgtcgagcaacagtgatgtttttataggcaacgggacattacccgctttcgtgagtaacagcaaaaacgagacaactttcaaaggggtggcggtaacgacatcaattgatctagatgcagagacggtcaacaatttgagaccggatttgaagaagaagaatgggatcttgctgaaagctcagatggatactaaagtgacagggaaaatgggtggattgaagagcacgaaagttgggat

SEQ ID NO: 20123 - DNA, 425 bp, Gossypium hirsutum
  Clone ID: uC-gsflnu33B131g04b1
tttctctcgtccgcccacgcgtccgcttgaccaacacatcaaaactacaaatataatcgctggatagtgtgataaatctctgacgagctttcaaactggtagagcttccgataatttgtaaagtaaaggaaagtaattatgtaagcaatgaatgctcagtaagctcgtataaaatttaaacataatatctcattttaataatgaaactttatagggtaaatataaacctagaccaatgccacaagatttattaaactatgtaaccatcaactcacatttgagtaagtccatcaatattatatatatatttctttcctatcataatatgattttataagacatattacacaatcattaaccatttcatgggaccatgaaccattccatttacttacttattattccatttacttagcataagctta

SEQ ID NO: 20124 - DNA, 484 bp, Gossypium hirsutum
  Clone ID: uC-gsflnu33B131g08b1
tctcacgcgtccgagatccccgtatccgtcggctccgtcgtgctggtccggaaaatctcggcgccgtcgagccagatggcggcgatacgatcgtactgatcgcctgaggagtcagcgcggaaatcgaggacgacgcgcggccagggcggagaacaatcggaaggtggagagtaaggggcggagaaaggaggggagtcgattgtgttggcgaatgaatgattgatgacggtgagggaacatgacggagtcagatgatcggacggtagaggattggtcaactcgaagaattcttgagattggggttttgggtcccaagatttcagccgaaagggtttatggaagcgatcaggtgcggcggcggcggatggtactgttccggtgaggaagagcaattagcccgtgaaagcaaagtaacaagcgctcatttttggtcttgaaaaggtagctaatttgcatgggtttatacttggggattcaatttttt

SEQ ID NO: 20125 - DNA, 424 bp, Gossypium hirsutum
  Clone ID: uC-gsflnu33B131g10b1
agcgtatcccttggcatgagaaattggaaggagaggaggcaattcagaaccatgtgcatgagctaatcacaattggaaacttggaaggtgctgtcagtttattgctttctacttctccagagagtccttacttctacccaaatgctctacgtgctgttgctctttcttctgcagtgtcaagatctcttcttgagctggcagttaaggtcgttgctgcaaacatggtcagaactgatcggtcactatctggcactcatctgctctgtgctgttgggaggtatcaggaagcttgttcacagctgcaagatgctggatactggactgatgctgctactttagctgctgcacatttaaaggggatctgattatgcaaggggtgttgcaaaggtgggcagagcatgtccttcatgctgaacacaacatt

SEQ ID NO: 20126 - DNA, 388 bp, Gossypium hirsutum
  Clone ID: uC-gsflnu33B131h08b1
tggacgcgtgggcggacgcgtgggttttgttctcctttttttttaatcttcgtaaccccgttttacaaattggttctggcttttatagtcatattacatggttcactactgtttcttttatttcttgccctgtttctgttgctttttgtgtccctttttgcaggtgctggcggtcaaagatggaggcttgctgttttggtgtgaacggcggtagctagggtgtcaagtggcacggcggtggcagtgactagagtgtcaaaaattattgaaggtttttttttaaatatgttaaggaaaaataagatgataactgctatataaacctaagcatttatttttatatatgtataactattcaacgagtaaaaatgcattattgaaaaatact

SEQ ID NO: 20127 - DNA, 487 bp, Gossypium hirsutum
  Clone ID: uC-gsflnu33B132a05b1
tacccgcttacatcgcaatgagggatgcgttccgtatcagggcctcgaatctgaagcgggcgcctgacttctcattgttcgatacatgcttcgacctgtccggcaagacttccgttaaggtaccgacggttgttctacattttagaggggcggacgtgtcattgccggcgacgaattatttgattccagtagacagcagcggaaccttttgctttgctttcgcgggtaccatgagtggtttgtccataattggaaacattcagcagcaaagtttccgggtggcttttgattcagcgggttctcggatcgggtttgctccccgtggatgcgcttaaacatgggtatgggtcttttatctatttttactaagggaagggataaatctctttccctgcctttattttaaggttagaaggggagaacaaaaacgatctttcatggatttgaatgttagacaggaagagagggagatgataaaaggcggtag

SEQ ID NO: 20128 - DNA, 355 bp, Gossypium hirsutum
  Clone ID: uC-gsflnu33B132a10b1
ttgtccacgcgtccgccctctcgcccaccgggggggttattaacacgtatcgggggtttttacccctccttcctcacgttaccttacaagctttgaaagggaccttctagacgagtcttcaaagtacccaccctcttgctctacattttagaggggcggacgttttcatttgccggcgacgaattattttgattccagtagaccagccagcggaacccttttgctttgcttttcgcggggtaaccactgaggtgggtttgtcccataattggaaaacatttcagccaacaaaagtttcccgggtggcctttttgattcaagcgggtttcctccggatccgggttttggctccccc

SEQ ID NO: 20129 - DNA, 165 bp, Gossypium hirsutum
  Clone ID: uC-gsflnu33B132b04b1
gcgttcctctggttcttctccatcaccatcttcatcgggttcatcaacttcgtaatcaacttcaattactaactttacagtttgagagcatagtccgatcaggcccatatttcgcggtgtccctgatgtgatctctccaagacgatgatcttttgtgtccaacaa

SEQ ID NO: 20130 - DNA, 213 bp, Gossypium hirsutum
  Clone ID: uC-gsflnu33B132b07b1
tcgtctcacgcgtgcggtctcgtgaacaattaaatggtagttaaggggtgatgttgctacttaaacctcttagagaaggagattgttaaatctgtcaacgtattttaatggggtgacttgtttgagacttcaagaacacttcctagatttatgttatgccctaaaatcgttaattacttatctctttaacatctaacggtctgtacttgatgc

SEQ ID NO: 20131 - DNA, 72 bp, Gossypium hirsutum
  Clone ID: uC-gsflnu33B132b08b1
tcgtccacgcgtgcggctaagcgaccaaaccaacgaccttttaggcataactaccggggggggacattcaac

SEQ ID NO: 20132 - DNA, 65 bp, Gossypium hirsutum
  Clone ID: uC-gsflnu33B132b11b1
ccctcccacacgtacgaacaattgaacaaactggggttttttttaaacttcccggggttactcac

SEQ ID NO: 20133 - DNA, 387 bp, Gossypium hirsutum
  Clone ID: uC-gsflnu33B132c02b1
tagacttctaagtaatgtgtcattgttgttgaaaccaaggggttattttttcggtattactcctgaaaaagtgattgccaaaaactgctgtttctggatttgtgtattttcctttttttttgttcttgtggttattgctgcccctgtttctgggaggtgattgtgtaaacattttagtgtgctttagttattgtaagaatatttttaacattgttaattttaatattattgtaagaatattttgaattataattcagttatcaatttatatcatttatctttcatttaaaaaaaatcacattaattttaaatctgtctttccgtcctagttggatttaattttttcttacgctatatattcctatctcttagctttttttttttttc

SEQ ID NO: 20134 - DNA, 100 bp, Gossypium hirsutum
  Clone ID: uC-gsflnu33B132c07b1
tcgttcacgcgtgcgggcaaataaactatgtagggggagttgatagatgattatcgtaaggagttttgggaaaaaaagggttaaaaatatatttatttgt

SEQ ID NO: 20135 - DNA, 113 bp, Gossypium hirsutum
  Clone ID: uC-gsflnu33B132d02b1
accttcctgtccaacctacaccaagatcaaacaatggtcaagtgacaaaatgagcgacattaaacacaccactcatggtatatatacggcgggcctttccagaaagcttcata

SEQ ID NO: 20136 - DNA, 92 bp, Gossypium hirsutum
  Clone ID: uC-gsflnu33B132d04b1
actttctcttaaaggtgtgaagggttcatagaggtgggggaaaataaatgaaagcgggatctgcccactctctagccatctttatagggaac

SEQ ID NO: 20137 - DNA, 197 bp, Gossypium hirsutum
  Clone ID: uC-gsflnu33B132d07b1
tcttccacacgtgcgaccatgagtacaaagtagtcacaggtaaggggtgaggaccaaatatacccctcttactacactcatcggagattcccctcgggggtttacgacgggattatgggctttaccctttaacaccatcccaccggcattcgtgttacccttttaaccctccaccccatagtaattcactaccgata

SEQ ID NO: 20138 - DNA, 200 bp, Gossypium hirsutum
  Clone ID: uC-gsflnu33B132d10b1
tcgtccacgcgtgcggtcaagtgtccatcgcgggggtagttaaaaggatagcaagttataaacacattcaagaaattgcttaaaatcattctataaaggtttttatagtagaagttttctctacagtttcgagcaatctgtcgtcgagctgtttatgtaactaaccaacgtaaacgcttattttcttaactctactttcc

SEQ ID NO: 20139 - DNA, 96 bp, Gossypium hirsutum
  Clone ID: uC-gsflnu33B132e11b1
tcttttcacacgggcgaaaaagcgaccaatggggggaatattaaaacattaccgtgtaaaatacactttctacaaacctaaaatgaccctcctcaa

SEQ ID NO: 20140 - DNA, 411 bp, Gossypium hirsutum
  Clone ID: uC-gsflnu33B132e12b1
tctttttgactggtgatttcctcactagaaccgcaaatgttttcatggatctaggatattctctcaatccatcaattgatgttggccaggttgaaggagcatttatgcacggtctgggttgggttgccttggaagaacttaagtggggtgatgcagctcataaatggattccacctggctgcttgtatacatgtgggcctggaagttacaaaatcccttcttttaacgatgttccgttcaagtctaatgtttctctattgaagggtaatccaaatgtaaaagccattcactcatcttaagctgttggagagcctccgttttttatggcttcatctgttttcttcgccatcaaagattccattttagctgcccgagctgaaacaggtcatacagggtgggttccggttgatt

SEQ ID NO: 20141 - DNA, 486 bp, Gossypium hirsutum
  Clone ID: uC-gsflnu33B132f02b1
ctatttttgagactcttctatttagcaatggcttcttctctagctcttaagaggctcgtctcatccaacatcctccctagctccttacgcgtcgccatcgttccatccatctccagactctttaacaccaacgccgccacgcctgatgaccacgatgatcgccgtcgtgctgacggtttcttcccagatctgcaggggcggcgccagggggccaaaaaagatatgtttgatcctttgtctccaacaaggagcctgaacatgatggatcaagtcaaggggaatcgatttctctccacatcccgtgacattccagggcttgggagcgaggccaaagaatcaaaccttcgcccgttatctcctcatcttcctatttataagccacaactttctgcgactctttcaattaccaataggatctccggggttttcctaactactgcacttttgttctcttatcttctttctctgaaaatgggttcaatttgc

SEQ ID NO: 20142 - DNA, 67 bp, Gossypium hirsutum
  Clone ID: uC-gsflnu33B132f06b1
tcttctcgtccggctatgaatactatttgaagggggatgatggaatgataagggaagtaacgcacct

SEQ ID NO: 20143 - DNA, 453 bp, Gossypium hirsutum
  Clone ID: uC-gsflnu33B132f08b1
ttctttcacgcgtgcgggccggcggccactgaggagatcgttcagcgttgactagggtatagagccaacctacaccctttatctcttactcgggggagagggaatacgattattttatattttttacaccaacgccgccacgcctgtattcatcttttatctccggtatgctgacggtttcttcccagatctgcaggggcggggccagggggccaaaaaagatatgtttgatcctttgtcctccaacaaggagcctgaacatgatggatcaagtgaaggggaatcgatttctctccacattccgtgacattccagggcttgggagcgaggccaaagaatcaaaccttcgtccggtattttctgatctttctatttataagccacaactttttgggactctttcaattaccaataggatcttcggggttttcctaactactggacttttggtct

SEQ ID NO: 20144 - DNA, 155 bp, Gossypium hirsutum
  Clone ID: uC-gsflnu33B132f11b1
tcgtccacgcgtgcgacctagcgtccaaagaggcggtggttaaaatgtatttatgttatagacacattccaataatatagaggggccatgtggtaaaggaatatatatgaaatcactaataaaatttttctagtaaactgaagataatcttatta

SEQ ID NO: 20145 - DNA, 68 bp, Gossypium hirsutum
  Clone ID: uC-gsflnu33B132g05b1
tctattcgttcggtacgatgaacaattaagagggagttgaaagaagaccatcgtaagaagaaaacctc

SEQ ID NO: 20146 - DNA, 63 bp, Gossypium hirsutum
  Clone ID: uC-gsflnu33B132g06b1
tccttttcgtccggagaggtagacaaacaagggggggatgacacacgttgaacgtgggtagca

SEQ ID NO: 20147 - DNA, 81 bp, Gossypium hirsutum
  Clone ID: uC-gsflnu33B132g07b1
tcgtctacacgtactaagagggggtccgggggggggggggagaggcattacaaccactatacttctcctacctccccctca

SEQ ID NO: 20148 - DNA, 154 bp, Gossypium hirsutum
  Clone ID: uC-gsflnu33B132g11b1
tctgttcacacgtgcgggctactgttcaacctcgcggtggtttgaatgtgattatgttagtggcacaagaaaatcatatttataactcatgccagaatgggggttctattccgtctttttatcatgttaaatacaaaacttgatgctatcttgt

SEQ ID NO: 20149 - DNA, 229 bp, Gossypium hirsutum
  Clone ID: uC-gsflnu33B132h04b1
ttatcatcaaaatgttgtgtatgaatttggtggagatacgacctaccagagctcgggagagaagcgttagtatcgtacaataacaaccatggaaaatgtgtgcacttattttataactctaaaatatggagttatttctagcactttttaccatgtaaactacgtaaattctgggttgttgatgacacgttttggtagtttttatctgtaatataaatttaatattatg

SEQ ID NO: 20150 - DNA, 504 bp, Gossypium hirsutum
  Clone ID: uC-gsflnu33B133a01b1
cggttttgtgggcggacgcgtggggtgataaccactcccgagatcgcggaggtcttgacccgacgaaattacttcaacacctttggtgggaaccctgtatgtacggctgcagggtcagccgttttgaacttaatcgaaaaagaaaagcttgaagacaatgccttcgtcgtaggatcttatttgaaagagagactaattgcactaaaagataaacatgaccttatcggggatgtgagaggacgaggattaatgcttggagtcgaacttgtcaccgatcacgagctcaagacaccggcaaagctagaaacacttcatttattggaccaaatgaaagagatcggtgtattggttgggaaaggtggattttatggcaatgtatttagaattacacctccactttgctttactacggaagatgcagatttttttgtagatgctatggattacaccatgtcaaagatgtaacgcctctattattctttcgtgcaaacgaggttgtagctt

SEQ ID NO: 20151 - DNA, 456 bp, Gossypium hirsutum
  Clone ID: uC-gsflnu33B133a07b1
atgtgtttctctccgtttaaacttagaaacaaaacctctagtagtagtattagaatcatgggtgttgtgagttatgagtttgaggtaacctccccaattgctccagccaggcttttcaaggcttttgttcttgaagctgccaaggtttggcccacggctgcccctcatgcagtcacgagtgttgagctcgaaggtgatgctagacctggaagtattgtaaagatcacctttgttgaaggccttccataccaatatatgaagcaccagattgggggacacgacgaaaacaatttttcatacagttacagtatgattgaaggtggccctttaggggacaagcttgagaaaatcagctatgagaaccagtttgtggcagctgcagatggaggaagcatttgcacgagctcaataaaatattacaccattggcgactatgtaatcaccgaagatgaaatc

SEQ ID NO: 20152 - DNA, 423 bp, Gossypium hirsutum
  Clone ID: uC-gsflnu33B133b06b1
ccggttcccctcgccaaaggtttccgatacggttgtcgagccatacaatgctactctttcggttcatcagcttgttgagaatgctgatgagtgcatggttcttgataatgaggctttatacgatatctgcttcaggactcttaaattgactactcctagctttggtgatttgaaccatttgatctctgcaaccatgagtggagttacttgctgtctaaggttccccggccaactcaactccgacctccgaaagcttgccgtgaacttgattcccttccctcgtcttcactttttcatggtcggatttgctccactgacctcccgcggttcccagcagtaccgagctctaaccgtccctgagttgacacaacaaatgtgggatgcaaagaacatgatgtgtgctgctgacccgaggcacggtcg

SEQ ID NO: 20153 - DNA, 478 bp, Gossypium hirsutum
  Clone ID: uC-gsflnu33B133b07b1
tctcgcgtccggctatccaagctgttctttccttgtatgccagtggccgtacaaccggtattgttctggactctggggatggtgtgagccacacagtccctatctatgaaggctatgctcttacacatgccatcttgcgtctcgacctagctggtcgtgatctcactgatgctctcatgaaaatattaacggagcgtggttattctttcacaactactgctgagcgggaaattgtgatggcccaaaaaggaggagcaatattgaagagaaacaggagatggttactgcaacaaacaaggctggactttatgcgtacgagtgtaaaacctgtaaccggtctttcccatcattccaagctacccaccaccaactctgatgcacccgtcatgctggaccgaatcttgcgttttctggttagctacaaacttctcaatggtttcttgcgtaccttaccttgggggcaagtggaaagactctt

SEQ ID NO: 20154 - DNA, 476 bp, Gossypium hirsutum
  unsure (1)..(476): unsure at all n locations
  Clone ID: uC-gsflnu33B133c01b1
tttttatatcttctttttcattttggggtcttttagggtttcaattggtacatgttgaatgaaggaaagggagatgatgagcatggaattacttgcggaattgagggacgatttcaaggccaagtcttcaacggtaatatcattgcacagcccaagaatggttttgcatacgagccatgggcttaaataattggagcaaattatgtagtctatgatcttggcttcgaggatatattaacctctaggcaagtctaatgcttggcttatcctcctctctctgggttttcttttttttgttggctgttcttgatcgtgtttggttgctgagaatatggaggatatcatatgaataagatttggaatcttgacttcatctaagatttccacgacttttcttctttgaaacactattgnctttttagcaaccgaacaggtttttaaaaaataaaatatttttttttttttatctttacttt

SEQ ID NO: 20155 - DNA, 124 bp, Gossypium hirsutum
  Clone ID: uC-gsflnu33B133c04b1
cccactcgtacgggtaaacgcgccaaaaaaagaagggggggactttaaagagtaactaggtgttagaaaagaaagaccgcaggaagcgacacgagatgagcccgttaagaaagggattccccac

SEQ ID NO: 20156 - DNA, 94 bp, Gossypium hirsutum
  Clone ID: uC-gsflnu33B133c07b1
cctactcgtccggaagaacacgccagcctaagggggctttgacgaaaccgtttgacgctacgagtgataagaaagacggctgaactaagcacgt

SEQ ID NO: 20157 - DNA, 81 bp, Gossypium hirsutum
  Clone ID: uC-gsflnu33B133d10b1
tcctagcgtacgtgaaagcgcgacaactaaggggggcgaggttaaaaacatatgtctgtacaagagcagaaaggcaccgca

SEQ ID NO: 20158 - DNA, 120 bp, Gossypium hirsutum
  Clone ID: uC-gsflnu33B133d11b1
actactcgtccgttatggggcgtcaataatggggggccagtttgacaaaatttacgcgcacaactccagaaaagctgcgcatggtgtctgatccgttctccatgagtagttcaacttcta

SEQ ID NO: 20159 - DNA, 448 bp, Gossypium hirsutum
  unsure (1)..(448): unsure at all n locations
  Clone ID: uC-gsflnu33B133e01b1
cccactcgnccgcccacgcgtccgccacatttcacactctttttcaactttctcttcttctctttgttttaaagaggggctggagttttagccaaagaaaactccatggctaaacttgttgctactttcttcttggctctcattgccatctccatggttcaaactttggttatggcatcacatggacatggtggtcaccattatgataacaaacgttatggacctggaagtctcaagccttaccaatgtccatctcagtgcacaaggaggtgtagccagacacagtaccataaaccatgcatgctcttctgtcagaaatgttgcaggacatgccctttgtgttcctccagcgtattatgggaaccaacaagtttgcccttgtctccacccctggaaaaccctgggaggaggcccaattgcccctaaattctcaaaccagccccctttt

SEQ ID NO: 20160 - DNA, 83 bp, Gossypium hirsutum
  Clone ID: uC-gsflnu33B133e03b1
cccactcgaccgcctacacgcgccacataaagatggcggggtctataaagagtaacttcctgataccaaacaaagacggcagt

SEQ ID NO: 20161 - DNA, 203 bp, Gossypium hirsutum
  Clone ID: uC-gsflnu33B133e04b1
cctactcgtacgtaaaatcgcgccagattatgatggtggggactttaaagagtaacttgaagataataaacaatgaccgcatatagattgatgagagattaacgatatgtaagggattccctaaaaaatatctggggggattattatcaatttgtaagggatagcacgaattggtgccttaaaatgacacaatggtggggacg

SEQ ID NO: 20162 - DNA, 128 bp, Gossypium hirsutum
  Clone ID: uC-gsflnu33B133e06b1
cctactcgtacggaaaaacgtgccagaaaaagaggggggggtttttaaagagtaactttggttttacaaacagagtccgtaattgaaatgatgagacaataccgttggtcatattgctttacaatatt

SEQ ID NO: 20163 - DNA, 198 bp, Gossypium hirsutum
  Clone ID: uC-gsflnu33B133e07b1
tcctcgcagacgatatatctatccaggcctaggggggctattttgaaaaaaaagattttttcagtcacaacaatgactagggataaaacaaggactacgctcgggcctaaagcgggtgttactcaaagaagaaaacgaaaaaaagctgctcttgctaaagctgcatggattatgcaaccttggcacgaacaaccttgt

SEQ ID NO: 20164 - DNA, 422 bp, Gossypium hirsutum
  Clone ID: uC-gsflnu33B133e12b1
actactctgacaaggaggaaggactaatatgaggggttcttttaaaaagctttcaggttacttgcacaaatatatctctctgacaagaggtttgatgaattgaatgcacttatcgtttaacccattgtctgccgctgagatccatttgaaaatgttctggagcctgataccaaagctcaatctattgaacaagagaatggcatcaccgaaactccccaccatgctatggtggctgggacacaacaatgccttgttctgcagtagcatctcattaatagaaccctgtaccttgcatgtactgattacacaaaatcagcattacgctggaagatattatagaatatagatggcacttggccgcctaaataagcaaacttatttttgcactgttgctatcgccttcgcagaaactgctatatgct

SEQ ID NO: 20165 - DNA, 403 bp, Gossypium hirsutum
  Clone ID: uC-gsflnu33B133f01b1
ccctcttgtccgcttgatttgagagcagaaatagaatctagggagaaggctggccgagaggctcatgaggctaagttgagaatggcagcaatggttcaggcagagcaagctcgagctgaatcacaagctcatgctgaactaatggctcgaggacctataagggcaaacgctcttgggtctcaaggaaacaaccttgcaattggtcatgacattcgggagcagcctcagggtgtaaaccctgatgagatgatgaatggatggggtagcagtgcacagagggatgaaaaggaaccatctgaagatttcttgaacgatgaggagactgaaaatggagatacaagtgtgcagaatgactggcgcgaagttggggagtttgatttgaacagtacataagtcatgaagt

SEQ ID NO: 20166 - DNA, 85 bp, Gossypium hirsutum
  Clone ID: uC-gsflnu33B133f07b1
ttctcgcgtaccgaaaggcgtgctatataatgggggtggttttaaacaagtatggcgttttcaaaacaaagaaagacggcagaag

SEQ ID NO: 20167 - DNA, 87 bp, Gossypium hirsutum
  Clone ID: uC-gsflnu33B133g04b1
ccttcttgtacgcataaacgtgctacaatatgaaggtggggactttaaagagtaacttgatgttaaacaacaatgaccgcattagga

SEQ ID NO: 20168 - DNA, 239 bp, Gossypium hirsutum
  Clone ID: uC-gsflnu33B133g10b1
ttctcgcgtacggaaacacgtgccaaaacacggggggagattttaacaaccatgagggttatataacacaacgagaccgcagtagtacagagaagagcataccaatgtcgacacgccacccgaataatgagccggggcgacaaaacttaattgctactggccagaacgatcttgtgaggtcaaacacaccatcgggcaagagctacctgctggccagaatgcactagcgtgggtgcgcg

SEQ ID NO: 20169 - DNA, 497 bp, Gossypium hirsutum
  Clone ID: uC-gsflnu33B133g12b1
cctacgcgttcggcagttcagagattggtgaagtggttccaatgttgaccggagcaacattttgtccacatattggagccattcttgaaaattatcacgaaatcatcccgaataaacacaacattagctgttaatggtttgacgcccttgctaatctcaagattggatcatcaggatgctattgctcgtcttattctacttaaattaattaaggctgtttatgagcaccacccgcgaccaaaacaattaatagtggagaacgatttaccacagaagcttcagaatctaatcgaagaacgcagagatgggcagcgttctggaggccaagtgttagtgaaacaaatggctacatcgttgctcaaagcccttcatgttaacaccgtcatgtaagttatttgtgttcaagttctcctccctgtatgtatatttttgcctcgatagtaaggcgtgattctccctccacctttgattttctcaaattttttgcaccttagttt

SEQ ID NO: 20170 - DNA, 86 bp, Gossypium hirsutum
  Clone ID: uC-gsflnu33B133h01b1
cccatgctgccgcccactcggacggcaactctaaggtgcattcttaaggctatgctggtggcttaaacagcaacacccatgagagc

SEQ ID NO: 20171 - DNA, 334 bp, Gossypium hirsutum
  Clone ID: uC-gsflnu33B133h02b1
cccttgctgtcgcccacgcgtccggcggcgtcaagagggggatctttgtcaaaaccctaacggggaaaaccataacccttgagggcgagtctgctgacaccatcgacaatgtgaaagccatgatccaagacaaggaaggcattcctcccgatcaacaacggcttatatttggcgggaaggagcttgaagacgggcggaccttatccgactacaatatccagaaggaatccactctttaccataggccttcgacttcgaggtggtgcctagaagaggaagaagaagacctacaccaagcccaagaagagcaagcacaagaagaagaaggtcaagc

SEQ ID NO: 20172 - DNA, 327 bp, Gossypium hirsutum
  Clone ID: uC-gsflnu33B133h08b1
tcatgcgtccgctactttcagtgaatacactgttgtccatgttggccaggttggcaaggtcaatcctgaggcttcggttggataaagttgtgttctaagctgcggaatgtccacagggtttggtgccaactgtgaatgtagctaaacccaaaaagggtcaatccggtgcaatatttgggattaggggttgcggtcttggtggtggtgaaggaaccaggagtttttggggtttcaggatcattggtggcgatttggaccctataagatttgaactagccaagaactttggggtgtccgagtttgtgaatcccaaagattacaacaaac

SEQ ID NO: 20173 - DNA, 489 bp, Gossypium hirsutum
  unsure (1)..(489): unsure at all n locations
  Clone ID: uC-gsflnu33B133h09b1
atttaagcacgggagatcaatctcattcgatgagtggaaatggtgcgtaagctttattttcatcatcggaatttgaaaactggtattatgatttagtgctaggggctcggagttcaagtaattatggatgcctttgtttgacctggcccgaacatttatggactgctatacaggtgccttggcatttgacgttgagtattcacggtggctagaggagcacaataagcatataaacgagttgagggctgcagtcaattcacatgctggtgacgccgaacttcgcactattgtcgacagcgtcacagctcattttgatgacattttccgtttgaaaggtattgctgcaaaagctgatgttttccatatcttatcgngaatgtggaaaacaccagcagagcggtgttttttgtgataggtggcttccgtccatcgagcttctaagcttcttgaagtcagttggagccttaactgagcaacagttatgggatt

SEQ ID NO: 20174 - DNA, 540 bp, Gossypium hirsutum
  unsure (1)..(540): unsure at all n locations
  Clone ID: uC-gsflnu33B133h11b1
tttttaccctgctatatatatccttcatatgtagagatattttccattttttcttcatatttagcgatcaaaatttgcttacttttccatatccaaacatttacatcacattagcaaacttatagctaaaatttcaaaccctactttgcatcccttcttaagaaaataaaaaagcaaaatgttttaattttgtttttaagtacataatctctgacaattgtgctatagtttagttacgtaatataacataattaaataattgctttcctttttaaagaacttgattcaaagggatcaaattaggattttttttctattttctttttttaaatttctattgctattgttgntaatttggagaaatggagaagaaaaaggtggctttaccgttagtgtgccatgggcattcaaggccggtagttgatttgttctacagccccattacccctgatgggtattttcttatcagtgccaagtaagactccactccaatggttagaaatggcgagacttgagaatgaatggcacatttgagggcat

SEQ ID NO: 20175 - DNA, 449 bp, Gossypium hirsutum
  Clone ID: uC-gsflnu33B134a11b1
tcctacgcgtccgcccacgcgtccgaccacgcgtccggcaacatgtatttcatgggttcagatttggagagaaatcccaagcgagcttacttgccgatcagattgtcagtgttaattccaaattgcttcagcaggcattggagaatgttgagatagcttcaaagagatggactataactgaatcactcgctggaactaagctggtgagaaatagattgaggatatcagaaaaatgctttactccatcaacaagtgaggagaagctgggaacaaatttcactttgcaagaaaaggcacttcagcttatttctaagggcaaagttgcagttgttttagatatgagtgaccataagaaccggggaaaagaatatgacctcagtctctcttcctcaacaagcagggagaattttgaaacatcctcccttaaatgttgctttgtgacgacgaga

SEQ ID NO: 20176 - DNA, 481 bp, Gossypium hirsutum
  Clone ID: uC-gsflnu33B134a12b1
ttctacgcgtccgattctacacctcaaacatgcctatcatcctgcagtctgcacttgtttcaaatctttatttcatctcccagttgctgtacaggaagtacagtggtaacttctttgtgaatctgttgggtaaatggaaggaatctgaatattcaggtggtcaattcattcctgtgggaggtttagcatactatgttactgcacctgcaagcttagcggacatggcagcaaatcccttccatgctctattttatcttgtgttcatgctttcagcatgtgccttgttttcaaaaacttggattgaagtttctggttcttctgccaaagatgtggctaagcagctcaaggaacaacaaatggtgatgcctggacatagagattcaaatctacagaaggaactgaatcgctacattccaactgcagctgcgtttggaggaatgtgcattggtgcattaactgtcctagccgacttcatgggagc

SEQ ID NO: 20177 - DNA, 137 bp, Gossypium hirsutum
  Clone ID: uC-gsflnu33B134b05b1
ttgtttccccttattttaactgaatatctcatttccagattgaaacactcctttgctatataaatatgcaatttgcctgcgattcaataaaaaagacaaaataaaaagacaaaaaaaaaaacagggcggctacttta

SEQ ID NO: 20178 - DNA, 446 bp, Gossypium hirsutum
  unsure (1)..(446): unsure at all n locations
  Clone ID: uC-gsflnu33B134b10b1
tcggttattgctatctttttgttccttttccaagggtgagtgtgatctgttcttattcactccatttctttaacccatggctctttccgtcgagaaaaccgccgccggccgtgagtacaaggtcaaggacatgtctcaggctgacttcggtcgtctcgagatcgagttggccgaggtcgaaatgcccggtctcatggcttgccgagccgagttcggccctgcccaacctttcaagggagccaaaatcaccggttctcttcacatgaccatccagaccgccgtcctcatcgaaaccctcaccgccctcggagctgaagtccggtggtgctcttgcaatatcttctctacccaagaccatgccgccgccgccattgcccgtgactcggcagncgtgttcgcctggaaaggtgagaccctncaggaatactggtggtgtaccgagagag

SEQ ID NO: 20179 - DNA, 189 bp, Gossypium hirsutum
  Clone ID: uC-gsflnu33B134c03b1
ccttcttgtccgcccacccatgcggccctctgtgcggaattgaaacttataactgcaagcaatctgccaacttaaatatgccggtcccgtaaggagatatggccaggacatgacgtcgcaacgagcattcttgtgcacgagccgatcatcgacgatttgccgtcatgtcagagctagagcaacggtcat

SEQ ID NO: 20180 - DNA, 198 bp, Gossypium hirsutum
  Clone ID: uC-gsflnu33B134c04b1
cctatttttccgtccacgcatgcggtattctgtgcgggattgaaacctaataccgccagccatctcgcaacttcactatgccggtcgcggaaggagatatggcacggacaagcgccgcaatgatcattcttgtgcacaaagcgaacatcgccgagttggcgcaatggaagagtaagagtaacggtaatcaaggggtat

SEQ ID NO: 20181 - DNA, 240 bp, Gossypium hirsutum
  Clone ID: uC-gsflnu33B134c06b1
cctaatcgtccgtccacgcatgcggtattctgggcggaattgaaacctattatcgccagccatatgccaacttaactattccggtcgcggaatgagatatgactcgaacaagcgcagcaatgatgattcttgtgcacgagccgatcatcgacgagttggcgtcattgcaagagttgagtaacggtaatcaagagggttaggagattgtctcatggatccttgatcaaactgctaacgtga

SEQ ID NO: 20182 - DNA, 185 bp, Gossypium hirsutum
  Clone ID: uC-gsflnu33B134c07b1
ttcctacgcgtccgtccacccatgcggcaccgtgggcggaaattaaacctagtactgcaaaccatctgccaactcaaatatgtcggtcgagtaatgagatatggcacgaacaagcgtcgcaatgaggcagcttgtgcacaaaacgatcaacgccgatttggcgtcatggaagagtctgagcaacg

SEQ ID NO: 20183 - DNA, 364 bp, Gossypium hirsutum
  Clone ID: uC-gsflnu33B134c12b1
tataactccaaagaaaataattgaaagatggtttgtatagcttgcctgttgccgctcttcctcgtcccgatcgtcaacattttgcctcttcttttcgatttcgtcatgggtaaaatttacaggcttcttggatgggaataccgtaaaccagagagagcaccgccggcgtgtccgtataaaccggctgccaaactggaaaacaatagtaaagtgaccccagaaacagaaccaggtgcaccagagtctagttcgaaacccgttggtatgaccaatggcaagcaagattgatactgaaagcttttccatggtactaaaatcagacataaacctttttgaagatgtacttcttaaggttgttaatggg

SEQ ID NO: 20184 - DNA, 117 bp, Gossypium hirsutum
  Clone ID: uC-gsflnu33B134d03b1
cccgcgcccccaaaattccgggggacacaccacgcgcccgcaatcgttttcgcccacaagtggggttatctgcgggaaaattaaagttaaaatcgcaaaaaaattgccaaattaaat

SEQ ID NO: 20185 - DNA, 195 bp, Gossypium hirsutum
  Clone ID: uC-gsflnu33B134d08b1
cctactcgtccgcccacgcaggcgggactaagggcggaattgaaacgtaaaaccgcaaatgcacaggcaagtaaaaaatgccgggcgaggaagaaggtaagggtagaacatgatgtctgagtgtggattctggagcacgaacccatcaacggcgagttggcgtaatgacagagtcagagcaacgggaattaagcg

SEQ ID NO: 20186 - DNA, 218 bp, Gossypium hirsutum
  Clone ID: uC-gsflnu33B134d09b1
tcctactcgtccgcccacgcatgcgacactggggggcgtatttaaaccaaatggccccaaccctcacccaagcttacttttcaggtcccggaatgagacaagtgcaggtcatgcccccaaacgatgcatcctgagtacaaccaaatcaatgccaatttggcgccatcgcagagctagactaacggacaaccacagcacttgaccgtggccacaaagag

SEQ ID NO: 20187 - DNA, 312 bp, Gossypium hirsutum
  Clone ID: uC-gsflnu33B134d12b1
tgcttttccttccaattatacccaccacaaccatgggttccttacctcaaaccttggtgctcaagagagcacgccgcgaattcaaggctcacaagatctctgaggacgattacatgaaacccattagggaggaaattaagaaggttggtgaccttcacgaaaagcttgtcattgcagtatcggctcatggagagtctgtgtgaaacggtacggctgggtaccatgggggagccgttgcctacacatgcattcactgtatatggatggaagcaaacctacggatctcggtgtgtcaagccaccgaatatatac

SEQ ID NO: 20188 - DNA, 203 bp, Gossypium hirsutum
  Clone ID: uC-gsflnu33B134e01b1
ccttcgctttcgcccacgcatgcggtattgtgggcggaattgaaaggtaaaaccggaaaccatatggcaagttaactatgccgggcgaggaagtagatatgaaaagaacacgcgtcgcaatgatgattctggtgtacgaaccgaactacgccgagttggcgcaattgaagagtaagatcaacggtaatcaaggggtacggaga

SEQ ID NO: 20189 - DNA, 391 bp, Gossypium hirsutum
  Clone ID: uC-gsflnu33B134e11b1
cttaggatgaagaaaagattatatataaaagcacgtccataattgtaacgtaaatcctggagtcaactccaggattgaatttattatactacaatcattgtgtcacagggattgttattgggaattggtgctaaaaacaaattacattactatattattggagaattatacatggaggaatgctactatatgtatttaatcaaggagaagatttcgatgggggcacacctgggaaggggggtacaggaaggaaaggggattgtggggaagtggaaatgggaagtttggtggtggagatttgtgttatttgttgaggtattttattttttatattttattaatgatgttatataattttaataaatattattgttattttttttttatttat

SEQ ID NO: 20190 - DNA, 204 bp, Gossypium hirsutum
  Clone ID: uC-gsflnu33B134f02b1
ctaatccttccgccgacccttgcggtcttctgggcggaaatgaaacttataattgcaagcgaattgccaacttaactattccggtcccgtaagtagatatggctcgcacacgcgtcgcaatgagcattcttgtgtacgagtcgatcttcgccgagttgccgtaatggcagagtaagatcaacggtaatccaggggtataggagg

SEQ ID NO: 20191 - DNA, 205 bp, Gossypium hirsutum
  Clone ID: uC-gsflnu33B134f04b1
ctctcgtgtccgtccacatgtgcgtccttctgtgggaaatttaaacttaatattgcaaaccatttcccaacttaaatatgcaggtccagtaaggagatatggcccgaacatgcgtcccaatgagcatgcttgtgcacgaaccgatcaacgacgagttgccgcaattgatgagtaagagcaacggtaatccaggggtatagagatg

SEQ ID NO: 20192 - DNA, 203 bp, Gossypium hirsutum
  Clone ID: uC-gsflnu33B134f06b1
ctaatgcttccgcccacccatgcggcactctgtgcggaaatgaaacgtaaaattgcaaacaatttgccaactcaactatgccggtcgagaaaggagatatggcctggacaggcgtcgaaacgagcatgctggtgcacgaaacgatgaacgccgagttggcgcaatggatgaggaagagtaacggtaatgcaggggaatagaca

SEQ ID NO: 20193 - DNA, 224 bp, Gossypium hirsutum
  Clone ID: uC-gsflnu33B134f09b1
tttgctacgcgtccgatgacgcttacggtactaagtatcaaaataaaaaaaacagttccagacactctgccaggaacacttggcagatcgaatgacggcaaatgataaggatgtgcataacagggatggatatgtggtacaagtatgcgaacaaagatccgatgtacctgcccagtcagatcaggtcagtctgtcttgccagtatgctgacgatggaaggaaag

SEQ ID NO: 20194 - DNA, 302 bp, Gossypium hirsutum
  Clone ID: uC-gsflnu33B134f11b1
cctactcgtccgaaaaaatggattctagccggtaggattaggagatcaacagtgatagactctttggtattgactcttgtgagactgatcttcatgaacctacagttgtcagccgcagttaaatgaattttactgacaactactagaaaaaagacagtatttacggtgccagaaagataaggacagactgactggacggacagctgacgaagggatgatagttccaactctacaacagagatggaaaggctcacgtggtacaatccattcttaaagcagaatatactgccacttggaccttt

SEQ ID NO: 20195 - DNA, 313 bp, Gossypium hirsutum
  Clone ID: uC-gsflnu33B134f12b1
tcctacgcgtccgcggacgcgtgggaaattttctcggaaaagaaaaaaaaatgaggaagtgtgaactatgtggaaggctagctcgaatgcactgtgaatcagatcaagcaaatttatgttgggactgtgatttcaaggttcatggagccaatttcctcgtagctaagcataatcgaaccctcctttgccatgtttgtcaaagtcctactccttggctcgcatctggtcggaatctcggtctcgcggtttctgtttgtgattcatgcgttgtaaacggcaacaataagtgtgagtcatcggagagagagtatgg

SEQ ID NO: 20196 - DNA, 294 bp, Gossypium hirsutum
  unsure (1)..(294): unsure at all n locations
  Clone ID: uC-gsflnu33B134g03b1
ccaactcgntcgtctacccttgcggacgtatttccgggaaacgaacgtgcatttgctagtgaaaaccctaatgaactgttcatgtccagttcgtcgcaatgaaccttatgtgtgtcaaggagatggtgctgttgcatgcaaggatctagccgaggaagccgtacttgccgattcagagttacgttaccgacgggaacatgggatttgctgaatgcggctccagaggaagtcgaaaggatgcgaatgagcgaagaattatacgggggactgaacaacagatgcctattacgttct

SEQ ID NO: 20197 - DNA, 208 bp, Gossypium hirsutum
  Clone ID: uC-gsflnu33B134g04b1
gtccgccttgtcttccgcccacccatgcggccccctgtgcggaaaagaaacttaaaactgccagccaatacccaactccactatgcaggtccaggaaggagaaaaggcccgaacaagcgccgcaacgagcatgctggtgcacgaaacgaacaacgccgatttgccgcaattgcagagccagagcaacggtaatccagcggataagaca

SEQ ID NO: 20198 - DNA, 483 bp, Gossypium hirsutum
  unsure (1)..(483): unsure at all n locations
  Clone ID: uC-gsflnu33B134g11b1
tttttctctactctttacgttcctctcttattttatatatccatacaagcattagtcgttttcttcaacctaaatatcctacaataaatctatgtcttaacttgtttagacccaaatccaattcaaacccttccaagatttgcttccttcttaacctacttagctagccattggtttatataaatacacacaccggcagaaaaacactcattcgtgtgaaaagttaacacaaaatgggggtnggaaggcaccttggagtacatctccgatttgcttagcagcatgaagaagaaaaagaagaagaagcaaactcaaactgtagctctcaaaatcaggatggattgtgaaggttgtgcccgtaaggtcaagaaagttctctccggagttaagggggctaagtctggggacgtggacttgaagcagcaaaaggcgacggtgacgggtaacgtagagcccaagaaagtactggcggcagcccagacg

SEQ ID NO: 20199 - DNA, 182 bp, Gossypium hirsutum
  Clone ID: uC-gsflnu33B134h05b1
cctactcgttcgcccacacaggcgggatcatgtggggaatttttatttaataatggacgacaattgccaagataaatatgccggtcgggaactgggataagtgccggacatgcgccccaatgatgcttctgatgcaagaaaagatctacgacgaattggggacatgaaagaggcagagtaac

SEQ ID NO: 20200 - DNA, 253 bp, Gossypium hirsutum
  Clone ID: uC-gsflnu33B134h09b1
ttttataaaaaaatggatattaatcaaactgatcttcatcaccctcaactataacattgattaaaaaaaaagggaggacgatgggggggctccataatttggtcccgggggccttccccttacaggctccaactttagctgtcactgtaattgcaactcaattgccttttttttggcggacccctaaattcggtaaaccggggggaaacccaactgattcggattggaaaacccttgccttaccccacctttt

SEQ ID NO: 20201 - DNA, 515 bp, Gossypium hirsutum
  Clone ID: uC-gsflnu33B134h10b1
tatttgtatcgtcacggtgaaatctccgcccttcaagtcttcacagctaaaagatgccggccggagaactccggtatccttcttcgatctcttgtccgcagatttctcaagcaacggaaacccccatggaggaagacgaggcgtgggtgtgggcgcagattaaagccgaggcacgccgcgacgccgagttggaaccggctctagctagctacctctactccacgatcctatctcactcctctctcgagcgctccctcgccttccacctcggcaacaagctctgctcctccacgctcctctctacgcttctctacgaccttttcctcaacactttctcttccgatccttcgcttcgagccgccgccgtcgccgatctccgtgcgggtcgcgttcgggatcccgcttgcgtttccttctctcattgcctacttaattataaaggattcttggcatgccaggctcatcgagttgcacacaagttatggactcagtcacgtaggccgctagcattggca

SEQ ID NO: 20202 - DNA, 343 bp, Gossypium hirsutum
  Clone ID: uC-gsflnu33B134h11b1
tgctggcagccccttccagatgatgatgatgatgcatttgtatagagaggggtttgagttgccagagagccatcaacaatttctgctgctttttcattttcactcccgtctgaatgtgtgctctcattttcgtatttaaattgcaagtagggaggagtgacggaggatgaatttgtagtgtaggattttacgaatctaattgatgtaattgccgatactccacgatcctatctcactcctcctattgagcgctccctcttcttccacctttgcaccaagactctgattctacacgctcctctctaccacttcttaccaccttttccttaaaactttttttttc

SEQ ID NO: 20203 - DNA, 361 bp, Gossypium hirsutum
  Clone ID: uC-gsflnu33B135a05b1
tcgcttacgcgtccgcccacgcgtccgatatttaggtgttcctgcagagtgaggaagctcccctgaaagcttcaattgaaaatgcctaagcaaattcatgagatcaaggacttgcttctcactgctagaaggaaagatgctcgctctgtaaaaatcaagaaaagcagagatgttgtcaagttcaaggtccgctgctgcaagcactagtacaccctttgcgtgtctgatgcttagaaggctgacaagttgaagcagactctttctacaggtttgagcgatcaagacctgtgaaattgaaactgcccttagcttgtactaggcaaggaaaactagagtttgacttttagcttattgtttgcat

SEQ ID NO: 20204 - DNA, 349 bp, Gossypium hirsutum
  Clone ID: uC-gsflnu33B135a12b1
tttttctttcctcctagccaaaaaaaaaaaaaaaaaagcctctttcctgtctctcgttctttttcctgttcaatcatgtcttgcttcattagcaaatatgctgatgagttggctaaaaacgctgcttacattggaacccctggaaagggtatccttgctgctgatgaatccactggcaccatcggcaagcgtctttcaagtattaatgtagagaatgttgaagacaacaggcgtgctctccgtgagctcctattcacaactcctggagctcttcagcacctcagtggtgttattctctttgaggaaaccctttatcaaaaaaccgcttcgggcaagcccttcgttgatg

SEQ ID NO: 20205 - DNA, 446 bp, Gossypium hirsutum
  Clone ID: uC-gsflnu33B135b01b1
gatatattatattagcctggattttgagtctcagcaccgccatggcagtagctcgttgccaagattattactcccatggcggaccatacgttccacctccacaaaaagtaacctatctccacttctttttacacgacactgagagcggcaacaaccctagcgcagtcaccatagtcagtccaaacaccaccacctcgacgggcttcggcggcgtgatagctttcgatgatccactcactgttggccccgacataacatcagaggtcatagggaacgctcaaggcctctgggtgtcgacaggcaaagacgttttaactctgatggcctacttggacatcgggtttacgaaaggtgaattcaacggcagctctatcacgtgttttgtcgaggaatccaattaccgaatcggagcgtgagcttgccgtggtcggagggaagggaaagtt

SEQ ID NO: 20206 - DNA, 508 bp, Gossypium hirsutum
  Clone ID: uC-gsflnu33B135b09b1
tcggttggtgccatgcttccctactggttctctgcaatgaccatgaaaagcgtgggaagtgcagctttaaagatggttgaggaggttcgcaggcagttcaacaccatccctggtctcatggagggtcgtgccaagcctgattatgctacctgtgtcaaaatctcaactgatgcctctatcaaggagatgattcctcctggtgcccttgttatgcttactcccctaattgttggaactttctttggtgttgagactcttgccggtgtccttgctggtgcccttgtttctggtgttcagattgcaatatctgcttccaacactggtggtgcatgggataatgccaagaagtacattgaggctggtgcctcagagcacgcgaggaccctgggtccaaaaggattcggatcctcacaaggcagctgtcattggtgacacggtcggggatccactccaggatacctctggccctcactcacatcctgaccagcttatgcagccgagcactcgt

SEQ ID NO: 20207 - DNA, 288 bp, Gossypium hirsutum
  Clone ID: uC-gsflnu33B135b11b1
aatgcttttaacatagcccataggcataaaattaatgggatgaacctgatctgaagcttcttcagagggttctttataatactgcaagaggatccgtaagagagcacgaagggcctgctaggagaagatactgactacttatggagcaaggagagcagcgaagatccatgggatgtggcaatatatgagatacatatattcttgggatagtgaggtcaatcttgcagcataaatcaaatgcccatgattaggtgacagtttaggaactgaagagactatataatgcta

SEQ ID NO: 20208 - DNA, 181 bp, Gossypium hirsutum
  Clone ID: uC-gsflnu33B135c01b1
aataattatttaaaaaaaaaaaaaaaaaaaaaggggggaaaaaaaaaaaaaaaaggggagggggaaacacaaaaaaaaaggccggtcgccaaaagggcccaggggcgggacgccctaagggacccggcctctgcttccggggcccgggccttaaatattctttcgttgggggtgcgtaacc

SEQ ID NO: 20209 - DNA, 382 bp, Gossypium hirsutum
  Clone ID: uC-gsflnu33B135c09b1
ttgcctgcttcatttttggaaggaaattctggactctgcggccctggattgccaaatccttgctccgatgaacacccgaaacatcattcttctggtttgacaaccttgacatgtgccctcatatctatagcttttgccatggcaatggtgattgttgctgctggcgtgtttgtgtttcatagattttccaagaggaagtctcagccaggcgtttggagatcagtcttcttctaccctcttagactcaccgagcatgatttagtaatggggatggactgagaaaagcgcttctaggaaatggcttctccttctcttcggcctctttatttatgctctctctttttccctttacttactttttactaaatttttcatttatttt

SEQ ID NO: 20210 - DNA, 236 bp, Gossypium hirsutum
  Clone ID: uC-gsflnu33B135c10b1
cctacgatatcggaaacgcaagcggaatcgagggccaggccacaatgcaagcacagaacagcgacaaccactcaatcactgctgccgcagaacagtgaaccaaccgacctggcaccccagagaacatggctgccagagctgggacagatactcccatcgaaagtcataagagattacgtcgcccttcattcacaaggagcataggaatacgacccgcatcgaagactacacgaaac

SEQ ID NO: 20211 - DNA, 135 bp, Gossypium hirsutum
  Clone ID: uC-gsflnu33B135d08b1
tcgaatctcgtccggccacgcgtgcggttgcactggtcgttattacagagcaatcgagagctggatcaagggacaaacgtaagcgtgcgaagatgacgggcagaagaggaacagaacgaatagtgctatacctgg

SEQ ID NO: 20212 - DNA, 208 bp, Gossypium hirsutum
  Clone ID: uC-gsflnu33B135d11b1
cctatgtttttggtaaaacgtgcagtttaatttgtgttgcttaaagattagttgatagcggtagataggagtaaaggtataatttggatgaagaaggttatagatggtactagtatgtaatttgttatagcttcgctaggtaggaaaggatcttatatgtaaggtcttgagaggttaattagcttttgatgtatagggtgtttaatga

SEQ ID NO: 20213 - DNA, 93 bp, Gossypium hirsutum
  Clone ID: uC-gsflnu33B135d12b1
cctattttttcggccacgcgtgcactttactttgtcgggcttacagataagccgatagcgggaacaaggggaaaagcgatgctttcgttgaac

SEQ ID NO: 20214 - DNA, 145 bp, Gossypium hirsutum
  Clone ID: uC-gsflnu33B135e02b1
cctatgttatcggccacgcgtgcagttgaagttgtcaaacttaaaggtaggttgatagctgctacaatcactttaaccaaaaattggctagagaacgttatgggtgtatctgaatgccaattttcactgcttgcttaaccagaca

SEQ ID NO: 20215 - DNA, 129 bp, Gossypium hirsutum
  Clone ID: uC-gsflnu33B135e03b1
cctacgtgtacggccacgcgtccagtttaatttgtctagcttataggtaagctgatagctgcagctatcactaaaaccaaaaattcgctgaacattgttataggggtaacggcatgtcattttttactg

SEQ ID NO: 20216 - DNA, 286 bp, Gossypium hirsutum
  Clone ID: uC-gsflnu33B135e08b1
tcgcatattcgtacggtcacacgtccactttattttttcaagctgaaaaggcgaccgaggcttgaatttagcgacaaaagcatgctgtcgctgttgacgggttgcggtggaacagcacggaatatgcagcagttgcctttggcaggcatctatctcagtggtcagatcttgacaggatactgatctcctgagggataagcagcttacagctggcggggactcgatgatataagtgaattacggcctgaagtcggcgacttcacgaagctcctggacttagttttct

SEQ ID NO: 20217 - DNA, 90 bp, Gossypium hirsutum
  Clone ID: uC-gsflnu33B135f05b1
cctatttgtccggccacgcgtccagttgacttggtggggcttattggtaggccgatagctgcagcaaggaccacacgcaggcgttggctg

SEQ ID NO: 20218 - DNA, 91 bp, Gossypium hirsutum
  Clone ID: uC-gsflnu33B135f06b1
cctatttttccggccacgcgtccagtagacctggcggggctaaaagggaggccgagagcggcagcaagcaccgaacccagacattcgctga

SEQ ID NO: 20219 - DNA, 140 bp, Gossypium hirsutum
  Clone ID: uC-gsflnu33B135f09b1
atcgccctaacagatcccagaatatgtccactgtatgtttgacattgaaagctgatattctgctgctgccaatgccctgcagcttgtccatcctgcttatgcttggatctgagcctcgcctgagggacatttccttctga

SEQ ID NO: 20220 - DNA, 106 bp, Gossypium hirsutum
  Clone ID: uC-gsflnu33B135g05b1
cctatttttccgtccacgcgtccagttgacctggcggggcttaatggtaggccgatagcggcagcaagcactacaaggatactttggctgaagatggttatgaggg

SEQ ID NO: 20221 - DNA, 406 bp, Gossypium hirsutum
  Clone ID: uC-gsflnu33B135g08b1
tcgaaatcactcccatattaaacattgttggtgaaacaatgacgtcttcagctctgacaggtaagcttgaggcagatgtagagattaaggcttctcctgagcagttccatgaaatgtttgcccacaaaccgcaccatgtgcaccatacttgctatgacaagattcaaggatgcgatttacatgaaggtgaatgggggaaagtcggtaccattgtccattggagttatgtgcatgatggaaaggctaaaaaggcaaaggaagtagtggaagcagtagaccctgataagaatttggtcactctcagagtgatcgaaggagatctaatggaagagtataagagctttgtaatcacgattcaagtttcgcccaagagccagggtagtggcagcgtaatgcactggacttg

SEQ ID NO: 20222 - DNA, 473 bp, Gossypium hirsutum
  Clone ID: uC-gsflnu33B135g09b1
tcgtgttgatatcccaccaagtgccattgctttcaatccttccactggtgctggcaccattattgattctggtaccgtcttcacccggctagttgagccagcctatgtagctgtccgggacgcattccggagacgagtaagggtggcgaacgtgacatctctgggtgggttcgacacatgttactcggtcccaatcaatgcaccgaccataacatttatgttttcgggcatgaacgtgacactgccacaagagaacctactgctccacagcacagcaggcagcatcacatgtcttgcgatggcatcggcaccagcgctgaatgtgatcgccaatatgcagcagcagaaccatagggtggttttcgatgtgccaaattcgaggatgggggtcgcccgtgagcgatgttcgaaaaagtgtggggtctttttcttctacttttgggaacagtgttggtgtgataaaagcagatata

SEQ ID NO: 20223 - DNA, 393 bp, Gossypium hirsutum
  Clone ID: uC-gsflnu33B135g10b1
ttgattggttattactggtgctacaaaggaatctcagattcaagagaacatgaaggcacttgatgtaatcgcattgctgactcctgctgtcatggagaagattgagacagtttttcaaagcaagccaaagcgtccagattcttacaggtagacgcgggatactgttgcttccttagcatgtcattggcatagcagtgttttggagcagatgtgtgagcttcaatttgtgtatttgttctggtgttttatagtactttgcaacttttaattgtatttggcacccttattattgtggaaagaagacttgggagatgaaatgaatttgtaactggttgtgatgttgtgggatttgtgaaccgtacgtacaactctaatttatttaatctcttttct

SEQ ID NO: 20224 - DNA, 383 bp, Gossypium hirsutum
  unsure (1)..(383): unsure at all n locations
  Clone ID: uC-gsflnu33B135g11b1
ttgcgtaaaagcccttgtcgctttttaccagaagtacgttgatgagcagagcaagaaggagattaaggatattttggtcgggtacgataggactttgctggtcgctgatcccaggaggtgcgagcctaagaagtttggtggaagaggtgccagggcaaggttccagaagagttaccgttgaagaactgtcatggttcgttttgatgttgttcttagtgaaatgatatggttatgcttgttttgaattaaggttttattatatggatttaaattagctgtgactgagtttctgaatttttggatgtttgttttggttgcttaaatttatagataaatgcttaagactgttattgccttttttattngccaaaaaacnacaccac

SEQ ID NO: 20225 - DNA, 136 bp, Gossypium hirsutum
  Clone ID: uC-gsflnu33B135h06b1
cttatttttccggccacgcgtccagttgatttggtcaagcttattggtaggctgagagctgcacataggactgcatgcatgcattggctgaagattgttacgggggtaatagaatgtaattggtgacggctgcctt

SEQ ID NO: 20226 - DNA, 212 bp, Gossypium hirsutum
  Clone ID: uC-gsflnu33B136a02b1
tcggacgcgtgggcaactttgaagcaatgagtagttgaaatatacagggggcggaaagtcatgctccaagcattggctacgtgggaggtttaggtatgttggaatgcaaagtagcagattcacgcttgtacctctcggacgggcatagcataattatgataggtcttctgccacgctgtcaggtataggatgggctgatataagagctataa

SEQ ID NO: 20227 - DNA, 506 bp, Gossypium hirsutum
  Clone ID: uC-gsflnu33B136b07b1
tttctctcttgctaatattgctacttggagtggtggctctcgccactccctcttttggtacctatgagtctcccaactatgggaagccccctactcctgtttataaacctcctaaggtgaaacccccaccttatgaacatcctgtttataaacctcctaaggtgaaacccccaccttatgaacataagccccctgtctatgaaccaccaaagaaggaaaagcctgagcctaagccaccagtttatacacctccaaagaaagagaagcctgaacccaaaccaccagtatatgaacctccaaagaaggaaaagcctgagcctaagccaccagtttatacaccaccaaagaaagagaagcctgagcccaaaccaccagtatatgaacccccaaagaaggaaaagcctgaacctaagccaccagtttatacaccaccaaagaaagagaagcctgagcccaaaccaccagtgtatggaccaccaaagaaggagaagccacccgcttataag

SEQ ID NO: 20228 - DNA, 314 bp, Gossypium hirsutum
  Clone ID: uC-gsflnu33B136b11b1
cggtccgggatttccggggcggcccaagttgtcttctttaggaaagggggagacctcccgggaggttcccattttgcccgcgggggaaaccgaccaccctctttttttaaagggtaaccgaaaaaaaccacaccggccttaatcccacagccacgggatcggtaataacctttctttcccaagctaaggctgatggcactagaggctcatctcttatgacccaggcccaacgaaggggctcctacaacgtctccctatctaacatgggctcaagccgactgatctgagcaaggcgccctggaacggctacacca

SEQ ID NO: 20229 - DNA, 405 bp, Gossypium hirsutum
  Clone ID: uC-gsflnu33B136c09b1
ttggcttcctcaacagcccctcagcctcaatcaccacatcctcctactagaacagtagtttctcaaggatcttctaattgttcctttgcttttcggatgattcaatccaatcatcaggcggaggtttcaatttgtagctacttatgtggtgcataatttgttcatagtcagtccatagaagaaactttgggaagtgttaaatggtctgagttgtaattgatgctatacttaataattacttagatttcacttaagtgtaaagtaaaaagagagaagaggaatatgttgggagtagagatgagaattgagagaatgagtgcaagcaggtagaagccgaaacaatgattgttagcactggagttatgtaattagaagttattgcaaggaataagattctctgtttct

SEQ ID NO: 20230 - DNA, 259 bp, Gossypium hirsutum
  Clone ID: uC-gsflnu33B136c11b1
tccctttcagtatggtggagctctaacggatctttggagctttggggacttccctgccgtggctggtggtcatttctgagaacattttctcttactagtttttgtaaataaggcatgttagccggttttatcaattgtgttgatctctaacaacttttcatttttctggacaaattttcagtaatttaaacaaaaaaatacattgaataagaaaataaaaaaaaaaaaaaaaatgctgacaaattgaaaggaatagaat

SEQ ID NO: 20231 - DNA, 299 bp, Gossypium hirsutum
  Clone ID: uC-gsflnu33B136d07b1
tgtaagctcgtgccttcacgtcacaaccggcgcttacatctactcattgatctttgcagctgctccatctttggcttctgtctacaatgagtatgctcttaagagtcagtatgagacaagcatttatctccagaacttatttttatatggttatggtgctatacttaactttctggcattaactggggacaactgttgtcaaaggtcctagtagctttgatatcctacaaggacattccaaaagccaccatgtttcttatatgttacaatgcagcacagggaattttatcctctttttt

SEQ ID NO: 20232 - DNA, 430 bp, Gossypium hirsutum
  unsure (1)..(430): unsure at all n locations
  Clone ID: uC-gsflnu33B136d10b1
cccggcctccttgggaccggaaaacggcccgcaaaacacccgcaaagaaaacccgcgcggngggccccggcgcaacacggggggcagcccagacaggcgccaaaacacgcaccgacaaccgctaagncggcccaaaaggaggaagaaagcaacgaggggagcaatgcagaggntcatacagacaacactggacaaaggaggggaccagggaagctcccagaaacgggctgctactcccagggcgggaacccagtaaagcacggaatgaaaattgcagcggcaatcaaaacggcattaagaacgggagcatgaacgggggcgaacacgattgacaccaacagagcacctgactgtaccagaacatttgagccatcacactggagagaaaactgccgtgagaaatgccatgtgacccacaacccaacgcaag

SEQ ID NO: 20233 - DNA, 350 bp, Gossypium hirsutum
  Clone ID: uC-gsflnu33B136e01b1
ccgcctcccgggcccggtccggacctcccgggccgacccgccccacccgtccgtcgtggactgaatctagggacttgcgggtggagatgtcgagagctcatctctctgcttcaaagctcctgtccaggtagaattctcttcttcctttgcgttgtgttctttgtagttcagtccccacggctccaaagcggattttgaaggaactcacggatttgcagaaagatccacccacttcttgcagtgctggtccagaacctgaagacatgttacattggcaagcaacaagcatgggaccctcagatagcccttatgctggaggcgggctctccgttacaacttcccccccttcc

SEQ ID NO: 20234 - DNA, 477 bp, Gossypium hirsutum
  Clone ID: uC-gsflnu33B136e11b1
ttatctgttgaccatatccatcaacggtctacgggtttcgaggagcagatggagccgctaccgccaccggttcagctcggcgagattaccgaggaggaacttaagcagtatgatgggtcggattcaaagaaaccactccttatggccatcaagggccagatctatgatgtttctcaaagcagaatgttttatggacctggtggaccttatgcgttgttcgccggaaaagatgcaagcagagctcttgcaaagatgtctttcgaagaaaaagatctgacaggtgatatttcagatctcggtccattcgaattggacgcattgcaggattgggagtacaagttcatgagcaagcacgtgtaggttggatccatcaagaagacaatggttccaggaaccgaaggggatgccagtggagatgcctcaagagctgcagaaactgatactaagcaaactggagatggtccatcacaaactcca

SEQ ID NO: 20235 - DNA, 425 bp, Gossypium hirsutum
  Clone ID: uC-gsflnu33B136f01b1
ttctcacgcgtccgaaagccctgatattgcccaaggtgtccatggccatctcagtaagcgtcccgaggaaatcggtgctggtgaccagggccatatgtttggttacgccacagatgaaacccctgaactgatgcctttgacccatgttttggcaaccaggcttggtgctcgcctcactgaagttcgcaagaacggaacttgcccttggctcagacctgatggcaagactcaagtcaccgtcgagtattacaacgacaagggtgccatggtgcctgttcgtgtccacaccgtgctcatctccactcaacatgacgagaccgtgactaacgatgagatagctgctgatttgaaggagcacgtcatcaagccggttatacccgagaagtaccttgatgagaaaaccattttccaccttaacccgtcag

SEQ ID NO: 20236 - DNA, 256 bp, Gossypium hirsutum
  Clone ID: uC-gsflnu33B136f02b1
tcatgggtgagatcaggaagcaatgcaatcttgcaatcaagcttcactaaaatgcctcgccaaagagaaagccgagtgtggccgaataaaatgtttgtttactcagtttcttttccaagagacgagtttgttaatgcgcaggtgagtaatggtgcaatggtactggtttgtaacgatcgatccattgcatttttcttttagcataagccaggttgccttctcttgatgttggtcatgggcttggaggatgccggga

SEQ ID NO: 20237 - DNA, 450 bp, Gossypium hirsutum
  Clone ID: uC-gsflnu33B136f05b1
tctccctttttacgccttggatcatccctttgttgttcgccatctcaacaatttagttgtgtttttggcgaactatgttcggatgtaagtttgtcaagtgtgaattgtacttgcgtgtatatctgttattgaccgcctccggatgtattaacatccaaagtgtgattattgcaactaaagatataatattgaggtgatgtaatcggagttgaagcttgaagaatatggaatatgtgaccaagaaaaaaaagttatattgttaatttgtttttgtgatatctttatgcctagctacttgttttagatcctccattaatatacttgttgtccttttttgtgatgagttttgctttggttatggactagaaatgtataggaagaaagatactctattatatatataaacatatatatttctacatgttttatcatatatagatgatgataatg

SEQ ID NO: 20238 - DNA, 291 bp, Gossypium hirsutum
  Clone ID: uC-gsflnu33B136f06b1
tccctctcacgcgtccgttcctagtgtttttgtgtgtgtggtttaagccctcatagaggaaaaaagacagagagagaatcctctggtaaaaatctcccttagaggagatcacttgtatcattaccatatggattcaatatgaatcactagtttagtttttccagccgaatcagggacccctaaactccatggcgatgaacaaaaaagaatccaaagggattgccttgctatccttggccaccgatgtaatatgacccaagctatcggacacatgcacgaaagggcccacct

SEQ ID NO: 20239 - DNA, 422 bp, Gossypium hirsutum
  Clone ID: uC-gsflnu33B136f09b1
ttaatcctatctctatatgatgtcaacatcgaggaagagatgcttaggaagcaggcgcatgcagctcaagaggcttatgtggaagatgatgacatgcacggcggtgcccaaagagtgcaatgcgctcagcaatgatcggtggcaggcggtaaggaatggaatgcatgattgtttaacaaaaattatttgaaaataccattctggatatggttgtttgcttagaccatttctcctagagtgctatctgctttgggaactgataaagcgtatggaaagatttagcttcggaacttgaccaatttgtttatggtatacaacctattgcttcttgtgatcttaataataagaatcatccgctgcttctctaactgttactgattcccacaaggctttaactcgaactcctgccccggttgaaacac

SEQ ID NO: 20240 - DNA, 331 bp, Gossypium hirsutum
  Clone ID: uC-gsflnu33B136f10b1
ccgtaggttggccgtaccctggctgactataacatccattaggagtccaccctccacttggtgcttcatcttcgtggtggtatgcagatttttgtgaagacacttaccgggaagaccatcaccctggaagttgagagctctgacacaatcgataatgttaaggccaaaatccaagataaggaaggtatccctccagaccagcagaggctgatatttgctggaacgcagctagaggacgggaggacccttgccgattacaacatccagaaggagtccacccttcactcggttctccgtatccgtggcgggatgcatatcttcgcgcagaccc

SEQ ID NO: 20241 - DNA, 530 bp, Gossypium hirsutum
  unsure (1)..(530): unsure at all n locations
  Clone ID: uC-gsflnu33B136g01b1
tttgaaatcagacatggaaaaggtgaaggaactcctgcatctagacaaagaagcagaggagacagtgtcacgactcactattcacccccaccgagtcggttacgagcgtagcttctacaacgatttcggcttacgcggcatccgtgtcgacaaggtcgagcctggcttcgtttcctgcactttcaaagttcctcctcgcctcaccgataaaaatggaaatttagcaacgggagcaattgcgaatattgtggatgaagtcggcgggtcagcggtctttgtcattggtgttcctatgaaagtttcagtggatatgtccatttcgtttctgggagctgctaagctcggtgatgagctagagattacctcaaaggcattaggagaaagaggaggatatgcaggaacacttgttcatatcagaaacaaagcaacaggggagttaattgccgaaggtcgtcattccttggatggtaatgaatctagcaaactcctgtttggtaatcaatctagcanactctagtccactgctggat

SEQ ID NO: 20242 - DNA, 445 bp, Gossypium hirsutum
  Clone ID: uC-gsflnu33B136g05b1
tctccttccacgcgtccggattatgagaagttaagggatgctattaatcagctagtcgaggatgggaaaacttgcaaaatgctttttaaggaatgaagaggcagtcataaaggttggagcagctttccatggaataacgtacgtgctttgccagttttctgatgcttgcgacatcacacagtttttaaagaaccaaaaatgattgggaaagagaaggtagaagaagtagctattatatgtgcttcttggaaccgcgaaagcgttttggaataactttttgccaatgtagtctgacaggtgcctagggctttgtatcaatcccttgtagttcggcaataataaatgtatgaatgaatccagcattttttagcagttaaacctgctttcagctgaaatttattgttaattaattgtatcacaatattccgaacttatatgtatgagt

SEQ ID NO: 20243 - DNA, 408 bp, Gossypium hirsutum
  unsure (1)..(408): unsure at all n locations
  Clone ID: uC-gsflnu33B136g06b1
tcnctccccagcagaagaatatacagaaaggtagaagatgagttcgggggaacctagtttcgaagaattgttggaggagaagaagcgtgtcaggaaccctcttgtccctgtcggtgcacttattaccgctggagtgctcactgcggggttgatcagttttagacaaggaaattctcagttgggtcagatgctgatgcgagctagggtggcagttcagggagctacagttgctcttatggttggcactgcatactactatggggataatccctggaaatcgagttagaacactcagtttcttggttgcaaccattatattgtttctattttgatatgcaatttctttttatagctataaatgttgaccaaaagcatcataccctgaaagcaaatgccctcagaatgata

SEQ ID NO: 20244 - DNA, 508 bp, Gossypium hirsutum
  Clone ID: uC-gsflnu33B136h11b1
ttatgtattctcagtctccctccccatggagagaacagtcaaggtcacgatccagatctagacctaggtctaggtctaggtcaagatcccgctcctggtcgaggccaaggcataggtccaggtcacatagtcgcggcaggtcaaggtcaagaagtcgaggcagggttgacgctggaaatcctggcaacacactttatgtgaccggtctatctcaaagggtcactgagagggaccttgaagagcatttctccaaggaggggaaggtggcatcgtgtttcctggttgttgaacctcgtactcgcatatctcgtggttttgcttttgttactatggacagtgttgaggatgcgagccgctgcatcaagtatctcaaccaatcaattttagaaggtcgatttataaccgtggagagggtaatccgattctatccttgttgcttagacttcatagatttgggcgtttatcatccttaacctggaggttttctggctatattcagaacagtatt

SEQ ID NO: 20245 - DNA, 520 bp, Gossypium hirsutum
  Clone ID: uC-gsflnu33B137a02b1
taattaaacagcactacacatctagtaaggatttgcttgtcttgaaggagatctctgcactatttcggtatctacaaacagtttactctcgtgtatcagtgcccacaatttggttccatcaagaaccgcaacaatctccttcctcgtgcaccctttcaggtattctcactagtatcatgcccctctagattgtcattgaagaaaaaagacagaaatgatatcatgctcaccttagggaaaattgttcatatattttccaagtttcaactattattctagctgtaataaaacacttgatgtttcttttatttcattagaagcaaacaagaacaaatgcctgaaaagtatattatagcaaagacactatggcttttatgtgttatctacattggaagtattgttctctttgagtccttcgaggctttggttcgaaccaaggatcatttttcgcaacataaatattaagtactggctgagctaagtttgtaattactgtaagaaaaatggatgttgtatgatt

SEQ ID NO: 20246 - DNA, 495 bp, Gossypium hirsutum
  Clone ID: uC-gsflnu33B137a04b1
tattatataactggaacagacccttaaactctctctccctcctccgttttctcatttcggctagggtttcaacacccatcatcgtcaccgccgtgaagccaccgtaggtggtggtcgtgcgaaagggagtttcgaccccagttttggagcgcccgaaggccgtattttcttggcccaataacacgaaaggagagacctccgctttccccctccgaaaatcgatttcaaagacggaatcggaactccgaaaactcgactccggggttctcgggtaagtccctcttttctcttttcttttatatttttttttttaaaaaatgattgaagaacagaaaataaaaataaagaaacgagaaaataaaaaatgagagaacgagactcaacctttttagtttgttctttttttgattgcttaatcgtctgtgtgtaaaaaccaattggtttctggttgggctttatagccgaaaaatacaaatgatttcatctatgctattg

SEQ ID NO: 20247 - DNA, 405 bp, Gossypium hirsutum
  Clone ID: uC-gsflnu33B137a05b1
taacattttctcttcgttattctccaaatccctaaaataaccccccaaaaccctaaaacctaaaacaaggctataatcggaagcttgtttcattagatttggaggaataaaagaaaagagtagaaagggggaatggattcagatcaggggaagctgagtctggtgaaggagacgaaggggatgaggaggagtattgagggatgtaccgttatccgtttgctactgtgatgtattttcttgttgattttggatgtgtgtttttagggttgaatacctcggataatgtactagtttttggtattttctatgaataaagtgcacggtaaaattataagatcgaagcctttttttggaaacaaatcgaggttttttgagaaccaatcaacatgtaagtaaaaactattg

SEQ ID NO: 20248 - DNA, 331 bp, Gossypium hirsutum
  Clone ID: uC-gsflnu33B137a09b1
tgtcttggagcttcttcacattgattctatggctggtttatcttatctgctgtctgctaccatatgagtctgcttttcttacaatttcctttaatttctttttttgggtttgaaatttgattaaatttatatatatgcatatgcatatgatatgagaggtaatgaatgaaatagcaatgagaaaggatgtactgccatgttattattattacaatttgaaatataataacagaaaatgaattaaagcacaccaaaaaaaaaaaaaaaaaaaaaaaaaaaaaggtcgaaagtagttttgatttatgggaaaaagactcctttttttagtaaa

SEQ ID NO: 20249 - DNA, 222 bp, Gossypium hirsutum
  Clone ID: uC-gsflnu33B137a10b1
tcgatacaactgcgaaagccacaggtcaacaatcctttagaccaattggcttcactatctttgaatgataaccatgtctcttgagtgactggaattttggtattgtagggttgagtttggaacatttatttatgcttttgtttgatgcggaggttggaaggattttattactttattagcattgtgggattttcggtctgtgttcccgttacaccgtttgct

SEQ ID NO: 20250 - DNA, 368 bp, Gossypium hirsutum
  unsure (1)..(368): unsure at all n locations
  Clone ID: uC-gsflnu33B137a11b1
tacctttccacgcgtccgtgctccctcaaagcccctgatatagggatagtaagaaacattgattttgattctttgttcttcacatacttgatttgtagtaacacaaatagcttaggatcgatttgttattgtgccgagtagcatattcttgctcatagaaacattacaccgtcatatgtttctacattgtatagtcttgcttaccttattgaaaggaaatacgagtatgtaatgtaaattaagaaacataaaaacatactgctggactggactattctgcctttgttagtaccacanattatttttcacatgtcagattttcaggacaatctttctaaataaaaaaataaggtttttttttttttttt

SEQ ID NO: 20251 - DNA, 415 bp, Gossypium hirsutum
  Clone ID: uC-gsflnu33B137b05b1
atcacgcgtacgcccaccgtccggagagagggagattgttggactagaaaaaggaaccatacaacgggatggtttgattgtttgtttttactaaaatttattgatgatttgtggttagatggttagattttgatttatataggtgttagagtgatggatgtatttaatgttttgttgttttttattctatttttagtattttataaatccttggttttccatcttaaatatattgtactattttatcttttttatttagtttgtattatttatctatttatgactctttctgattttatctttttttaatatttcatttcttttaatggtcttatggtattgtacttatgtttttgttgcttttctctttatctattattctctcttatctatatttatttacttcttattttat

SEQ ID NO: 20252 - DNA, 426 bp, Gossypium hirsutum
  Clone ID: uC-gsflnu33B137b12b1
tacttttgttgtcccccgcagatatcagagggaagactcaaaaactagggttttagagagaacgggagccaaggtgagagagaagaggccgatatttttaggagtagggttttgacatattgcttctctagggtttagaaaatggtggtcgacacaggaaagaatctgaaagttgcatagaaagtagaggatgagaaccatgaacaaatagatggagacctcgtcatttccattgagaagctatcaagagatccaagatgagcttgaaaagatcaatgaagaggcaagttagaaagtcttgtaagtggcgcataaatacaatgaggtttgcatgccggttctatgagtagcggaatgaaatgatcaatccaatttatgatttctggttaacagcttttttgagccatactgctcttggtgatcttt

SEQ ID NO: 20253 - DNA, 446 bp, Gossypium hirsutum
  unsure (1)..(446): unsure at all n locations
  Clone ID: uC-gsflnu33B137c07b1
tggngcggatggcaagctgaagaaagcagcagtggtgatagataagaaatcggggagggtgatggagttgtttacgaatcaagcaggagtgcagttttacacggctaatttcttgaaagatgtgagagggaaaggtggatatgtttatgaatcacatggagctttgtgtttggagactcaagcattttcagactcggtcaatcatacaaatttcccatctgatattgtttatcctggaaaagagtacaagcatgttatggcgttcaagtttacgttttcctcctagacaaaaaaaaacccttgtcttctttattgttgttgtcgaatcttctacaactttaaacaataatgtatttcaggatgggataataaaccttttttttttttaaggtttagagaaagaatatggggtataaattggaaagttaccaaagtttttacgattg

SEQ ID NO: 20254 - DNA, 312 bp, Gossypium hirsutum
  Clone ID: uC-gsflnu33B137c12b1
tcccacgcgttcggcaggggatagaggcgagggtgattttattttctgtgtgatcacatctgagaccgctgtgaatacaacaaccgggaagacatacaccagggattgcgatactattaacactgttggtcagcatgcggataataaaagagaggaagtgattgaaccatcgaagataaaggacgaacaccttcaggttcctatcccagtccgaaggagtactaagaataagagggctacagctgttgatgagagccacgatgttaccccaactgataacttcaaagaggacaccttgcaaaatgaaggact

SEQ ID NO: 20255 - DNA, 449 bp, Gossypium hirsutum
  Clone ID: uC-gsflnu33B137d01b1
tttaatctttgggtggtggtactggatctggaatgggaacccttcttatttccaagatcagggaggagtatccagatcgcatgatgttgacattttcggtcttcccttctcccaaggtatctgatacagttgttgagccatacaatgcgaccctttctgttcatcagcttgtggaaaatgctgatgaatgtatggtgttggacaatgaggctctatatgatatctgcttccgtactctcaagcttgccactccaacttttggtgatcttaaccacctcatatctgctaccatgagtggtgtgacatgctgtctgcggttccctggacagctaaactctgatctccgcaagctggccgttaaccttatccccttcccacgattacacttctttatggttggatttgcttccttgacattcagaggatcacagcagtacccggcactgact

SEQ ID NO: 20256 - DNA, 396 bp, Gossypium hirsutum
  Clone ID: uC-gsflnu33B137d04b1
ttctataaagaaactaaacagagactcgatgcagcaaaattcacgtttcgtgctcctctcgctatccctccttttccttccattcattttctccaacgccgaaaagggccatcttttcggaggatggacaccgatcaaggacatcaaggaccctcacgtgatggagattgcagaatttgccgtcgatgagtataacaagcagtcaaactcgagtttaattttgcagaaggtggtgaaaggtgaaacccaggtggtggccgggattaactatcggctggttttgaaggcaaagaatggaagcatggctaagaaataccaggctgtggtgtggtagaagtcgtggctgaatttcagaaaacttacctcctttactctcgtcaagggttagattttatt

SEQ ID NO: 20257 - DNA, 533 bp, Gossypium hirsutum
  Clone ID: uC-gsflnu33B137d06b1
tggttatttaaacgcaacctgaataggactaactatatattgagatacaaaggatgtgacaacaagaggaaaggggggcgaggtgttaaccaaggagtgcacaatgaaccttcacaagcgccttcatggttgcacatacagaatgacagatccgagggctaccaaggataattaggaagggaggagaaaagccatgaggacaaaggatgtacgagaagctgcaagcgtgacaaagacatttggagacagacggatcccgagacgtcccgagctagactagggcacgccatgagacagacgagagaccatcatggatgagccaaatgcgatcatgacgtctgtagaagcgtttgctcggattccacctgtaggatggaagggactgggcacgatagccaaagatgactacgaggaataatgtcagtgtggctgtgggaacttaagacttgcattttgtactcctacaagcttcatcagagttttgactagttttacaattgtgacattaaaaatacttcgtttggggtatttag

SEQ ID NO: 20258 - DNA, 342 bp, Gossypium hirsutum
  Clone ID: uC-gsflnu33B137d07b1
ttgagcttcaaacgccaccaggtaaggactaactatagagtgagtaacaatggttgagaaaacaagaggaagaaaggaagaggtggtgaccagagagtacaccattaaccttcacaagcgccttcatggctgcacattcaagaagaaagctcccaaggctatcaaggagatcaggaagtttgcagaaaaagccatggggacaaaggatgtgagagttgatgtcaagctgaacaagcacatctggagcagagggatccgaagtgtcccgagaaggattagggttcgcatcgctcgcaagagaaatgatgatgaagatgccaaggaggagctgtactctttagt

SEQ ID NO: 20259 - DNA, 475 bp, Gossypium hirsutum
  Clone ID: uC-gsflnu33B137d09b1
tgcatctctgcagattccatattgcaaacaatggggtcaatggattcaaaagaatcacctgccaataacccaggccttcatactccccctgatgaagccaccaaaggctacatcatgcagcaaaccatgtttcgaatcaaggatccaaaacgtactcttgaattttatagtcgcgttttgggcatgtcgttgctaaacaaagtggatgttccatatatgaaaatgacattgtatatgatgggctatgaggatgtttcatcagctccaagtgacccagttgagaaaactatttggacatttggaagaccagctactatggaattaacacatttttggggtactgaaaacgaccctgagttcaaaggataccacaatgggaattcagaacctattggctttgggcacattggcatcaccgtagattgacatgtataaggcatgccagagatttgagagtcttcgagtagaggttgtc

SEQ ID NO: 20260 - DNA, 228 bp, Gossypium hirsutum
  Clone ID: uC-gsflnu33B137d10b1
gttgatctcaagttgacggtagtcttttagtttggtgcttgttacaaaatgtgtcgacatgatgtggatatgtttgattgaaggtaatgttttcatcggaactgtcgtgttagacccgcgtattttagtgtgtttttttgtggttctcaatgtggactcgttgctttgttatcgtataatacaaattgttgttgcctgggacttgaaatcaaaaaaaaaaaaaataaa

SEQ ID NO: 20261 - DNA, 419 bp, Gossypium hirsutum
  Clone ID: uC-gsflnu33B137e01b1
aatggcttcttctagtggaaactccatgtccaattcaggatccgaagaggatttgcacaatcaaaggaaacggaaaaggatggaatccaaccgagaatcagcgaggcggtctaggatgaggaaacaaaagcacttggacgagttaatggcacaagtgactcagttggttaaagataataatcaaatcttaaccaccatcaacttcaccactcaacactacatcaacatggaagctgagaactcggttttgagagctcagatgatggaactgagtcaaagactggagtcactcaatgaaatcctcaattatcttaatagtggtaccaatagcaacaacagcaacgatgggtttgaaacgagtgagggatttgaaacaacaagtgatgaaagctttaccaccattattagcaaccacaaca

SEQ ID NO: 20262 - DNA, 76 bp, Gossypium hirsutum
  Clone ID: uC-gsflnu33B137e08b1
tgtcctcccacgcgtccgcccacgcgtccgggggaaaaataattaaaaaaaaaaaaaagaaaggccggccaggtta

SEQ ID NO: 20263 - DNA, 187 bp, Gossypium hirsutum
  Clone ID: uC-gsflnu33B137e12b1
atcgatcacgcgtccggaaatttgtttggggaaaggataacttggctgcaggacctctaaagaccaatggtgcaattcaaacattcttcaatgatatcaaagttggggactaagggggcaagtatatgcagaacaaaaatcctgatcaataaaaaggaatcatattctatcgtgaaaaaaaaagaaa

SEQ ID NO: 20264 - DNA, 463 bp, Gossypium hirsutum
  unsure (1)..(463): unsure at all n locations
  Clone ID: uC-gsflnu33B137f01b1
ttccttgcgtccggttccaaaaaccctcttccccttccactctctctctctctgtcattttctcaaacaactgatcggttctttccgaaaatcgtacgccgtatttcaccagccaattaatcagtgattcggtcggattgactgaaaaaaataaacaagcgaagatgtctcttagaccgagcgcgaggaccgaggttcgacggaaccgatacaaggtggcggttgatgcggaggaaggtcggcggaggagagaagacaacatggtggagatccggaagaacaagagagaagagaaccttctaaaaaagcgtcgcgaaggacttcttgctcaacaaccgcaaccgcagcaacagcagatgttatcttccgcgttggttccgagaataagttagaaagtcttccggctatggttgtnggcgtttggtctgatgacaagaatgcacagcttgaggcaaccactcaa

SEQ ID NO: 20265 - DNA, 508 bp, Gossypium hirsutum
  Clone ID: uC-gsflnu33B137f04b1
tcctacgcgtccgcccacgcgtccgcaccatttttctgctttttcttctttcaaagggattccttcagatttttgaggaagatgaatcactacaatcttcagcagaatcccattgccgtttccgcttatgaggagatgggagggtttatctcttcaatatcggagcatcatagggccggccccgttgtttgccctaagcctcggcgaattggggttctcaccaataaccctatcaagccttttagattgcatatgagtcaccaagccgatgtaagtgaatcgaaagccagtgcagaacttctagatatcatcctcaacaagggtgatttatgggcagagcaatctgcagcacaggtagcatcttcacccccatttttttgtggttcgcccccaagtagggccacgaacccagttgtgcaagatgctcgatttggtgacgaaggagttgcagccctttcagcatcgcaaagtccatctccgtcgccatcggcacataaaggggggatgt

SEQ ID NO: 20266 - DNA, 540 bp, Gossypium hirsutum
  Clone ID: uC-gsflnu33B137f05b1
tttctatcgcgtccgctttttgagctttcgtgtttgtctattgaattctttccttcactttctctagaaaaagaaaatgtcttcaggttgcaattgcggatctaactgcagctgcggtgacaactgctcatgcagcaggaaccttaaccttggatactcggagaagacaaccagcactcagaccatcatctccggagttgcgccagtaaagatgacctttgagggaccagagatgagcactactgaatcaggacatggatgcggctgtggatcaaactgcaaatgtaatccatgcaactgttgaaaagcttgatgaaagccatagattatgaaaaaagaaagcagcaaaataacaggcctctgtaatgatttattttcaaggatggatgcgtgcaaggtctataattatgtctctgtctgtcttgtgtaatagaagctttgttgtggtaaaaataatgtataagccatttggttgggagcaaattttcttttgtcaaaggatttttgctgcttattcatggtgacttgtttatggtttta

SEQ ID NO: 20267 - DNA, 529 bp, Gossypium hirsutum
  Clone ID: uC-gsflnu33B137f11b1
ttctttaagaatcagattattcggtccttgccccggatattatccagattattgagtccacaatcttggtattccgactttttttaaaaatggacaataaaaaacatggtagttttcgtaacttgttcggaaaccagaacccaatggctacccctcttcaagttcaatcattgttagagaagaaaggcgcaaagctgaaggagctgcgtaagaaacggaaaggatggaaaaagaatatgtggccgatatcgcacgaggatgttccgttgttgtttgggcttattgacattaaaataatatcaagggttcttcggatgggaaggataagtaaagagcagttgttttggtgtgaagagaagatgaaaaagcttcatttttgtgatgggaaattggagagagatccttcacccatacttttccctgttttgattaaaggttaggtgttgtgtaaagctatgttactgtttcccttgttttgatgcacagtttgctactgattttcctctggaggcacctattcgacttttat

SEQ ID NO: 20268 - DNA, 484 bp, Gossypium hirsutum
  Clone ID: uC-gsflnu33B137f12b1
tcgtatttgcccccatctcaattatcctatccgtttttcatttccaagggggtgaactctcaagttctaggcatacagtataagtggcttttgtggtggcgcatagtggattagattgttgtttgcttgctgtttggttttaagggaaagtaaaaaataaccttttttcctcccatgattgtgtttatcctttgttttctggtgaaaaagatgtattaatgtttgtttgagttgattttcatgtctccatctatctcatctttatgttgtgagttcatttctggttgaagtgtgcatgtttagtaaacttgactttttctatgatgcaggagatgcagtatttgatgcgtcacagtatgcattttttggaaaagatgttcttgaggaggtcgaattggggggattagatgacgaggaggaggatttacctgcagtcggacttgaggatgaggaggagtttttggttggttgagatgaggctaat

SEQ ID NO: 20269 - DNA, 461 bp, Gossypium hirsutum
  Clone ID: uC-gsflnu33B137g02b1
tgcctcacccatttgacattgtggaaagctgatttatctgaagaaggaagctttgatgcagccattaatggctgttgtggtgtcttccatgttgccactccaatggattttgagtccaaggaccctgagaatgaagtgataaagccaacaatcaatggagtactggatataatgaaagcatgcatcaaagcaaagacagtaaaaaaattgattttcacatcatcagctggaactgtcaatgttgaagaacaccaaagaactgtttatgatgaaagtaattggagtgatttggactttgtctatgccaagaaaatgactggatggatgtattttgtctccaagacattggctgagcaagctgcctggagtttgcaaggagataacttggatctcatcactataattccaactcttgtcattggtccatttcttatgccttaatgccacctagtctaattact

SEQ ID NO: 20270 - DNA, 474 bp, Gossypium hirsutum
  Clone ID: uC-gsflnu33B137g07b1
tttcctcccacgcgtccgcttcaatctagatcttttctccaccaccctttcggagaaccgcctctccctttaatcaggtatgtttcttcttccttctttagcgcttcttctgcaatcttatgagcaaaaatattctctgttctgtgtataaattggaatctaaggtcttcaaatctagtcatcttactatgaatgtcgttaataatcgctcctgtgactgatttatctctcttcatttcttggcacttcttgatgattgttcgagagtcccctataaccgtcactaagggacaatccatttcacatcctagttgtatcacctgtaaacctgccagggcttcagcagcaaatggtgactgaacattcctgtatagaacagtcttcttcgcatgagtcttcctctttcgccccaaaccacaagaccaaatgccgacttaaagttcctgttatcaaaggctgcatcaaactggatcg

SEQ ID NO: 20271 - DNA, 384 bp, Gossypium hirsutum
  Clone ID: uC-gsflnu33B137h04b1
tgatagcaaagaaaaggtaagccgaagagaagagatgagaagcgaaaggaagaggagagaattatagaaaatcgtttcttcgcttcttcagccttctctttcttttttgcttcttttctccaattcctttctctatctctttctcctttgcttcttattagcaaagaagagaacggtagagtaaaaagaaaaaaaaaaagaaaagaaaaagaaaacccacattttttgttttgcaaatctcttatttcacccaagctttttcgagggtagagaagatgatggttgtaagtagttttgatttatggcaaaaagacgccttcttttcggcagcagaagaggttcaagaattcgctgatgtaaatggaatcagtatacaggatgtgg

SEQ ID NO: 20272 - DNA, 340 bp, Gossypium hirsutum
  Clone ID: uC-gsflnu33B137h06b1
tataaattgtaagggtaatagcccttactgtagataggttgatgtttatcaacctatctatgacaataaacgccctattcattattcgaatcgtaaaggttgctacttttgtggactcttatctgtttctttgctttttgtaagtagcaatattttcttatttaaaaaatagtaattttttaatgttggaataaacatttccctccatttgattctctaaaaaagaaaaaaaaaaaaaaaaaaaaaaggaaaaaaacaatcaatgaattgatgacaaaaagaaagaaagcatgtgcaggtcaagagaggatagaaactgaaatggggggggcctttttag

SEQ ID NO: 20273 - DNA, 226 bp, Gossypium hirsutum
  Clone ID: uC-gsflnu33B137h10b1
tggaaaaacctcttcgatactcggtaacaaacctcattgtatcagtgccctttttcctaaagaaatgcaataagaacatacaaaatggggaccatataacccagtttaaactcaatatacagttcacctgggggcgaatttaatgagtatttggttacaacaaggaacattagctctgaattactcaaactgacaattctaaacaatcccaataacccgtactttt

SEQ ID NO: 20274 - DNA, 306 bp, Gossypium hirsutum
  Clone ID: uC-gsflnu33B138a01b1
tcttgtctctaacaaataaccaaagcaccgtggcattttgaaccatatattaagggcattaatgaataaagtgaagagatatctaccacctcaaaggtcaggtatcgctgctctagacttctagtatctccaatctcttggatgatggcattagttatttacttaaaaatcgtggtgtgataaatttaaggatatacttttagtaagctgatttatttattttgtattcttgggatttaaaaagcaaacttcaatttaatttataaacattttttagaaaaaaaaaaaaaaacgaaaagtaatgac

SEQ ID NO: 20275 - DNA, 419 bp, Gossypium hirsutum
  Clone ID: uC-gsflnu33B138a04b1
ctagaacagaccctctaagtctcccttggtgctccttgattatatgatggttccgcctaaaggacgccgcagatgtaccgccccggagcctccgcagagggctcgcatgcgacaccgacgaccgtccccttgaataaagcgccagaacgtccggtgaaatcggcccattgacacaacattgatagacatgcgactggaagatcccaaaagcttccaaaaagacactatccgagactgagaaaagctatgatggacgcgatcgaaggaaagaacggtcaaaatctttgctggaaggaacataactgtcaacgaagacccatcgcgcaaaaatggaagcggtggccgaggaaatgcaggatgaaacagcgggtacagaccctgtgggggcggtcgctgatatagtggtcaccaaggcggat

SEQ ID NO: 20276 - DNA, 294 bp, Gossypium hirsutum
  Clone ID: uC-gsflnu33B138a05b1
cctccgtgctcgatttggaatctgcaaaaagtgagtggagcttttaaatttgggatggggtaggttatctactctcttttttctatgccaattgataccttgtgagggaattaaggcttttcagtcatcattttcgttactgttaatgctgtgtcagtaagaatcctcattgttgaagggacatgttgagaaataattgttttggtctgaaaatccgcttgctttgccagccgcacggcttctttttttcatttatgtctcgccccgaccgatcttcataattggttcgcatat

SEQ ID NO: 20277 - DNA, 284 bp, Gossypium hirsutum
  Clone ID: uC-gsflnu33B138a11b1
ccctcgcgtccgaacaaaaaaaaaaaaaaaaagggaaaaataaaaaaaaaaaaggggaaaggaaaaaacatctaaaagaaccaatatacatccccgctctggggcggcccctctactggttccaggccaccttacccgagcctgcgggcctttatctttcctctagtggaccctaaaacccatggcctgccccccttttttccccgtttagcctggccaaaccctgcctgctcccatattaataaattggcccttcactgacgtttctcccattggttttttca

SEQ ID NO: 20278 - DNA, 509 bp, Gossypium hirsutum
  Clone ID: uC-gsflnu33B138a12b1
tgtgtcaggtgcactgatagcaacaaccacattgcaagcgattctgagcccgccaggagggctgggtcagggtgaggacaatgaagggaaggtggtgatgaaagcttgggtatacatgatattcataatcttgaatggtacttcgttttgtgtgacagtcataaccatatttcttcttctcccacacggcttctttggttggctattgacggtatccttaggtctgctgtctgctggttacctgttcagctcaatggtcatatcgccaaacctggaatgtgctttgtttaatttgggtttattcattctgtttgtagtgttactagttgtgggtattctggttttatcaaagcgtcaacggttcatctccatcaaaaaactctgcaaatgcagcaagtatgacctttcattcgtggacggatctttgagtccaattatttgggtacataaaagatatctcctcactctgtgtgaagtgcattttctttgcaattaaactttttctttta

SEQ ID NO: 20279 - DNA, 474 bp, Gossypium hirsutum
  Clone ID: uC-gsflnu33B138b04b1
ctctgttcaacatcctatctctttctctcgaccaaagactcagatccacgcgtgaatctttgttccagcttgttagaatggagacatttctattcacatctgagtctgtcaacgagggtcaccctgacaagctttgtgaccagatctctgatgctgtgctcgatgcctgccttgcccaggaccctgacagcaaggttgcctgtgaaacatgctccaagaccaacatggtcatggtctttggagaaattaccaccaaagctaatgtagactatgagaagattgtgcgtgacacgtgccgcaacattggatttgtttctgatgatgtgggtcttgatgctgacaactgcaaggtcctggtcaatattgagcagcagagccctgatattgcccagggtgtccatggccactttaccaagcgcccagaagatattggagctggtgaccagggccatatgtttggttatgccactgatg

SEQ ID NO: 20280 - DNA, 512 bp, Gossypium hirsutum
  Clone ID: uC-gsflnu33B138b06b1
gtttatttccgaggtgaccctgtttatgtaagggctgcttgtgaaggtagcttgaaacgtcttggtgttgattgcattgatctttattatcagcatcgggtggatacaagggttcccattgaagtcacgattggagaactgaagaaactagttgaagaaggtaaagtgaagtacataggtttatccgaggcttctgcatcgaccattaggagggctcatgcggttcatccaataactgctgtgcaattggagtggtcattgtggtctagagatgttgaggctgacataattcctacttgcagggaacttgggattgggattgttgcttacagtcctctgggaagagggttcttttcatctggccccaaaatgatggaaactttgtccgaaggtgactttagaaagtatcttccaaggttccagccagaaaatatggagcataacaaacgcctgtacgagcgagttaatgagatagcagtgaagaagggatgcaccccatcacagcttgcatt

SEQ ID NO: 20281 - DNA, 451 bp, Gossypium hirsutum
  Clone ID: uC-gsflnu33B138b07b1
taaatctttccagtttcaattttctcacaacaaaactgaaaatgtcttgctgttcaggaaaatgtggctgcggcgctgattgcaagtgtggcagtggctgtaacggatgcagtatgttccctgacataatagagaagactacaactgagactattgttcttggtgtggcaactcagaaaatgcactttgagggatctgagatgggagctggggttgcggccatggccttccgccttagcaacaatcttgttggaatcctcaacttcataaccttcctcctctcgatccccatcctcggagccggcatctggcttagtctagaaggcgtgacggaatgcgaacggtttttggacaagcccgttatcgtaatcggagtcttcctcatgctcgtctcacttgcgggactaatcgacccgtgctgtcgcgttacttggctactcttgctttacct

SEQ ID NO: 20282 - DNA, 508 bp, Gossypium hirsutum
  unsure (1)..(508): unsure at all n locations
  Clone ID: uC-gsflnu33B138b08b1
tgctatttctgacacttgtttggctatggaagaatgggtggaaaatccccacgcggagactgctcttagtaacatccttccttgtgttgatccgagaacaacaaaccatacactcactcaaagcaaacaagtcatcactagtatagtagatgttgtcaatacatatatctactccattgcaaatatagatctttccccagacgacaatcgttactacaatcagtctgggcctactatgcctgctttatgttacccatttgactctcagctccaagatcggcagtgcgggtcttatgaggtgtctatggcaaatgcttcactggtttggcagaactacacgtgcatggtatcagaatctgggctatgcaacaccactggaaggataacgccagacagattcacacagctggtggcagcgattaacgagagttatgctcttgagcactataccccacccttactgtgccttcaaattgcgattntgtccgggatacatttcaaaatatca

SEQ ID NO: 20283 - DNA, 414 bp, Gossypium hirsutum
  Clone ID: uC-gsflnu33B138c01b1
tctacttctaaaaaaaaaaacaaaaaaaaaaagggaggagattaaaaaaaaaaaggggtccaaacacccaaaaaaaacaaaacacagaggaagggcaccccggaccaagaggccggccgccaagaccaaaaccagaaccggatggcccgcccacgacagacgggggccgcacctttaagggcccccccccaccccccccgcccccccagctcccacgtctcttcgggcagccccctaaccaccctagacgcggcgcgggagaaccaacactggcgcaccaaaccctgggaacccccccgaacccgtgcggcgacccccccccccccccccccaagtgggacccccgccgaggcccccccccacacaaccccccacaaccaagcgcccacccccgatcgccattgcgaccccccc

SEQ ID NO: 20284 - DNA, 72 bp, Gossypium hirsutum
  Clone ID: uC-gsflnu33B138c02b1
ttttatataaaaaaaaaaaaaaaaaaaaaaaaaaaaaaaaaaataaaaaaaaaaaaaaaaaaaaaaaacaaa

SEQ ID NO: 20285 - DNA, 438 bp, Gossypium hirsutum
  Clone ID: uC-gsflnu33B138c03b1
tcctcctgactttctctagaaaaagaaaatgtgttcaggttgcaattgcggatctaactgcagctgcggggacaactgctcatgcagcaggaaccttaaccttggatactcggagaagacaaccagcactcagaccatcatctccggagttgcgccagtaaagatgacctccgagggaccagagatgagcactactgaatcaggacatggatgcggctgaggatcaaactgcaaatgtaatccatgcaactgctgaaaagcttgatgaaagccatagattatgaaaaaagaaagcagcggaacaacaggcctctgtaatgatttatattcaaggatggatgcgcgcaaggtctataattatgtctctgtctgtcttgtgtaatagaagctccgattgtggtgaaaacaatgtataagccagttggttgggagcaaaac

SEQ ID NO: 20286 - DNA, 494 bp, Gossypium hirsutum
  Clone ID: uC-gsflnu33B138c09b1
tcgggttgagtgtagagatgaggaaaatgatgggtgccaaagttcttttcttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgcgctgtccagtcatgtgatgcttcactgctgctggactccacaagacggagcttgtctgagaaggagacagacaggagctttggcctaaggaatttcaggcacattgagaccatcaaagaagctgtagaaagggaatgtcctggagcttgttcttgtgctgatatccttgttctgtctgctagggaaggcatcgcttcgttgggaggcccttatattcctctcataactggaagaagagacggcagcaggagc

SEQ ID NO: 20287 - DNA, 348 bp, Gossypium hirsutum
  unsure (1)..(348): unsure at all n locations
  Clone ID: uC-gsflnu33B138c11b1
cctacgcgtccggtttgagaaaaaggagcatcagctagggatggccggatggatgcatatctttccgagttcggcgcatttttatcatttctctgagaaatcaatcagataattctgtggatcttttgtaattttagcactcgatttccagtttatggacttttaattgcaagttcatcaggttttctatatggttgtgcctgcctaccatactctgtttcgaaataataagattactgaatggtttgttgtnnaaaaaaaaaaaataaaaaaacacctaataaaaaaaaaaaaaaaagaaaataaaaaaaaaaaattttttccgacactagacaacccaaatttccg

SEQ ID NO: 20288 - DNA, 134 bp, Gossypium hirsutum
  Clone ID: uC-gsflnu33B138d05b1
gttacgtgtacgataaagagtgtactcccacggggggtcatgcttgaccgagggatgagtcagagccacccaagcctatcgaaccacccatgttggggccattaggtctacatcatggacgcttacaacctgga

SEQ ID NO: 20289 - DNA, 289 bp, Gossypium hirsutum
  Clone ID: uC-gsflnu33B138e12b1
tgcttacgcgtccgaaaaaagctaagcatatgatggaagctgatctaaataatatatgatgtatttgggtttttactattagaataaagcagctatggttcattaggtgttttgcttcttgtatccatggttgcttggtttgtgtatgtgtgtgtgtatatagtgaaatgaaattattttaactagctttgttgtgttactgccatgttatataactgatgaatgaatgaaggaaagctctatttgccttttgcttaaaaaaaaataaaaaacaaaaaaaaaaataaaa

SEQ ID NO: 20290 - DNA, 436 bp, Gossypium hirsutum
  Clone ID: uC-gsflnu33B138f01b1
cccggacttaattgctggacccacccacgcgttcacttgtccgaacaaaaaaaaaaaaaaaaagagaaaaaaaaaaaaaaaaaaagagaaaaaaaaaaaaaaaaaaaaaaaaaaaaaaaaaaaaaaaaacaaaaaattaaaaaaaaaccaaaaaaaaaaaaaaaaaaaaaaaaaaaaaaaaaaaagggggggcccccttaaaagaaccaaacttaactccccggcccatgaaaaacaaaacttttttaatggggcccccaaattaaaatcacgggccccggtttaaaaaccccgggacggggaaaaccccggggaaccccaaattaaaacccttggaaaaaaacccccttttccccagttggtgataaaaaaaaagggcccaaccaaatcccctttcaaaaaattgcccccccctaaatggaaaagggaccccccc

SEQ ID NO: 20291 - DNA, 491 bp, Gossypium hirsutum
  Clone ID: uC-gsflnu33B138f04b1
gataattttcctcagaaatggtgtatactcagtccggatactaatgacctaagcaaacttgcggacaacataaactatgcctgcaccttctccgattgcacagcacttggctacggatcttcatgtaacatcctggatgcgaatgggaacgcatcctacgcatttaacatgtactaccaggtgcaaaaccagaatgacatggcctgtaattttcaaggtcttgccaaggttacaacacagaatccttcacaagggacttgcaattttatcattcaaattgcatcttcttcttttgctattggtccctcactgataggaatgacattttttgctgtaatagcatctgtattactataaacttgattctgtagataacggggaaggtactctctctctctctctctcttttttttcaattcatttttgctagtcacttttgtatgtcatagattcttgggttattttttgaaccgattgacttcaaataatta

SEQ ID NO: 20292 - DNA, 144 bp, Gossypium hirsutum
  Clone ID: uC-gsflnu33B138f07b1
tttcttgtccgcacaaaaaaaaaaataaaagggggagagtattattagttgggggggattaacccacaaccaaacaagcgaagaataccaaccatccagggcccaagaggactccagcacggaacctcacaacatgaagcacga

SEQ ID NO: 20293 - DNA, 525 bp, Gossypium hirsutum
  Clone ID: uC-gsflnu33B138f08b1
gtgctcacgcgtccgccttgttgacaatgttgggagacaaactggtagcttgtacactgattgggatcttctcccacctaagaaaataaaggatcctgaggccaagaagcctgaagattgggatgacaaggaatacatccctgatcccgaagacaagaagcctgagggttatgatgacattccaaaagaaattccagatcctgatgctaagaagcctgaagattgggatgatgaagaagatggtgaatggacaccttcaactattcccaatcctgaatacaagggcccatggaagccaaagaaaatcaagaaccccaactacaagggcaagtggaaggcaccaatgattgacaaccctgatttcaaggatgatccggatctctatgttttccccagcttgaagtatgtcgggattgaagttgtggcaggtgaaatcaggaacaatgtttgataacatcttagttgctgatgatgtagagtttgccaagaaactagctggagaaacatggtgcaagcagaaggatg

SEQ ID NO: 20294 - DNA, 441 bp, Gossypium hirsutum
  Clone ID: uC-gsflnu33B138f09b1
catggtgtacaggcaacatgggtggacgaccactttgggttctggttctgggtgtgctgcttatggcttccggaacaatcgcagctccccctaagaagcctgtagatgtaccattctccagaaactatatgcctacttgggcttttgatcacattaagtatttcaatggtggctctgagattcagctccaccttgacaaatacactggtactggtttccagtccaaaggatcatacttgttcggacacttcagtatgcaaataaagctagtccctggagattctgctgggactgtcactgccttttatttgtcttctcaaaactcagagcatgatgagatagattttgagttcttgggcaacagaacagggcaaccatacattcttcagacccatgtggtcactgggggcaaaggagacagagaacacagggtttaccttt

SEQ ID NO: 20295 - DNA, 135 bp, Gossypium hirsutum
  Clone ID: uC-gsflnu33B138g03b1
attcgcttcaagttgatcttcgggctgatgtttctttttgtttgttgctattcctaaggtgcaaaacaaatgagaaaaataagtttacttgaagacacttcagtagacagattctagccaaaaaaaaaagaaaaa

SEQ ID NO: 20296 - DNA, 470 bp, Gossypium hirsutum
  Clone ID: uC-gsflnu33B138g04b1
gctcctgccttccctgctcgatcccacgcgtccgtttttttctaaaaaaaaataaataaaaaaaaagagacaaattttaaaaaaaagggggctttaaaacccaccaaaaaaaaacacacaagtactctcctatattgtccctcttctcctcccccccttcctctccccctttttctccccccttctccttccctttttcctttctcccctccggcgcggctcttttttatgtatttctctcccttttccccctcccttcttccaattcccccttcttctgtcgcccctcttttttccccctcccccccgccccctttcccccctccccatctcttgcaccccccttttcgtccccccctttttctccccttgcgctgcccctcccttttccccattctgtttttcttcccttaatcccccccacctccccttccctccccccttatccccccccccttttcctttttttc

SEQ ID NO: 20297 - DNA, 506 bp, Gossypium hirsutum
  Clone ID: uC-gsflnu33B138g07b1
ttctttctcaagagctggctcggagatgtgatacggtcatccgattggttgagaaggaaaaccaataatgtgaccagagggagcgacaagcccgcaaggaaaagaaacttgccaagaacatatcaccatctgagctcggagggaggcacccaactgagagtgctactgaacaaatgaaacgcatgcaggtatcaatggatgattatgcgaattcacgtaaaaagaggaagtgagcgagcaatgtgaactacaaattttgggtctaaaatctctgatatttatttgggtttaaaagcagaaatatcataacgaggaattgggctgtagtttgcattttgtatttcatggaactcttgaggctgggtgggaattaaccaccattaatggaaattagttcagggtataaaaggtgcataactgagtatagtgaggttaatgacaaaggatctttaaaacaatctatctgatcttatacatctggatgtggaaccatatgtattatgctg

SEQ ID NO: 20298 - DNA, 454 bp, Gossypium hirsutum
  Clone ID: uC-gsflnu33B138g08b1
ttcgctaatttttcattgagtgaaaggtatagggatggttctccaatggcaacccaaattaacaacgaggaaagcttctcatatgccctccaaatcgtcacctcttcagtgctgcccatgtcaatgcatgcggcggttcagctggacatcttcggaatcatggcgaaatgcgggccagatgctgagctctccgccaaggagatcgcggcacagttggctaccaacaactcagaggcagcctccatgctggaccgaatcctcatagtgttagccagccatggaatcgtgggctgctccatggcggatgaggaaaagggtaatcctcgtaggctgtacagtttgacgcccgtctccaaattctttgtgcggaatgaagatggggtttccttaggccctttgatggcattgattcaagacaaggtcttcattgatagttggtcgcaactgaaggatg

SEQ ID NO: 20299 - DNA, 503 bp, Gossypium hirsutum
  Clone ID: uC-gsflnu33B138g10b1
attctgggaagactggcatcaacaattgctgggcatattcgtggaaagaattggcccacttatactcctagtgtcgatatgggtgcttttgtgatagtggtgaatgctgaaaaagttgctgtatctgggaagaaaaggacccagaagctctacagaaggcattcaggaagaccaggcggcatgaaagtggaaacattcaaccagctgcagcagagaattcctgaaagaatcattgagcatgctgttcgtggtatgcttcctaaaggacggcttggtagagcattgtttaaccacctgaaggtttacaagggcgctgatcatccacatgaggctcagaagcctattgagctgcctatacgggacaaaagggtgcagaagcagagataaacgaacttaaagcagggtcaggatattgggagcgagagggagagagagcaagcaatgttgatttccattttctcgtgtttttggggtataagtttcattatgttgttaagtggaat

SEQ ID NO: 20300 - DNA, 338 bp, Gossypium hirsutum
  Clone ID: uC-gsflnu33B138h01b1
gttcggcgcttgtgttaaggaaatagtggggggggttgtttgatcttttgacctgcaatggaaaagtgactctattgatatgtatgaatctacgaaaatgtccagactgatgtgaatccccgtataactgagttgatacggcaattgccaatggagaaataccatgaccacgtgcttctatccccgacttctggaagggatgcatttattagataaaaggtcgacgcgggctttgccgggtgctctgtctatagattcacaaccttactacgcgtacatgctatgtgccagctactcattagtgacacctaaatcctatccactgtccgtggttttac

SEQ ID NO: 20301 - DNA, 513 bp, Gossypium hirsutum
  Clone ID: uC-gsflnu33B138h05b1
gttttctcaattttccttattatttcataatcaagggtatcttctgcttttctcacattaaactttgtgtccaatccgagccgaggatctgctgcatagccttctttcctcgaacaacagcatgacagtcatcagatgatgaacatagagttttgttagtagtaatagaggcttattaaggccctgagcccctgactgctgtgctgggtcatgtcttgcaatgggatggcttttttcccagcaaatttcatgctccaatctcctcatgaagaagatcatcaaccctcaacttctatcaatcaaatgcttccttcttgcccgccccaagacttccatggtgtggcatcatttcttgggaagagatcaatgtcattttcagggatagatgtgtgcgaagaagcaaatggggaggatgatttatcagatgatggctcacaggcaggagaaaagaagagaagacttaacatggagcaggtaaagactctcgagaagaactttgagctgggtaataag

SEQ ID NO: 20302 - DNA, 513 bp, Gossypium hirsutum
  Clone ID: uC-gsflnu33B138h10b1
cttatatcctcagcatgtcacgcctgattattgggtattcagaattcctgggaaaatttccgacgaaaattcggctccctatcgttaccgttacgcctttatcggacctctcgtttactgctcctatctttcagcccaccgtgaagaagaaaaacagagatacctggctgcctttctcctccgtgctcaacccaacactagcttgagcgattttatcacattgattaaagggtctttagcaaagatccgagggtgttacgaaaatttgtattacaggaattgggatgattcatttaaaagaccacggcaattcatttaaaagatgtgggtatacttgttcgaagaaggattatgattaactaaccagcttggcagccataaagcaatagtgaaaatgttcaacaatctctgcaaatatattgatgtggagaagaagaaccgatattcaagtcttttcttgaagcttaatgcatacaatgctgttcctcaccatagttggcttggcatacttaa

SEQ ID NO: 20303 - DNA, 475 bp, Gossypium hirsutum
  Clone ID: uC-gsflnu33B138h11b1
ttctctcgcgtccgcaaacatccatggcctggtggggtctatattctattctctccgtcgttttcctctatttcgttttcattacctcgaggaagcgccgccgtctgcctctccctcctggtcctaaaccatggcccatcattggcaacttgccacatatgagccctgtgcctcaccaaggtttagccgccatggccaaagtctacggccctctcatgcacctcaggttggggttcgtggatgttgtggtggcagcgcccgcctccatggcggctcaattcttgaaagttcatgactctaacttctccagccgcccaccgaatgccggcgccaagtatgtggcttacaactatcaggaccttgtgtctgcgccgtacggaccgaggtggcggctgctacgtaaaatgagctcccttcatctcttctccggcaaggctttggacgactttagacagattctcgaggaggagataag

SEQ ID NO: 20304 - DNA, 545 bp, Gossypium hirsutum
  unsure (1)..(545): unsure at all n locations
  Clone ID: uC-gsflnu33B139a09b1
ttttatcgcgtccggtgactatgaagaatttagaatgataccgatgttgaggtgcttgttactgagagtgggtggccttccaagggggactcaaaggagccttatgctactaaagacaatgctgatacctataattcgaatcttattaaacatgtattagaccgtagtggaacccctctgcatccggaaatcacttccagtgtgtatatttatgagttgttcaatgaggattcgaggtcacctacagagtctagggcaaattggggatcgctttattcgaattcaaccccggagtatttgcttcatgtatcaggaagtgggacctttttggcaaatgatacaactaatcagacctttcgtgttgcaatggatgggatagattcaaagacattgcagacagcattggactgggctcgtggtcctgggagggcaaattgcagtgagattcaaccagnggagaattgctaccagtctaacaatgtgaagaaccatgcttcttgcgcctttgatagctattatcagatagaagggaaagcgtctgggtc

SEQ ID NO: 20305 - DNA, 244 bp, Gossypium hirsutum
  Clone ID: uC-gsflnu33B139a11b1
tcgtagatgcgtccggtgaccctatcgatggggggggatttttataaccaagtggtggatctagctcaaaggctgaagatctgcaagaaagaggccatagactgttaactagttgcacggagataatccttcattgttcgctgttttgagggactatggacattttaggcagggatgggagaggcaatcacacgcaggtggtgcccttacaggttgcgagccgtacacacgctacactgttgga

SEQ ID NO: 20306 - DNA, 536 bp, Gossypium hirsutum
  Clone ID: uC-gsflnu33B139b01b1
tgttattatactgctctcccctagatcgtctgcaagagagagatctccttacagctaccgtacacattcacacacacattcactgaatgggtcgagtcatccgagctcaacgtaagggtgctggttccgtcttcaaggcccacacccaccaccgcaagggtcctgctcgtttccgcagcctcgacttcggtgaacgaaatggctacctcaagggtgttgtcaccgatgtcatccacgaccctggccgtggcgctcctttggcccgtgtcgtcttccgtcaccctttccgttacaagaagcagaaggagcttttcgttgccgccgagggtatgtacactggacagttcgtctattgtggtaagaaggctactcttgtggtcggaaatgtattgcctcttagatctatccctgaaggagctgtcgtttgcaacgtcgagcatcatgtcggtgatcgtggggttttcgctagggcttctggtgattacgctattgttattagtcacaaccctgataacgacaccaccaggatcaagctt

SEQ ID NO: 20307 - DNA, 487 bp, Gossypium hirsutum
  Clone ID: uC-gsflnu33B139c01b1
tgtatttgttcttaggcttatcatgcttgcaatgacatcagtgagctggtatcaagttaatctggttctctttgtggcaatggttactgggaattatctcagtttacttaacatttagagactgcatgcttgggaggtcattcagccaataaggtgggttttgaggctacatgactaaattttgagcttgaggtggggaaacgaagacataatgttgacaatcttagttggcggttctgttagtacatttggcattgaggttctcgagcttcctatattctcttctgagataatcatttgttcttcttatttccgggctatgtcgaggtccgatggacttgcatgacattggatgactccatagaagactttggacctatgatatgaagggcaactttcagagatctgactttgtttctttctgctttcttagcatcgtttcgttgggaggcccttacattcctctcaaaactggaagaagaaacgg

SEQ ID NO: 20308 - DNA, 286 bp, Gossypium hirsutum
  Clone ID: uC-gsflnu33B139c05b1
ggtacttttaccaaaacaaagcggttgttaagaggggggatagcagaaccccaggatctactggaccatcaggattcagagctgatgcaatgcctgtcgactgcttgggggtcgggggatcaagaccaaggaacctactggagaaacagcatcatcactatcatcatcatgctcatcaaccgcaaccagactgggagcatgtcgcaggaagggggcacgcgagcactgcacggctcgagccatttgcaacaccatgcagtgttcgagaaaccaatgcggaaagctt

SEQ ID NO: 20309 - DNA, 250 bp, Gossypium hirsutum
  Clone ID: uC-gsflnu33B139c07b1
tgattcgcgtccggagaacccagggcaggggggggattggaacacacaaggggtggaaccagcccaaggggagaagatcggcagcaagaaggacaaaaaaagagcagggaggacacggaaaataagggtacatggttcgcagagtaaaggaacgatggactgctccggcgcggaagcgagaggcaaccacacgcgggagaaggcactcctgggcgggagacaaacatacgcaacgagaagggaaacaacg

SEQ ID NO: 20310 - DNA, 251 bp, Gossypium hirsutum
  Clone ID: uC-gsflnu33B139c09b1
tagacgcgtccggaaaagcgaaggaaggggggggctttgaagaaaaaaaaggtgtaatcaacccaaaaggagaaaaacggcaggaagaaggacagaaaaagagaaggcgagagagggccaataatgcaacaaaaaacgcaacgcaaaggaggagaggaactcaccgaagcagaagcgagggccaagcaaaagcaagaggaggcacccctgcgaggaagacaaacataggcaaggaaaagggacgcaaccaa

SEQ ID NO: 20311 - DNA, 260 bp, Gossypium hirsutum
  Clone ID: uC-gsflnu33B139c10b1
tgcttacgcgtccggagaacctaaggttaggggggggtttgaataaacaagtggtggattcaacccaaaggggccatatcggaagcaataaggacatatacagagcaggctgtacacggagaatattggtacattattcgcagttttgaggagcattgcacttctcgcgacgagaagctggaggcaagcataagcacgaggtgtcattcctgcgtttgtgctaaacataggcaacgctaagggacgctacgattgtattt

SEQ ID NO: 20312 - DNA, 551 bp, Gossypium hirsutum
  unsure (1)..(551): unsure at all n locations
  Clone ID: uC-gsflnu33B139d02b1
ctttacttgcttagaccaacaaagtaatgctggcagtatgggaaagaaaggaagttggttttctgcaattaaaagggttttcataccacactccaaggaaaagctaagtaatgaatcggataaacgaagtggtaaagaaaagaagaagaaaggcctaggaaaattaaggcatggagaaaccaattcctttattcccctctttagagaacccagcagtattgagaaaattcttggggaggctgaaagagagcataaactagtattcaggcctccaacacctccagagcagccaacgacaccaccttttgtgcctcataaagatgcttctccaagagttccttcacagaggattgcctctcctaggattgcttccccgagggctgcttctccaagaaccgtttcccctccacgagctgcttctccaagagctgctccacctaaggtcgtctgtcctcgaccagaaccaactntaaggaatcatcatgcttctgctacgaaaattcaagcagcctatagagngtatatggcgaggagaagttttcgagcttgga

SEQ ID NO: 20313 - DNA, 281 bp, Gossypium hirsutum
  Clone ID: uC-gsflnu33B139d04b1
gatacttttgcgattaaactgaacttaacatgggtggcttttgtaaagggacgtgttttttcccaagggtatgatataaccgacttagcacccatcgacaaggcaatggcgaagctaaccactgaccagttgagcgaaccaggagcggcggagcaaaccatatattaccatataatgccagagtaccagacggaggaaagtatgtacaatgcggcgaggagattagggaaagtgtcaaacgatacatcgaggttgccggataaagagttggctaaagaagc

SEQ ID NO: 20314 - DNA, 280 bp, Gossypium hirsutum
  Clone ID: uC-gsflnu33B139d06b1
gatatttgtccggagaacctaaggttggagaaggacgggtatttttaaccggcggaacgagcccaaaaggagaatatcgacaacaagaaggacatatacagagcaagttggacatggagcatattggtaaattgttcgcagagtaaaggaacgatgcacttctccggcgctgatgcgaggaccaaccacacgcgggagatgtcactgctgggtgtgagatgaacataggctatggtaagggaagctacgattctgatggctgaggccatagaaagggaag

SEQ ID NO: 20315 - DNA, 263 bp, Gossypium hirsutum
  Clone ID: uC-gsflnu33B139d08b1
tgttacgcgcccggaaaaccaaacgcaagggggggatttaaataaacaagggggggaaccaacccacaggggcaaaaccgacagcaagaaggaccaaaaaagagaaaccaggacaacggaaaataaacctacattgtacccaaaacacaggaacgatggacaatcaccgcaagggaaccgagagccaaccacaagcaggagaaagcactacagggcgggacacaaacacacgcaacggaaagggaaacaacaactctaagggc

SEQ ID NO: 20316 - DNA, 244 bp, Gossypium hirsutum
  Clone ID: uC-gsflnu33B139e05b1
gctatgtttccggtgaaacttgggttagaggggggggggtttttataactggggggttgagcccaaggggatcatatcgccaacaggaaggacatatacagagcggggggggtatggaccatattcttgcattgtacgcacagtaaaggcggaattaacttctccgacgcggatgcgagaaggaaccagacgcgggggatgtcactccttggtgggacatgaactttggctatgggacggggag

SEQ ID NO: 20317 - DNA, 255 bp, Gossypium hirsutum
  Clone ID: uC-gsflnu33B139e06b1
gctcttttccggagaaacttaggttggtgggggtcgggtttttttaattggtggatcgtttccacaggtggaatatcggcgacaggaaggtcatatacagagctggttgtacatggagaataatgttgaattgttcgctcattaaaggaagattgaacttcttcggagcggatgcgagaaggaacgatacgagggtggtgtcactccttcgttggacaagaatttgcactatggaaagggacgctacgattctgt

SEQ ID NO: 20318 - DNA, 220 bp, Gossypium hirsutum
  Clone ID: uC-gsflnu33B139e07b1
atcggttacgcgcccggagaacccaacccagggcggggatgaaaaaaaaaaaggggtggaaacaacccacaggggccagaacgacaacaagaacgcccaaggcagcgagcacacgacacgagcaaaacgcaaaaacgaacgcaaagcaaaggaagaaaaacaaccccagaacggaagcgagcaccaacgaaacgagagacacaaaacacatgcgcggaac

SEQ ID NO: 20319 - DNA, 105 bp, Gossypium hirsutum
  Clone ID: uC-gsflnu33B139e08b1
tggtttctcgtccggagaaccaaacgaaggggggggtttaaaataaacaaggggtggattcaacccaaaggggccatatcgacagcaagaatgacctatacagag

SEQ ID NO: 20320 - DNA, 330 bp, Gossypium hirsutum
  Clone ID: uC-gsflnu33B139f01b1
cttcgtttccgggagatggatgtccttaacgattgggtctagaaatttgaagctaagtaccctgttgtcggccgcgttgtctcctgaaaatttgcacctttcctctatgttgggtgtaatttgtttcgtttttaagtgtctttagactctggttattacttatctatcaattgtgtttggtgttttgcttagctcagagcaatttctaggttaaataaatgggtgaaaattaataaattgagatacttatgggcttgcgttgtgttggtatctcgctgttgtttatgttagagaagtttcatcatcaatggagaaattcattttaattgg

SEQ ID NO: 20321 - DNA, 572 bp, Gossypium hirsutum
  Clone ID: uC-gsflnu33B139f02b1
gtttccttttcactgctttccttcaattatttcccacttccttttgccttcaaaatttccttgggattcctatggctaccgctgaggttgcatcagttcaaactgcacttcatgaggagaaaactgaagaatcagtgaaggatcaagaagctacaacagatgaagtagttgccgaagctccagcagcggaaccagttgccgaagagccaaaggaagcggagcctgcggcggtggtagtcgaggaacctgaagcctcagttgaagttgaaaccaaggaggtggtagaagaaccaaaggctgttactgaggagccagtagtagaggaggctcctaaggaaacaatgccagaaccagttgccgaggagatcaaggaaaccactgaacaaaccgttgaaaccaaagaaactacagagtctagtgaggcagcagcagaagcacccaaagaggaagttaagaaggaagaagatgcacaaccagctgaagtggaggagaaagttgaaacagaagctgatccagcagagaagactgagtaaataataaagctttgtgatgaaaatgcggtgtcaatggag

SEQ ID NO: 20322 - DNA, 125 bp, Gossypium hirsutum
  Clone ID: uC-gsflnu33B139f04b1
gatcttttccggtgaaactttacttaccatggggcgtttttttataaatgggatctttttctcaaaggtatcacatctccaattttccagacatagacacttcgggtgatgtatgcaccatatgc

SEQ ID NO: 20323 - DNA, 106 bp, Gossypium hirsutum
  Clone ID: uC-gsflnu33B139f05b1
ccttcttttccggtgaacctttgcttagaggggggcgggtttttataaatggggtcacgagcccaagggtatcatatctccaactggagggacctagacacttcgg

SEQ ID NO: 20324 - DNA, 211 bp, Gossypium hirsutum
  Clone ID: uC-gsflnu33B139f06b1
gagatgcttccggtgaaacaaaggttggatgtgggggggtttttttaaatgggctgaggttttcaaaagaagcatatttccagacaggcgggtcatatatagagagggttggatatggacatagtggttgaattaaatggacaccggagggggatagaagattctgcacagcttatttggtatcgtaaatctaatggggtggtataagctc

SEQ ID NO: 20325 - DNA, 215 bp, Gossypium hirsutum
  Clone ID: uC-gsflnu33B139f07b1
tcggatattcgtccggagaaccccacgctggggggggtttaatttatataagtggtggtttcaacccacaggagccatatctcctacaggaaggacctatacagagctgtgttgggtacggacaataatgttcaattaattgcacagcaaaggaggaattgacttctccagaagcaaatgcgagaaccaaaaatacaagggagaaatcacttcta

SEQ ID NO: 20326 - DNA, 243 bp, Gossypium hirsutum
  Clone ID: uC-gsflnu33B139f09b1
tggtttttcgtccgttaaaccaatcgctggggggggttttttttacctaggtggtttattcaacccaaaaggataatatcgccaacagtagtgtcatataaagagctggcgggtcttgaacaatattgttacattattcccactttagaggaggattagacctctccgataaatattgcgagaaccaaccaaactcctgatctacaagttctacgtttcaggaattcatgcccaagtgtaagg

SEQ ID NO: 20327 - DNA, 199 bp, Gossypium hirsutum
  Clone ID: uC-gsflnu33B139f10b1
ttattacgcgtccggagaacccaaggttggagggggcttttaagaaataattggttgaatcaacccaaaaggagaatatcggctgcaataaggacatataaagagaggtcgggacacggacaataatgcaacattgttcgcaacgtaaaggagcattggaattctccgaagccgatgcgggaaccaaccaaacgcacga

SEQ ID NO: 20328 - DNA, 200 bp, Gossypium hirsutum
  Clone ID: uC-gsflnu33B139f11b1
ttactacgcgtacggaaaagacaaggaaggacgggggtttaaataactaaatggcgggtttcacccaaaaggagaatatcggaaggaataacgacgacaaaagagcgggcaggacatggaccatattgcaacaacattcccatagtaaaggagcataggacatcacccagagacgagtcgagaaccaaccaaaagcacga

SEQ ID NO: 20329 - DNA, 413 bp, Gossypium hirsutum
  Clone ID: uC-gsflnu33B139g03b1
cttatcttttccgagcaatcaatagtcaatgtcgctgtatcaactataataacgatgctgattgcacatatatcactcctattccagataacaagatgacggctggggatgctcatgaacaagaaatactactaatattggatgttgcgcaagggaacacggtacatctcatctgcagaaaaggtgtctccatcttgtgaaccaaggacacttgcgacgcggaaattcatttaggggacgccaacgacccatcgcacaaggtattcatcttaatggccgtgaggcaggtgaggaaagctgcagccatcctgagggtcagaatgatggattgctattcgatggatcgaggggctctccgctgaaaacctagaactgacagctgcatcagaccgatatcaaaacttcgtacacgg

SEQ ID NO: 20330 - DNA, 123 bp, Gossypium hirsutum
  Clone ID: uC-gsflnu33B139g07b1
tcgcctacgcgtccggtcaaacgtacgttagggggggtctattttatatgggtgggggcttcaacccaaaggggggatctctccaacagaacagacataaaaagcgcgggctggggatggaca

SEQ ID NO: 20331 - DNA, 244 bp, Gossypium hirsutum
  Clone ID: uC-gsflnu33B139g09b1
ttgctacgcgtccggagaaccgatggttggggggggttttaatgatctaaatggtggattcaatccaaagggaggatatctcaagcaatagtgacgtataaagagcgggcagggtatggacaatatgcgtgcattaatcccatatgagaggaggataagacatcaccgacacagatgcggaaacgaaaaatacgtaagaggaataagttctacgattctggtaaagttagccataggaaagggg

SEQ ID NO: 20332 - DNA, 66 bp, Gossypium hirsutum
  Clone ID: uC-gsflnu33B139h07b1
tcgctacgcgtccgcccacgcgtccgtaagggagggtttaatttaaatggggggggggaacaaccc

SEQ ID NO: 20333 - DNA, 382 bp, Gossypium hirsutum
  Clone ID: uC-gsflnu33B139h10b1
tccactcgtccggacaacatccatatatagggggctttaaatatctaagtgggggcttccatcctaacgtacgatatctcaagcaataggcacggggagagagacgacatgaaatggacaatattgcttccacatttccataacaaagaagaattagaattcactgatgcactaggcaggaggcagcacatagcacgatatgtaaattgtgcgattctggtaaatttgagcaaggataagcgacaatatggtgagagttttctagtgccttgagtagaaaatgggagcgccactctaagtatactgcgagggctatccctaactgggaacttactaatgccatataaaatagcctgcacaaagacaggatgagcgtattcta

SEQ ID NO: 20334 - DNA, 52 bp, Gossypium hirsutum
  Clone ID: uC-gsflnu33B139h12b1
tgcatgaggtgcggactgcctcaataggctgagcggcatttttgaataagaa

SEQ ID NO: 20335 - DNA, 442 bp, Gossypium hirsutum
  Clone ID: uC-gsflnu33B140a02b1
ttgcacttgtggccggacgcgcgggagctggcagggttgtagatgccaagggggtcacgcaagctatgccacatgaacctgtggctctcgaggctgagagttgcaccaagcgaccagcagctgcttgcacgagttaagctggcactgattcatgcagcatccactacaaggcattccaggattgcctgaatagctatggaagcgaactcagcaagtgtcagttctacatggatatgttgactgagtgcaggaagaacacacggtccatgttgggtgcctaaaagattattcaccattttccttggtatgctatagaaaatgtcagctccggacttgcgctgagatttaccctgggaaacctctggttgatcgatgaagatgaactcttccataaatctctatgaataaaaagcactctttgagagatactgcttattaattg

SEQ ID NO: 20336 - DNA, 529 bp, Gossypium hirsutum
  unsure (1)..(529): unsure at all n locations
  Clone ID: uC-gsflnu33B140a05b1
tgagagattttggacttgcagcactcggcgatctggatggctggtgtatatttaatgctattgatgcagttccttgagaataaagtggctgtggagcttacacggtctgaatttcttgaagctcaagaggcattgatgcaaatgaagaactggttcattcgctttccaacaattttacaagcttgtgagagcatcatcgaaatgcttagggggcaatattcccattctgttggctgttataatgaagcagcttttcactatgtagaagctgcaaagataactgagagcaaatcaatgcaaatcatgtgccaagcttatgcagccatttcatacttttgcattggtgatgctgaatcgtcttcacaggcgcttgatttaattggaccagtttacagaatgaaggattcctttgttggagttcgtgaggaagcaagcatcctttttgcttatggccttctattgatgaagcagcangatctacaagaagcacgaaacccgctggccaagggttgcagatggctcatgttca

SEQ ID NO: 20337 - DNA, 497 bp, Gossypium hirsutum
  Clone ID: uC-gsflnu33B140b02b1
tttttcttttgtttcttcttacgctcgattacctcacgaaaagagaaaatgaccaagtgttacccaactgtgagcgaggaataccagaagtcagttgaaaaggctaagaggaagctcagaggtctcatcgctgagaagaactgtgctccactcatgctccgtctagcgtggcactcagctggaacttttgatgttaagaccaagacaggaggtccattcggaaccatgaagcatcctgctgagctcgcacatgctgctaacaacggccttgatatcgccgtcagacttctcgagccgatcaaggagcagttccctaacctcacctacgctgacttctatcagctcgctggtgtcttcgcccgtgagattactggtggacctgaaattcccttccatcccgggagagaggacacgcctcacccaccacctgagggcccgctttctgatgctacaaaggttctgatcacttgaggaagggtttagtgctcaaatgggtc

SEQ ID NO: 20338 - DNA, 500 bp, Gossypium hirsutum
  Clone ID: uC-gsflnu33B140b03b1
tctcatttttccttcaaagattccacctttgttgaaccaagatggactgttttgtaccttcaaggaagccttgtttcattgaagaagatgatggtttagcttcacttgcaggcatggagggtgttggatattcaggtggaagctattacaaaaaccatagccaaaatgggtttttctcaacacccttttgtttctcaaggaggaataatagtttaaggaacatgtcttcttcttcttcttcttcttcttcatgtttgatttcttcttctccaaggtctactagattttatgatggcagatttgaagatcatcatcaaccccattacttggatgcttgcttcctttgcaagaaaccttttgggggtaataaggacatcttcatgtacagaggggacacacctttttgtagtgaagagtgtaggcaagaacaaatagacatggatgaagcttaagaaaacaatttgagctttttttatcaatgaagcattgagaggagaaga

SEQ ID NO: 20339 - DNA, 491 bp, Gossypium hirsutum
  Clone ID: uC-gsflnu33B140c01b1
tcccactcgtccgcgaagacggccgcaccttagctgactacaacatccaaaaggaatccactctccaccttgttctccgtctcaggggtggcgccaagaagaggaagaagaagacctacaccaagcctaagaagatcaagcacaagaagaagaaggtcaagctcgccgtgctccagttctacaaggtcgatgaatccggcaaggttcagaggctgaggaaagagtgccccaatgctgagtgtggggctggcactttcatggctaaccattttgataggcactattgcggtaagtgtggactcacttatgtttaccaaaaagctggtggcgattgagtttccacctttagcttgtcgatcttttgttagtatgagagacgggattttaatttccaattatcgttcgactctttaattttttaatgttacgatacttgggatatgatcatcaattttagcttttctgaatctaaagtagggcattttacaaaa

SEQ ID NO: 20340 - DNA, 271 bp, Gossypium hirsutum
  Clone ID: uC-gsflnu33B140c04b1
tgccacgtttccggaaacccagacttacagggacgctttcaatttccagggggttgcagtcactaaaacagcatgtgagggagcaactctttggctaatacacacggaaactgatgtagaaggcgggtaaatcttacttttactgacacgaactgtcgattagaccctatgatatagccattagcattggggaaggacgaatcttgtgagtgcaacgaggcctttctagggagccaccattcgtggggtgtttagagaaatgaagtgttta

SEQ ID NO: 20341 - DNA, 80 bp, Gossypium hirsutum
  Clone ID: uC-gsflnu33B140c06b1
ttatatatgtcttgccaaaaaaacaaaaagggagaacaagggaaaatttaaaagagggttagcgataaaaaaaaagaaaa

SEQ ID NO: 20342 - DNA, 587 bp, Gossypium hirsutum
  Clone ID: uC-gsflnu33B140c12b1
ctaactctatggaatgctgggaacgcctgcaagcgcaccggtgcgccagttccggaatcgacccacgcgccctgcgtttttgtacgcggacgcccacacgtgcggtcattgataagcacctcattccatcttcctccaccggggaatcaactgttttctactataagatgaaaggagattattttcgttatttggcagaatttaaggcaggagatgatcgtaaagaagctgctgatcagtcacttaaggcttatgaggctgccacttccactgcaagctcagagttgcctccaactcacccaattagacttggcctggctttgaacttctcagtttgctactatgagatattaaattctcccgagagggcttgtcatctggctaaacaagcatttgatgaggctattgccgagcttgatagccttaatgaagaatcttacaaggatagcacgcttatcatgcagcttcttagggacaacctcaccttgtggacctcggatctgccagaggaaggaggtgagcaatcaaaagcagatgaacctcaggttgagagttaattggatggaagagcattctttaagactggg

SEQ ID NO: 20343 - DNA, 518 bp, Gossypium hirsutum
  Clone ID: uC-gsflnu33B140d05b1
tttccacttttccgatcgtcttcaactccactttttctgctaattcccatatccttccagttcccactccaaaaaagaaaaaaaaatcccatttttttcagtgccatggtcgcttgctaagaacccttttccattgtttttttcttgcgaagcagtgcgaaaaaatgcctccaagaagacgtccgaaaaaggcaatttctttccctgtttttcctttgatttctcttaagtttgttcctatcgttcacttttaatgaaaaatttgcacttttttttggatgttgcagaaatctaatacgagaaaggatgctgccattgatgcaatgaagccatatgggtttcctgtagacgttgttcaaacaaccataaaggatttgctaaatgtttatggggaagatgggtggccattcattgaagattctgcttacaaggttttacttgaagccatacttgacaaggtaaccggagaaggaacaagtgatcctaaggaaccagttgctgagacctcaagtagaact

SEQ ID NO: 20344 - DNA, 197 bp, Gossypium hirsutum
  Clone ID: uC-gsflnu33B140d12b1
tcccacgcgtccggtttgtagtgaaaaaaaaaactgtatggtttagtctgtgatggaaacaatatgttgggggttaaagtgatatttcaccaatgtgttcactttttttttaatgtgtgtgtgagatctatatcatgtactactagttgttgaagaagtaatttatttaatggaaatcagtgttggatgattagatt

SEQ ID NO: 20345 - DNA, 285 bp, Gossypium hirsutum
  Clone ID: uC-gsflnu33B140e02b1
tgccacgtttacgaaagccaagaccgacagggacggggtcaatatgaagggcaaaacggtccaccaaagggaagcatctggatatactcctgggacaaaacacaggcaagatcacgacgacagcgggaacaaaacacaggtgcagagactgacaaacgtataggacgaaaataaaacggacagccctgcggaaggagacacccgcgagggacagggaaggcacaccgcggacacaacaaggtgtgggtgcaaaaagaaccgcccggataacagcgccaaacacaa

SEQ ID NO: 20346 - DNA, 244 bp, Gossypium hirsutum
  Clone ID: uC-gsflnu33B140e11b1
tcccacgcgtccgtctaaatatgggttgacggtgacggtgatctccttctccgctcagactttttagccttcgatttttttttgtttccttttgatctttaaagatccgattcactggctttcggatctatcttttgcaccgaattcaattcagaccggataaaacaatggcagcatccagacgattacgtgatctacaatcgcagccgggaaacaagacttgcgaccatagcaatcaaaagaa

SEQ ID NO: 20347 - DNA, 440 bp, Gossypium hirsutum
  Clone ID: uC-gsflnu33B140e12b1
tcccccacgcccattcgtcctttgaggggcggcgttgctatgcccttgtcttttgatcacaagcccgacaggcctgatgagttggagagagttgaagctgctggtggaagggtcataaactggaatggatatcgagtgcttggagtactggccacttcaagatccataggtgatcagtacctcaaaccctttgtgatatgcaaaccggaagtgaccgtacgagaggtaacgaatggtgacgagttcctgatactggctagtgacggactttgggatgtggtatcgaatgaggtggcgtgtcgagtggtaaggcgatgtctgaacggcctaataaggagcacaacagctgatgttttgaattataaccgtgctactgaagtatcagcggtgttgtgatgaactctcattgtcaaggggtagctatgacattattagtgtga

SEQ ID NO: 20348 - DNA, 345 bp, Gossypium hirsutum
  Clone ID: uC-gsflnu33B140f07b1
taaaaaccaaaagaggaaaacaaggatgcatttgatgctgctggacaacttgagaagttgagctttcaagagaaagctggagagaaggctgttgctaagaaggaagagaaggaaacaaaagtggatacagaaaaagcagatacagagaacaaagatggggagccagcttgctcaacttgaaaagagtttggctctgttcttcatgccattggcttttggcgaatatggtgagattagtcagatgatcaacctcctcacccatgtctaggatattcctacgggtgaaactagatgggtagtttatctggctggaatggccctagtcataagggtagcttggtaaga

SEQ ID NO: 20349 - DNA, 373 bp, Gossypium hirsutum
  Clone ID: uC-gsflnu33B140f12b1
gcaaacaaaaaaaaaaggggaaggggaaaaaagaaaagcccaagcgcccccaaaaaggcaagaggaaaagaaaaacggcgccaaacaagacagccaacccgaccgggaacgagcgcacagggaagcaaggcacaacgaaccgaggggggagccccaagccaaaaaaaaaaagaccaaggcgagaaaaagagaccggggggaacaaagggggagcgacgggaaccaggcagaaacaggaaaccaaaaacacgcgccacccaggaaacagccaaaacaaaaaaggccgaagggagcaacacacaacgacaaaaaaaaaagccgaagcagaacagagcggagcaacagccccagcagaaaacgcaaaaaagaggcc

SEQ ID NO: 20350 - DNA, 369 bp, Gossypium hirsutum
  Clone ID: uC-gsflnu33B140g03b1
tcccacgtttccgcccacgcgtacgtgtgaccagccagattatgttaaactggtcaaggcactctgtgccgatcacaatgttaaagtgctacgtgcacctagtgcaaaaactctgggcgagtgggctggtttgtgtaagatcgattctgagggaaaggcaaggaaggtagttggctgttcttgtgtagttgtcaaggattatggtgagcaacatgaggctgtcgaagttgttcagcagcacaaggattaagcaaatcagaggatggttgccttggtatgctgagattttttgttatgtaacgagttcttgatagtgaacaacaaaagattatgtttttgtagagtcgttgcgattctctggaactgata

SEQ ID NO: 20351 - DNA, 297 bp, Gossypium hirsutum
  Clone ID: uC-gsflnu33B140g04b1
ttccacgtttacgggctgctacagttattctggatggttcatcaaaaatatgacacctgttctgagaaaaagtgaaaatcagttatactctcatctatcatatatcatttgtgaactccttggagggcactttctcattgtttgagtttgtgtttactgcaggccaggaggtggacggggagaactcctgctccaggaatatatttgggtttgagaactaattgtgctgaccatcgatctagaaggaactcaactaatcgatctgcaagcatattcttcatattcaagaagctagag

SEQ ID NO: 20352 - DNA, 292 bp, Gossypium hirsutum
  Clone ID: uC-gsflnu33B140g08b1
tagggattgaagcagaagaaggcacacctgatggagatccaagtcaatggtggaacaattgctgacaaggttgattttgcttacaagttctttgagaagcaagtccccattgatgctgttttccagaaggatgaaatgatcgatattattggtgtcacaaagggtaaaggttatgaaggtgttggacgtgatgccattgctaaggcaaatcccgttgttaaagctgataagggcaagaggttctgaaaggggcggaagttgttcgttccgatgcttgttttttagagtcttt

SEQ ID NO: 20353 - DNA, 500 bp, Gossypium hirsutum
  Clone ID: uC-gsflnu33B140g11b1
tttccacgcgtccgcccacgcgtccggaacaagcaaatgcaaagaaagaatttattgagtgcctgaagctgttggaaggagagcttggagacaagacttactttggaggagaaagtcttggatatgtggatgttgcattagttccattttatagctggttttatgcttatgagaagtgtggggacttcagcattgaagcagagtgtcccaagatgattgcttgggttaaaaggtgcatgcaaaaggagagtgtagccaagagtcttcctgaccaagaaaaagtctatgaatttattctgcagttgaagaaagtctttggaattgagtaatttaattcttgggagttgggatccaagctttaggcatgtactaccattatatctggttttaaataaaagggcatttaactgttgcctgcctggatgggacttgtatttgaaatttttgagttttcaatttttaagtacttttaggtcctaaaaaaaaaaaaaaagggcggc

SEQ ID NO: 20354 - DNA, 285 bp, Gossypium hirsutum
  Clone ID: uC-gsflnu33B141a05b1
gtaaatacacttgggcgggagatgggcttgggccgttctagatcgggtttgataatgaggttattgatgttaaggatcctaactttgaagatgccgatgagatcgtgaccgtttgatggtgatcatcatcgacgatcatcgttgcctttgagttttttttatgatgatgatgatcggatgtgtaaatttatagttttatccctgaaaatgaataaatttgatgctaacgcgagttttgttgaagcaaattttcactatgtagaagctgcaaagataactgagagc

SEQ ID NO: 20355 - DNA, 516 bp, Gossypium hirsutum
  Clone ID: uC-gsflnu33B141a07b1
ttccgctgccccacctatggaatgagcgagggctactttacttacggtcaatctcatggcacccacaacggaaacgcaatgtcgaaaccccaatttcatggtcatgggaatggctacggcagccacatgagcaacgggatggctcacactcaagcatatggctctaaccatcacaacagccctggaaaacaccaaggccctgggtatggcagtggctttgggggctaccctcccaaaaaccatggaatgccgcatagcccaccgcaccacggcggcaaactgtcaggccaaggcaacgggttcctgaagccccaagcatacggccctgggagaagcatggcctacggaatgaccgaaaccgaaagttgcgagtaccgcagcgaagtatacttttccaacgagtcacactacaacgacggccgtggataccaccacgctggcaaaagtgaccaccctgtcaagggtctgctaaggaaaataaagggtggcattttacgaataaaagctgtagtgata

SEQ ID NO: 20356 - DNA, 415 bp, Gossypium hirsutum
  Clone ID: uC-gsflnu33B141a08b1
taagagagattcattttctccggctcaggggctctttttacattcgccgcactatcttcttctttagaaagtaagataatttttttcttcttttgatggttgaatttcgaaggcgacgcttggtagctgcaattttagacgtttttactttacgagtttaccttgagtgtttacaattcagattttcggttggttcaatcattccttcgttgaaatttcacgttaacatcgtttgagttcagatcaaagaagattctgtgacaagaaataaaattctgattccgtcagtaaaacgagtggaaagatcttctgaggctgaaattgtcgaatttttctaaagaaaaaaattgaaggaatttattttgaaggttcagaatttcttgaaatctgaagtgaaaaatgagcctccgatctc

SEQ ID NO: 20357 - DNA, 517 bp, Gossypium hirsutum
  unsure (1)..(517): unsure at all n locations
  Clone ID: uC-gsflnu33B141b02b1
ttanactttatttgatttcatcaaaaaaaagggccatttttagagaaatcctccacgttcaagccggtcagtgtggaaaccaaatcggaggcaaattctgggaagttgttagcgacgaacatggcattgatcccaaagggaactacgtcggtacttctcgtgttcagcttgagagggttaatgtttactacaacgaagctagtggtggtcgttacgtacccagagctgttttaatggaccttgaaccaggaaccatggatagcttgcgtactggtccgcacggacaactttttagacctgataacttcatttttggccaaaatggagctgggaataactgggctaagggtcattacactgaaggagctgaattgattgattcggttcttgatgttgttcgaaaagaagctgagaattgtgcttgcttacaggctntcagatttgcattctttggaggtggaactggttcacggatggggacactgttgatattcaaagatcaaggaagaataccctg

SEQ ID NO: 20358 - DNA, 89 bp, Gossypium hirsutum
  unsure (1)..(89): unsure at all n locations
  Clone ID: uC-gsflnu33B141b07b1
tccacgcgaccgccaaagacnacaaagggggcgatttttaaaacggacaggcttagaaacaccccccaagagaagaagaaaggagccga

SEQ ID NO: 20359 - DNA, 297 bp, Gossypium hirsutum
  Clone ID: uC-gsflnu33B141b09b1
taagagcggctgctcagattttgcctatggctcagttttttctctcagtttgaaacgatgcctacggctggcgaagctgcttgttcttacgctgctttaattctctatgatgatggcattcccatcaccgctgagaaaattgcaacaattgttaaagctgcaaatgtctcggttgaatcttattggccaagcttgtttgcaaagcttttcgaaaagtgcaacattgaggatcttataaccaatgttggtgctggtggtgctggtgctccagttgccgaagctgcacctgttgctgct

SEQ ID NO: 20360 - DNA, 493 bp, Gossypium hirsutum
  unsure (1)..(493): unsure at all n locations
  Clone ID: uC-gsflnu33B141b11b1
tctgcctctgcagttttcgggaagatcttattagcgcattttgataatggaaccgattgtgataaatcatttcgagactagatcgatttggagaaggggtttcgatttgatcatgggacagattatttttcaacttctcgggacgttattgttattgtgtcagttatattgttctcgctacaataatacagtaccaacaacacttcggcagtcgatatttccttccgaagagattccactaatcggtgacagatgaggaacttccagtggattcagaagaacaattgccaatgaaatataggacctagtgcacgctttgtgttaactatttttgcttaccgtggacttgtttttaatactgtgccgaaaaaaccatgtaaattgatttttttttatagcttaatgagactgatgtaaaataaagttagaggtgacaaatgnatatccatcccactttaccattttattccactgtaatacttcactataaaaa

SEQ ID NO: 20361 - DNA, 527 bp, Gossypium hirsutum
  unsure (1)..(527): unsure at all n locations
  Clone ID: uC-gsflnu33B141b12b1
ttgtctctgttcataaaaatgggaagaggagaattttttgaaaagcccaccggttaacgccacttctctactcctgaagagatgcttgcgggtacctcatctcgtcctcgcacttttaagcggcaagaagctgcatacaaagaggaagaagaatccgcggaggaatctggacaggagtctggagaagaatccgaagatgaaactgaacaaaagcgcaagggaactcacggtgttattgaggtcaacaatccggatttggtgaagccaaagaacttgaaagctagagatctcgatgctggtaaaactaccgaactgtcaaggcgtgaaagggaggaactagaaaagcagagagcccatgaacgatacatgaggctgcaagagcaggggaaaacagaacatgcaagaaaagatttggaacgcctagctcttattcgtcaacagagagaagaagctgctganaaacgagaagaagaaaatgctgcgagggagcaagatgaggttgaagctcgacatgacattgccttata

SEQ ID NO: 20362 - DNA, 446 bp, Gossypium hirsutum
  Clone ID: uC-gsflnu33B141c07b1
taagcaccaaaaaaagcaacaccctctccttcacggtttttcaacctcgccatggctacactagactccgatgtccccatggtacccgtcggcgagtcttccaacagctccgccgcttcctcttccactaagaaacccaagcgtttcgagatcaaaaagtggagcgccgttgccctttgggcttgggatattgttgtggataattgtgcaatttgcaggaatcacatcatggatctctgtatcgaatgccaagcaaaccaagccagcgccaccagtgaggaatgcactgttgcttggggggtctgcaaccatgcatttcactttcactgtatcagtcgatggttgaagactcgtcaagtgtgtccattggataatagtgagggggaagttccaaaagtatggtcactaaatcttttggactgttttatcagttgaatccacttgcc

SEQ ID NO: 20363 - DNA, 397 bp, Gossypium hirsutum
  Clone ID: uC-gsflnu33B141c08b1
taaaaaaaaaaaaagaaaaacaaaaaaaggggaaaaatagaaaaaaaaaaacggaaagaaaccaaaaaacaaaaaagagaccgaaacaagaggagaaccgggggggggggcggaaagaaccgacgccggggaacgtgcgccagcgccggcagaggagaacccaggggaggccacagccaatcccaggggcggcaaagcacagaaagggaagggggcgaaagccaggaaggccgcagctcgtaggaagccacgagcaactcctgatcatgctgggtacaaagagaaggagaacgaggcaagacggtacttcgaaggagaagacgggaacaagtgaggatggggtcacccacttgcaaaggggagaaacaggaggggcgtcgtggggaattccaagaag

SEQ ID NO: 20364 - DNA, 476 bp, Gossypium hirsutum
  Clone ID: uC-gsflnu33B141c10b1
taagaaaagcagcgtaatgggtgaagaagtgaaggtttttggatactgggcaagcccttacagctacagggcagagcttgctttgaagttgaaaggtgtttcttatgagtacataaatgaggatatctttggcaacaagagcgatttgcttttgaaatacaatccggttcataagaaagtcccggttcttcttcacaacgggaaaccaattgtagagtctcttgttatacttgaatacattgaggaaacttggaagcataatccctatttgccacaagatccttatgacaaagctaccgctcgattctggatcaagttcatcgacgaaaagtgctttcctaccctttggctagctgcatggagcgccgagaatgagcgagaaaaagtgacgaatgaagcttgcgagtatctgaaaacgcttgaaagtgcgcttaatggaaagaaattctttggtggagaaaccattggaatggtag

SEQ ID NO: 20365 - DNA, 506 bp, Gossypium hirsutum
  Clone ID: uC-gsflnu33B141c12b1
cttgctttgttcatcgaccaagatggcgtatgatcattttcaccctgtttgggctacttaccagagagttgtgtggcatcaattattcagcatttggatcctccggagatatgtaaacttgcaaagttgaaccgagcatttagtgctgcttcttgggctgattttgtttgggaatccaaattgccacctaattatcatattcttgttcataaaattctgggttttgtgcctcaaaacttgggtaaacgagacatttatacaaggctatgtcgacctaatacttttgatggtggcaccaagaaagtatggctgcataagagcacaggtggtgtttgtatgtcaatttcttcaaagggattacaaataacggggattgatgatcgaagatactggaatcatattcctactaatgaatccaggttccactcaattgcgtatcttcggcaaatctggtggttcgaagtcaacggggaggtagaattcccgtttccgtgggaacttatagt

SEQ ID NO: 20366 - DNA, 174 bp, Gossypium hirsutum
  unsure (1)..(174): unsure at all n locations
  Clone ID: uC-gsflnu33B141d06b1
ngtcacgcgtccggaaaaggggaaggatcggggggagtttttgaacgtcgccgggttttctccctcctatctgataggactcatgaacattgcagagaagaacctgggtgcgagctccatgtacaagattcaagaggacggaagctaagcaaagaaagactacgagctcgggga

SEQ ID NO: 20367 - DNA, 164 bp, Gossypium hirsutum
  Clone ID: uC-gsflnu33B141d07b1
tccacgcgtccgattcgatggagtggatggagagtgtgtgaaaaatgcaaaatgttggatttaaggatttttgcaataatgttcacccttgtgactgttatattgttgtattcatatatcattgccgagtcatatggaatttgatgtttatggtgcattaattc

SEQ ID NO: 20368 - DNA, 462 bp, Gossypium hirsutum
  Clone ID: uC-gsflnu33B141d08b1
taacaagtcttttttttttttaaactaagttcaagctgtcgatcgaaaatcaagaatccactgtccgtgaaatcaagcctaagaacagaagaatcatgggaggtggtggacctgatgaagaagacaacaataacgagaagtggccgccatggttgaaacctttattgaaagaacaattctttgttcaatgcaagcttcatattgagtctcataagagtgaatgcaatatgtattgcttggattgtatgaatggttctctttgttctttttgccttgcttatcacagggatcataattacattcagataaggagatcttcgtaccatgatgtaataagggtatctgagatacaaaaatatttggacatatctggtgttcaaacttatgtaataaacagtgctaaggtagtcttcctcaatgaaaggcctcaaccaaggcctggtaaaggtgttatcaatactt

SEQ ID NO: 20369 - DNA, 102 bp, Gossypium hirsutum
  unsure (1)..(102): unsure at all n locations
  Clone ID: uC-gsflnu33B141e01b1
ttactctttaagctatatgtgatgttgaatgacaatgttaaccgntgcatattatacataaataggtgtcaaaaaaaaaaaaaaaaaaaaaacacaggaacg

SEQ ID NO: 20370 - DNA, 511 bp, Gossypium hirsutum
  Clone ID: uC-gsflnu33B141e02b1
attatcacaagccaatgcaaaggaccaaaggatccatttgaaagttgttgttctgcattcaaggaatatgcttgtccttatgcagaacagatcaacgacttgacgaccgaatgcgcttcaaccatgttcagctacattaatctttacgggaaataccctcctggtctttttgctagtgagtgccgtgaagggaaagaagggctcgcttgccctgccttatcgccatcagcatcagcatcggagaatgctaatggtagtcaacagctgatacgtaatccttggatgctggtaatggccgcaatcatagctgcagctatgttgttatgaaagcctggaaatgaattccgattattccattgtttgatttttatataatatttatattattttcccacttttaacgctgaagaagagtgcagtattttgatttcatacaccaggttctttcttggtgcattcttttatttgtacttgaaatgttgtagaaataatatacttcatttggtttgcg

SEQ ID NO: 20371 - DNA, 110 bp, Gossypium hirsutum
  unsure (1)..(110): unsure at all n locations
  Clone ID: uC-gsflnu33B141e04b1
taagtaagagcgacgaccggaaaaagcccgttcgattttcgccgtgcggatcgtttttctaaacaccttcctncgatctcatttcttgtttcgtgaaacaatcaaatatt

SEQ ID NO: 20372 - DNA, 409 bp, Gossypium hirsutum
  Clone ID: uC-gsflnu33B141e10b1
tcccacgcgtccggcaaggcattgaacattacgggttggtttgtcgatgatttcctctctcatttgatgtgctgttgttgtgccctcgttcaagaatggcgagaagtagagattcgtgggatttacggtcctgagaagactaaaacaagccctccaccatcacagttcatggaatcatgagtgaaaaaagtactgaagagacattttcttgggaggtttgtatcaaagctgaacatagaaggtaactctagttgccacttaccagattgaacctgtactaaaagattgcttttctctttgaacctacatacacgtatatattgtccttgtatgtaaattagcgaaattattaatggagattcggcacatgttgttgtaggagaaactgattttcatttagcattgcggt

SEQ ID NO: 20373 - DNA, 412 bp, Gossypium hirsutum
  Clone ID: uC-gsflnu33B141f02b1
cttccctctcttttcagtttcccgatcaacacaacatgtttttcgatggttttgtctccgacaataccaaagacatgcaaacccttgctctaaacgaaccaccgccatcagctgctgacatcgatcattgggaaagagctaaatgcaaggccgagataatggggcaccctatgtacgaccagttgctggaagctcatgtcgcctgtctacgtgttgctacgcctgttgaccagctcgctcagatcgatgctcagttagctaggtcccaagatgtgttggctaagtactcctcggccgctgctgccgccggttctgctgaagaagaactcgatcacttcatggcaaattatgttctattgcttggtctcttaaagacccaatgcacaacatgttcgtgtttatgcaatggaag

SEQ ID NO: 20374 - DNA, 349 bp, Gossypium hirsutum
  Clone ID: uC-gsflnu33B141f03b1
tttatcaaaatgagctgcaatggctgtagaattcttttaaaaggttgcagtgttaattgcatgcttagacaaagcttacaatgtatagagaacccacaagctcaagcacacgccaccgtttttgttgctaagttctttggccgtgccggacttatgtcatttctctcctccgtcgccagtcctcaaagacctgctttgtttcagtcgcttttgtttgaagcagtgggacgggcaattaatccggtgagtggagccggggtgttgttatggacagggaactggaacgtctgtcagtcggcggtacaaacggtgctccaaggcggcacgttgcagccgttgcctgaattta

SEQ ID NO: 20375 - DNA, 152 bp, Gossypium hirsutum
  unsure (1)..(152): unsure at all n locations
  Clone ID: uC-gsflnu33B141f04b1
ntccgtcacgcgtccgctacgaagaacccagaccggtcctttttgaaagtaaatcatgtttacgaagcagcctgtgattcgttggttaaaacttaaaattatgcgtggcaggtggttgtacatatttaagtggtaaggatggttgttttatc

SEQ ID NO: 20376 - DNA, 125 bp, Gossypium hirsutum
  unsure (1)..(125): unsure at all n locations
  Clone ID: uC-gsflnu33B141f07b1
taaaaaaaagacactgaaaaaacagtaactcacagaggtcctcttttctgctttaatgtattctaaagggcattgagtagtttgtttggtttttttttttnccgccctctcgtctcaaacttcgg

SEQ ID NO: 20377 - DNA, 126 bp, Gossypium hirsutum
  Clone ID: uC-gsflnu33B141f08b1
gcctccctcgcgtccgaaaaaaaaaaaaaaaagggggattttttaagaaatttccttttattattccccaaaaaagggagaaaaataagggggggtggctgcctcttttcgcgtcccctccccccc

SEQ ID NO: 20378 - DNA, 330 bp, Gossypium hirsutum
  Clone ID: uC-gsflnu33B141f09b1
ctggaatggatctcagttctttatttgtaccgctaataccgagtggcttgatgtgatgcatgtggtgtttggtcaagttgttgaaggtatggatgtggttaaagccattgaaaaagtcgggtctagcagtggaagaactgctaagcctgtcgctattgcagattgtggacagctttgttaagaacaagaacacgaacaagaaatggaataatgttgactctggtctatgaatggagaatcatgactgaaatttattcattatatgtcgtattactttgcagtctcctgcatctgcctcatatttgtttcttacaaccaacccatccataa

SEQ ID NO: 20379 - DNA, 543 bp, Gossypium hirsutum
  Clone ID: uC-gsflnu33B141g04b1
gtaaaaaaaagtgataatcaacttgtcagaaggaagttgatatgggaagcgagtcataccaggaagccattgcagctttgtcgaagcttcttagtgacaaagctgatctcgggagtgtcgccgccgcataaatcaagcagataacagacgagttagaggcagctgccgagtcccactcagttcgacccggccaagccgctcgcgaccggcttccttcacttcacgatcgaaacactttgtcaccaaccctgacctggaccgtgcacttgccaaagggcaaccgccctaactcttctggtctcctgcttccccccactccccctctcgctcccttcccccctcccgccatcctccccctttgccacgctcccccccatctgcacccctcttctcccttccccccccccccattccttgaacttactctccaacctccccctctatccccatccccctaccttatctcctcctccaatccccccccatccctctttccctctgtacaactctccctctccaccctcccctctctaccccccctcc

SEQ ID NO: 20380 - DNA, 221 bp, Gossypium hirsutum
  unsure (1)..(221): unsure at all n locations
  Clone ID: uC-gsflnu33B141g05b1
ncggtttcttgtgctgatatccttgttctgtctgctagggatggcatcgtttcgttgggaggcccttatattcctctcaaaactggaagaagagacggtagaaggagcagagcagatgttgtggaggagtatcttccggaccacactgagaccatctctggcgttctcgacaggccagccgacatgggtattgacacccctggagtcgtcgccctcctagg

SEQ ID NO: 20381 - DNA, 438 bp, Gossypium hirsutum
  Clone ID: uC-gsflnu33B141g06b1
ttgctatcgtagactcggagttcaactccaaacaatcgtcactgatttccaaaggatttctaaaatccacgatcgtgtctttctcggactctctggccttgccaccgatgctcaaacattgtatcaaaggcttgtctttcggcataagttgtatcagctaagagaagagagggacatgaaacctgaaacttttgctaaccttgtttctgctcttctttacgagaaaaggtttggtccatacttttgccaaccagtaattgccggattgggagatgaagacaagcctttcatttgcaccatggattccattggagcaaaggagcttgcaaaagattttgttgtggctggcactgcctctgagtttctttacggtgcctgtgagtcaatgttcaaggaggacatggaacccgaggaattgtttgaaacggtttcgcaagc

SEQ ID NO: 20382 - DNA, 298 bp, Gossypium hirsutum
  Clone ID: uC-gsflnu33B141g09b1
ttcacgcgtccgggagaagtgatatatgtgagtatagttttaatgatgaagagttcaaacaactataagggctattattattctctgggaatgagcagattgatgctgtgttaaggagcgaggatgaaacatacctctggttctgattcgcaaacatgtccatatgttctttcaacggagcggaaacaagtatagagtgcgatccagaccgatacgcgaatggtggactatctgctccggttcaatatccacgaacgatttgtgaatggtttgcttgcctcagctcctggcggacgga

SEQ ID NO: 20383 - DNA, 464 bp, Gossypium hirsutum
  Clone ID: uC-gsflnu33B141h03b1
ttatgcgtccgcacaagccggcgagggaaggaaaactggagagggagaaaaatgccagctggtcacggtctccgatctcggaccagggatctgttttccagacccttcagaaagaagggttacatcccattgtccacttatctcaggacctacaagattggtgactatgtggacgtcaaggtaaatggcgccgttcacaagggcatgccccacaaattctaccatggccgcactggtcgtgtctggaacatcaccaagcgcgccatcggcgttgaggtcaacaagcaggtgggtaaccggattatcaggaagaggattcatgtcagagtggagcatgttcagccttcaaggtgcactgaggaatttaaacggagggagataaagaatgatcagctcaggcagaggccagggaaaaggtgaggggattagcacaagaggcaggctgaggcccaaacctggtttat

SEQ ID NO: 20384 - DNA, 384 bp, Gossypium hirsutum
  Clone ID: uC-gsflnu33B141h04b1
ttcacgcgtccggaaataaatggtatttggttgtatgtttcacatgaactcgcgtaggttgcgaatctttttagcaggattcttactgcatactcaaaggttccccagaagtcaaaggcaacatcaacaaaaggtgagtttgaagaactggaagctgtctcaacaatggccatcatggatggtcccttggagccatcatcatcaactgcacccagtgtcgcagatgtccctgatgaccctgcctttgtgaatttcttcagtacagctatgaccattggaaatgcttcaaagacatcgaattttggactaccataccaatgttttgactaatggtctggacctttgaacccacccattgttgcgtaccctacagtgcccgctttt

SEQ ID NO: 20385 - DNA, 234 bp, Gossypium hirsutum
  Clone ID: uC-gsflnu33B141h06b1
ttctcagcttcaccgaccggccattgaatgggttccattactttcaaagactgacagtagttactgggtagaggtagcggaatttgctagcgtatgtagaagacagcccgatatgcttggcagaacattacgcaagtcttttctgagaggacactctatactgaggagattaaacgagctgtggttccaaggatcaagacggtgcagggaccccagcccagctctaatatatgg

SEQ ID NO: 20386 - DNA, 391 bp, Gossypium hirsutum
  Clone ID: uC-gsflnu33B141h10b1
tccacgcgtccgacttcccaacatatcttgggaggccctggaaggaatactcgaggactgtggtaatgcaatcaacaatcagtgacgtgattcaacctgctggctggcacgagtggagcgggagtttcgccctgaaaacactgttttatgccgagtaccagaacactggggccggtgcctcaacttctgcgagagtgaaatggggagggtacaaggtgatcactagtgcaagtgaagctcaggcttttactcctggcaggttcattgctcggaggaagttggttaagctctacaggctttcctttcgctcttgggtttgaataattttaaagattgtattgtcaatgtagccacctacctacttcattggttgggtttgagatttgctttg

SEQ ID NO: 20387 - DNA, 468 bp, Gossypium hirsutum
  unsure (1)..(468): unsure at all n locations
  Clone ID: uC-gsflnu33B142a01b1
tttcggtactcagcagaaatgcaaggcttgtgagaagaccgtttatccggtcgaacttttgtcggctgatgggatcccttaccataagtcttgcttcaaatgcagtcattgcaaagggacactaaagttgggtaattactcctcgatggaaggtgtcgtttattgcaagcctcatttcgagcaactgttcaaggagtcggggaatttcaacaagaatttccagtcacctgcaaggtcagctgagaagttaactcccgagctgacaagatcacctagcaaagccgccagcatgttttccgggacacaagaaaaatgtgctacttgtggcaaaactgcttatccactcgagaaggtaacagtggaaggacagtcgtaccacaagtcatgtttcaaatgctctcatggtggctgccctataactccatcaaattatgcagcacttgaaggcatnttgtattgaaacatcac

SEQ ID NO: 20388 - DNA, 372 bp, Gossypium hirsutum
  Clone ID: uC-gsflnu33B142a06b1
tcttactcattcggtcatctccgtgtaagcttagacacaaaacctctatgtgtaggattagaatcatgggtgcatgtgagatatgagtttgaggtaacctacccaattgctacagcacaggctcatcaaggcttttgtttttgaagctgccaaggtttgcaccacggatggccgttatgcagtctagagtgttgagctcgaatgtgatactagtgctggaagaattgtaaagatcacctttgatgaaggctctgccataccaatatatgatgcaccagaatgagggacacgacgaaaacaagttttcatacagccacagtatgattgaaggtgggcctttaggggacaagcttgagaacataactatgagaa

SEQ ID NO: 20389 - DNA, 453 bp, Gossypium hirsutum
  unsure (1)..(453): unsure at all n locations
  Clone ID: uC-gsflnu33B142a09b1
tctcncgttcattttctttgtcttccttatttgtcgatctcgatcgagggatcgtgttgtccttgatgatcgcttgaagaatcgataagaggggcgtcgattttcagttaattattggtggaaggaaatagaagcttaaataaatttcgcccacttaagtttttttcttttttggcggcggttaacttgttaaggttcggtaaaaggggatttttcttttcaaaagatcgagttgtttttagttttaatgatgttagccttaactgctgggttttgaagtgctatggaccttgttgttacaccgcaataaagatgacgctttacattggtcgcgaagcttcaaagttatggaagagaatttgttcagagacaactacagagatcaacctttttcttgataactggaaataccttcttgctggtctcatctttcagtatattcatggtctagct

SEQ ID NO: 20390 - DNA, 421 bp, Gossypium hirsutum
  unsure (1)..(421): unsure at all n locations
  Clone ID: uC-gsflnu33B142a11b1
tctgttaagattgaggctgtgctggattggaagcagcctaagaagtgtctgagatccgctgctttctgggcttagtaggttattatcggtggtttgcggaaggtttttcattgattacaacgcccttaactaagccgatactgtagcaccccaaacccggcccagacgttatgaccggatccgacatgcgttcaaaacattttatattattggtccagaaaaaaacttacttagtgctttaaaggataatttcattataggttaaagtgaatggaagctgtgcaccaggtaggaaaccggaaaagaggtggtgagtccatcggactgcttaagtaccaagctccctttggatccaatcctagacatgcttaccgncattgccacaccttaacgtcgtggatatttttaggaaaccgatttg

SEQ ID NO: 20391 - DNA, 511 bp, Gossypium hirsutum
  unsure (1)..(511): unsure at all n locations
  Clone ID: uC-gsflnu33B142b04b1
tccacgcgtccgcccacgcgtccgcccacgcgtccggaaaaagatatgttgacacccttaacccttttagtaccgccggcatctcctccttcactgttttccttcaatcgcttctctcatttcccattctctacctccatctccgccaccaccacctccgcctctgacagatttattgagagtagtatctagaagacttgttttggcaaccaagacgcagtcaataacgaccatggcaagtctagaggaagaatgtaaggggaatctgaaggcacagttagcaaaactatttgaagtttcacttaaagtaacagttccgaatgaggcagatgttgacccattgatagctgcctgcactggcaaatttggtgattcccaatgtaataatgccatgggcctttggtctaaaatcaaagggaagggtactcaatttcgtgggcccccagctgtcggagaggcaatcaagaataatcttnccacctcttgaatgatagattcatgctctgtagct

SEQ ID NO: 20392 - DNA, 485 bp, Gossypium hirsutum
  unsure (1)..(485): unsure at all n locations
  Clone ID: uC-gsflnu33B142b07b1
tctctccgtcgccccctggaaaaaacaaagtgttgttatttgcatcatcatcattatcatcttaatccaccatttcgggttaaaacttgtatgggctaaaaatgggtatcaaaattctaaatccatggtggtttcggttattgagaaaccatttctcctgtctccaccgccacctccaccaccaccaccatcaccaccacgagccgcctcgaacgatcaaggtcatcaactgtgatggggtcgtcaagatctacgaccgtccggttcatgtttccgagctattgatcgagttccctaagcacatgatttgccgttccgattcgttttacataggccaaaagatcccgcctctttccatggacgacangctccacttcggccacgattacttccttcttccttcacaggctttccagtcagctttatcgttcgtcaccatcgcctctttcgccaacgccagatattcgtcgtctcgggaatcggga

SEQ ID NO: 20393 - DNA, 505 bp, Gossypium hirsutum
  unsure (1)..(505): unsure at all n locations
  Clone ID: uC-gsflnu33B142c02b1
tgatagaatagctcagttggagctttcgttgcgctgctcccaattgcttctgccctgttttaccctcccaacccgaaagccacctccaccctctccctcccaacatcaaacagaaccgccccttacattatcctacttctgtcccgtcaatttttctgcttgtttattgtttaagctctaggaaaatcgaagaggccttatagttttcgagcaggaactagggatctgacaaggtttttgatctcaaaattttgacaaggttgcctgtctcaagatttccttgatctccatcctttctggataaagccaatcccaagtgaaaatctgcctcctggttttgatcctgttgaaggttgcaagcttaattctttgcctctggaagggacctttttttgaagcaatgtangaatgggatagcaatgtatggtggtgggattattctttcttaatcaattatataatatatgaatttgattccgtttaattaaaaaatttattttgattt

SEQ ID NO: 20394 - DNA, 135 bp, Gossypium hirsutum
  Clone ID: uC-gsflnu33B142c03b1
ttttttttaggtaaatatatatacttaacaaatatggatataatgaagatcaaaccagaaacattcattgatccatttttattatgaatcaacctaagccacaccccaatactgtcccaatcatcatcattacct

SEQ ID NO: 20395 - DNA, 59 bp, Gossypium hirsutum
  Clone ID: uC-gsflnu33B142c04b1
ataataaaaaaaaaaaaaaaaaaaaaaaaaaagaaggttgtacagatatagaggtttca

SEQ ID NO: 20396 - DNA, 273 bp, Gossypium hirsutum
  Clone ID: uC-gsflnu33B142c06b1
ataaccgctcggacgagattataaaagggggggcgattttcaaaaaagagagcttaagaggccaaaaaacggaagaagaaaggccggggcatactgaccgaccaggaagagcatcatgaacgcgactgaagcaggaacgattgatggggaaccccgaaaaaatgaatcagcaccgggtatagcgcaacgagagacaggtacagaccggtttagggaagaaaagaaactcggagaagaggccgatgtggcccacggacgggaccggcaagaggc

SEQ ID NO: 20397 - DNA, 432 bp, Gossypium hirsutum
  Clone ID: uC-gsflnu33B142c09b1
tcccacgcgtccgggctgttcttgggaaggaaattgtcgttgacaagggcaatatactacatggtgatgcagtgcttgggagccatatgtggggctggtgtggttaaagggttcatggggaagacaaggtatggtgctttgggtggtggagctaactctgtgaatcatggctacaccaagggagatgggcttggtgctgaaattgttggcacctttgtgcttgtttacactgtgttctcagtcactgatgccaagcgcagggccagagactctcacgtccctattctggcaccattgccaattgggttcgtaatgtttttggtgcactttagccaccattccaatcacaggaaccggtatttacccagcttcgtattctttgggcgccattattttcaaaaggtcaaaggctgtgaaaaccattggattttt

SEQ ID NO: 20398 - DNA, 387 bp, Gossypium hirsutum
  unsure (1)..(387): unsure at all n locations
  Clone ID: uC-gsflnu33B142d11b1
tgctcacgcgtccgggggatgttgcatgtgggtgactatgacataattgagtaccttaaccgttacaaaggccttattttaacatgtaacggtcttgggattaggcaatcaatttggtaaactcaagctggaggaactgaggttccttatgttcgttgtcataatgctcaaactgagacacccagatttgtgaatatcacaaaaacagcacagttgaggatgagaagaagcttggatgtattacaaggctatgttatatctttggttggngtatagtgaagtagaagaaattcacataaatctgtaacaaatttatgctttgtccggcttatttgggtatgaccaatttgttcactggatgcttgcaacttgtaaactttgagggtt

SEQ ID NO: 20399 - DNA, 478 bp, Gossypium hirsutum
  unsure (1)..(478): unsure at all n locations
  Clone ID: uC-gsflnu33B142d12b1
ctggaaaagtcctcctgttcataattaatagttgtcgatcttggcgcggtgaagggatgaagatgttcactcagttgcacttctcgtatgaacaagagagtcatcccgaggagttctttattccatatgtttggcaacttgtcctatcccgctgtggattcagttttaacgcagatgctataactttgttccccgtcggtatgcatgccaataaagaaatttactatgatgaaatgaatacgaaccaaaacggggagttgaatgaacaaagggttctgtttgatccgtaaaaagaaaagaaaaaaaaggcattttataccattagcttgtgcttatgcatgtacgtttgtggtgtattctgtaaatacataaaanaatgataaaaatagcagaaaatgtattcttggtaattcttttctggttatatatgtttgaaacacttgagaggggcccttttttgaagtagattaatttttaa

SEQ ID NO: 20400 - DNA, 315 bp, Gossypium hirsutum
  unsure (1)..(315): unsure at all n locations
  Clone ID: uC-gsflnu33B142e03b1
tcngtcacgcgtccgctttccaagacaaagcttggtattattttttttagttccgactaaagaaaacgaaaaaaaaagaagaagaaatacaatcgttttctttttgaagtcgggttttagtttttggggtgaaaaaaatgttgggagtatttagcagtgcgatagtgtattcgtcggactgagctggttgcggacggttgccttattccatcacctaagatatctttggtctctcttgagaaacggtttcttgtgacgaattctttttgtgcgttcatgctcatttgtgatcttgttcattttttataatttttc

SEQ ID NO: 20401 - DNA, 181 bp, Gossypium hirsutum
  Clone ID: uC-gsflnu33B142e09b1
taccacgcgtccgcccacgcgtccggccgggtgttgtttattgatttttctttttttctgacctttatcctttgattaatgagaggtgatgatgatttggcattctttttccaccagaatgaattttgctttagaaatagtaatactttgtgagtgtctgcgttcattttaatgtattaaa

SEQ ID NO: 20402 - DNA, 399 bp, Gossypium hirsutum
  Clone ID: uC-gsflnu33B142f01b1
tatcagcagtcaagcatgctatcacccattaatacaaatttttctcctaaaagtaaggagcatccgctattgcaggtgtctctatctggtaggatgtctcctcggaatgtggaacctatctcgccgatgagctctcgagtttcaatgttagctcaacttgagaaacagcagtttcgctgtctaagctctagggaacttggctctgactctcctgccagtatttcttccccagtaaattcttggtcaaaatggggatcttccaatgggaagcccgattgggctgtcaatgcagatgagttaggcaagcatcatgcttcatttgagctcagcaacggagatgagcccgatttatcatgggttcaaatccttgtttaggaatcttccactgagatgaaagag

SEQ ID NO: 20403 - DNA, 249 bp, Gossypium hirsutum
  Clone ID: uC-gsflnu33B142f11b1
ttgtgatgtagtgcaactagtggagtgctgggcgtattataccctcttctcatggcggctttcctgggcgtcggtgatggggttttgaacacgcagctcagtgctttgcttgctctactttttaagcacgacacggaaggagcgtttgcagctgaaggtgtggcagagttccgcgattgcagtcgtgttctttttgagcccagttgtgacatttgcacacaatggtggagatcatggctggtgcgattt

SEQ ID NO: 20404 - DNA, 281 bp, Gossypium hirsutum
  Clone ID: uC-gsflnu33B142g02b1
gtacatcccttgtcagccaccatcatgtgcgaatattcaaacaagaaaactcgtggagcatttatcgctgctgtgtttgcaatgcaaggatttgggattttaacaggtgggatcgttgcacttatcgtgtcggcttcgttcgatcatgcatataaggcccctccatattcggttaacccaaaagattcgactgcgcctgaagccgactatatttggcggattatactcatgttcggagcttgttctgcgcttctaacatactactggcgtatgaagatgcc

SEQ ID NO: 20405 - DNA, 467 bp, Gossypium hirsutum
  Clone ID: uC-gsflnu33B142g09b1
tcttttacttctacattgagtttccttttgtgaaattactactcgctttactccattaaggaaaattattatttcgatcgttcaaaactgggagaattcatcgctcaatcattctcttatattttggaaagtttacttgctgtttgtgttgagcattggtctgcaatgcaacaaactaccagcatcttgagcagcagcagcatgtctgtttgaagattgaaccagaagcaacttttttgtttaaattttgtatttttgtgatgttaacaagttggcaagtagcttgatatctaaagctagtatttttagatttgaaattgatggatgtaacagctgaatttttcagcttttctttttgaatattttagttggcaacttgccaaattgggaggagcagtacagtttaaggaactgacttatatatttttgaaccccttatatttcgaatggaatgcaagctggggttt

SEQ ID NO: 20406 - DNA, 142 bp, Gossypium hirsutum
  Clone ID: uC-gsflnu33B142h04b1
tatacacaaacgaaaattaaagagaagaaggggaaatttagaaaacaaaagagtatacaaaaaaaaaaactaaaaagaagaagggggggctcgtatttaaaggatccaaggtaagaaacgcttgcatgctgcgtatgatata

SEQ ID NO: 20407 - DNA, 264 bp, Gossypium hirsutum
  Clone ID: uC-gsflnu33B142h06b1
tagtttctaccgccgccgttggcttctctttgatcgtttcccttcttgctttcttcaagcattaaattgaagggcttgtttggctctcctctctgtgtggctttcttttatatatatatgtatgtgtgtatgtatttatgataccattctttcttcgttaaatttattgtaatgaagttgattctttgaataaaatgcttccgttatgatttaaaacaaacaaaaactaacatatatcaaacatcactcttaacctcactacag

SEQ ID NO: 20408 - DNA, 401 bp, Gossypium hirsutum
  Clone ID: uC-gsflnu33B142h08b1
ctcctaataaagataacagatgccaaacttgcagaagattttcaagcagttttgaaagagtttcagaaggctcaacggcttgcagctgaaagagaaacttcatattccccttttgttccccagtcagctcttcctgcaagctacactgcaggtgagatggatgcaggttctaataaaagtgctgaacagcgagcccttcttgttgaaagaagacaagaggtcgtgctgttggataatgagattgcatttaatgaggctatcattgatgaaagagaacaaggaattcaagaaattcagccagcaaattggtgaggtgaacgagatcttcaaagatcttgctgtgctagttcatgagcagggaactatgattgatgacatcgggacccatattgaaaattccc

SEQ ID NO: 20409 - DNA, 57 bp, Gossypium hirsutum
  Clone ID: uC-gsflnu33B142h10b1
tggagccaagcccaagaaaaaaggaacgaggggaagaattgacaaggagtctataac

SEQ ID NO: 20410 - DNA, 188 bp, Gossypium hirsutum
  Clone ID: uC-gsflnu33B142h12b1
taacgatcgagccggttttctttttattattggattgaattctttcttatgatctaaaacttgctatagattgactcttgttagcaacattgaaaatcttatcgtaggtgaaactttgcacagactgttttatgtagtttaattgtctaacttgttcgaaaatgcaactgtgaaatgagtctcacttt

SEQ ID NO: 20411 - DNA, 149 bp, Gossypium hirsutum
  unsure (1)..(149): unsure at all n locations
  Clone ID: uC-gsflnu33B143a01b1
gtcttaacatgaacctcaggttatagagacagggaactttttatcattcaaaatggaggaatggcacattgctgttccattcttttgcattttaaaaaaaggagnaatataacaggaagagaccacaaaaacacaaaaaaaaagaaacc

SEQ ID NO: 20412 - DNA, 565 bp, Gossypium hirsutum
  Clone ID: uC-gsflnu33B143a02b1
gcgctctcacgtgcgcccacacgtccgcaacaaaagagggatggtgaggattctaggggggtcattctgcccaaggtccatgctgacctgcatgtgaccgataagatgatgctcaatgaatctttcatatttcctcacaacacaccaactacaaaagaagcatattactacaggatgatttttgagaggtttttccctcagaactcggctagattgactgtccccggaggagctagtgtggcatgcagcacagctaaagctgttgagtgggacgctgcctggaaaaacaaccttgacccttcgggccgggctgccttgggggttcatctctctgcttatgacgcagagactcccctcagcaacaagccatccaaggttattgatagtataccacggatggactttcctggagttgccatacagagttaatgcctgcctactggaagacaacagaatgtatgaattatttaatacaatgagtaggagctgtggcatgtccaaatgtatgaagtatttaatacaatgagtaggagctcgtggatggccataaacttcccaatacatt

SEQ ID NO: 20413 - DNA, 262 bp, Gossypium hirsutum
  Clone ID: uC-gsflnu33B143a04b1
tgtattttcaatttcgagtgccggttcaattgcgtgagactcatttatatataaaaatgtagtttgctgctctgacttttcatttgtactcttggatattctgtgagctcttttgaaactcttcaaagtgtcttcttctatgttctttgcctgtcttcactaaaaaccagtctgttgtatccaagtaatgtcctttaatcgtggtctgtgatatgaatgagaatggttgtctaataaactgaagagaaccactgaaagaacc

SEQ ID NO: 20414 - DNA, 132 bp, Gossypium hirsutum
  Clone ID: uC-gsflnu33B143a05b1
ttaattcaagtactttgtgttgctttatttacgcgaggtttatttcaaaaataaagggagtaaaaccaacaagaaacattaaactaagcaattatgtactagcatttaggtgttgcatagaaatttaaaacg

SEQ ID NO: 20415 - DNA, 584 bp, Gossypium hirsutum
  unsure (1)..(584): unsure at all n locations
  Clone ID: uC-gsflnu33B143a06b1
ctctttcgtccgatttatgacatccttgaaccggggtaccatgatcctacttcacaactaagctcaaaaggaaacaaaagcttgccagttagcttccaacaattaggggctacatcgaagcctcttccggtgaggactcggattttcggtcgtgcttggccgtttcgagcaccggttaaggatggtatcgtccctttatggcctgaactagcgcaaacgaacagccgcgatgtcccctgtttcaatgatgaagttgcgacgctatggttgaatgatgcaaaagttaggcaagctattcatgcccaaccggaaaatgtatccgggacttgggagttatgtaccgatagaataagctattaccatgatngctggagtatgattctgtaccatanaaccctaacactccaaggttatcgagcacttatttacagtggagaccatgatatgtgtgtgccatacactggaacccaagcctggaccaggtcactcggatataagactattattccatggagatcatggatgtctaatggccaagtttctgggtacttgcanggatatgaccatgacattacctttctaac

SEQ ID NO: 20416 - DNA, 525 bp, Gossypium hirsutum
  Clone ID: uC-gsflnu33B143a07b1
atcaactgccatcatggatcttatagaatcacgctgggaagagttggtcggagaaatgccgttaaaggtttgttatccagccatggaaactcatgaatggcggattataacaggatgtgaccccaaaaacacccggtggagttaccacaatggaggatcatggccagtgttactatggcttctcacagccgcttgtgtgaagactggacgtccccaaattgcaagacgtgccatcgaaatagccgaagccaggttgctgaaagaccattggccagaatattacgacggaaagctgggccgatacatcggtaagcaatcacgtaaagctcaaacgtggtcgattgctggttacttagtggcgaagatgatgttggaagacccatctcacttaggtatgatagcgattgaagaagataaacaaatgaagcccattttgagaagatcatattcatggactttatagaaaaaaaaattgtagcttttgactcactgacctgttaagtagaggggtttaaaaaaaaagta

SEQ ID NO: 20417 - DNA, 506 bp, Gossypium hirsutum
  Clone ID: uC-gsflnu33B143a09b1
tttacgcgtccgcccacgcgtccgcactgccgggcataagaagaaccaaactgagaaccatgtggcggcagtggaaaatggggtgtcgggccgtatatttctgaagaaaagacgtggtgctgctaaaacagaggatgacggcttgcaatgctgcagcgagactggagctggtatagtaaggagaaagagccctgttatctatgaatgcctgagcatggagaggacagacctatatcttgacccagcatactactcatcttgctctagtgggatcacacaggtgtcagatgataacgcggatgacgatgaagaaagcaacagttgcactagttatccttattttagaagaaaaccttaaaaaagccacactcacacttttgatttcttgtctatatcagtagtggagctctgaggatcccttcataataataacctctataaagaaaaagcaatcaagatgttggtaatttcaagtctttgggtctgttttgtctgtgattactacg

SEQ ID NO: 20418 - DNA, 242 bp, Gossypium hirsutum
  Clone ID: uC-gsflnu33B143b01b1
atgcagattatatgagaatgcatgatcactcataagcttatcacccatttattttctattttttattctatctttcaaacatcatttgtattattggattattagtaaatgcgactgcttaatttggtaagatgtaattagtcattaataaatatgttgtaaattccaacaaaaaaaaaacaaaattaaaagagaaactgaaaaaaactaagacaagaattaactataaaaaaacaagaaaa

SEQ ID NO: 20419 - DNA, 507 bp, Gossypium hirsutum
  Clone ID: uC-gsflnu33B143b03b1
cctacgcgtccgtccacgcgtccgaaaaaagcggggcatttttagcaaagttacagttgtcctcatcgaacaactatggcagccatcaaagtccacggaagccctatgtccactgctacacagagggttcttgcatgccttcacgagaaaggtactgattttcagttggatcccataaacatggctgccggtgaacataaatccgaaaactacctttgcctcaatccattcggtcaagttccagcttttgaagacggggacttaaagctcttcgagtcaagagcaatcacccattacattgctcatgaatacagcgacaaagggacccaactcttaatccctggctctaacaaggatatggctgtcttagaattatggaaggaagtggaagcccaccagttcgattctccatcttcaaaaatagcctgggaggccgtttacaaggcatttttcggcatggttaccgacttcgcggctgtggaggaaaatgagggaagcttggcaaag

SEQ ID NO: 20420 - DNA, 401 bp, Gossypium hirsutum
  Clone ID: uC-gsflnu33B143b07b1
tttacgcgttcgcccacgcgaccgcccacgcgtgcgacttgcggcaggtgttgagtcatcaaatggctcttagcgaccaggacattgatgctctttctggtggacacaccctgcgaaggtgccacaaggagaggtatggattcgagggaccatggactaccaaccctcttatctttgacaactcttacttcaaggagctctagactggagagaacgagggcctgatacagttgccaactgacaaaggtctcctttacgaccctgttttccgtccattggcgcgacaaatatgcggttgaagaggatgcttgctttgctgattacactgaagctcacctgaagctgtgtgagctcggaactgctgacgcataggctgctgactgcaaacactggaagaagcc

SEQ ID NO: 20421 - DNA, 472 bp, Gossypium hirsutum
  Clone ID: uC-gsflnu33B143b09b1
ctcacgcgtccgaaaatccaggaaaacccgagttcagaaacgaaaacaagattgctattttctttcattttgggaattaatcaagaaaatggagacggtgatggaagatgaagagtacaattacagagaagtaaatttgccttcgctgatcccagtagtcccagagccagcactagagagggaaacaggggagagaaggagaggccgagatatactcattgctattgatcacggtcccaagagcaaacacgcctttgattgggctcttattcacttcctcaggcttgctgataccatccatcttgtccatgctgtttacagtgtcagaaacgatgtggtttatgaaactagtcaagctcttatggagaagttagctgtcgaggcttttgaggttgccatggtgaggactcaagctcgaatagttgaaggtgatgctggtaaggtaatctgcaagggagcagagaggttgaag

SEQ ID NO: 20422 - DNA, 99 bp, Gossypium hirsutum
  Clone ID: uC-gsflnu33B143c06b1
cttacgcgtacggtgggactacgatgataaaagggggttcttgaaaatgaatagggatttccacaccacgcgtgcgtgaacacgtgagagaaatatgct

SEQ ID NO: 20423 - DNA, 505 bp, Gossypium hirsutum
  Clone ID: uC-gsflnu33B143c09b1
taatattttccctttgatttcctgcctagaaggtaacactcacacagtttcaggaaatggatcttgacgacgacggaggcacctctgatcttagcaccagtgctggagaacctaacgctgccaccgagaaaatttgtgaaaactcagcgtttcagattatgctatttaaagaagagccaatagactcccaccctctgccgcttatcggggtggtccctgtttccatgcggcctctacccactgttaaacgctcctgcaccaaggaccgtcatacaaaagtcgagggccgcggtcgaagaattcgaatacccgccactttcgccgccaggatcttccagctgactcgtgaacttggccataaatctgatggagaaaccattagatggctccttgaacatgctgaacaagctatcagaaactaccggtaccggcaccgtttctgccatcgctgtcttagtcggtggtaccctttaagatttcccacaacgtttggttaaaacgcttt

SEQ ID NO: 20424 - DNA, 97 bp, Gossypium hirsutum
  Clone ID: uC-gsflnu33B143d05b1
ctacgcgtacgatcagactatgatgatcaaacggggttcttgcaactcaatacttatttccactccatgcgtgcgtgaacacttcaaagaaattgct

SEQ ID NO: 20425 - DNA, 495 bp, Gossypium hirsutum
  Clone ID: uC-gsflnu33B143d11b1
ttttggctcatatagatatagagccagcaatacccgaagaagaaacgacgtcgaattcccttatacgaaacactcgttgctgcttctgtttcccttgcttcagctcccgtcgtacgcctgccgttggcgtagccttttggcagcggataggttcgtcccacgtccagtccgatactggcttctggtcctcaagtgttagagccttcaagaaggttcgagagtggtccgagatcgtcgccggcccccgctggaagacttttatcaggagattcaaccgtagcaaaagtgggggcggaatcgtctccggcggtaggcatggacaattccattatgatcctttgagttacgctttgaatttcgacgaaggcccgggacagaatggtaatttggaagacgataatgatttcggtgcctttcgggctttctcacacccgtacgcttctgttcccggttcggagaaaacaccattggcgtagatgacgccgagtggatcat

SEQ ID NO: 20426 - DNA, 469 bp, Gossypium hirsutum
  Clone ID: uC-gsflnu33B143d12b1
tagatgcgaccctctcatcatcacattcactggatttaggcttcctctttttttgttttttttttttcttttataagtctcaaagaaacttagaccccttcgtattctccgctcataccccaaatccccataccccttctgttcaacagcaaagatggcaactgtgcgagttacctcctctagtatcgttcaagcttcgatcccgaaccgattcacgagtgccattgtcaaggccccgacttctcttggatcttttaagaacatctccaaaccttttggcttgaaatgttcctccaatcacaaaacatttatggcagcttataagattaagcttgtaggaccggatggtgaggtgagcgagtttgaagcccctgacgatcaatacattttagatgcagccgaggaagcaggagttggactgccatactcttgccgagctggagcttgctccacatgtgccgggaagatg

SEQ ID NO: 20427 - DNA, 508 bp, Gossypium hirsutum
  Clone ID: uC-gsflnu33B143e01b1
ttttcgcgtccggttttcttttaagataacccggaaaaatgtgtggaggtgcaattatttccgatttcgtcgccgtgaaacatgacccgaaattgaccggcgatgacctttggtctgaaattgacatattctccgacctcctaggtttcgacaacaatggcaaaagctttgtcaatcatcagtttcataacaacaacaagaagctgatcaatccaaaagacaatcaacttaacaaagagagaagcgagacgattcagaagacaagccgagtcactaaaaatgttgaaaagactcagcgaactcggaaaaacttttaccgaggaataagacaaaggccatggggcaaatgggcagctgagattagagaccctcaaaaggcgtccgagtttggctcggtacccataacacagccgaagaagcggctcgagcctacgatgaagcccgcaagcgtatccgtggtgataaagccaagctcaacttcccttaaacgcccaccaaaaatcaagca

SEQ ID NO: 20428 - DNA, 300 bp, Gossypium hirsutum
  Clone ID: uC-gsflnu33B143e03b1
gtcaggaatgaaaagcatagaggaaaaaccatcctcatgtccgttctcttctttctttttcctttttggtttaaaattttttattatttttattttctttgatgttcttttatttcctttttcttttgaaatttcaggaatttgttgcgaaacctgagtcattattcctggtaagttaaattttctatttagttcctataattttttttccattattggttcaataaatcgggcgcgtttgtctattattttcacttcttggcaattggacactggtgtggtcttttaaatctataattt

SEQ ID NO: 20429 - DNA, 424 bp, Gossypium hirsutum
  Clone ID: uC-gsflnu33B143e10b1
taaagctctgacaccattgacaacgtcaaggccaagatccaagacaaggaaggcatcccaccagaccagcaaaggctcatctttgccgggaaacaactcgaggacggtcgcaccttggccgattacaacatccagaaggagtcgaccctccatttggtattgaggcttcgtggtgggatgcagattttcgtcaagacgttgactgggaaaaccataactttggaggtggagagttccgatacgatcgacaatgttaaggcgaagattcaggacaaagaagggattccaccagatcagcaaaggttgattttcgctgggaaacagttggaagatggaaggactttggctgattacaatattcagaaggaatccactctacatcttgtcttgcgctttgcggttggttctaagttctcctatgaaa

SEQ ID NO: 20430 - DNA, 416 bp, Gossypium hirsutum
  unsure (1)..(416): unsure at all n locations
  Clone ID: uC-gsflnu33B143e12b1
tacgggttttgggctaggcaaattgggtgtatggggcttctgaggcccgggcataatcgggattgtacaatgtgttaattgattcttaaatgttcataataaccaattataaaanaaaaaaaaaaaaaaaaaaaaaaaaaaaaaaaaaaaaaaaaaaaaaaaaagaataagaaataaaaaaaaaaaaaaataaaaaaaaaaaaaaaaaaaaaaataaatataaaaaaaaaaaaaaaaaatgggggggcctttttaaaagaacaaaattataacaccggggaaagccagccaaaaattttttttaaggggccccaaaaataaatacaatggcccagtttttaaaaaagttagtagggaaaaaccctggggcaccaaaaaaaaatcctttaaaaaaaaatccactttcaacagtttgg

SEQ ID NO: 20431 - DNA, 389 bp, Gossypium hirsutum
  Clone ID: uC-gsflnu33B143f02b1
gccactggaatcgtgctcggaggcgtgcttggcattgatgactgtcatattcttctgggccatgcatgataccgacttcttctcggacaaatttggtgttcgatctctacgggaacgagagcatgagatgatgggcgctttatacttacaagtgagcattgtgagccaggctctgatcttcgggactagatcgcgtagctggtcgtacgctgagcgtcccggactactattggtcactgccttcatcattgcacagcttgttgcaactttgattgctgtatatgcaaactggggatttgcaaggatcaaaggaattggttggggatgggcttggtgtcatatggctctacagtatagttttctacgtaccattggatataatgaagttc

SEQ ID NO: 20432 - DNA, 432 bp, Gossypium hirsutum
  Clone ID: uC-gsflnu33B143f06b1
gtaactcctgttgatgaccagtctgcaccagtctgcaccattctacattaccattggagatggaggaaatcatgatggacccgctataggcatggtggaaccacagcccagcttctcagcctatagggaggctagttttggtcatggtatattcgatatcaagaacaggacacatgcctatttcagttggcaccgaaatcaagatggatatgctgtcgaagctgattctttctggtttcacaacagttactggaatcccttagggaaatcctttgtagctcaatactaataaatcattcatccaaactagttcttacaatatagtagtagttaaactgtaacgtgcctctgtccgtcatgaaagaaaaatatatcttggattttaagatcagtgtgaacataaattgtcagcaggaaaaattattaatactt

SEQ ID NO: 20433 - DNA, 429 bp, Gossypium hirsutum
  Clone ID: uC-gsflnu33B143f07b1
gtgaaaaacccagagccaaaaaaaaatggccaaattattgctgttcattgcactatttgtggttccatgtcttgttagtgctacacgcatggtgaagaacccgttggtggttcaaggtcaagtttactgtgaccattgccgtgctgggtttgaaacaccaaagactagaaacatggctggtgccaaggttaaggtggtatgttccaaccggaagaccggtgatgtcgtgtacgagaaggaaggacacacggactcaaccggacaatacaagatcgctgtctccgaggatcatttggatgagatctgtgacgctgttctcgttaagagctcgcagacggagtgcgctgaaatgtcatcaggacgtgaacgtgcacgcgtggtcttgaccaacttcaacggcatttcatccaacacccgttttgccaacgc

SEQ ID NO: 20434 - DNA, 396 bp, Gossypium hirsutum
  Clone ID: uC-gsflnu33B143f09b1
ttccttctggatgagaagccagagaagagttggtaaatttggtaatcttaccccttagcttgaattaagaaaagggctaaggatgctaacaagttgataattttccttttttaagtgtataaaagttggacgacaaattaaagcacaagcgtacgaaaaagcttgtgtcatgtgcagtgtttgcttttcagctctggacactccatggtaagtaactagagatgtcgaaaattaaaacgaggcagaaagtgttatctttgtttgtagagcaagaaaattggtatgaataaggcggagcatgctgctaagtatcggaattttcttcgcagctgtattgcatttactaataaccttggctaatatttcctattgggtcctttctttcttaaactgtta

SEQ ID NO: 20435 - DNA, 502 bp, Gossypium hirsutum
  unsure (1)..(502): unsure at all n locations
  Clone ID: uC-gsflnu33B143g04b1
tttacgcgtccggctttggctaaaatataaggacattatattaaaacaaaagaaaaatgggtggaataggttcgattgtgttccgacccagttgttttagtaattacaagacacctttcaaataacattcttcaaattcatttgattttgaagaaagaaaccaaaagaaaaaaaaaagaaaagaagaagcaatgcctgatgtaaactcaggcatacaagtttgtgtttgctttcatttagacattcatattcctgcaacttgtgggaaacctgtttgctgtaagacaaatctcaatttgacctcgaaatggttctgggaaatatgtatgttcccagcacgacaatgtttgtgtcttttggttttagttaaattaactttatgcanatnaaaaaaaaaaataacaaaaaaaaaaaaaataaaaataaaataaaaaataaaaaaaaataaattatttaaaacttatctttttaatttttaaactatttaaaaatttaaaggggg

SEQ ID NO: 20436 - DNA, 382 bp, Gossypium hirsutum
  Clone ID: uC-gsflnu33B143h09b1
tgttaccctccatttctctctgccaccagcgggacccaaagatgcaaatcttcggcaaaaccctaacggggaagaccataaccctagaggttgagtcttccgacaccatcgacaatgtcaaagccaagatccaagacaaggaaggcatcccacccgaccaacagcgcctcatctttgccggaaagcagctcgaggacggccgcaccttagccgactacaacatccagaaggaatccaccctccatctcgtgctccgtcttaggggaggtgctaagaagagaaagaagaagacctacaccaagcccaagaagatcaagcacaagaagaagaaggtcaagctcgctgtgctacagttctacaaggtggatgaatcgggtaaggt

SEQ ID NO: 20437 - DNA, 447 bp, Gossypium hirsutum
  unsure (1)..(447): unsure at all n locations
  Clone ID: uC-gsflnu33B143h10b1
ttttagcagtaccggtttcaccagctatgggtatggacttggtcgccggcggcaagagcaagaagacgaagagaactgctcccaagtctgatgatatatatctcaagctccttgtcaagctttaccgttttctggtaagaaggactggcagcaaattcaatgcggtgatcttgaagcggctatttatgagcaaaaccaacaagcctactttatctctttctaggttgattcaattcatgaagggcaaggaggataagattgctgtggtagtcgnggctgtcaccgatgacattcgtgtgtatgaagttcctgcgctgaaggttactgcgttaaggttcactgaaacggccagggcaaggattgagaaagctggtggngaatgtttaacatttgaccaacttgctcttcgagcacctcttggacagaacacggntctcctccgaggtc

SEQ ID NO: 20438 - DNA, 431 bp, Gossypium hirsutum
  Clone ID: uC-gsflnu33B143h11b1
gtctattgaatgggttccctcactttctcgaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctggcaggtctataattatggctctgtctgtgccttgggtaatagaagctttgtttggtgtgaaaataatgtataag

SEQ ID NO: 20439 - DNA, 243 bp, Gossypium hirsutum
  Clone ID: uC-gsflnu33B144a09b1
tattttcgtctattcacttttatgtttttaggaaaatttgaataatcttcattgctgtctttgatttcatgttgttcattgcaaggcatttgtattgctgctgtactcttttgatgctttaaaatgtgacttatatgggtctaagctcccactgaaatgaggttgtctttgaataaaaaaaaaaaaaaaaaaaaaaaaaaaaaaaaaaaaaaaaaaaaaaaaaaaaaaaaaaaaaaataaaaa

SEQ ID NO: 20440 - DNA, 421 bp, Gossypium hirsutum
  Clone ID: uC-gsflnu33B144a12b1
gttgaaaaactatgatccccaaaaagacaagcgtgtcagtggttccgtgaagttgccacacattcctcgacctaaaatgaagatctgcatgcttggagatgcccagcatgttgaagaggcagagaagataggtttagattatatggatgttgaagcactgaagaagctaaacaagaacaagaagttggtcaaaaagcttgccaagaagtatcatgcttttttggcttctgaatctgttatcaagcagatccctcgtctcctgggtcctggtctcaacaaagccgggaaattcccaacccttgttactcaccaagaatcgctagagtccaaagtgaatgagaccaaggcgatggttaagttccagctgaagaaggttctttgcatgggaagttgccgtgggaatgttgcgatggaggagaag

SEQ ID NO: 20441 - DNA, 489 bp, Gossypium hirsutum
  Clone ID: uC-gsflnu33B144c02b1
gccctctctgctcgtatcctctcaaaatctcgccagctttgtggtagtcaatctattctacaaaaggagaataccattcctgttcgtttttatgccaaagaggctgctgctcccattgctaataagggagatgagatattgaaaaatatctttttggaggttaaggcaaaatatgaggcggcattgggaatatttaggaaggagaagatcaccattgacccagatgaccctgctgctgtttctcagtatgcaaaggttatgaagacagttaggcagaaggctgacttgttttcagaatctcagcgcatccagtacaccatccaaacacgaactcaggacattccagatgctcgaacatatttattgatcctgaaggatataaggatcaagagaggactcactgatgacctttgtgctgaggctatgatgatgaatgctttggataagtcgaaaagaaatcaagaaccttttttgagaatgacaagaaat

SEQ ID NO: 20442 - DNA, 435 bp, Gossypium hirsutum
  Clone ID: uC-gsflnu33B144c07b1
gttttacttaatttttcattattttccattggtaacgaagttttattttattttatttatttaattttttttccttctctgccatgtcaatggcgggggagacggggatggagcaattaacgtcgggagcaagcaatcgtataatccccatcttaagaacgctaagaataccgctcattttccttcaatcaataatactgtatctcctcctcttcctcttccctcgccgacgccagacggcggtcggagctgccgatgaggcgccgcagttgcaggctaaaaccgcgaggcggaggtcggtatggaggcgggaagaggaggacacgttgagaaggagagctttagcggagggttgggacatggggttcgaaaccgcccgacggagaggtccggtgtcgatggggcacgtccctgttttttggggtccgaagaaat

SEQ ID NO: 20443 - DNA, 466 bp, Gossypium hirsutum
  Clone ID: uC-gsflnu33B144c11b1
ccctcgcgtccgcccacgcgtccggagcaagtacaggctaggttatggagtggatggagcagaggaaaagagttcttcctcatcttatgtttcacgccttgaaagtaaatataagccgggttatggagttgacaaagatgagtatatgcaatctccgtcaaggattgatcatcataacttggaaaacgacagagatgatgacataggaagtgaagatgtaggtgtattcaccatagatgatgtacatgctttcaacgtagggaggaaattgagcactttctttttcatcaggaacaactctctttatcctggtttcttacctaaagaattagccgattccatctcattttcatcatcagaaattcccaaaattctcaagttcttttctattcctgcagcctcacagaaagccaaagtcgttaaagatacaattaggaaatgtgaactcgaacccgtcaaaggggag

SEQ ID NO: 20444 - DNA, 371 bp, Gossypium hirsutum
  Clone ID: uC-gsflnu33B144d08b1
tacatataacctctgccctaccctcgggagcgccggtttcggaacgtttgccttgcgctcagaagacatcaacccgcgtccaccgccgccaaactcgctctccaaaagctttccgagctcagcgaaccgcaacctctcgagtcaaaaagaccaaagccacaggcaaccaccagacacaatggccgacgccgagcacaactatgtcttcaacgtcagcatgtcctgtggcggctgctcgggcgccgtcgagcgcgtgctgaagaagctcgagggcgtcaagtcgtacgaggtctcgctcgacacgcagacggccaaggtcgtggccgacgagtcgctgccgtacgagaaggtgctcaagacgatcgccaaga

SEQ ID NO: 20445 - DNA, 504 bp, Gossypium hirsutum
  Clone ID: uC-gsflnu33B144e04b1
ccctcgcgtccgcccacgcgtccgcccacgcgtccgagaatttgcttcctttccttcttccattattttctctcgtcaaagttctcaacttttaactctttttcaggatgggcagtactgatggaaccagctatggtgcttacacctatgatgctctggagagggagccttactggccatctcagaaactccggatttccatcactggtgccggtgggttcattgcttcccacattgctcgacgtctgaagagtgaaggccattacatcattgcttctgactggaagaagaacgagcacatgacagaagatatgttttgtaatgaattccacctcgttgatcttcgagtcatggagaattgcttgaaagtttccaaaggagtggaccatgtcttcaaacctcgctgccgatatgggtgggatgggtttcattcagtcaaaccactctgtcattatgtacaacaacactatgatcaagttcacatgcttgaggctggtaggatta

SEQ ID NO: 20446 - DNA, 505 bp, Gossypium hirsutum
  unsure (1)..(505): unsure at all n locations
  Clone ID: uC-gsflnu33B144e11b1
tatgcttaataaggaaaatttagggttttatttgaattatgggaaaatggcgatgaggaaagtttacagcgagataaaaggtatgaaattgaaggaagttcctggttacttcaagccgatgctatctatgggttacttgaagaaatctgttcagaggggtttggacaattaccatgctaagtacattgagactgattctatcgaacctctctaccatgtctgtttcggtgggatgatcttttcttaccttgttgctcttcccaacgagcgtcgccacctcgagcacaagcagcatgctgagcaacacggtcatcattaatcccatctagctttaaagatggttcggatcgttgttgtgcccttctcagttttatccggtaacaattcgatttgcttaatgctttntggttgtaatttgtgaacaatgtacgcagaggaagatgcttgcttgatcaaatgcaaaaataaaagagtacaattttcttaaaattagtgaaagactttt

SEQ ID NO: 20447 - DNA, 465 bp, Gossypium hirsutum
  Clone ID: uC-gsflnu33B144e12b1
tggtactggaaaaggtggagaatctatttatggggctgtattcgatgatgagataaggtccgagttaaaacatactggagctggtattttatctatggctaatgcgggtccgaattcaaatggaagtcagttcttcattactttatctccagcgccgtcattagatggtaaacacacaatatttgggagagtatgtaggggaatggaaattatcaagaggcttggtagtgtccaaaccgacaacaatgacaggcctattcatgatgtgaagatcctacggacttcagtcaaagactagcaccggagttcggaaactgcgaattgtagttctatgaaatgcccatcgtttccccggatattttgaaattggatcattcataaacgtgttatataccttgtgttagagttatgtttagtataaactgagcagaaacaattaatgaacggcatttcttttagggttta

SEQ ID NO: 20448 - DNA, 480 bp, Gossypium hirsutum
  Clone ID: uC-gsflnu33B144f01b1
cgataattcatagcaggcagtcataaaacacttcccatttagctatagcatttcaagctgctttgcttcgttgcttttttcaattcaaggtagtgctgccatgattctgaatggctttacctttccgttgaggtctgtttcggtgagttcaaggcttcataagcctgtgccgtgtagctctagttttgcatgctctcatcatttggctaccacagctctatttcgaagcagcagtgaatctggagatgtgcctttcttgcgcctttctgctgcatcatctccattgttgagtggggatctaggtggtctatcacaagctttaccgtcattacctaagcgtcgtggatctaatttggtgccttgagcttaaaggatgtcccgtaccagtttcgtttttcaccgatgactaaaaaacccaaatggtggtggaggactttagcgtgcctttcttatttaatgcctcttcacgagacgtggatg

SEQ ID NO: 20449 - DNA, 385 bp, Gossypium hirsutum
  Clone ID: uC-gsflnu33B144f02b1
actacgtttacatcctgagcggacgccctctttgggccgcagtcaataccgctacttgtcgctgagatttcgcatgaaagatctcagacctcaaagcggagcgctcttttatatcacagacatggctttgatcttgcatgctggcacaacaaacataaatgcctttaacgcactcattgctgcagaacataccggcgtgcacgacaagatggatgtgaataatgagatgggggggtgaaacacgactcctgagtgcatcaagacgaaccctacggggaaggatcctgtggcgggaacaccggaggcaccggcagttgagagcaatggcagtgctgcgattgaggctctgttaaaggctaacaaccctatatgcggggctacattg

SEQ ID NO: 20450 - DNA, 445 bp, Gossypium hirsutum
  Clone ID: uC-gsflnu33B144f03b1
ccctcgcttccgaacaatggttactttccggtttcaccagtaccaggttgttgggagggctcttccaacggagaacgatgagcaccctaagatttacaggatgaagctttgggccaccaatgaggttcgggccaaatccaagttctggtacttcttgagaaagctgaagaaggttaagaagagcaatgggcaagtccttgccatcaatgagatttttgagaagaaccctaccaagatcaagaattatggaatctggctccgttatcaaagccgtactggttatcacaacatgtacaaggaataccgtgacactactttgaatggagctgttgaacagatgtacaccgagatggcttctcgtcacagagtcaggttcccttgcatccagattaataagacggggaccatcctagctaagctattgcagcgggacagcacgaagcag

SEQ ID NO: 20451 - DNA, 484 bp, Gossypium hirsutum
  Clone ID: uC-gsflnu33B144f06b1
ccctcgcttccgcccacgcgtccggccggtttgggggacttgtgcaggtcttatatttttggcaaacaaagctgttggacagaaagacggaggacaggaattagttgggggtctgaattgcactgtccatagaaattactttgggagtcagatccaaagctttgaggcagagctcttagtgccagaacttgcctcccaagaaggtggccctgagacatttcgtggtgttttcatccgagctcctgctgtccttgaagtggggccagaagttgaagtgcttgctgattatcctatcccatcaaataaagttctatattcaagttcagctgttgaaattcaagaggagtctgccgtgcctgaaaagaaagtgatagttgccataaagcaaggaaacttgctggggactgcttttcaccctgagttgactgcagatacgagatggcatagttactttctaaagatggtaagagatgttggagaggga

SEQ ID NO: 20452 - DNA, 404 bp, Gossypium hirsutum
  Clone ID: uC-gsflnu33B144f08b1
tttaatcgggaatcgtaggtgtttacttgaacagccttgacaaaggaaagaaagatttgtcgtcacataaatggtcgtaccaggttggtttaaaaggagaagcaatgtatttggccttaccggaaggagtctcatccgttgaatggatccaaggttcactggccacacagagtcgccagtcaatgacctggtacaaggcatattttgatgcaccaacaggtaacgaaccattggctttggatatgcggagtatgggaaaaggtcaagtatggatcaacgggcaaagtgtaggaagatattggatggcgtacgggaatggtgagtgcagtaagtgtagttactcggggacgtaccgacctacaaagtgccagagtgggtgcgggcattcaacacaaagatggtac

SEQ ID NO: 20453 - DNA, 479 bp, Gossypium hirsutum
  Clone ID: uC-gsflnu33B144f11b1
tatttctgtgatgattactacaaatacatgtatccatgtgcccctggagctcaatactacggccgtggtgctttgccaatttactggaactacaactatggagctgctggcgatggtataaaagttgatttgttgcaccaccctgagtatctcgagcagaacgcaactattgccttccaggctgccatctggaggtggatgaccccaatcaagaagaaccaaccttcagcacacgacattttcgtgggtaactggaaaccaaccaagaatgacacagaggaaaaacggggtcctacttttggctccaccatgaacgttctctacggagattacacttgcgggcaaggcgatatcgatcccatgaacatcatcatcctccattaccttcattaccttgacttactaggtgtttgggcgagaggaagcagggccacacgaggagcttagctgtgccgagcagaaagcatttaacccaaccc

SEQ ID NO: 20454 - DNA, 436 bp, Gossypium hirsutum
  Clone ID: uC-gsflnu33B144g07b1
ttcctcgcgtccgatttgaggaagatgttactgagagaggacgtctctaaggttcttggaattttgaaggtttcagcggcaattggctttgatgctggggttctttcttgcttggagtacttggaagccgcgccgtggacggaggacgaagaagaaaaagtggcttctttattggcggagctccgccttgaaaacgtgggagctggggaagttttaaagagggtgtctattgaagctagcaacggaattgatggtggcgataatgaagaagtgcttctcaagcttttgcatgtggttcttcaaggcaaagacgaaaaagcaaggcgtgaaatgaaagaattggtgttgaagatgcttcgcgagaatccctttcagaacgatctccgggaagagtctttatactccgcttgtgacggctgtcttgaactgcttaacg

SEQ ID NO: 20455 - DNA, 428 bp, Gossypium hirsutum
  Clone ID: uC-gsflnu33B144g12b1
ctttggagctccaaagcttagtattgtgagaatctgtccactaaattccggtcatggattcttctgatttcaccgaatcaatgctagatcagctccccatggaaagattttgggacattcctttgtaccaatgggatggattttggtacagatcttatcatctccaagcaacaatggctcttcgttcccagtacatcgcacgcgacgacgacatcatcctcgcatcccccatgaaaaccggcaccacttggctcaaagccctttgtttttccatccttcaaaaggacggaaacgccgctcgccttaatggagaaacggtaggcaagaccgaggaagacgatccccgtcacatccgtgacccgctcgtcgacaaccatcccgccgtctacgttcaaaccttggaagttcaagttttcacggcgaaacca

SEQ ID NO: 20456 - DNA, 414 bp, Gossypium hirsutum
  Clone ID: uC-gsflnu33B144h08b1
tccgttcgtcgccatggtgaagtttctaaagccgaacaaagctgtcattgtcctgcaaggccgatacgccggacgcaaagctgtgatcgtaaaatccttcgacgacggcacacgtgaccgtccctatggccactgtttggtcgcggggataaaaaagtacccgagcaaggtcatcctcaaggactccgccaagaaaaccgccaagaaatcgcgcgtcaagtgcttcgtcaagctcgtgaactaccagcacctgatgcccacacgatacaccctcgacgtcgacttgaaagacaccgtcacagtcgacgcgcttcagaccaaggacaagaaagtagccacttgtaagactatcaaacaaaggctggaagagaggttcaaaacaggaaaaaacaggtgggttctttaccaagctta

SEQ ID NO: 20457 - DNA, 347 bp, Gossypium hirsutum
  unsure (1)..(347): unsure at all n locations
  Clone ID: uC-gsflnu33B144h09b1
tctctatagtgttaaaaaagaaagattgaaacttaataatagcccttaaatgtgtgcttataggtatcttgacactaaggcaataataattattatatttttgacgatncacaatagctntcctatggccaaatgataaaaaaaaaataaatgaaaaataaccaaagccaggctataatatataacacacccaagaaaaccaaccagaaaaatgcgcatacaaaagccttttatatactctaacctaaataaaatcaaatgccctaactaataaaacctcgacgacaataaaaacgacaccgtcacacaacaaaaacttcatacaaaacataacaatgtcgccactt

SEQ ID NO: 20458 - DNA, 461 bp, Gossypium hirsutum
  Clone ID: uC-gsflnu33B145a01b1
atccgactttctcatcatcacattcactttatgtaggcttcctattttttgtcttttttcttttttttgtataagtctcaaagaaacttagaccgcttcgtattctccgctcataccccaaatccccataccccttctgttcaacagcaaagatggcaactgtgcgggttacctcctctagtatcgatcaagcttcaatcccgaaccgattgacgagtgccattgtcaaggccccgacttctcttggatcttttaagagcatcttcaaatcttttggcttgaaatgttcctcctatcacaaaacatttatggcaggttataagaataagctttgaggaccgaatggtgaggtgagcgagtttcaagcccctgacgatcaatacattttagatgcagccgaggaagcaagagttgaactgccatactcttgcccagctggagcttgcttcacatgtgccggg

SEQ ID NO: 20459 - DNA, 389 bp, Gossypium hirsutum
  Clone ID: uC-gsflnu33B145a04b1
atttcggcctagacgtacgcttacgtttccggattttgatgcttatagttttaagattattggggcatctgatgaacagcttgatgtatttaatgaagtctggtacactatgttgctgaatactggacaagttaccaaagcaattgaatcaatcgagaaacagataccgaagagggaaggggctcctttcctgtggcgtctgctggagaaaggttataagctgactggcaggcaggaagcctcgactattggtgagagggccagactgttggagacagcatatttcaactagcctgaatgtgcactagtagctacatatatgatatagcatttgtattaggaacagattgaatcaccgtttagtcaccaccgtaatgaaactagaatgt

SEQ ID NO: 20460 - DNA, 449 bp, Gossypium hirsutum
  Clone ID: uC-gsflnu33B145a11b1
taaagtttgatgctcctgcgcgtgccggtcccgaatcgcaggatcgacccagacctacgcttacgcttacaagcgcaatatcccagaatgcatggctgctacaagtgtcaaggcttcagcctcctccattggatgctacagcagagcaacctgctatctttgatggaacaataaggatgtatctggctaattcttgaccttacgcacagcgcgtgtggatcgccagcaattgtaagggtatgcaagacaaggaaaaaaaggttcctttgaaccatgcaaatatcactgtattggtgcaaggaaaaagtcaaccctgaacacactgagccgcccttggaacataatggggacttatcatactgagtctagatcagattcaataagtatgccgataactaagggagtcagctcttctaactaatgattgtctcgaaaatgacaatatagca

SEQ ID NO: 20461 - DNA, 483 bp, Gossypium hirsutum
  Clone ID: uC-gsflnu33B145b02b1
tttcaattcaagcccaccaaaataatgaccacttcggtgcttctatctcttttattcagctttgtagtacttgcctcagctgccaactttaaccaagacatcgatgttacttggggcgatggcaggggcaagattctcgaaaacggaaaccttctcactctcaccctcgacaaattctccggctctggttttcaatccaagaaccaatatctgtttgggaagatcgatatgaacattaaactggtcccaggcaactctgctggcactgttaccacttactatcttcgttcggaagggtcgacatgggatgaaatcgacttcgagttcttggggaacctaagcggagacccatacatagtccacaccaatgtatatacacaaggcaaaggtgacaaagagcaacagttctacctctggttcgatcccaccaaagacttccacacctactccctttttggaaccctcacgtattatcttctctgt

SEQ ID NO: 20462 - DNA, 355 bp, Gossypium hirsutum
  Clone ID: uC-gsflnu33B145b07b1
tttagctgtggttcaacctaagggggctcaaacctggtgggacacgtattgtatgttcaaaactactttgcttcaaaaaatggaggggaacgagaaaactaattgtggtgactggatgatgagtgcctgaattttcttattgtcattctttataacttgttctagggtgagaggatgaaggagtgtttctacttaaaaggaagtgtcattggaagaacatgcccatgtgattctccccgatgtatggctgcttcatgtgatgaagcctaagttctgactgctggcaagactagcttatgggatggtagggacggaaatggaaaatggcagaggtgtctttataggaacagaaaac

SEQ ID NO: 20463 - DNA, 83 bp, Gossypium hirsutum
  Clone ID: uC-gsflnu33B145b08b1
tttcgttgtcatccatggagttgcagcaaccaacagctagtggtagcaacaagaatggtgaccatgaatcacagtcacagatg

SEQ ID NO: 20464 - DNA, 395 bp, Gossypium hirsutum
  Clone ID: uC-gsflnu33B145b11b1
tttcgttttcactttcttataagcaaaccacaaaggaaagcttggagagagaccccaaaacaatgtctaaggaagtgagtgaataatgacagggacctaaggactatgtgcacccttcaccggaacctctgattgttctggttgaactgaagttatggtctttttacagagacctcatagctgagttcatagtgcactctcctactgctctatgtgactgtcggtaccggaattggacacaagacacagcaaaatgcatgtgatgggataggtctattgggatttgcaatgggctttcggtggcatgagatctattcttgaatactgcactgacggtatctaaggtggacacattcacactgcgctgacaattgagtcgtatttggcccagaaag

SEQ ID NO: 20465 - DNA, 444 bp, Gossypium hirsutum
  Clone ID: uC-gsflnu33B145c07b1
tcgttttcattggcaagcaacaatcatgggaccctcagatagcccttatgctggaggtgtgtttttagttaccatccatttccctccagattatcctttcaagccttctaaggtcacgtttaggaccaaggtcttccatcctaacatcaacagcaatggaagcatttgtcttgatatcctcaaagaacaatggagccctgcactaaccatttccaaggttctgctctcaatctgctcgttgctgaccgatccaaaccctgatgaccctcttgttccggagattgctcacatgtataagactgatcgggccaagtatgaagccactgctcgtagctggacccagaagtatgccatgggatgacagtggttggtgtgtaatacctatcagctttcttatgtgttttggggaaggaagggggtgtttttttttaaagtaacttgtca

SEQ ID NO: 20466 - DNA, 483 bp, Gossypium hirsutum
  Clone ID: uC-gsflnu33B145c08b1
gttactttgaatcttttgagagcctttgctactggaggttatgctgctatgcaaagggttactcagtggaatttggatttcaccgaacacagtgagcagggggataggtaccgtgaactagctagtcgtgtggatgaggcccttggattcatggctgcagctggacttacagttgaccatcctatcatgacaacaactgaattctggacttcccatgagtgcttgctcttaccttacgaacagtcacttacccggcttgattctacttctggccgttactatgattgttctgctcatttcctgtgggtcggggaacgaacaagacagttggatggtgctcatgttgagtttttgagaggagttgctaatccccttggaattaaagtgagcgataagatggatccgaatgaactagtaaagctgattgaaattttgaaccctcagaacaaagctggaaggattacagttatcacaagaatgggt

SEQ ID NO: 20467 - DNA, 65 bp, Gossypium hirsutum
  Clone ID: uC-gsflnu33B145c11b1
ggcccacgtttacattttctcgtgggatgggatagacaggaatttgcaacaagaggtctggaatg

SEQ ID NO: 20468 - DNA, 463 bp, Gossypium hirsutum
  Clone ID: uC-gsflnu33B145c12b1
tcgttgttttgtcatcgtctttttccaatgtcatgaaaaaccagccctaacagagcagctgaacctaacatcatcatcatccatggcggcaccgatctggctatgggctttctctgtagccctaactctggtcccgtctgtttttggaaactctgaaggagatgctctttacacgttgagaaaaagtttgaccgatccagataacatactccagagctgggatccgaaccttgttaatccttgtacttggtttcacatcacttgtaaccaaaataatcgagtcactcgagtagatttaggtaattccaacctgtctggacatttggtacctgagcttgggaagcttgagcatttgcagtatctggagctttacaaaaatgacattcacggaaccatcccaactgaacttgggaaccttgaaagccttattagtttggacctatttaacaacaacatttaagga

SEQ ID NO: 20469 - DNA, 463 bp, Gossypium hirsutum
  Clone ID: uC-gsflnu33B145d09b1
tccacgcgtccgggagaagataagctgaaggaatttataaacttcacattgcattatattgctgacttggatatcccgataaaaagggggacattcattgaattccgaagtgggatgcttaatgtatctccgattggacgtaactgtagccaagaagaaagggatgaattcgaaaagtacgacaaggttcacaatattcgcctgaaaatggtgtctgtacttcgagaaaagtttgctcaccttaacttgacattttcaattggagggcaaataagctttgatgttttccccgagggctgggacaaaacatattgcttgagatatcttgaagagtttcaagaaatccacttctttggggacaaaacttacaagggaggtaacgatcatgaaatttatgaatcggagagaacagtaggacacacagttacaagtcctggtgatacagtgaagcaatgcaaagctc

SEQ ID NO: 20470 - DNA, 483 bp, Gossypium hirsutum
  Clone ID: uC-gsflnu33B145e07b1
tcgtttttctaggatgtatgaggtgaaggacccaaattcgatctttgtgttcaagttcaggactcattttggcggtggcaaatctactggatttggtttgatttatgattctgtcgagagtgcaaagaagtacgagcccaaatacaggctgatcaggaacggactcgataagaaggtggagaaatcaaggaagcaaatgaaggaacggaagaacagggctaagaagatccggggagtaaagaagaccaaggccagtgaatcagcgaagaagaagtgaggtaagatgcccggaacggaaaaaggcgaggatcgcgcttatcttaaagccgatgtttctcgagagcgatgcataagtcgtctgaagtttttaggtgttcttgaacctatatttttggaaactgcgtttggagctatttgattatttagttatacgctacttattagatctgattatcctattctgaaatatttagagttatgcag

SEQ ID NO: 20471 - DNA, 469 bp, Gossypium hirsutum
  Clone ID: uC-gsflnu33B145f04b1
cattattttcttccccagtttgaaacatcttaaatttcaatctatggacgattggcaagagtggaattatggacacctactcactacaatgccacttctttgttctttgaaaatcaatagttgcctcaagttaaagtctttgccacgccatcttcttcagaagacaactctgcaagtattagatatcttcgattgcccgatcctgacagagcgttattcgagaaatgggacaggggaggactggcactacatttctcatatccctacgatcacaattgatggtgaagacgtgaaaagagatgggaattgatcaaactcttcttggcttcaaagcattgggatgcaattagtgaaaaacgagcaaaaagaggccaaattgaagcacaaatcattgagttgtggccaaatcataaagatgggaaggccaaggacttaacatcaaaatttgactttgtaaatagctaaaaat

SEQ ID NO: 20472 - DNA, 406 bp, Gossypium hirsutum
  Clone ID: uC-gsflnu33B145f08b1
tttttgcattctactgcctccattggatttgatcttcacttccgctcgcaaattgtggttttcttggtatagcttggattgccttatctcatttgccttttttcatgtcgtggataatatctgattgtttgcaagagtgactttttaggctccacacctcctagcgtcactggctttggcaatgtatcacatgtagtagtcacggagagttggactaggcagggcaacattcttttatttgggtggcatgtatctcatctcagttgcgttgatattttattagtccttgctataggttggtaaacaaggttggttgctgtatatggtttgcatttgttcgaacataatggataattcatggtttgagcaatatatatatctaaaaacttatatctgtgtgtgagtc

SEQ ID NO: 20473 - DNA, 375 bp, Gossypium hirsutum
  Clone ID: uC-gsflnu33B145f12b1
ttcgcgcgtgcgctgatgctctggaggaatgaaggttactaacgcgtgcaggcactgtcatggttaatgtggagagagactgaagcatggtatactgattgcggtgcatcagcagtgggactggctaaataggggtggctgctagcatacatgtcatgtgggggatacggatgtcgtcaggtggcgacactactaagagggccggacagatcggagttactaacagacgcgcagtcagaatggtgggagggacacgacatgtggcgtgctataaagcggggtgttgcagatggttaatcgcatggtgacatgaacactggccagctctgatatgcgcggtagcattaggttattaccatgcaatttaggcacaat

SEQ ID NO: 20474 - DNA, 501 bp, Gossypium hirsutum
  Clone ID: uC-gsflnu33B145g03b1
cttcacgcttccgcccacgcgtccgcatccctttcttctgttctttcaactcaaaaactcccaagtaatattagaatcatgggtgttgtcacttataactatgagtctacctctccagtcgcccctgccaggcttttcaaggctttttctcttgaagctgacaaggtttggcccaaggctgctcctcaggcagtcaagagtgttgaggttgaagctaatcctggccctggaagtatcgtaaagatcaactttgctgaaggccttccattccaatatatgaagcaccagattggaggacatgacgacaagaatttgtcatacagttatagtttgatcgaaggtggacctttgggggacaagcttgagaaaatcagctatgacaacaagtttgaggcagctgcaggtggaggaagcctttgcaagagctcgatgaaattttacactgttggcgactatgtgatcactgaagatgagatcaaggctcaaatcaaagggagtgaa

SEQ ID NO: 20475 - DNA, 476 bp, Gossypium hirsutum
  Clone ID: uC-gsflnu33B145g04b1
gtgagtgttagatcaaagaaattaaaaaatgcgattcagcagggcgttgaaggttgctccgattctgcttcttctgctgatcctttttacatttgcgaatgccaagaagtcagccgatgtgacccagctacagatcggagtcaagcataagcccaaatcatgcgagttccaagctcacaaaggtgatagaatcaaagtgcactatcgggggaaactcactgatggaactgtattcgattcaagttttgaaaggggtgacccaattgaatttgagcttggtagtggtcaagtaatcaaaggatgggaccaaggactactaggaatgtgtgtcggtgagaagcggaagttgaaaatacccgcaaagcttggttatggtgaccatggttcaccacccaaaatcccaggtggagcaacactagtatttgacacggagcttgttgcagtcaatgggaagccatccagcggaggggataata

SEQ ID NO: 20476 - DNA, 424 bp, Gossypium hirsutum
  Clone ID: uC-gsflnu33B145g12b1
tttacttactgccagggataacgagaggccacgggggtctaattggactggcgaagaggcagatgaagcttaaaaagggacatcagctactagagatgctcctgtgacagggggtacagatacagatgcaaaagtagaatctgacttgactgcaggctttaatgcacctgaggggaaatactgagatcctaataacttgacagcatcaggctgttcagctactgctcaattaattagcttattgcctttgcatgtgtcttctgtgtatagcgacgagccttctacaattactgctgctgctggtgctaaagggcctttagcacccccagataacgttatgcggactaaaggagcacttggatggaagggatcatgagacacacgtgcatgctggccagctgaacctataacgaatacggatatg

SEQ ID NO: 20477 - DNA, 148 bp, Gossypium hirsutum
  Clone ID: uC-gsflnu33B145h02b1
ccattatagtgaaagccgataccccggcaggaacacggacccgaatacccgggacgtcccaccctttctagatatagaccaacaaagctacaagaaagggaggggcaactttaaaagccccacccggaaaaaaaacaaaccttccctg

SEQ ID NO: 20478 - DNA, 153 bp, Gossypium hirsutum
  Clone ID: uC-gsflnu33B145h03b1
gaagaagaaaggggggggttgattataagccgggatgaggacagatacaaagcaagccggggggcacatctaaaccttaagcgtgtagaaaaagctcgaagtctgggcaagtcaaattcaggtaggggtgacacttgtgtagaccaaaacttg

SEQ ID NO: 20479 - DNA, 341 bp, Gossypium hirsutum
  Clone ID: uC-gsflnu33B146a03b1
gtatatgattcttttgtcgatgccgtgactacgtttgctttggtttctggggaagctgtcggtatactcgtcgagaagacacgaatgtcgcttcaggagttattggcgggtttgccagagatcgccgaagggttttcggagatggtttcgacggtggtgacggatttgtggaacaattgcatgcaagctttgggatatgttacggaaaatgcttgattctaatataaggttaataaataacggctcgcttatttttggcaacttatttttgcataaaatagtaacgattttgtctctaaaaaccaaaagttatgttaaaatgtgtgccttttatgcctcgt

SEQ ID NO: 20480 - DNA, 347 bp, Gossypium hirsutum
  Clone ID: uC-gsflnu33B146a05b1
gtctatatggcatggatcgaaagtttcgctaccgtgttcaatataggggttgcgaaggctttcgacattggcatacaaatggtttatgttggcaaaaacaatgcacgggaacgagtgaaaaagattactggtttaatcaaagagaataaacttagccacgcttgggaagatggcaatgtgaggtttcttttggaaccgcttagagagcatgttgttctctaaaacccaccatgggaaagccattgaaaactatgttttaaagcaagaagtgatgaccttgcttgcatatgacagtagtgaaaaatggatggacagtgttcttcactggttcatatgaaatggtgaga

SEQ ID NO: 20481 - DNA, 437 bp, Gossypium hirsutum
  Clone ID: uC-gsflnu33B146a06b1
ccctctcgtccgaaaagaaggtgctggaagtacatattgagaaaggaatgagagatggtcagaaaattacatttgagggacaagctgatgaggctccagatacaataactggagacattgtttttgtattggaacaaaagaaacaccccaaatttgataggaaatttggggacgacctttatgttgaccacaatctcagtttgacagaggctctatgtgggtttcagtttgccctgactcaccttgatggcaggcagctcttaattaaatcgaaccctggcgaggtcattaagcctggtcaatacaaggctatcaatgatgaaggtatgcctcaccatcagagacctttcatgaagggcaagctagtcatccagttccatgttattttcccagaaatctgggtattttcacctgagcaatgccggaagatcgagagt

SEQ ID NO: 20482 - DNA, 542 bp, Gossypium hirsutum
  Clone ID: uC-gsflnu33B146a07b1
ggatagtgctgcagaactacttcctgagcctgcgttacgtcgaggggattcagtctatcttgtgggtttaagtagaagcttacaagcgacatctaggaaatcagttgtgaccaatccatgtgctgctctaaacattgcctctgctgactgtccacggtacagagcaacaaatatggaagtaattgagcttgatactgattttggtagtacattttcaggcgttctaacagatgagcatggaagggttcaagcaatctgggggagcttttcaacacagctgaaatttggttgtaatacatcagaagatcatcaatttgtgaggggtatcccggtttatgcaataagccaagttcttgataagatcatagctggtgcgaatggaccacctcttctcataaatggtgtcaaaaggccgatgccacttgtaaggattttagaggttgaatattatcctactctgctttcgaaggccagaagctttggattgagcgatgaactgatacaagcgctagttagaaagatccagttcgacgtcaagttta

SEQ ID NO: 20483 - DNA, 173 bp, Gossypium hirsutum
  Clone ID: uC-gsflnu33B146a09b1
ccctcgcgtccgaaaaaaaaaaaaaaaaaaaagggttttattttaaaaaaaaagggcggttaattcctttattacctttcaatacatattctaattcggggggtctcccttccttcttccctgcttcctttcccgttcttttttctctcttctcttcttctttgtgtcctctt

SEQ ID NO: 20484 - DNA, 159 bp, Gossypium hirsutum
  Clone ID: uC-gsflnu33B146a11b1
gctaaatgccgcaagaaggcgctggaagtagggtttgtttaaggaatgagagcgcgtttatcctcttcacccaaggggcaatgttcggcaagcccatgtacaataactggagacactgtttttagtttgggacaaaagaaacacccccaaacttggtag

SEQ ID NO: 20485 - DNA, 229 bp, Gossypium hirsutum
  Clone ID: uC-gsflnu33B146a12b1
gcctgtcatccactatgagacactcaaattcacgtgtttgtaacacgagcgggagctgttactgacctgacaagagtcagtgcatgatgaagggaagcagttacaccatggctatagagaccgacaaagagccacaccagcactgttgcggcataggttccaactgagaatgatcgcaagtgcggagttaactgctgttgcaccaactgctcttgtgggcggaaaacag

SEQ ID NO: 20486 - DNA, 435 bp, Gossypium hirsutum
  Clone ID: uC-gsflnu33B146b04b1
ctttcgcgtccgaacagtaccaatatcagcaaccacctccggctccggttcctcagacacaaccaccttacatgatgatgaacatgatgcagccgcctcagagtcatcctccacctatgtggcccccacaacaaggttcggctggggtaccagctcaacaacagccagcgggtcaaccggctaacgcagatgaggttcggactttgtggatcggagatttgcagtattatatggatgagaattatctcttgagctgttttgcccaaactggagaggttgcttctgtaaaagttattcgcaacaagcaaaccggtcaagtggagggctatgggtttattgagtttgcttcaagagctgccgttgtgagagttttacacatcatcaatggttcacctatgcaaaatggtgagtgcatctttaggctgcactgggcat

SEQ ID NO: 20487 - DNA, 449 bp, Gossypium hirsutum
  Clone ID: uC-gsflnu33B146b05b1
gctaactcccttactccattgtggtaagtaaattggcgattgttccaggacagctgatttgcgagatcgtgatgagaaacaactgtttcttggtgatggagttcggtctaggcaccgccggcattcagttcattaaggagagcatcaatctctacaatcttaactcttacaagcactctggtcttgctaacaagaagactgtaactgttcagcctggtgggaaggatcaatcagtgttacttgccatcacaaagactaagaagcagaacaaacctgcaagtgtgcttcataaatctgttatgagaaaagagtttcctaggttggttaatgctgttgtcaaccaggttgtagataatcactaccgaccggacttgaagatagccagccttgccaagacttagtgcttgtcacaggagcctgaaggtcgccaaatttcggggtcatgaaga

SEQ ID NO: 20488 - DNA, 461 bp, Gossypium hirsutum
  Clone ID: uC-gsflnu33B146b12b1
ccctctcgtccggaagacagaagaggtgaaagagataaagtataaatggacggctgagattgaaggaaagggaattgatgggcctatctcgagaaagtacgtgttctcagcatccactggtggcgatgcaagtgaatgtagcaaatcggagaagaaggaaaagaatgagaagaagcatcagaaaaaggacaagaaaggagagaatgtcccgcgtgtagtggagatcgaagagccgtcagatcacggagctgtcgttttaagacaggcttttgccaaaagagctggagttataagaaatagcaggggcaagaagaaggaattgtctcctcaagatgctgctttggtgatccaagtaacattcagatcttacctgatccgtagatcacaggctctttgtgcccttagggaattggcaattgccagggctaagctgaaagagctcagatcatattttaatacct

SEQ ID NO: 20489 - DNA, 506 bp, Gossypium hirsutum
  Clone ID: uC-gsflnu33B146c12b1
ggttccactccattgatacgtaacccatcccaaccatctttttactatctttcactccaaggaatcacagtgggaagcactcgcttgcctatcaaggaatcaacttttgcactcgaagacaacggcagcggcggtgtaatcatcgactccggcaccactatcacgtatctcgaacaagctgctttcggcgtgctaaaaaaggcattcatcttggaaatgaagcttcccgttgacactttgagttcaacagggcttgacctttgcttcaccttgccatcaggttcaacccaagttgaagtacctaaacttgtattccatttcgacggggcggatttggatctaccggcagagaattatatgatcgcggactcgagctcgcgggtaatatgtttggcgatgggaggctcgagtgggatgtcgatctttggcaacgttcaacagcagaatatgttggttgttcacgatctggagaagggaactgtgttccttattcaaacacaatgcca

SEQ ID NO: 20490 - DNA, 421 bp, Gossypium hirsutum
  Clone ID: uC-gsflnu33B146d04b1
gtttttcagtcactcccaatccccagtactctgtttctcttcctcccttttgcttttgctatatcttttcttcctctccatgtctccttgatcacgatccgacggtccacaatgaacgcttatccttttgcttgtttcctctgcttttagtcctgcaaatcctcagatctactttcgcctccctcctaagcttctctgttttctcctttccttttgattttagctctgtaattcctcagatctactctctccgccttcctcatcttcgtttctcggtgagttgtgtttttccaaaaaccaaaagctaatttataccaaaaacaactttccgccggcgagttttgctcgtaattcaaggttgcctttaggtttatcgttggccgtagtgaaatactgaagttgcccacagctcgatggcggt

SEQ ID NO: 20491 - DNA, 331 bp, Gossypium hirsutum
  Clone ID: uC-gsflnu33B146d08b1
atataaaaaaaaaaaaagaaaagcaaaaaaaaaatttttaaataaaaaaaaaaaaaccaaaaaaaaacttaataaaaaataataacttacatatccgggggggtcgctccggtggtcccatgttttcctccgcttgcttgtctctcctttgtttctctttggggccccctattttttattcccgggcgtgctcttttccacctccgtgtccgggaatccttctgctctcccccctttctttgtcttgcttcccttccccctttcgcccgctggggcttttgtaaacgggccctttcccttcgctctttctaactgttgccctcctttgttt

SEQ ID NO: 20492 - DNA, 496 bp, Gossypium hirsutum
  unsure (1)..(496): unsure at all n locations
  Clone ID: uC-gsflnu33B146d09b1
aattatctccccttttagctcacagctcctctcttgagtactataatgggtaaggagaaggttcacatcaacattgtggtcattggccatgtcgactctgggaagtctacaaccactggtcatttgatctacaagcttggtggtattgacaagcgtgtgattgagaggtttgagaaggaggctgctgagatgaacaaaaggtcatttaagtatgcatgggtgcttgacaagcttaaggccgagcgtgaacgtggtattaccatcgatattgccctctggaagtttgagactaccaaatactactgtactgtcattgatgcccctgacatcgtgacttcatcaagaacatgattactggtacctcacaggctgactgcgctgntctcattatcgactcgaccactggtggtttcgaagctggtatctcaaaggatggtcagacacgtgagcatgctttgcttgcgtttacccttggtgtcaagcagatgatttgctg

SEQ ID NO: 20493 - DNA, 459 bp, Gossypium hirsutum
  Clone ID: uC-gsflnu33B146d11b1
tcggatatcccgagggcctgattccagttcaacttctctgggttaatcttgttacggatggaccccctgcaacagctttgggattcaatcctccggacaaggatatcatgaagaagcctcctcggagaagtgatgattcactcatcactgcttggattttattccgctatctggtaattggactttatgttggagtagcaactgttggcgtcttcatcatttggtatacacacagttccttcttgtgcattgatcttagcggggacggccacacccttgtcacatacccccagctcgccaactgggcccagtgctcatcctggaaaaatttcactgtttcacctttcacagccgggaaccaagtcttctacttcgaaaataatccatgcgattactttcaaggcggcaaagtaaaagcaatgacccttttcctcttggttttagttgccattgaaatgt

SEQ ID NO: 20494 - DNA, 521 bp, Gossypium hirsutum
  Clone ID: uC-gsflnu33B146d12b1
attttggatacccaggaggttaattttgagcaagggatgcaaattctcaaaatcttcaaagaccattccagcaagacatgcatccttgatgactttgaattttacgaggtccgtcaaaagatgatccaggagaggaaggctaagcatcagctgttacaaaaacaaggtctgagtggggaacctaaaggagaaaacccagtaatggcaaaggagacattggaaaaacctgtcgaggcagccttgacagaacgaacggttgcatcaacagcagaagcagtaaatgcaacgaatggagatgcaaaacccattgaagagaaaggatcagttgctgcaactgaagacggctctcaatgaaatcaggttgttttcgatagtcggctttggtagaaatgggataggattgtactctttgattggttaattctagttgcttgatagtgtgatcaatatcatatttagcttattttgagttaattttatgacctgagagactggtaggcaaaacaccttttttttttgaa

SEQ ID NO: 20495 - DNA, 497 bp, Gossypium hirsutum
  Clone ID: uC-gsflnu33B146e03b1
cttcgcgtgggttccgacattccaaaggccctgtgaacaatatcgtcattgttagactcccatacccccttggtcgggcagaatcaaaatcacaaccttcctcaagaaagcatgaactttcactcccacctccgctagaaaaatacgcaaattcaagcgatgaagacatggacaacaaggctattgttatgctcccagatactatcgacctcccttcatacctcagttctcagctaatcaatgatcacattaaacaacttcagcaacaagggtcttcggctgtggccgaaatggaagcgaagagactgaaggttgattgtcaaagatcaaaggagatgtttcaacaactgagaaaagtttatgataacttacaggaattttgtgtcaatgagctcttagatgagcaaacaatggaaggatccaaagggaattaactcagatacccctcaaacccttttctttttacaccttttttcttcaaaatttcatggtgaatt

SEQ ID NO: 20496 - DNA, 210 bp, Gossypium hirsutum
  Clone ID: uC-gsflnu33B146e05b1
ccaagatgtaattttttgaaagtttaggggttggtgtgtttttttgagaaagtccagggtttgcaatgtactcttagaaaagcttggggtcaaaatgttaattttacaaagtacaggggttaatacattaaatataaaaattcatttttataaaaatattaataaattattttattaaaatttatacttatataatttggtttttccttt

SEQ ID NO: 20497 - DNA, 510 bp, Gossypium hirsutum
  Clone ID: uC-gsflnu33B146e10b1
gtgtttttatccgagctatgattatgctcattgcatcgtggactctcttgaaaatatcacacattcactgtgtacacttgaatttgagaccaggcgtgcttcttactattggctgctacatgtattggacctttaccagccatatgtgtgggaatactcacgactgaatgttacaaacactgtgatgtctaaacggaagttaaactacattgtgacaaacaaatatgttgatggttgggatgatccccgtctcatgacattagctggtttacgacgtaggggtgtgacttcaactgcaataaattcttttgttcgaggaattggaatcactagaagtgattgtagcatgattcgtttggatcgcctcgagtatcacataagagaagaattaaacaagacagctccttgtgtattggttgtgctgcatcctcttaaggttgtcataaccaaccttgaatctggttctgttttggatcttgatgcatagaaatggcctgatgctcgaacaga

SEQ ID NO: 20498 - DNA, 458 bp, Gossypium hirsutum
  Clone ID: uC-gsflnu33B146f01b1
tctttatccccctaaaactcttcagcaatttcccttcgttaaccaaaatgagagagtgcatttcagttcacattggtcaagctggcatccaagttggtaacgcctgttgggagctctactgtcttgaacatggcattcagcctgatggacaaatgccgggtgacaaaacagtcggaggtggggatgatgctttcaacacctttttcagtgaaaccggcgctggaaaacatgtccctcgtgctgtttttttggatcttgaaccgaccgtaattgatgaagttagaaccggggcttatcgtcaattattccaccctgaacagcttattagtggcaaagaagatgctgcaaataactttgccagaggccactacacaattgggaaggaaatagtggatctttgccttgattggatcaggaagctagcagataactggactggacttaagggtttttggtgt

SEQ ID NO: 20499 - DNA, 101 bp, Gossypium hirsutum
  Clone ID: uC-gsflnu33B146f02b1
atatataaaaagaaaaaaaaaaaagaaaaaaaaacgttaatttaaaacataaaaaagacgctaatactccaaaacacaaaaacaggggggggcgttctggg

SEQ ID NO: 20500 - DNA, 335 bp, Gossypium hirsutum
  Clone ID: uC-gsflnu33B146f09b1
ctgtcatgcttatttctgagcgactcaggccctgcgagtgacagggccactgtatgagtaacgatatggatctttttttctacttgtcgaacctgaaaatgtatctcatcttctcagtattattacatctgtaatcgaaatgagtattcctcaagtaaggagatatgtaatggtgatggtgatgttgagatgtgttccaatgaggcatcatttatagcttgtatgagtttgatagcgtaaccaaatgtataattgatataatatagacatgagagctgtaattatagagaatattattcataatttatttaggtccgcatgcgaagtatactatc

SEQ ID NO: 20501 - DNA, 455 bp, Gossypium hirsutum
  unsure (1)..(455): unsure at all n locations
  Clone ID: uC-gsflnu33B146f12b1
gtcatatttatggggaaagtgaggggagatagagtgaaatttgacccagaccgtattgttatgagtggtggagcaactggtgctcatgaaatggtggctttttgcttggctgatcctggtgaagcattattagttcctactccatattatccaggatttgatcgtgacttaaggtggagaacaggagttgaacttgcaccagtgatttgtgaaagttcacataatttccaaattactaggaccgccatggaagctgtatatgtaaaagctcaagaagctaaccttaaagtcaagggtttagtcataacaaattcattaaatccatttggaactttaaatggatcgagagacattgaagagcatcgtgcagttcattaacgataagaactattaccttatagngtggcaattttattccggcacagtcttaaagacccttaattttgtagtttttt

SEQ ID NO: 20502 - DNA, 366 bp, Gossypium hirsutum
  Clone ID: uC-gsflnu33B146g03b1
ccctctcgtccggtttgatgacaaatgggtggctgattctgatgtaattgttggaattcttgaagaaaaataccctcagccttgtctcaaaacccctcctcaatttgcctctgttggatcaaacatatttggaacttttgtcacatttttgaagagcaaagatgctaatgatggatctgagcaggctttgcttaatgaactcaaggcattggatgaacatcttaaggcacatggcccattcattgctggggaaaagataagtgcagttgatttagctttgggacccaaactttaccatcttgaggttgctttgggccattttcagaaatggactgttccggaaagcttgactaatgtccgcaatta

SEQ ID NO: 20503 - DNA, 508 bp, Gossypium hirsutum
  unsure (1)..(508): unsure at all n locations
  Clone ID: uC-gsflnu33B146g04b1
agtttggttacagattacaagagctaatatcagagagcttaggcctggaaaaagattacataaagaaggttctaggggagcaagggcagcatatggccgtgaactattacccgccatgcccggaaccagagctgacatacggattgcctggacatacagaccccaatgctcttacgattttacttcaagacctccaagtggcgggtcttcaagttctcaaagatggcaagtggcttgctgttaatccccaaccaaatgcttttgtcataaacattggtgatcaattacaggcattaagtaatgggacgtacaagagcgtgtggcatcgggcaatcgtaaatgccgataagccaaggatgtctgttgcttccttcctctgcccttacgaccatgccctgatcagccctgcaaaacctttcacccaatatggatgtggagccgtatacagggattttacttatgctgagtattacagtaagttctggngcaggaacctggaccaagaaca

SEQ ID NO: 20504 - DNA, 540 bp, Gossypium hirsutum
  Clone ID: uC-gsflnu33B146g11b1
ccttttgcgtccgaatgaccctaagataattcaagcttccacaattatttgtaggtttatggatgatgttgctgaacacaagttcaaacataggagagaagacgattgctcagcaattgagtgttacatggaagaatatggtgtaacagcacaagaggcatatgatgtattcaacaagcatgttgagagtgcttggaaggatgtgaatcaagagtttctgaaaccaacagaaatgccaacagaagttttgaatcgtagcttaaaccttgcaagggtgatggatgtactctacagagaaggtgatggctacacatatgttggaaaagcggctaagggtggaatcacttcattactcattgaaccaattgcactttgaaatcgtattaaattttcctcttctgttccttaaggaatagttattaagttataattaataatgttttataatatatatattataaaagaaattctaaatcaactgtctttgtattcatttcccttgattgatctaataaagttcttttcaagctttcatttgtg

SEQ ID NO: 20505 - DNA, 503 bp, Gossypium hirsutum
  Clone ID: uC-gsflnu33B146h04b1
ctctctcacaacgagatccttcgtttagctaacctttttgttacttccggtgtcgataagatccgtctcactggcggtgaacccaccgtccggaaagatattcacgatatttgttccgatttatcgagcttgaaagggcttaaaacattggctatcactacaaatggaattacccttgctaaaaagcttccaatgcttaaacaatgtgggattactaatttgaatatcagtttagatacccttgttccttcgaaatttgagtttatgactaggcgtaaaggtcatcataaggttattgaatccattaatgcggccattgatgttggatacaaccctgtaaaagttaactgtgttgttatgcgtggattcaatgatgatgaaatttgtgatcttgtcaatctcactgttgataaaccaattaatgttcgattcattgagttcaatgccctttgatgggaatgtatggaatgtgaagaaactcattccgtattccgagatgttgc

SEQ ID NO: 20506 - DNA, 305 bp, Gossypium hirsutum
  Clone ID: uC-gsflnu33B146h08b1
cccatgcgtccgcccacgcgtccggggaaaagccgttaccttgcccttgcatttctcatgaactgtggagtcctcttgggtttctattgttggggttgggagttcttaactgcccttcttcttttcttcccttatccttgaattaatttcttcttcgttctatttaattttacacaatacttattatatagatttcacctttctgaatttgtatggattttatgatgggaagtgataataacaaaggcttgtttgaatatgtaaggaaatcaacaccaccaccatttttgttgaagactttacat

SEQ ID NO: 20507 - DNA, 528 bp, Gossypium hirsutum
  Clone ID: uC-gsflnu33B146h12b1
cccttgcgtccgcaaacccagatttgttctctctgtctctctctctctatttccaatcaattaattcctccattggaggagcttagggtttgttggtgttctggtctttgctttgtctgaaaaataaacagaattataaacgaacaccaacgccatgggaagatttgaagagagaggattcgattcagtggtttgccctaagcctatccgaacctttagatggtctaccaacagctgttatcagactgagatggctgattcaaaaactggtgcagagcttcttgatataatcctccactaacatccccagcaacctcctcaaggggaggatgcgtgagggtgaaattcgggcagatgccagctgctgtacgaatcgagggatttgattgcctcaccagagatggccgccatcgcagcatctccgccgtggcttaaaaaaaccaagatttgagaacaaaatgtgagaggagagagggagatgataaaatttagttacaacttggaatagtgggggtagtgttgatttgt

SEQ ID NO: 20508 - DNA, 54 bp, Gossypium hirsutum
  Clone ID: uC-gsflnu33B002a09b1
tataaacctcagaactaacgtagcactagggtttaacatttaagtcaaaaggcg

SEQ ID NO: 20509 - DNA, 457 bp, Gossypium hirsutum
  Clone ID: uC-gsflnu33B002b06b1
ttcacgcgtccgctggctttcgcgtttctttctgaaactagagctgagaaaataaaacccaaagccttaaaaactatcaaaaatggttcaaaggctcacttaccgtactcgccatagctatgctaccaaatccaatcaacaccgtgttgttaagacccccggtgggaaattgatctatcagactactaagaagagagcgagtgggcctaagtgtcctgttactggaaagcgaattcagggtattcctcacttgagacctgctgaatacaagcggtctcggtttgcctaggaaccgtcggacggtgaatcgtccctatgggggtgtctggcctggaagtgctgcttgagacaggataattccgagcctttttagtggaagagccaaagaatgtgaacgaaggttcttgatatccagaagactaaggaaaagcactcctcaaagtgcttggaattttaa

SEQ ID NO: 20510 - DNA, 340 bp, Gossypium hirsutum
  Clone ID: uC-gsflnu33B002c03b1
taatgggtttgaaaaatggagtccaacaccagattgtcttttcttcttttgctctgcatgcctttcatctcatcagtgacaccaattcttgggtgtggttcatgtgggaaagcaccacacaagcatcgaaagcctaagggaaagttctctaaaggtcccatcactttgccttccccttgtgaaaacctccaaacaagttgccaccggtagttcctccaatagctaagccaccccattgacctccctccggttacagtccctttcaattaaccccctttcagggacggttcctccagaaactaagcctactcagtgggaaaccctgcccaacaccaccaac

SEQ ID NO: 20511 - DNA, 134 bp, Gossypium hirsutum
  Clone ID: uC-gsflnu33B002e06b1
ttcggggggaaaagacagaaccagcaaacggggaagcgatgagagcaaaataccgcaaaacacatgaaaaaacaacagaaggatgacgagaacaataatagagagcagggggcaaaaaaaaatacaaccaaaat

SEQ ID NO: 20512 - DNA, 311 bp, Gossypium hirsutum
  Clone ID: uC-gsflnu33B002f12b1
tccacgcgtccggaggacattaatggagtacagtggtattcccttgtacagatgcagaaactgcaaaaatccacttgctcttatcgacgatcttctttctaaaaacttcatagcgaaatcagggaaagcatatatgttcgaacatgcaatgaacatcgtgttgggtcccaaatacgacaagcagttgataactggtcggttcagcattgctgatgtattttgcagtaagtgtggcgaataactgggttggaaatatgcttatgctttatgatttgcaagaacctgtacaaggaacgcaagtttattcttcc

SEQ ID NO: 20513 - DNA, 204 bp, Gossypium hirsutum
  Clone ID: uC-gsflnu33B002g09b1
tgcacccagagacgaggaagggcgtagtaagcgacgaattgcttcggggagttgaaaataagcgtagatccggagatttccgaataggtcaacccgccgtctccaaatccgcctcctccttcgtctccgtaatcatcttcaaggaaaggagggtgtatttgggccaattttgtgatcaaaccagcagtgagagtggaggggttt

SEQ ID NO: 20514 - DNA, 264 bp, Gossypium hirsutum
  Clone ID: uC-gsflnu33B003f03b1
tccacgcgttcgaagactcttgcatcattaggggcatttttagtacgtttgcctcgaagctacaagttgatcttttaaatgttctagacggcaattacttcaagtttgaaaatcagcttaagagcaacgggaagctatcactaactcgcaagagatggtttagaaacgatacgctcagattgagattgtatggtgcacaaccaattcttgatcagattgcctgtggcggttcatcatgtatactgtgagcagaaagaggcgcag

SEQ ID NO: 20515 - DNA, 117 bp, Gossypium hirsutum
  Clone ID: uC-gsflnu33B003h06b1
tcacgcgtccggcttgctaccctctgcatgtgagatatttaagagaaaagaccagatttctctattttaaattgggattttttttgtgcgcgtggtttttgagaggaaccatttttt

SEQ ID NO: 20516 - DNA, 426 bp, Gossypium hirsutum
  Clone ID: uC-gsflnu33B004e06b1
tccacgcgtgcgcccacgcgtccgcccacgcgtccgctatccccaaaatcttttaactttcattttgctatctactttcattactcatctgcacattgctccttcattctggttctttaagccaagtttctgccgaggcgaaggcgtgaccttccagatcttctcccatcagctttcaggcacgcataagcctctgctgcaaaaggtgaggggacatctctgtggataaccgtctttaacaccattaagtttcccctcaaatgccaccctaccaaacctgtcgctgaactgaaagttctactgtcgaacgctgcattaaaatagattctcggactcggtatggccttttgtgttttataacttctggttatactttcggtctttgtcaagttttttaaacctccaaattcttgccagatgtctttg

SEQ ID NO: 20517 - DNA, 440 bp, Gossypium hirsutum
  unsure (1)..(440): unsure at all n locations
  Clone ID: uC-gsflnu33B004f03b1
gcgttccttttaaccattgtataaatggacccatcaagaatctccctccgtcgattccacctccccgacgtcgacgacttcctaaaatgggcaagcgacgacaaagttactcgttatctcagatggaacaccatcacttccagggaagaggccttgtcgtatctccagaaagttgctataccccaaacttatcgtcgctccatttgtttagacgatcgttccatcggatacgtttcgatcaagccaggatccggcaatgataaaagcagagctcgccttgggtatgcagtgagtgcagggtaccggggacaagggattgctacagnctgcgttgaagaggccggttgctaatgccttcacagagttccaaggcctagtaagggtttgaagctttggtagaggtagaaaatatagggtctcaaagggtgttggagaaggtt

SEQ ID NO: 20518 - DNA, 447 bp, Gossypium hirsutum
  Clone ID: uC-gsflnu33B004g09b1
tagaaaggatactggcagtaatttagaagtgaccggtgagaggaaatctgaggtggacgttgcggatgacctgttcaatgcgtacatgaatttggaaaatcttgagacattgaactcttctggtactgaggacagggatatggatagcaaagcaagtggcacaaagacatatggaggcgaaagtagtgacaatgaagtcgatagtagagtacataaacatccaatcaatatacagggaatgagttctggtgtttcaagtgagaagagggaaggtgtcaagaggagggctgctggagatattgcaccgactgttcggcactacagaagtgtttcaatggacagttacatgggaagcctgcagtttgatgaggatccaccaaaatatcctcctttaggaaatcatggcaattattactttcctgggagctctaggcatgcaaattaagt

SEQ ID NO: 20519 - DNA, 471 bp, Gossypium hirsutum
  Clone ID: uC-gsflnu33B005a12b1
ttctcgcgtccgtcctcgcgtccgataaaaaaaaataataataaaaaaaaaaaagactagcaccaatatcaaatataggtgtgtcgcttttaacggtttcctggtttttcttgtggtggccttgaccttccattttctttttcttggcggggcctttcttttggctggtgtcttttatttctaattcgcctgctgcttgttatggctctggtgttccgacccttttttttcttgctcgcttttttcccttttttgccttttcgcttttgtcgagttcggcctctttccctttcgtgcttttcctccggggggcccttcttcctttgtgccttgcttctctggctgtttggtggctttgtctttggcggcttttgtcttccttctgctttttgggcggccccctgtgtattgctccttctttggtctggttggttttttggccgttctttttttgcccttcctttgtttttc

SEQ ID NO: 20520 - DNA, 491 bp, Gossypium hirsutum
  Clone ID: uC-gsflnu33B005c06b1
ttcacgcgtccggtaccccactcccaccagccaaggctttcaaggcctttgctgtagatatcgaaaacctaatgcccaaagttgccccacaaacagtcaagagcatcgaggtccttgaaggaaatggtggccctggtactatcaggaagatcacctttgctgaagggcatggattaagtcatgcgaaacacaaggttgatgtattagacaaagacaacttggtgtacgcttacactgtgatggaaagcgatttttttaacaagaagatcgagaaaatcagttacgacatcaagtttgttgcagcagctgatggagggtcaactgttaaggtagctgccacgttttacaccgccggtgacactgaggtcactcccgacttaatggcccagatcaaggaagcttccgagaagcgagcccttgttatgaaggctattgaaagttacatcttggcaaatcccgatgcctaaaactgtgctttcatggcgttaatg

SEQ ID NO: 20521 - DNA, 425 bp, Gossypium hirsutum
  Clone ID: uC-gsflnu33B005d03b1
tttcacgcgtccgatttgatggtgctgaggccttcgcaagggaacaaggtcttgagactgttgagatgagccattttatcacccctgaaaacattgaaagacttaagcaggcacaagaatctgacagagttcagcttgattacactcaaccaattccaaaggaggtgccaaaagaagctgcagttgctgatggtgatagccagattggcactgttggatgtgtggctgttgacagtgaaggaagtttggctactgcaacatcaactggtggaatagtgaacaaaatggtaggccggattggggacacaccaatcatcggtgcagggacttatgcgaaccatctctgtgccatttctgctacaggcagaggagaagcaataatccgtggtaccatcgcaagggatgttgctgctgttatggagttc

SEQ ID NO: 20522 - DNA, 473 bp, Gossypium hirsutum
  Clone ID: uC-gsflnu33B005e09b1
ttcacacctctctttgttgcacctttttttggtcaaaacaacacaaacaacaaattaacaaacccttgttctactactattactacaacaacatcctctgtctacaactcaaaagcaaaagaaagtaaaaaaatggatggaagcagcatagatgaaagcacaactagtgattccatatccgtatccattgccccatcaaatatttcacctttgcctcagctcaccaaatctcctgactccctctaccgcgttgggagtggaaccagcgtgattgtggattctgaatctggggtcgaagccgaatcaagaaagctcccttcttccaagtacaaaggtgtcgttcctcaacccaacggtcgatggggtgctcagatatacgagaagcaccaacgtgtttggcttggcactttcatgaagaagatgaggcggccaaagcctatgacatagcagctcaaggtttaggggtcgtgatg

SEQ ID NO: 20523 - DNA, 266 bp, Gossypium hirsutum
  Clone ID: uC-gsflnu33B006a06b1
ttaacgcttacggactatcgttctgctaatcgttgctatatctatagttcttcaagccacggtgcctccaactgcgttagccgctcgtaacgaggttatgtcctctgccgctgcatcgaaagtggctaatgattgcaacggtttggctgaggttttcaagatggcaggccctggctgcaaacctaaaggatcgttttgattgtttgacctaaccagctgactggaggtcatgcggatgccttgcaggggggagctataactatgat

SEQ ID NO: 20524 - DNA, 515 bp, Gossypium hirsutum
  unsure (1)..(515): unsure at all n locations
  Clone ID: uC-gsflnu33B006b03b1
tttacgcgtccggttagcggctgccgcacccaagcccaatattgatgttcccaagccaaaagagtttaagggaacaaggtccgcaagagatgtggacaactttttgtggggaatcgagcaatacttctgtgccaaaggcatcacggaggatgtcactaaggtaactactgctgcgatgtatttatctgacgttgctttgttgtggtggcgtcgtaggtccactgatgtgagacgtggtgggtctgaaatcgaaacatgngaggagtttcgatgtgagttcaaagcacagttttacacagagtatgccgaggatgaggctcgggcaaggttgcgtcggcttgcgcaacaaggcactgtgagggagttatgtacagggagtttagcgagcttatgctccaaatctcagatatgggggagaaagaggcatttttttcctttatggacggattaaaaccgtgggcgaagcaagagttgcagtgccgaggagttcaagagctcaccaaggctatgtcagt

SEQ ID NO: 20525 - DNA, 161 bp, Gossypium hirsutum
  Clone ID: uC-gsflnu33B006d06b1
taaaatccaccaagagactacaccaacaaatggaggcattgaggataagactatttttggctctgatggtggtgttgatggccatctcactcagcccctatcttctccttgctgatactcccccctcccttcttctaccccctacgccaccctttctcctc

SEQ ID NO: 20526 - DNA, 419 bp, Gossypium hirsutum
  Clone ID: uC-gsflnu33B006e12b1
tccacgcgtccgctcagtatggctatggtggataccattaatctggttatgggcagccatcatcatacgatcagcaacaaagttatggttctgctttgagctacggtaatgtgacaaatccaactcaaggtggtcaaggggattcaggtcaggcacctacgtctacccaaccgtctgcaacaggccaacaagggtataatactagtcagcagcctaacccaaaccctggaagttatccacctccaggaagtactcaacctggttatggaatgccgccttcccaaactggctatgggaatcagccaccagcacagtctggttatggagctggatatggacaaccacaaacgcagaatctcttggccaatccccagatgtatgggtaggctcaacagttgcctagcacccaaggatgttat

SEQ ID NO: 20527 - DNA, 222 bp, Gossypium hirsutum
  Clone ID: uC-gsflnu33B006g06b1
ttatgagggaagacgaggaagatattgattttgatgatgatgatttcgaagatgatgaaaaagatatgctggagcactatctggttgagaagtctgttttttacacacatttgacattgagagttgtctaaatgaacaaattgtggcctgtgaagttgatgaagatcataactgatgcactttatgcggcttgccctttgataatttttatagtgatataac

SEQ ID NO: 20528 - DNA, 402 bp, Gossypium hirsutum
  unsure (1)..(402): unsure at all n locations
  Clone ID: uC-gsflnu33B006h03b1
tcgtttgatcttacacctgagcaacttatccagttcaacggctccgacccatccaagcccatctacgttgcaatcaatggtcgcatctacgatgtcaccgccggcaaatccttctacggtcctggtggtgcctacgccatgttcgccggcaaagatgccagcagagctcttgcaaagatgagcaagaacgaagaagatgtctgtcccaaccttgacggcctctctgaaaaggagtgngatgtccttaacgattgggtcaagaaatttgaagctaagaccctgttgtcggcgncgttgtctcttgaaaatttgcacctttctctatgtgggtgaattggtgggggtttttaagnggctttagacttgtgttattacttatctaatagttggtttggtgttttg

SEQ ID NO: 20529 - DNA, 489 bp, Gossypium hirsutum
  unsure (1)..(489): unsure at all n locations
  Clone ID: uC-gsflnu33B008a05b1
tgagagcttccattcgatctcttttagtgaaaaaaatggctgaaaatcttatgcatgctttacaatataacagctatggcggaggcgctgctgctttgaagcatgttgaagttccgatcccccctccaaataaaggtgaaattttgcttaagctggaggcaactagtctaaacccaattgactggaaaatacagaaagggattctgcgcccacttttacctagaaaattcccccacatacctgcaagtgatgtagccggagaagtcgtacaggttggaccaggagtcacaaattacaaagttggggataaagttgtatctcttcttgatcatttaactggtggactagctgaatatgctgtggctacggagaatctgacagttgcaaggcccaccagaatatcagttgccgaagctgctggtttacccatggctggtctcacagctcaccgagcagtcacccatggngctggggtcaagcttgacggaa

SEQ ID NO: 20530 - DNA, 332 bp, Gossypium hirsutum
  Clone ID: uC-gsflnu33B008f08b1
tattcatcctctccccttgtctccggtcgaaagggccactgaccatccgttcacccaccatagacggtggccgacgttgcgtaaaatgtggtttttcagctccttttcaaatgggtctgaagacgaaaccctcgaagcctgcaaaaaccaaaagaaaaaggcccactttcaccccctttttcgtgttcgattccgaccgtggagagaaacctccgatgacgggaccacatggtgacgatgcagtcgtgaggtaactccggtgagccatttcctcttttttttaatgtaaaaataacagataaataaactttaaagcaatatttgaaataaaa

SEQ ID NO: 20531 - DNA, 217 bp, Gossypium hirsutum
  Clone ID: uC-gsflnu33B008h02b1
ttacacgtccgtacacacgtaactgaaaacattctattttaacaatagggaacaactaagctagtggagaaacaacagttactgctctataaaggtgaccttcaacttattcatgactgcaccaacgatgcttacggtattgtcagggctgaagtcattgtcggcgaccataactgaactgatgatgttatcagaggagccatttctagaaccattg

SEQ ID NO: 20532 - DNA, 380 bp, Gossypium hirsutum
  Clone ID: uC-gsflnu33B009c11b1
taaagttggaacactattgcaagcaaagcaggtaactaatccaagtaattgaatagatttctttttcctttgttttaaccttgtttttgcaggtttgaagaggtgtggtaaaagttgcaggctgagatggatgaattatctgaggcctaatattaagagaggaaatatatcagagcaagaagaggacttgatccttaggcttcacaagctccttggaaacaggtggtctttgattgcgggaagattaccaggaagaacagataacgagatcaagaactactggaattctcatttgagcaaaaaaataaagcagaaagagaaacaaggctgcaaagatgaaaagagatcagtggagaatggcaaagaggaattgagacaag

SEQ ID NO: 20533 - DNA, 483 bp, Gossypium hirsutum
  Clone ID: uC-gsflnu33B009d08b1
tcgtttacgcgttcggcccccgccttccgttggaagacccgaccacatattccaaggccaattaaggtcaccaatcttcacttctttatgcacgaaaatttgggcggtacaaacgcatcagcagtcatcgtagcccaatctaacatcacaagcaacgacaataattcatcggtgccatttggcaccctatttgccgttgatgatcccctcaggataggtcctgagccagactccgaggtgattggaaatgctcagggactttcacttctggccggaacaaatccaagaacttcgacgacatactttgatttttggatttactaccggtaagtataacggcagctctataagcatgttttcaaggacagatcttgagttgcgggggccgccgcaaagaggacgattaaggatggcaacagggtttgcactacttaatccttacctcataaatgccaccactgtcattattgaatttgatgtgac

SEQ ID NO: 20534 - DNA, 453 bp, Gossypium hirsutum
  unsure (1)..(453): unsure at all n locations
  Clone ID: uC-gsflnu33B009e05b1
ttttcctcctagcccaaaaaaaaaaaaaccctctttcctttctctcgttctttttcccgttcaatcatgtcttgcttcattagcaaatatgccgatgagttggctaaaaacgctgcttacattggaacccctggaaagggtatccttgctgctgatgaatccactggcaccatcggcaagcgtctttcaagcattaatgtagagaatgctgaagataacaggcgtgctctccgtgagctcctattcacaactccaggagctcttcagtccctagtggtgttattctctttgaggaaaccctttatcaaaaaaccgcttcgggcaagccctcgnntgatgttttgaggagggntggtgtcctccctggcatcaaggtcgacaagggtcccgttgagcttaacggaaccaatggcgaaactttcacccagggtctagatggccttgcacagcgat

SEQ ID NO: 20535 - DNA, 436 bp, Gossypium hirsutum
  Clone ID: uC-gsflnu33B009f11b1
ttcgtttcctctcctaatcaaataacttacgaattcacagataagagagaagaaagggaaaagaaaatgtcttcacttcgttcagatccggttcacagaattcatcctgagccgatcgatcacttcgaccgtcttcccgattctcttctccctttagtcttcaacaagatcggtgacgttaaagctctcggccgatgctgtgtcgtttcgcgtcgtttccgttccctcgttcctcaagtcgaaaacgtcgtcgttcgtgtcgattgtgttatctctgacgacgattgttccccttcttcgtcttcctacgataagtcacgcgccgccggtccgatttctaacctcttacgtatccttcttggaggcattgtcaaacctttcaaggttgttgtcagctcattgagacccacggcccgttttcaatgaaacccttcaa

SEQ ID NO: 20536 - DNA, 445 bp, Gossypium hirsutum
  unsure (1)..(445): unsure at all n locations
  Clone ID: uC-gsflnu33B011a02b1
tttaaaatataatagaaacagcgagatctgctgcgagctgattcgaaaatggagtatcgcaaaatcaaagatgagcttctgtaagtaatgttcctccaagggaacaggccaagtggaaacgcaagacagttgttacagttgcattgacttttcttacaagttcacaagcaatacttattgtctggtcgaagagagctgggaagtacgagtatagtgttaccacagccaactttttggtggagactttgaaatgtgctttgtcacttgcagccttggcaagaatatggaaaagtgaaggtgttacagaagataacaggttgagtacaacccttgatgaagttattgtttatcccattcctgctttactttatcttgtcaagaatttgctgcagaattttatctttgcctatgttgatgcaccgngttatcagatactaatgaacct

SEQ ID NO: 20537 - DNA, 460 bp, Gossypium hirsutum
  Clone ID: uC-gsflnu33B011a11b1
ttcacgcgtccggacgttcactcgagaagccagagaatgaaattaatgctcaaaactaaggtggtaggtgttgatactagtggaaatgatgtgaagttgactgttgaacccgctgctggtggtgatcagaccacacttgaagccgatgttgttctcgtctctgctggtagatctccattcactgccggacttggcttggacaagataggagtggaaactgataagataggacggattttagtcaatgacagattcgctacaaatgtggcccggtgtttatgccattggagatgtaattccagggcctatgctagcccacaaagcagaagaagatggtgttgcttgtgtcgagtttatagctggtaagcatggtcatgttgattatgacacggccacttgagttggatacacttatcctgatgttgctctatgctaggacatgtgtggacgtttgggtggc

SEQ ID NO: 20538 - DNA, 426 bp, Gossypium hirsutum
  Clone ID: uC-gsflnu33B011c05b1
tcccacgcgtccggaaaaattaaaaaaaagaaaaagaaaaagaaaatctcttttattcattttatttttctctctctttctttcttgcttcttggtattattagatttcgattcagctaacagttttccacttatagttgttaaagattcttcagatctatgtaaattttatggatttttttgggtatttgccttttttttcttctcctttttaaactgtaatgtaattatagttctctgattcctgaagatgaccgtgggaaagaatctattttcccttcattttcactacagaaaaaaaacctcttttattctttctcgagagaatccgagctccttttcactctctttcacttcggctctcgaacgaaccgcgagttcttcaaagcaaaagctctctgtctccccccccccctctcccctatg

SEQ ID NO: 20539 - DNA, 501 bp, Gossypium hirsutum
  Clone ID: uC-gsflnu33B011e04b1
tacagatctctgtccctctttctctacgtctcaaaccctaattccttaatttttacagaagatcgggggtttaatcgcggagaatcaaccatgtttaacaggcttttcgggaaacccaagcaggaagcaaatgctctaaccacgttagacaaattaaatgagacccttgaaatgcttgagaagaaggagaaagtacttgcgaaaaaggctgctgctgaggttgaaaaggccaaggaatttgccaaagggagaaacaagagagcggctatacagtgcttgaagaggaagagactatatgaacagcaaatagagcagcttggaaacttccagcttcgtattcatgatcaaatgataatgttagaggtgctaaagccacaactgaaactgtagatgcattgagaactggagcagctgcaatgaaggcaatgcagaaagcaacgaattagatgatgttgacaaaacatggacgagatcaatgacatacttgaaacatgaaacaga

SEQ ID NO: 20540 - DNA, 457 bp, Gossypium hirsutum
  Clone ID: uC-gsflnu33B011f10b1
tttcaacctgacattgatgcattttctgaagaactgaaaccacatcagaaagcactgcttcctgataattatactgtgctggaccgtgccataatagagcataatcttctgagtgctagcaaactgtacacaaatatacgttttgatgagttgggtactttgctgggcattcctcctcataaggctgagaagatagcctcaagaatgatttgtgaagatagaatgaggggatcaatcgaccaggtggaagctgttatacagtttgaagatgacactgaagaactccaacaatgggatcaacagatagttggtgtgtgtcaagctcttaacgatatacttgatagcatggcaagagggattggaagttcccatctaatcctgaccagtcggtgcactgttcgagagcaaagaaacttagaagagaatttgccttagccatttcgcccagatgcataaa

SEQ ID NO: 20541 - DNA, 179 bp, Gossypium hirsutum
  Clone ID: uC-gsflnu33B012d10b1
ttctgatctcaactcgaatgccttcttgtacgatggtctccgtctgcgaggagggcaaaccccggacgagcttgagatggaggatggtgatgagagcaatcctatgcgtaaccaaacaggctggccctctggggaagagagaactgcatggccgcgaagacaacactgatgagttagtt

SEQ ID NO: 20542 - DNA, 392 bp, Gossypium hirsutum
  Clone ID: uC-gsflnu33B012f04b1
ttcgcccttgacctaaagtcagtgcaatgtggcatgctggcgcaaagatgggtcttactgtctgtagaactagtgcctttaatgatggaggttataatgctctccaaatgtgccctggccaattcgatgagcgagttttcaaggccttggattatgctattgcagaaacaaggcaacaaggaattaggctgcttctcaccttggtgaataactagcatccatatggcggaaagacgcagtatgacaactgggcatggcaagacggcgttggtttgagctctcctaatgattccttcttcgttgatccatgtatccgcaaatatgtcaagaattatgttctgactgttctcacatgaggaacactatcactggaataaaatatcgcaatgatc

SEQ ID NO: 20543 - DNA, 125 bp, Gossypium hirsutum
  Clone ID: uC-gsflnu33B012g01b1
ttttgctcccaaaattcacggcgcaataacggggggcattttttggttgattggcggtgttacccacaacaacagtggttatcgagaagcctgggattttatgcagaaaatgatactacagggag

SEQ ID NO: 20544 - DNA, 354 bp, Gossypium hirsutum
  Clone ID: uC-gsflnu33B012g10b1
tccacgcgtccgcccacgcgtatagaaagggtgtaatttacataatataggcctgttatccaattagcaaaatgattgctgggtatcttcattgtcttgaacatggaaatcagactgaaggccatatgacaagtgacaagactgtcggaggaggagatgatgcttttaacaccttttttagtgaaacttggtgctggaaagcacgtacctcgtgctgaccttgcggaacttgagcctactggtattgatgaatcgaggactggaacttaccgtcagttttttcaccctgaagcaaatcaatcaattgcaaggtagactctgccaacaacatcttaccgaggccactacactatt

SEQ ID NO: 20545 - DNA, 119 bp, Gossypium hirsutum
  Clone ID: uC-gsflnu33B013b01b1
ttcgtttcattgttcgtcataactctccttttcagcatgctgtattcgatgatttcttgtttgtgtttattgaatggaagaacaaacctgaagaaagggcatgttcttgattttcagtt

SEQ ID NO: 20546 - DNA, 115 bp, Gossypium hirsutum
  Clone ID: uC-gsflnu33B013c07b1
tcttgcacgcgtccgggcccagagacattaatgacatgctgtgcaggatgctgaccggagacccgaaacaaaataaacgaatacgctcacttgctggatctatgagtcatgaaga

SEQ ID NO: 20547 - DNA, 495 bp, Gossypium hirsutum
  Clone ID: uC-gsflnu33B013h01b1
tgtgttggcctatggactgcttcgcgtgactatgtcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgccactgttgaaaagcttgatgaaagccatagattatgaaaaaaagaaagcagcaaaaataacaggcctctgtaatgatatattgtcaaggatggatgcctgcaaggtctataattatgtctctgtctgcgacttgtgcaatagcagctttgattgcggtgaacataatgtatcagccatttggttgggagcagattgtccttttctacaaggactcctgctgctcattcat

SEQ ID NO: 20548 - DNA, 538 bp, Gossypium hirsutum
  Clone ID: uC-gsflnu33B015a04b1
ttttacgcgtacgaaaatgggcagaatattttcgcttgcataaggatctctttgtattctggtctgctaaagctgctactgctgaattagaaggaaaactgcttactgaccattggaagatggaaaataatatgcgaaagagtgatgatcctgaaacaaaaatacatggtagagatgagctcttggctcgtttgcagtacgaggcagaggaaatagtcaaaatgaggaaatcaggctctgatacctccacgtcatccaatatttattctcctagaaacaatgctgaaggaacttcagcaccaaaaagtgtgatggtgggatttgtggggtatcctaatgttgggaaaagctcaactataaatgctttggttgggcagaaacgtacaggtgtcacctccactccggggaagacaaagcatttccagacgttaataatttctgatgagctgattctatgtgattgtcctggattggtgtttccatccttctctagctcaagatatgagatgatttgcttcggggtgttgccaattgacag

SEQ ID NO: 20549 - DNA, 543 bp, Gossypium hirsutum
  Clone ID: uC-gsflnu33B015a06b1
ttctttcgtccgaaaaaatacaagaagctaggggcgaagtagatgcaaaccgcgacaagtacgttggcctgtcatctacttgcataacttataagtccagtgcatcctcatacagaagtggtggcttcaatggtggtggggataagtatggaggcataagtagcagaagagaaagtgacagctatagagacagttataaagaaagcgatccatatggggaagaaaagtttgatacagatacctacgtcaaatcgcatcgagggactgcatgtgagatccaagggaattcctctaaggagtctaggcatcatggcagcaaggattcaaagaaaaaattcttttcagagttgaatgattccaataaatatagccaaagcaccagcaccccttcaaataattttgatgatgactttgatgattttgatccccggggaacgtccagttccaaactagcagctggaagttctaatcaagtggacccgttcggaccaaatttgattgatgacctctttgacggaccagcaccagtccctatggaaaaat

SEQ ID NO: 20550 - DNA, 537 bp, Gossypium hirsutum
  Clone ID: uC-gsflnu33B015b01b1
cttatatccaaaaattaagccaattttcagtatgggtttaactatggcttcaaatcccaaggttttcttcgacatgacgatcggaggtcaaccggccggccggatcgtgatggagcttttcgcagacgtcactcctcgtactgccgagaacttccgggcactctgtaccggtgagaaaggcgtcggtcgttccggtaaaccactccactacaaaggctctaagttccaccgcgtgatccctgatttcatgtgccaaggaggtgatttcacagccggaaacggaaccggaggtgaatcgatatacggatctaagttcgccgacgagaacttcatcaagaagcacaccggacccggcatactatccatggcgaacgccggtcccggaacgaatggatctcagttttatttgtaccgctaagaccgagtggcttgatgggatgcatgtggtgtttggtcaagttgttgaaggtatggatgtggttaaagccattgaaaaagttgggtctagcagtggaagaacttgctagcctgtcgtta

SEQ ID NO: 20551 - DNA, 447 bp, Gossypium hirsutum
  unsure (1)..(447): unsure at all n locations
  Clone ID: uC-gsflnu33B015b02b1
gtgagagggaaggtagggagcgtgataggcgagacagggagcgtggcagacgaaggagccgttcaaggagtaggagtagggagcggaagagacatggtcgcagtagtatgagtccgagaaggcatgaagcagaggatggtaatgctccagaagagtcaaagaagaagggaaagaaagaaaagaaagaaaagaaggaaaagaaggatgatggaacggaccaccctgatccagagattgctgaagccaacaggattcgagcatccctaggtttgaaaccattgaaattgtaagcatggtagatgttatatgcggcaagattaactattatatcatatgaaggtacattggtgttgttttggtatgtattgttaatacaaaagctatgcgggagttggaatcagatgatgatggccatcttactaatnaaaaaaaannnnnnnnannnna

SEQ ID NO: 20552 - DNA, 471 bp, Gossypium hirsutum
  Clone ID: uC-gsflnu33B015b05b1
agccttccttccacccttccgctacacgttcagggaatagagagaatcggctctgaaggtggcgctagaccatgtgacgagtagcggattatgaagtcacatcatcgattcgctgtttgccagaaggtccgagatgctcttgtggtcatgatatcgagatcgaagattaaactactgatactactctttgctttgggattatcattggaatctgatctgtgaaagcgatgaatgactatatatagcacctgtggggtattggctccaggttttggaggattcgaaattgtgctaagagtacatcataaaaattaagaatgccatggcaaatatggcccataatcccatatttagctaatggaagaacaagccttttttctctagaattagtggtaaactgaaatgcaacgcaggctggaatctttattcattattatacccatgtaatttcgcatcattagaccaaaacaa

SEQ ID NO: 20553 - DNA, 473 bp, Gossypium hirsutum
  unsure (1)..(473): unsure at all n locations
  Clone ID: uC-gsflnu33B015b07b1
ttctcacgcgtccgctaccttaacacaacttacgaactcaaaaaccccaagttttcactttcaaaaaacttcccacattcaccatgtctggcacgtgcggcaactgtgactgcgctgaccgcagccaatgcacgaagaagggaaacagcaacaccatgatcgttgagactgagaagagctacatcaacaatgttgagatggatgctccagctgagaacgatggcaagtgcaattgcggtactggctgcagctgcacagactgcacctgtggccactaagccaacatacaatggtcatgcttcagatcatggcatatatagggatctaaataatgaatttaaggttgaataatttgtgtctgttgtagtttgtgtggtgacttatatctgtcagttaacctttctctcctttactatgatgtaatggctatgcttatggccttatctggttaatgaagtatccttactatnnaa

SEQ ID NO: 20554 - DNA, 376 bp, Gossypium hirsutum
  Clone ID: uC-gsflnu33B015b08b1
ttcacgcgtccggatcctcaacattggcctggtgtgtactagtccactcccaatcaaccgaccatcaatgagaagggtggttaaaatgttgcaagaagctggcgctgatagcctgccaaaaactgctgctaaaaaggatgggaaattgactccttactactacgaagatggctcagatcaaggaagtgtagcttgagaaaaacgaaaagaaaagaaaaggttttcctcgtagatttgtcccataaacaaagagtaatagaaggattgtgcgagtgtgttacgcctctagtttttttttttcttgccctcaagttttggttttcaatcattgatcccacttgctgttttgctttacaggttggtttagtgggggact

SEQ ID NO: 20555 - DNA, 499 bp, Gossypium hirsutum
  Clone ID: uC-gsflnu33B015b11b1
tttcacgcgtccgaaaaaaaaaaaaaaaataccgcccatacagacaatagactaggacaggaggatctctcagggtttaggtgatggcttctaagcggatcttgaaggatctcaaggatctccagaaagatcctgctacctcttgcagcgcaggccctgttgctgaagacatgtttcattggcaagcaactattatgggtcctcctgacagtccatatgctggtggagtgtttctagtcaccatgcattgccctccggactatccatttaaaccaccaaaggttgcattcaggacaaaggtctttcacccaaatattaacagcaacggtggcatttgcctcgatattttgaaggagcagtggagccctgccctcaccatatccaaggcatggctatctatctgctctctcttgacggatccgaatcctgatgacccattggtgccggagattgcccacatgtacaagactgacatgagcaagtctgagacaacggctcg

SEQ ID NO: 20556 - DNA, 535 bp, Gossypium hirsutum
  Clone ID: uC-gsflnu33B015c03b1
gttttaaactatgtgaaaaaagggtctgcaccaggctttgatctcgaagaaatcgaagaagggcttgaaggatacgaagaattggagaaatcgacattaatgtcgcagaagaatttcgagaaacgattcggacaatcaccggttttcattgcctcaactttgatggaaaatggtggccttcctgaaggaactaattccacatcactgattaaagaggccattcacgtaattagctgtggttatgaagaaaaaaactgagtggggcaaagagatcggatggatttatgggtcggtgacggaagatatattaacaggtttcaagatgcattgtagagggtggaaatcggtttattgtgtaccgaaaagaccggcattcaaagggtccgctccaatcaatctctcggatcggttgcaccaagttttgagatgggcacttggttctgtagaaattttccttagtcgtcactgtccactttggtatggttatggtggaaaactgaaatggttcgagaggcttgcttatatcaacaccatt

SEQ ID NO: 20557 - DNA, 471 bp, Gossypium hirsutum
  Clone ID: uC-gsflnu33B015c04b1
ttcacgcgtccggcagcctcatttctccaagagggctagagggttgaagaaacatttgaagaggctcaatgcccccaggcattggatgcttgacaagcttggtggtgcttttgcacccaagccatcgtctggtccccacaagtccagggaatgcttgccattgatccttattttgcgaaaccgattgaagtatgctctcacctatagagaagtcattgctattctcatgcagaggcatgttatggttgatgggaaggttaggacggataagacctatccagctggtttatggatgttgtgtccattcctaaaacaaatgaggacttccgtctactttatgacaccaaagggcgatttcgtctccatgccatcagtggcgatgaaaccaagttcaagctttgcaaggttcgatctgtccagtttggccagaaaggtattccatacttgaatacatacgatggtcgtactatc

SEQ ID NO: 20558 - DNA, 529 bp, Gossypium hirsutum
  unsure (1)..(529): unsure at all n locations
  Clone ID: uC-gsflnu33B015d03b1
cccacgcgtccgcgaaaaagaacccagtcttcggatctctgccccaaagcaaagagagttctcatcttttacaatcacagctactgcttatttattttcatggctcaaggagattctaacttccagcaagacatggctaaagaggaagaagaacagaggctgaaatacttggaattcgtgcaagtagccgccgttcacgccgctttgtgcttcaccaacctttacctttacgctaaggaaagatcggggccgttgaaacctagcgtcgagaccgttgagggaacggttaagtgcgtggttggaccggtttatgataaataccatgatgtccctgttgaattccttaaattcgttgattccaaggtgggtgaatcagtgaccaagcttgatcgtcgagtccctccagtcatcaaacaggtctcaaccgaagccatctctgcagcccaaaaggctcccgaggttgctcgtggcgtggcttccgaagtccaccgtgctggagtggtgaacaccgnctcaggattagcaaaat

SEQ ID NO: 20559 - DNA, 549 bp, Gossypium hirsutum
  unsure (1)..(549): unsure at all n locations
  Clone ID: uC-gsflnu33B015d07b1
ttgacgtttggttgccagagttgctcttcagaggaacgatgttgaactcgtcgccgttaacgatcccttcatttccaccgattatatgacatacatgttcaaatacgacagcgttcacggtcaatggaagcaccatgatcttaaggtcaaagactctaaaaccctcctcttcggcgaaaaacccgtcactgttttcggaatcaggaaccctgaggagattccatgggctgaagccggggctgagttcgttgttgagtcaactggagtgttcactgacaaagacaaggctgctgctcacttgaagggtggtgctaagaaagttgtgatatctgcccctagcaaagatgcacccatgtttgtaatgggtgtaaacgagaaagactacaagccagagcttgacattgtttccaatgctagctgcactaccaattgtcttgctccccttgtaaggttatccatgaccgatttggaatcgttgagggtctcatgactaccgttcatgccattactgcaacacanaagaccgtcgatggaccatcaatgagggac

SEQ ID NO: 20560 - DNA, 527 bp, Gossypium hirsutum
  Clone ID: uC-gsflnu33B015d09b1
ttttgatctgaggaggagtcggtggaccatctgggtagggagtgttccttcacacagcaggttttgcggggtttggagatgccattttcaacatgcaacagagaagccaattggaaaacatggttagtagcggattttgaaaataagagtctggaagcatgcaaaatcaaatttatcgcttactggaccatctggtataatcacaacaagctatatcatgaaggagtcagagagcaggtacatgaagtttttggatttatcaaggcttactatgcagaaatttctagtatgggggagatattacagaatacacatgacataaaagactcagtctggaaaccaccggataatgacaccatcaaaattaatttcgacgcctcatttaatcgaatcacaagaagttctatttcaggaatcattgtacgtgataagagggtttgcctatggcagcctgtacctttcaatgggataatatttcagatccatttatggctgaggcaagggcgtgtttacaagctattgtcatg

SEQ ID NO: 20561 - DNA, 200 bp, Gossypium hirsutum
  Clone ID: uC-gsflnu33B015d12b1
ttcgcaccaagcaacgcccacaaggcggcggggggcacttttaaaaaaggatgcgggtaccaccccccaacccgagcggcaaccggaggctgcggaggccgaagctggcgaggaagacaaagggaggcggggggacccacgaaaacgcgaaaaacgatcggcagacgaacgaagaacacgcggagacctaaccagaacgc

SEQ ID NO: 20562 - DNA, 405 bp, Gossypium hirsutum
  Clone ID: uC-gsflnu33B015e10b1
taataaacaaaaaaaaaaaaaaaaaaaaaggggaaattttaaaaaaaaagggggtaaatttctcaacaaactaacccttatatccatactcagccccctctttttttggggggctcctccttttggggtccccttttccctccccccgcccgggccccgcttcctcttcttttggggcccccttttttccttttcctccccccctttttccccctctcccgtgctggaccaccccgcgtcttccccccctttttctcctttgcgcccccttccctttttcccggtttggctttctcccgggtggcccctcccgtgccccttttccaccctttttgctccccccttggcccctccgtgtgcccttcctctttccggctcctgcttcccccccggttgtttttttct

SEQ ID NO: 20563 - DNA, 539 bp, Gossypium hirsutum
  Clone ID: uC-gsflnu33B015e11b1
tagaaatcatgggttctgaacagaatgaaggggctagcttccctccatcggcgccaaaactttgtgccaacggctgtgggtttttcggcacggcggcgaatatgaacctctgttccaagtgttaccgtgacctccgtgccggggaggagcaagctgccaaggcgaaagctgccatggagaaatccctcagcgttaatacgaagcaggaagatgtcgttgacgagactgtgaagcctgttcttgagcttcctcatgtgggttcctcatcgacggtggtcgagatacaaccggctgctattgtctccgatgataaaccggcggaatccaaggcggcgaacaggtgctttatctgcagaaagaaggttggattgaccgggttcaagtgcaagtgcggaagtacattctgcggcgagcatcgttacccggaaaaacatgagtgctcctttgatttcaagggtactggacgtgatgcgattgccaaagcatatcccgtcgttaaagctgacaaggttgagaggatttaaagaagtattagtggg

SEQ ID NO: 20564 - DNA, 517 bp, Gossypium hirsutum
  unsure (1)..(517): unsure at all n locations
  Clone ID: uC-gsflnu33B015g03b1
ttttcttttgatcccaaacccattccgggtggctggaatggtgctggtgctcatgctaattacagcacaaagtcaatgagaaatgatggtggcatcgatgttatcaagaaggcgattgagaagttgggtctgcgccacaaggagcatattgccgcctacggagagggtaacgagagacgtctaactggtcgtcatgagactgcagatatcaactcattctcatggggtgttgcaaacaggggagcctccatccgtgttggtcgtgacactgagaaggatggaaaaggctacttcgaagacagaaggccagcatcaaacatggatccttacgttgttacatcaatgattgccgagaccaccattctctggaagccttaaagggnggtggaaattgaaggttgtgaaagacgagaaggaaaaacctattcagattaataaccccctctctcatctttctttggtgggccagtgggtgaacttgtattttattggtttggttngctggtttgcaatttaa

SEQ ID NO: 20565 - DNA, 456 bp, Gossypium hirsutum
  Clone ID: uC-gsflnu33B015g09b1
ttctacacatacaaccacacaaacaaaaaaaggggaaactttaaaaaaaaacgtggttacaaaaaaaaaaaaaaaacatcattatcatacccttccatttccaaaaaccgaaactcctatgggcgtcctttctaaagatcccaaattatcatccccttccttgccacataataacttttttttcgggaccccaaagaaatattccctgcccacatttttaccaccgagagcctgggaaacccctgcgttaccccaccttaattccttttagaaaactccccttttcgcaacctggctattttcataacagaccccaccgggagcaccttcctaccagttgctctactcttactagataatggaccccccccttacctagagctttaccccccagtcatgcttcacttatcctctacgtgaaccgatacctttacaatcgccctaaccccctgcatt

SEQ ID NO: 20566 - DNA, 376 bp, Gossypium hirsutum
  Clone ID: uC-gsflnu33B015g12b1
ttttcaactgggagggaaagaagaggaggaaagggctctccagattggtaaagggggggatgatacattcaccatggattataggcagcccttatcggcttttcttgcttttgccatctgccttacaagctttggtacaaaattggcttgtgaatgattttactatgtttatgtgctatcatatacatatatatagtaacaagttgtgctacatgttttaatataatattttttttctacttaaatgtcacttgaaaaacgtttggagagccttggcttggtgagacacaatcaaaatcatgtacacgtggtctctttgcatctaataacatatgctgaaattattggtttaaacaccttctgaaaatggttaatt

SEQ ID NO: 20567 - DNA, 485 bp, Gossypium hirsutum
  Clone ID: uC-gsflnu33B015h02b1
tctatgcgtccgcccacgcgtacggggagctcgggggttttgcgccgttcggccttcatttcatcacggcgacgatgaaagatgacttttggtgacccccccttttgctcctccgtttactccaacacggtgtttatcgatttaagccctgaagtcccatctacgatttcgatttttagcgaaggagatgtggtctccgacagttcattcgcgaaggtaaatcctttcctcttcgctttattcactttcgaggagaaaaaacaaaaacagagaacaatcgaaagaaaaaaagaacgcccactagtttgaatcggaaaattaccttcgaatataggtggtcttttctttgtatttgatatctggatctttggttttgggatggcgaaaaaaaatacaaagactcaaaatctggctttatagccgaaaggaaagaggaaaaattaatgaaaaatcaaatacaatggttggcttttttgttctctttg

SEQ ID NO: 20568 - DNA, 417 bp, Gossypium hirsutum
  Clone ID: uC-gsflnu33B015h06b1
atatgggagaggaggaatagttgataaaactgggggaacttttaaactagtgggtgaaggtacatgataaaggggccgctaacggtaggctgtgtgtgtttttccttgatggttcgatctttagcgcttgcgtttgatcgccctgttttttgacgggtatgggctgtctggccttccccagcttgcctggacggggacgcctgctggcctcgtgttttctttggtttatccatcttttcccgcttggctgttgttccgctgttgcatgcgttcaaccgatgcgcctgccgcggcgttgccttgattatacccgggtttccgacggtgttggttttttaacggtgcgtttttttgtttcttttagcgcgcctgtgcgaatgttttgacggggagctgccgatattgttgcggcctgcg

SEQ ID NO: 20569 - DNA, 506 bp, Gossypium hirsutum
  Clone ID: uC-gsflnu33B015h11b1
ttctcgcgtccgcccacgcgtccgcagaatcagggaagcttgacggcagctgaggctaaagttcataagatcggtactcttccaaattatggtttcagtttcaagtgcgatgaacgggctgagaaaaggaaagagttctataataaactcgaggaaaaaattcatgcaagggaagtagaaaagagcaatttgcaagccaagtctaaggaaactcaagaagcagaaattaagatgcttaggaagactttgaaattcaaagcgactccaatgccaagcttctatcaggaacctacacctccaaaggtggaattaaagaagataccacctacaagagctaaatctccaaagtttggtcggaggaaaagctcaactccttcagacattgatggtaacagcaataacagtcaccaatcaggccggctaagtctggatgagaaagcatctcagagaatctctgccaaagtgatttctcctgtccatgcgaagaagtcacagaggaaatcact

SEQ ID NO: 20570 - DNA, 505 bp, Gossypium hirsutum
  Clone ID: uC-gsflnu33B016a03b1
taatatatggaagcggtgacgcctgcgggggccccgccgcgatatccggggcgagccacacgcgcgtttttatgtgtcagacaagctccataaatgcccaggtaatgtcatagacctcaaggacgcacactatgagagtacagaacgaggtgcagcaatggtaatggccaaccactactacagcaacatactgcccaacacggtgtaagaacattgtggaacacccatggctacatgacgtctaccttgtgagactgcaaaccagatttaatgggagtctaggacatacatcttgaggactaatatgtcatatataggtggggaatcataagaaggtgtatggaactgatgactaaatgccttggcaagagaaagccgagtgtgttcgaataaaacggaagctcacttgtttagtgtccaagagacaagaaagataaggtgcagtgagtaacggtgcaatggtactagtttgatacgatcgacccattgcatttatatttagcat

SEQ ID NO: 20571 - DNA, 464 bp, Gossypium hirsutum
  Clone ID: uC-gsflnu33B016a04b1
tttattacgtacgaccatgggtatgtaaatgcggggggctaaagctagaatgttagggatttaagtatgtaatattaaagcctgtggttcattgagttatgttcactatctgcatacagatggtctgggaaacaacggttaggagcatgcacgaaatgcctgtgtcaaacacggagcggagctgatgctgtatgactgagacagggtggaagcctttcgattgcttaaaagctatatactggactataacgaactttaattagtggatctaatatctcggcacgaatggactgggactgggtgaactatagctgtatacacatattgggagtaaaaacgatatcatggggatgatagttgtgcttcgtaactaaataggatatgagtgcaaggttgcgagtgaccagtatgataatgagcagagagtaacggcttaatggttctagatagatacgatcgaccca

SEQ ID NO: 20572 - DNA, 483 bp, Gossypium hirsutum
  Clone ID: uC-gsflnu33B016a07b1
tggggagcggtggcgcccgtgcgggccccgccccggaattccgggcgacgccacacgcgcgctttttctggtgataggttcaatgcatgtataggggcactagatgcaggggaacctgatgttctaagagactgggccgcatgtgagggtatacagcttgaggatttactaccgctgagcaaagatacaagagcaaggagtgctgatatcgctaggaaggttgatgtgagaagggaggcacagccgagaggctatgaaatagccaaagctggaactttggtgcctgaacaagtgaccgtggaaactgggcttctcgctacgacattcaagatcgggcgagctaaagctggggcgtgctgcgggaaagccatatccaacatgtatgctgagctttcaacttgcgagccagcaccttcaaatgtctaaattgggattggcttcaacaaaatgcacaaacacatttcgagagggaacaactttata

SEQ ID NO: 20573 - DNA, 538 bp, Gossypium hirsutum
  Clone ID: uC-gsflnu33B016b01b1
gcaagctacagcattcgtttccaggaggagatttcaagctgggagagaacatatactggggcagtggctcggcgtggaggcccagtgatgcagtgagtgcctgggccgtggaagacatatattacgactatgcaaccaactcgtgccaggagggacagatgtgcgggcactacacccaaattgtttggaagaatacccgacgaattgactgcgctcgagtggtttgcgacactggagatgtgttcatgacttgcaattatgatccgtcgggtaattatattggagaaaggccatattgatatggttcaatattacaattctaacgggtacttcactatacttgttcaatattttcgaaaatttgttctcacgatgctatctcactacttcattgaagctaacaagctttccgaaaactagtgaacaagtatattaaggttctcagtagaatctctatatatatatgaatttgatgtgaacattataagaatgttgttaatatgtatgccatttgagtgtcgacatagctatatcatat

SEQ ID NO: 20574 - DNA, 498 bp, Gossypium hirsutum
  Clone ID: uC-gsflnu33B016b02b1
atttatggctctgcaaacctctgtcaaacaactgaaaaagagaatggaaatcaagaagaggaagaaggcgttcgatttataatacggacaagtcaaagaacaattgcaagaggtggaggatgcaatcaaggagttgtgcaacgtcaatggtgaattgaccaaggatgtcgaagggagttcttcatttttagacgggacaaactcaaaggaattggaaggacctggaaagagcaacttgaaaaaggtacgtgagcaggcaacaaaagggtctgataagatcggaaggttgcagctcgaggtgcagagcatcgagtacgttatgctggaactagaagatgaaaggaagaacaaaggggaaacccgaaccggtgtcctctaaagggactgtatctacaacacgtggaagacggagtgctaagactaaagatgggttgattttgtgggtgtgcaagaccattttccagtatagactgaggctaagcatatacagacagacag

SEQ ID NO: 20575 - DNA, 92 bp, Gossypium hirsutum
  Clone ID: uC-gsflnu33B016c01b1
aaaaaactatcccgcgcgaattccacccacaccaaaaccaaaaacaaaacacaaccaacaccaaaataaacaaaaaaaacccgccccccccc

SEQ ID NO: 20576 - DNA, 494 bp, Gossypium hirsutum
  Clone ID: uC-gsflnu33B016c09b1
tttatgacggaaagatcttggccatggatatcaacagagaaaactatgagttgggattgcctgtaatccaaaaagctggcgttgcacacaaaattgaattcaaagaaggccctgccatgcctgttcttgataaattggtggaagatgaaaagaatcatgggtcgtatgatttcatctttgtggatgctgataaagacaactacctcaactaccacaagaggttgatagagttggtgaaggttggtggtttgattggctacgacaacacactgtggaacgggtcggtggtggaacggcccgatgctatgcttaggaagtatgttaggtactacagagactctgtactggaactcaacatggctattgttgttgaccccaggattgagatttgcatgctccctgttggcgatggaatcaccctctgccgccgaggcatatgaacgaccaccaatgctaccgccgtcacagtcggtactaccacgcaagatcgacaa

SEQ ID NO: 20577 - DNA, 367 bp, Gossypium hirsutum
  Clone ID: uC-gsflnu33B016d01b1
cccacgcgtccgcaaatatctggccaagtttgggttggttgatatgaaggcgtgatggaacaagtttaatgagtagaggagagactacctacctatatttttactcccgcgttcgaactttcagtatcttgcttccggcttaaaccttcgttattacttgaaataattaatgacttttgaacacatactctcgaatgcttagtttttagtaattgttggctaagtgttttgaccctcgctttaagaacacggatgtttagaatcaaactataattgaatagctacaaaactatatgatgctgccttggtctctgttgctgaagatattggacctcgtgaccggggtagatacgctgaacaaccctgc

SEQ ID NO: 20578 - DNA, 412 bp, Gossypium hirsutum
  Clone ID: uC-gsflnu33B016d02b1
ttgaagctgttggacagggtatatacatcacgtggcatgtactttatagaataggctacccaacgggtcatctgctaagattgttaataataaaggatgttgtgtatgaaggggttatgggtgtggaataagggatgaagatggactacatacatatgtgtgaggaaaatcgtatggtccataacaaacaacagtgcataatagatgcaaggatgatcatccagctctggaagaacactggttgctatgaagcataatcatgataagttacctggtcaacttcacgacgctgatttcgccacagctgaagagctgttccagctcccaaccgaggtaaaaatgcagcacaccaccgacatgcttttattgggttgttgacgacaatacaacactggtacaatctacgagttct

SEQ ID NO: 20579 - DNA, 539 bp, Gossypium hirsutum
  unsure (1)..(539): unsure at all n locations
  Clone ID: uC-gsflnu33B016d07b1
taaaatggaagaaactcatcctgggttagtgactattatatgcgcatgacattcttctataaatagcctactcaacaagccaacttgatttatcttcaaaaataaaacatttcttctattaattcgttatgggtttggaatcagagatgaagcttcccgtcatcaatttttctgaggaaaatctaaagccaggaacaagcggttgggcatcggcatgcaaggatgtccggcgagctctggaagaacacggttgcttcgaagcaaaattcgataaattacctggtcaacttcacgacgctgttttcgccacagctgaagagctgttccagctcccaaccgaggtaaaaatgcggaacaccagcgacatgcctttcttcggttatttcggacaatacaaaactgttccactctacgagtccttggcaatcgaccacccaacatctnttgatggaactcacaggatcaccaatctcatgtggcctgctggaaacgatcgctttcgcgacagtgctcaaaggtactcagaggtcgtggcagaa

SEQ ID NO: 20580 - DNA, 502 bp, Gossypium hirsutum
  Clone ID: uC-gsflnu33B016e03b1
ttattttcaagcttgaaattttgattcaaacactgtaccttttcattctctcataaaactcaaatcccaagttcttatcaatgggtttctcagtcgagaattcggtaacacaatcccacacgagaacccacaaaatcttcttaatcagcaattaccttctattgggagccgcctccagttgcgtcttcctcaccctttccctccgcttattcccttccctgtgcggattcttccttattctcctccatgtcatcaccatcgccgccgccgtcttgggttgctccgtcgccatttcgggttccaacaaacgctacttggcttacatggtgtcgatggtgctgacatcaatattcgaaggctctgtttcggtgcttatcatgacccgaacgtcggatttcttggggtacttgaggtcttacgtgagggaagatggggttttgatattgaaactggctggcgggttatgcgcggctcgtttctacttgcagtgcgtggttttggc

SEQ ID NO: 20581 - DNA, 109 bp, Gossypium hirsutum
  Clone ID: uC-gsflnu33B016e05b1
aaaaaaaaaaaaaaaaaaaatatacacgggggaaatcaaaaacattatagccatatataaaaaatgaaaataatgtaaagaaaggaaagcatgataccttgatcaacat

SEQ ID NO: 20582 - DNA, 549 bp, Gossypium hirsutum
  unsure (1)..(549): unsure at all n locations
  Clone ID: uC-gsflnu33B016e06b1
gttctggtcgaggacgcagcacaaccattgttggggtgcttcttgggaaaacaatgggcatataactcctgatgcagcttatgagtatgtgagatctatcagacctagggtccttttggcacctgcacagcagcaggctgttcaagattactatcttcacagggacaataataatggaatctgtggagactcttgctcaatgataataaagaaaactctagttgtacctgaaaaacaggattagcggtcttcgatgatggctctgtagttgttgtaacagagtcggaccttgacgggtatgacgctagctttgcacagatgtgttaagcaacgagatgttggatgagggaagcctaactggcaggttgcagtttgctagtcaagcagctatgaccaggctttcttgcctatggttacgctgccgtgcagaacaaaggcatctaggaagctattgagcagtcttggtatggacatcgggtttattgattgtnggtatccatcaattcagtgttaaattgagtgcttttgtatcacgtttcagtttgtttt

SEQ ID NO: 20583 - DNA, 508 bp, Gossypium hirsutum
  unsure (1)..(508): unsure at all n locations
  Clone ID: uC-gsflnu33B016f04b1
ttcacgcgtccgcacacttcaaacatcggcgtcagtgtctaatcgcgttggcaccggtgtgctgtcgaaaaagacgagtccaatcaacggagcttttaacttttaaggtactccacacaaggaaatcatccaggagaccaattttacatttttacccctctgcacaatcaattttagggtataggttaaattgttagaagaaaaacacatgcctggtttcatattaccaaacttgaatctctaaactcgactttagttgttcttttgaatgtgttgatttgagaattggggatgggatagtaacagttcagttatttttttccttcctctctgttagtgttaaggtagggtccggttggcaaaagattggttcttgttcaaccttgtattttattacattttaggcgttcctgtctgctatcatcatagattntgttctccaccttaaagcgaagatgacatcagatcatgttgctgtatttcttggttatgttcctcatcttcatgt

SEQ ID NO: 20584 - DNA, 480 bp, Gossypium hirsutum
  Clone ID: uC-gsflnu33B016f05b1
ttaaacactgctcagtaaaccctaatcttttggcaatggctttcttttcaaccagtttcttcacttgtttcttctctggttctaataagctagcttcccaaggagaagacactcaaccatcatcatcgaccattattaaagcaggtagtgatgctaaactgaaggaaggcaaggctaagaacaaccctcctattccctatcggatcaaaactttccctgttatgaaagctgttggttgaagtagtataagttggaatccctactttaaacgctcatgtcccgagacagattggtctcaagtccgatgttggagttgaaacatatgctaacatgcatgtcagcttctttaagagcacgttttctctgtatttaatcaactctttgttttttattttgagaattgtattaatttgttttcatcttcgacaaggttaataatgtttgttcaggaaatctactgttagaagttagtgagttagt

SEQ ID NO: 20585 - DNA, 484 bp, Gossypium hirsutum
  Clone ID: uC-gsflnu33B016f06b1
gggggagcattaaatacacagctgttttttcacttgtcaatattatggttatataccactagcggtccaaggaggggacacccattcatctttaagtaccgttatgaaaaaaattcaatgctactaaagtgctggacagggagactaatagcaactctactgttcgtatatcgggccagagctttcgctgctatgaagcttggtgactactgtaccgtagggtgtaatatggactttagacgctgatgcactggcacagattgttttctaatcctatacaggagctttaatatattctctgatgtttggaaagtgcatacagattcaatggaccaagttgagaatgggaatgagaactacaatgatatcaatgtcttaaccagtgtggactcgtctgggactgttggaagtggaaaagttgttccaggagggaatgaagatttagattaagatgtagatgtagatttagactgctcaaaggagg

SEQ ID NO: 20586 - DNA, 520 bp, Gossypium hirsutum
  Clone ID: uC-gsflnu33B016f08b1
taaaacctcatactgtgccatgcaaggttacggggaaatgtgggtccgtcaccgttaggatggtgccggctcctagaggtgctggtattgtggctgctagggttcccaaaaaggtgcttcagtttgctgggattgaagatgtcttcacttcttcaaggggttcaaccaaaactcttggaaactttgtcaaggccacctttgaatgtcttctgaaaacatatggtttcttgacaccggatttctggagagagactcgtttcacaaggtctccattccaggagtatactgatctgttgggaaagccatcgaagacccttgtactggaagatgtcgagagagttgatatctgattgaagatcaacagggtcattacttattagtaagttgggcgtgtttctaggtcctttctatgttgcaatctttaattgtgtcttgcttgttttgattctgtcatgagattaaatcagtaatggttcacatttgttgtgttttttcatctggattctgtataaagatatgg

SEQ ID NO: 20587 - DNA, 440 bp, Gossypium hirsutum
  Clone ID: uC-gsflnu33B016f12b1
tttggccttgccatggcaagggcttttggagatttttgcctcaaggattttggtctcatctctgtgcctgaaatatcttattggcacgtgtcagagaaggatgaatttatcgtcttggccactgatgggatttgggatgtgctttcaaacaaagaagtagtagatattgtagcatcttgtcgagctcgcacatctgccgcacgagctttggttgagacagctgttagagcttggagatacaagtacccaacttcaaaagttgatgattgtgctgttgtttgcctattctttgattcaacctcaaacaacctatctactgtttccaatgctaatgccaaagtgcagccagtttcaatggaccaagttgagaatgggaatgagacagacactaatctcattgtcttaaccagtgtggaccgttctgctactgttgcaagtgg

SEQ ID NO: 20588 - DNA, 364 bp, Gossypium hirsutum
  Clone ID: uC-gsflnu33B016g01b1
ctcatcacatccctccacgcactcaaattcggggctatttttaatcaaatcggggtttttatacccaattattatagatctagatcccatctttcaaacttatattaacgccttaaaagatgtccctcaacaatctaaacctcatgcccataaattaaaaaaataagccccaactcatactctaattactttactctcccctttatataaacattgaaacatggaaaaaccccgcatatacaatttaaaaagagctcattcaaaaaccagtttcaaccataggcttaaatttgaaaaagcccttacaaatcttcttaacctttacattccaactcaacctaccgaattggaaaaactctgtaca

SEQ ID NO: 20589 - DNA, 503 bp, Gossypium hirsutum
  Clone ID: uC-gsflnu33B016g03b1
ccaccccgtccgttttattttggccttggaagcttaataaagcacgttgcgtggttggcagttatggttcaaagtctcttgattgtggcatcccgcaaacattacatggttgatgtagttgtggcatggtacactgttaatttagtggtattcttcatagacaagaaactgccagaattgcctgacagaagcagtggaagctcaccaatgttgctaccattgagcaccaaagacaaggatagtaaaaccaaagaagagaaccacaagctcttgaatgggaattctgtagatcctgcagattggaggccgagaactcaagtaaatggcaagattcaggaagatggcaatggaatccatgatactgcaatgaacggagcataggtgatggaaattacatgctgtcactataatggggctgcctgcttgaatcctttatgtttcttccaaggctggtaaatttgaatttgtaatcataagaaaactgaaccttagtgcagttgtaa

SEQ ID NO: 20590 - DNA, 531 bp, Gossypium hirsutum
  Clone ID: uC-gsflnu33B016g07b1
tttacgatgccgttttcgcccttggtttcggggctgtctatgatcagttgagggaagggtacccgagtgatgaggatcgagatgccatcttccaagcttatattaacgccttaaaagaggtccctcaacagtatagagctgatgcgcagaaattagaagaatgggcgcgagctcagacttctagttcgctagtcgagttttcatctagagatggagaggttgaagcgatacttaaagacattgcagaaagagctggtagtaaagggagtttcagttatagccgtttctttgctattgggttgtttcgtcttcttgagcttgccaatgcaactgaacctacggtgttggaaaagctctgtgcagccttaaatatcgacaaacgaagtgtggatcgtgatcttgatgtgtataggaatttgctttccaagctggttcaagctaaagagttgcttaaggagtatgtcgattgggagaagaagaatagagaagaaagatcggaatcactcaagccaatgaagccgttaagaaatg

SEQ ID NO: 20591 - DNA, 502 bp, Gossypium hirsutum
  Clone ID: uC-gsflnu33B016g10b1
tttttcacgcgtccgggagctcatagcgtccggcggggaacaaatccacaacgaatgtcggccggtccaaaacctgttgttctcagattgtaagctcggaatcaacgatttgccgaaccacgtttacgaagtggattgggatgtgatattaatcgatgggccgagaggcaacggaccagaaagtcccggcagaatgcaaccgatcttcaccgtcggcgtgttagcgaggagcaagaaagggggcagccttaaaacacatgttttcgtacatgattattacagagatgtggaacagatgtcaggggatgagtttttgtgtagagaaaacatggtggaacgcaatgatatgcttgcccatttcatggtcgaaagaatggaagagagtagcttccattactgtcgcaataagaacaatgcatcatcgtcaacaaaagcttcagtttcgtagtcgttgttaattcaagttcatgaaaaagataaatcttttgtactatttatcatc

SEQ ID NO: 20592 - DNA, 506 bp, Gossypium hirsutum
  unsure (1)..(506): unsure at all n locations
  Clone ID: uC-gsflnu33B016g12b1
tcttcccatctaaatctgctacggcttcttctcctccggctgctgctccggtgagttctccacctgctccagtacctgtgagctctcctccagccaaatcgcctcccgttgctgcaccgacgactccaccagagagctcggcctctcctccggctcctgttgctgcaccaactactgctgaggttccggccccagctccaagcaagagcaagagcaaaagcaagaaatccaagaaacaccatgctccgactccttcacctgatatgcttggacctcccgctccaccaactggagctcctggacctagcctcgatgcttcctctcccggtccatctgtcgctgccgatgagagtggagcagaggcaatgaagaacatgaagaagataattggagggttggcgttgggatgggcagccattgctatgagcttctagatttgttttgatcacattccacattcntgcgtgtaattctttggttggtgtactgagaggccgaaactctag

SEQ ID NO: 20593 - DNA, 236 bp, Gossypium hirsutum
  Clone ID: uC-gsflnu33B016h01b1
gccgcgccggaattgccgcgtccaccgccgccgttttttcgtccgaaggccggccccaatcaaaggggggggttgaataaatctggcgggctttatataaggtccaagatggcggacacacactggccacttttgagaatgacatgagagtcaacggtatccactacagtgggcgcggttgttcaaaattaagaccacgaaaagggggccggcttcctatttattcactttgcatg

SEQ ID NO: 20594 - DNA, 232 bp, Gossypium hirsutum
  Clone ID: uC-gsflnu33B016h03b1
acccacgcgtccgttttttttcttctcccaaggggattaaaaatggggggcaagagttatgaacatgggaaaagtgacaaaagaccaactcttttggtgccacaacaaattgagtaagattaattttgttcataggaagattaatgtagaaccatctcttttgcttttcccatgttaatattcatgaaaaagtcttgtctacagttatacttacaccatcatatacttttgg

SEQ ID NO: 20595 - DNA, 85 bp, Gossypium hirsutum
  Clone ID: uC-gsflnu33B016h08b1
ttcacgcgtccgaaaaaaaaaaaaaaaaggggggaaaaatggaagccgctgtgggggaatacaaatttggccgcccgttctatgc

SEQ ID NO: 20596 - DNA, 400 bp, Gossypium hirsutum
  Clone ID: uC-gsflnu33B016h12b1
tcctcgcgtccgcccacgcgtccggtctgcagcgactaatattggcaaaggtgggggttatagccatcgctacaactgatgctcaaagcatttgcaacatgccagcttcacgattgatggcatgcaaaccagcaatgacccacgccaaccctccggcggccacgtcaacttgctgcttcgccctctcccacactgacatgcgttgcctttgctcatataagaactccaagctcttgccttcccttggtattgacccaaaccttgccatgaaattgcctagcttgtgcaagctaactcatcctgcaaatgggtaggtactggatctccatattcgatctcaaatgtgagggaaaatcaagcgtattataagccgctactacacataattgtactgaccttc

SEQ ID NO: 20597 - DNA, 477 bp, Gossypium hirsutum
  Clone ID: uC-gsflnu33B018d06b1
tccacgcgtccgaggaagtgcaccagcacgacttccattaccacttgatcttgcagaagatggccctgtttatgtcaatgcaaaacaatatcatgggattcttaggagaaggcgttatcgtgcaaagcttgaagcacaaaacaaacttgtcaaatctcgaacgccctaccttcatgaatctcgacatcttcatgcagtgaatagagctaggggatccggcggacgttttcttagcaaaaagaagctccaacagcctcatgattcaacttctaacccgagttcccattccatctctgatgccagctgcttagaccgaaagaacagatgatcagaacttgagagccatttgcatgtgagaggctgcagcagttcaagtacaagctgatcggacatctcaagtgcgaggaacatcaatgatagctgcagctacggaaacatggaatcatggacatctctcctggtgttagcagcatgtgc

SEQ ID NO: 20598 - DNA, 305 bp, Gossypium hirsutum
  Clone ID: uC-gsflnu33B018e02b1
caaggcgtcgtctacacgtgcgatcacgcgtgcgtaggcgtgttcgatctggagctaatagctgaaccataacagattcaactatagaagcgacatgggagattccaggaaaacaagggtaacttgaaagacccgagagtggtaaaggagataggtataggaatgacactgggactgagggcacgtaaggttctggaagatgcattactggaaggagtagaggaaagtgagagaatgtataaaatgctcgtgaaaggtgaaataagtgacatagcaaaagaataaatggactattagattagtga

SEQ ID NO: 20599 - DNA, 523 bp, Gossypium hirsutum
  Clone ID: uC-gsflnu33B018h11b1
tctctctctctccttctctgcctaaacccaaattattaaaacagtcgtcgtctgcaaccgacaccaatgtccaccgcagttccacccgttatccctgtctcctccgtgcaatccgtcgaatcccaaccgcccgctgccagccccgcctttctctctttcgtttcccgtctcaatgaatcccttcgcaacggcctctcccagcgccgtccttgggctgagctcgttgaccgttccgccttctccaagcccgagtcattctctgatgctctcgttcgcgtccgcaagaactactcgtatttccgagtcaattacctgtctgtgatcggtctcatccttgccttttcccttctttcccatccgttttcccttctccttctcctcggactcctctgctcctggatcttcctctacctcttccgccccgctgatcagcctctcatcctatttggccgtacattctccgatcgcgagaccctcggctttctcatcatcttcagcgtcttcgttgtctttctcactaccg

SEQ ID NO: 20600 - DNA, 487 bp, Gossypium hirsutum
  Clone ID: uC-gsflnu33B019a08b1
tgtcacgcgtccgattactcccatctgatcctgaaccaccaggcctgccatcgatttgaaatcccttcggttaaaagtagcatcaaagtgaatcgtcatcccagaactcgtatctctctgaatggccctcgtagtcgtacacaaggacccatatgccacagcaaagcaatcgaccttttgagagttctcttttggaacatccaataccgaaagacatgtgataaatcttcttccccagatctacatcgagaacaaacagcagtgtcgactactcgtttagatcgcaaattaactagagtaggcatatagttccatgatgctcttcaaactgtaatagtaatctttgagggtaactgtaaattccagagctttttgtagaaattttttaaatcggtatgtaataataagttgttaggattcgagctagtgctttgaatagtttggaggcacttctgaccgaaaatcaactccttggagttccgctaga

SEQ ID NO: 20601 - DNA, 547 bp, Gossypium hirsutum
  unsure (1)..(547): unsure at all n locations
  Clone ID: uC-gsflnu33B019c11b1
ttttcttctcattttcgagaacatttttttaaagattttttctatatattctttgaagatattaatcagaaaaatggcgctggtttctttcatcggaagggttctttttgcgtcagtgttcatcctctctgcttggcaagagttcaatgaatttggcgtcgatggtggtccagcggtgaaggagctgaggccaaagttcaacgtcttctcaaagactgtctcatctcacacagggttgcaagtgcctgaatttgatatcaagtatgtggttgctgctgctgtagcctttaaaggtgttgggagtattctctttacctttggcagcaccatcggagcttatcttctggttttgcatcaactcattcttactcccattggttatgacttctacaattacgagaaggagaaagaaagaatttggccttctttttacgaagttctcacagaacttggcgctgttaggggcattgctgttccttcattgcatgangaactcaatccccacaagacaactgaagaaaaggcctccgaaacccaaacagtttga

SEQ ID NO: 20602 - DNA, 418 bp, Gossypium hirsutum
  unsure (1)..(418): unsure at all n locations
  Clone ID: uC-gsflnu33B019d09b1
ttgacgcatactcatgtattggctcccaggatgctatggtttaaagtaaaaatatacatctcgcagagggtnctactggcagtaccttacaagtaaccgcctatcaaggtgtaatggaaactctcatggcagacaatcgacgcttcaaacacaaaaatggcaacacgacatctgctgtattactcttcgaggagcccgatttcacatggattgcgtccgaaattcgacattctcagttccatgtttcctcaaatagagcatggggcagcggaacagaggttcaccttcaccaagcatattatcaaggaacggaatccatagcttgccttcaattataatcgagaaccggacatcaagggtacaatataatggaccaaaaagatctgctgtcgaccgacaaatttatgagaaaacaaca

SEQ ID NO: 20603 - DNA, 438 bp, Gossypium hirsutum
  unsure (1)..(438): unsure at all n locations
  Clone ID: uC-gsflnu33B019g09b1
tgtcacgcgtccgaaaaccccattatttagtgatcaaattctgtttgtttggttgacttattttgagatctgattagtttttgaaattgggttttgaaaaatgaggaaacccacaaaagaatcagagttaaacactgagccaatcggtcaaaatctgatcaaattgattagtaatctctgtttctctgtttttgtgttgtcggttcttatatttacagccattgctatcacttatcaaccaccagatccatggctggaatcagctccttctttaaccaagctcttcactcaaactgaaaatgccactgtcggctgccattttttctctcattttctctcttgccaaacaccatttttcttcttcaaaagacagcaactggttacttctttaatttggggtttcaagcaaagttaaaccccattcaacaatnntactgt

SEQ ID NO: 20604 - DNA, 431 bp, Gossypium hirsutum
  Clone ID: uC-gsflnu33B019h06b1
ttcatcaagtctgcaaaaatacaaggctggttattggtgcatgatatggctctactaggcggaacaaagcactgataaaagtcgtttttccactgccggtccgaccaacaatcccaatcttacttcctccttcaaatatgcagctgatgccatgaaggaccagcggagcattaggccaataacgaacctgcttgatgagtttgacgttttattatgcattccctgtaaagttcatgactcaacaaatggagaaaatagttagtaaaaccttttgattataccttcaaattacaaatctcgacttttccaagacaaggccagccgtgtgtaggccggttagtttcaattacttcgggagcttcactaggaatatgcatgtattgctctaccctttctactgaaacaactgaacttgatagaaaaaaataaaa

SEQ ID NO: 20605 - DNA, 272 bp, Gossypium hirsutum
  Clone ID: uC-gsflnu33B022a03b1
ttttcttttttttttttttttttctcttttagctttactgtgatcgaaagttcaaggatcatggggtctgtaaacaaaaaccaaaaaaacacgttgagttacatataatatattccggtctttgacccaaaaatgtatcaacatgggtacggcccctggggaaaaacagggggggactttgtcgcaaagcccagaacactgtgtcaaataatcaaaaccgggtatcgttggaaaatccccaatgtatagctaccggtcgtggttgcccccat

SEQ ID NO: 20606 - DNA, 527 bp, Gossypium hirsutum
  Clone ID: uC-gsflnu33B022e09b1
cagaagaaagaccactggaaccggtaggatgaggtatctgcgccatgtccctcgcaggttcaagactggtttcagagaaggtactgaagcagcaccgaggaagaaggttgcagcagcttctgcttgaggtattacaaggttgttttggatgaagccttctttttttaggaaaacttttacgagaacatttttcttgaggggtgtcattacattgaatgctttagctgtttttagtttatgattatggagttgcattaaattttgaacaaggatgaatgctttagtttttctctagtttatttttgaggagttgcttcaaattttgaacgaggatggacaaggctattgttggttgacacttagttacttgatacatttttttgggatgaagctaatgtatgttcttgttctttgttagaaattatatcacctctcattttttcttttctcttatatttactacatcattcatccccttctattcttcactcatttcatactacatctttatatttcttcttatcttc

SEQ ID NO: 20607 - DNA, 403 bp, Gossypium hirsutum
  Clone ID: uC-gsflnu33B023b06b1
cccacgcgtccgcccacgcgtccggagaacaacaagctttttttaatactaaaattttaacgctttcctttccttcgtctttcctttgctttcctctgtgtgatttttaataaaagggaaacgagaagaaaaaatgcaggcaatttctcacgtgcaaaatcttaattcgtaccttataattcgccggtcgaagcctcggtttgataagccggttcggttagctgtacctgtacgttgtgtgtatcactctgattcggttcaattccccaatggagtcggttcaagccgggtggattggcaaagctcgtgtgctattttgtctagcaaagtcttctctcaggatcaagattccggtgacaaatcgaacacttcctccgtctccgatcacctggcggcggctgtt

SEQ ID NO: 20608 - DNA, 119 bp, Gossypium hirsutum
  Clone ID: uC-gsflnu33B023f03b1
tagtttcaagagagcgcaaaataagggcagagagagctccttggcttgcaatggataccgtctattcttagatctcttaaccctagccatttctattattcatcatgtatcgattctca

SEQ ID NO: 20609 - DNA, 222 bp, Gossypium hirsutum
  Clone ID: uC-gsflnu33B023g09b1
gtaagaaacaccagagttactgaagaaacaaaacatgaatatgtagaccttgttgctgatcatatcttgacaaatgctatccgtcctcaaatcaattccttccttgagggatttaatgaattggtgccacgtgaacttatttcaatttttaatgatcaagagctcgagttactaatcagtggacttcctgaaattgatttggacgatccaacggctcaacac

SEQ ID NO: 20610 - DNA, 97 bp, Gossypium hirsutum
  Clone ID: uC-gsflnu33B024c06b1
ttctttgtgagtgttacagtgaaaaacaaagataatggcaggcgggtccaaatccaattcaccatagcctaggaagagagacatccctgattatagc

SEQ ID NO: 20611 - DNA, 262 bp, Gossypium hirsutum
  Clone ID: uC-gsflnu33B025b03b1
tcctcgcgtccgggttaccccttggtcctccattgtcaacgtggggataggctttgtcatgttcgtctacatcattatccctctttgttattggaagtttaacaccttcgatgctcgaaaattcccgatattctctaatcagctctttactcacagtggccataaatatgatacaactaagatcttgacaccgcagtatgatctgaatatttctgcatataacagttatagcaatacttctatcctttatgcccaccttttt

SEQ ID NO: 20612 - DNA, 250 bp, Gossypium hirsutum
  Clone ID: uC-gsflnu33B025d06b1
gggtctgacccacgcgtcctggacaacgaattctacaagggaaaacaggattttatcatctgctgagcctctttcattcgtcagagaacagcctaccagaatacctaatgattctgatccttttctccttctaaagattcttaaccccatccacctgcctatactgataagaaaacccctcctaaaaaatgctttggttgcgaacatctcttgcgctaatgaagaaagagtttttgagtgtagcagaacc

SEQ ID NO: 20613 - DNA, 475 bp, Gossypium hirsutum
  Clone ID: uC-gsflnu33B025h12b1
tcgtatgaaagatctcttctcatgtctcagaagagactagagaagcgatttggtcagtccccggcatttattgctgctaccttcatggaacaaggaggcattccaccatcaaccaatcctgcaacacttttaaaagaagcaatccatgttattagttgtggatacgaggacaagactgcaatggggcacggatgattggggcggatcatatggagtctggttacagaaagatattttctgacttgggttttttatagcaatgcccatttggccttccgtctggggggtcttgtggtatttaatttcccaaaacttcccttaaattttagggccaaatttggtccccccttttcccccccttttccgggttttcccccccaaaggggcccaattttttttttctaaataaaagggggggggggtaatatttcccccttttggggcccctttttttccccccctttttaaatttttt

SEQ ID NO: 20614 - DNA, 440 bp, Gossypium hirsutum
  Clone ID: uC-gsflnu33B026a04b1
tttcacgcgtccgcccacgcgtccggagaaaacgcacttctggaactatcgaagaagagagaattatttcaagatttggctccattgttgtggaattcttttggtactattgctgcacttttacaggagatagtttcaatttatcctgttctctcacctccaaatctgactccagctcaatcaaatcgagtttgtaatgctcttgctctgcttcagtgtgtagcttctcatccagacacacggatgttattcctgaatgctcatatacccttgtatctgtatcctttccttaatacgaccagtaagtcaaggccgtttgagtattcgaggcttactagcttatgtgtcattggtgccttgatgaaggttgatgatactgaagttatcagctgtctcctgtccactgagataatgccattatgtctgcgcacaatggagat

SEQ ID NO: 20615 - DNA, 444 bp, Gossypium hirsutum
  Clone ID: uC-gsflnu33B026a06b1
tttaattctctcacgggttccactgcgattatcttcgaagtaaaagattagaaggctaaaacagtgagagagggcgcagcaatcaaaaatcaaatcgaatattgcagagaagaatagagaggaaagagaaggaaatggctttaaatggaaatggttgctgttggattcaggagcgtattttaagtagaaatggatgtagtgtgttcctcgctcccaggagtaggtcctctgctgtcattttgccccgcaagtcaaccgctctctccttttcctgttcctttcaattccaaggatttgtggtggataggaagcagagctcctcctctatgcaaacggctgcagtccgccatttggtgggatctgttaccaaaactcaaggccttcgctttgctgtggttgtcgctcgcttcaatgagattgtgacaaggcagctcttggagggcg

SEQ ID NO: 20616 - DNA, 413 bp, Gossypium hirsutum
  Clone ID: uC-gsflnu33B026a09b1
tcttgtcacgacatgaccagtattgggcaaccagctggcggacagcgagggagctcttgaggcaattgcagctcacggactgctgagaacttccgtggctctctgcgcctgcgagacatgaccagtccgtaactggaaacctttccactacaaaggctcatacttccacctggagatccccaattccatgtgtcaaggaggcgactttaccgccggaaacggtaccggaggtgaatgcatgtatggagccaaggtcgcggacgagaacttcatcaagaagcacacgggacctggcatactttccatggcgaacgctggaccgggtacaagggatctcaattattcatctgcacgaccaagaccgtgtggctggacagaaagcacgtggtgttcggacaggtagttgaaggcat

SEQ ID NO: 20617 - DNA, 571 bp, Gossypium hirsutum
  unsure (1)..(571): unsure at all n locations
  Clone ID: uC-gsflnu33B026a10b1
gttttgtgttaggtacaaatccatagaatttgatttgttggaatcgcaaatccttagtggcgattgggatgattgtattgataccttgaataaaattaaggatgtgaaggatgatacacgatcttcagttttgtttcttgtgttcaagcagcgttttttggagtatttgaatcgaggtgatgattctttggctttgtcagttttgcaaaaacgggttcccactttacatatgagcaacgaaacagttcataaattagcttatagtatacttgcattgaaagagatggagttgggtaagctagatgaagatgttattagtgaactgcgaaaaaggttagtgatggagctaggcaaacagcttcctccgccaattgtattgcctgagagacgtttggaacatctagttgaaactagtgtaacagctcaaattgattcatgtatatatcataattcccaggatgcagtcttgctttatgaagatcattgctgcggcagagatcagatacctacagatacagntcagattttgactgaacattagcattgaagttgggtcattcaattttcaaat

SEQ ID NO: 20618 - DNA, 420 bp, Gossypium hirsutum
  Clone ID: uC-gsflnu33B026a11b1
cagggcccccgactccaggttttaatcaaccagttcttgcgccaccaacaatgggtgaggccgcagcattctagccccaaattcctgctcgaccagccgagtctcctggtccaccatataagccccctgcaccagcaccggctgccgaggctcctactcccccatataaagccgctactgccgcaccggcacctccagtcgaggcccctacacccccatatgagcccccgacacctgctccagcacccccatccatagcacctacttcagcaccagcagctcctagtgaagcaccaactcccccatataagccccgagatcctacacctgcagttaagtcaccaacaactccatgcccgtcttacaagccaccaattgctgcattgccgcctgttatgacaaaaaaggattgcatgccat

SEQ ID NO: 20619 - DNA, 251 bp, Gossypium hirsutum
  Clone ID: uC-gsflnu33B026a12b1
cccggcggccttctcttctggaccacttttataggactacttgggtacatgatcactgcgggcatgtacacaacagcaatctcagtggtgtggacactggctgagctcattcggagtccacgagtgcaggacaaggcgcactaagagcttgatcgtgtgataggatccagaagggatgatgcctgaacgcagcttatataatctgtcttaccttaagacgcgtatccaaggaagcactacgactgcacccc

SEQ ID NO: 20620 - DNA, 127 bp, Gossypium hirsutum
  Clone ID: uC-gsflnu33B026b05b1
tactaaaaaaaaaaaaaaaaaaaaaaaaaagggaaaatttataaaaaattagggagtaaaaaatagaataaaaaaaagaggcaagcctctgtgggggggccggtgtttctgacgcgtgcttccgttg

SEQ ID NO: 20621 - DNA, 395 bp, Gossypium hirsutum
  Clone ID: uC-gsflnu33B026b09b1
tgtcacgcgtccggtgaaaaggtgcgcagcagtcagcttgctagtaaattgtggagtccaatatggtatccagattgcagtaactaaattaaggatctattctgaagctgttgcgtaaaagtaattagtttttaggaatcttcgggtgtatttgtaaattatatgcccactgagatctgtttatccatttgtatcccattcttgttttaagtaaaagaacacgcctcttgtgtattggtagtttgatgcgtaaataagttaaagcctattacagaatgccagatggagtatcaactgatgagaatgctgctgatgttggaaatagaacaactggggcgtccgatgttaagtatccaaggttccttacacgggcatgcaacgatttaactttttta

SEQ ID NO: 20622 - DNA, 546 bp, Gossypium hirsutum
  Clone ID: uC-gsflnu33B026b10b1
ctttcgcgtgggtggctacgcatccgacaaagctgctcagctattcggcatgagaggccggctatgggtcctatggatcctccaaacattcggaggtgccttttgtatctggctaggccgtgctaatacactccccattgctatcttggcaatgatcctcttctccatcggagcccaagccgcatgcggtgccacattcggcatcatccccttcgtctcacgacggtccctggggatcatctccggcctaaccggcgcaggtggcaacttcgggtccggtttgacgcagttgattttcttctcaacgtcgaggttctcgaccgccgcaggtctcacgtggatgggcgtcatgatcgtggcttgcaccttgcccgtcagcttggtccatttcccgcaatggggaagcatgttccttccgccgtcgatagacgtagcgagatcaaccgaggaacattattactcgtcggagtggaacgaggacgaaaagaaaaaaggcatgcactcagcgagccttgagttcgccgagaatagcctgtcggagcgcgg

SEQ ID NO: 20623 - DNA, 446 bp, Gossypium hirsutum
  unsure (1)..(446): unsure at all n locations
  Clone ID: uC-gsflnu33B026b11b1
tccgggttgagacccacgcgtccgttatgttgccttagagcttaaaggaaaatttacgaccatgccgggtgtcaatcctgaaattgagttcccagccattgagttccgttcatcggatttgaagcgaggaaccgaagggtggaaccgtttgtgcaagagggttcaacgggcttgtgagactttcggttgtttcgaggtggtatacgaaaaggtatccacgaaacttcgagaggatgcgtttgggttgatgaaagaaatggttgagctcccagtggagacgaagcagaagaataatagtcccatgccttaccatggttgggttggaccttgcaagcaggtttctgtgttgtatgaaggctctggagttggagatgcctncaactatgactctgtaaaaggtttgctcaacttatgtggcctaatggtcacccacacttttctgacac

SEQ ID NO: 20624 - DNA, 537 bp, Gossypium hirsutum
  Clone ID: uC-gsflnu33B026c02b1
ttcctcgcgtccgcccacgcgtccgggatgggggcggaagtatacggagggaaagtgaaggggagtgcaagccaacaaaaattgtacgacgagggagtgcgtgcgggtgcgttgggtctaatgataaactccatagtgttggcgttcgcgtcgttggggttagagcctgtgagccggttgataggtggagtgaagaacatgtggggggtggtgaacttgatattggcagcatgcttggcggggacggtgtggatcaccaaggtggcggaggcatggaggggtgaacatggaccacaaatcttgacccctccaccaaccagaatcaaaacctctgccttggctttgtttgggttgttgggtattccacttgcggtaacatttagcattccattcgcattggcatccatctattgctctgaagaaggtggcggtcaaggtctgtctttgggagtactaaacttgtctatagttatcccacagatgattatatcagtgattagtggaccgatagatgcagcatttggtggcggaaactta

SEQ ID NO: 20625 - DNA, 514 bp, Gossypium hirsutum
  Clone ID: uC-gsflnu33B026c08b1
ttgacgcgtgggcggacgcgtgggcggacgcgtggtgtcgggggcgccgcggttctgctatcgaatcggtctgttgatcggaggcgcagtaagtataagcttgttcatgtggttaggacacattgtggggcaaatgacaaggcattcaagtgtgtttaccaagaacaggatgataatggtaaaacaggtgtttcgatgtctaaagatttaatggcaattgctggtggtgcactcaagaccaatatcacaacattgggtccccttgttcttcctataagtgaacaaatcttgttctttgcaacattagttgccaagaaattgttcaatgcgaaaatcaagccttatatcccggatttcaagctcgcgttcgatcatttctgtattcatgccggtgggagggccgtaattgatgagcttgagatgaatttgcagcttcttccggtacatgctgaggcttaccgtatgactcttcaccgattcggcaacacttcttcgagttcgatctggtatgaac

SEQ ID NO: 20626 - DNA, 539 bp, Gossypium hirsutum
  Clone ID: uC-gsflnu33B026d02b1
tttatctctaaaccttcttcccatttcttcattacattgttcaagaacaaacaaaaaaaaaaaagaagcaaaaaaacatggccaaagttctgttgttcattgctctatgtgtgcttccagctttggttagtgctacacgcattctgaataaccaattggtggttgaaggctatgtgtactgtgatacttgccgtgctggttttgaaacccctaagactagaaggctagctgatgccatggttaagctggtatgctccgacaggaagaccggcggagttgttttcgagaaggagggatataccgacaaaaccggaaaataccagattcgtgtatccgaggatcacttggatcagatctgtgatgcagttcttgtgaagagcccccagcttggatgtgccacaatgtcccccggtcgtgaacgtgcccgtgttatcttgaccaactccaatggcatttcatccaccacccgttatgccaatagcatgggcttcatggttgacaaggctgaaagttgctgtgctgagatgatgagatgtatc

SEQ ID NO: 20627 - DNA, 296 bp, Gossypium hirsutum
  Clone ID: uC-gsflnu33B026d03b1
aacgacatagctcttatatagagacacctaaagggggggcccttttaggggtcccacatttccgtcccctggcaaaaccctgactttccccttcttagtggccctgaaatacattcccctggccccagttttccaactagcgaactggcaaaccccgggcgtcccccacataaattgcttagcctaaatgccattttggacgcgcgctgtaatggcaaataagccccgccggttgggctttccacacactgggcgacccttactgttgacagggccctaccctccgctgctttatt

SEQ ID NO: 20628 - DNA, 447 bp, Gossypium hirsutum
  Clone ID: uC-gsflnu33B026d05b1
ttctcgcgtccggataaaacataaaatagagagagatatattttatagaaaatagtaaaatactaataactttttaaaatgacagaggattaaagtgtgttcttgctttatttggagggtggtggtctccccatgggaactgtttatgttttattttgaggggggggccgttttttgggttcccttttttcctgccggtcgttgcggaattacttgtttttttttgtgggcccttgttttaattcatggggccgggttttaccaccggtgggcgggggatccccggggttttccccttttttttgcgttgtggcgacttccccttttttctgtgggggcaatttaaaaaaggccccttcccgtcgcctttcctcaaagttgctgccccttctttggtgtttggcaccccccttttcttggccttttttgccggttggttgggtggtt

SEQ ID NO: 20629 - DNA, 542 bp, Gossypium hirsutum
  unsure (1)..(542): unsure at all n locations
  Clone ID: uC-gsflnu33B026d06b1
ttcacgcgtccggcgtaagccactcgagtgccaacaaggcggatgagatagatttagaatcaggggagactttgtacccgggactcagctacggcgagaaccaactccggtggggttttatccgcaaggtgtacggcatcttggcggcgcagctggttctaaccaccgtggtctccgccttcgtggttctttctgctccggtcaacgagctccttcgtggaaattctggcctcttgctcttcctctgtttaatccccttcgtcttgttatggcccttgcacgtctatcaccaaaagcaccctgtgaacttggttatcctcggcctcttcaccgtgtcattgagtctcacacttggtgtgagctgtgcaaatactgatggaagaatcgtgcttgaagcgctaattttgacagctgctgtggttgcatctcttactggctacagtttctgggcatcgaagaagggcaaggacttcagctatctcggaccgattttgttcaccagccttattatcctcatcttaactggtctaatnncagatgtc

SEQ ID NO: 20630 - DNA, 319 bp, Gossypium hirsutum
  Clone ID: uC-gsflnu33B026d09b1
gtactggggcatggaaatgacccaccaatgatagcttgcctattggctaaactaacatgcaattggcatatggcagggagagagtttagagaaggttcaagcaggaattggggggggggggacatttttcatggtcaatctgttctctgtaatgggtggttcctgggtcccaactcccaagcaggtcgcttaaatttagtgtttctgcttgtatgtttttattagaagaggcagtttgcatgttgtcttttacaagtaataataataaatcatagggcatttgtttataataaaaaaaacatgagaaaatgtaaaaact

SEQ ID NO: 20631 - DNA, 328 bp, Gossypium hirsutum
  Clone ID: uC-gsflnu33B026d10b1
ctatgttacttgacgtactacatatcggcatgtgaaacgtgcgagctgtgcgcggcctttgttaatgcctttacctccataggactgttgctagactgacacaggaataaaagtgtggacacccatgctgtggatattggtgcggttcaaacatgtggtgccgcctcatcatgtatgtcagttatgtagtcggtgtggcctcagctgatatgaccgtggaggaagacatgcatttcacctgtgtagagcccaatgacatggctcgtgacgtacccagccgagttggtagaatggcagatggcgcttgacctgaagggtgagggatgat

SEQ ID NO: 20632 - DNA, 525 bp, Gossypium hirsutum
  unsure (1)..(525): unsure at all n locations
  Clone ID: uC-gsflnu33B026e02b1
gctaatgggtcatcttcttcaactctactcttcaaattcaacagatcttttccagttcttcgtgcctcttctggttcctcttcttctgttgacactggtttgagtactgaattggatgctgtgtctactttcagtgagatagttcctgatactgtgatctttgatgattttgaaaagtttccaccaactgctgcaactgttagctcttcattgttgttgggcattttgagccttccagatactatttttagaaatgccgtggatatggctttggcggattcgacatgttctccgctggacaatcctgaactgaggttgtcttgttttgttaacaaggctttagtaaatgttggtggtgacttggcaaagctagttcctggtcgagtttcaactgaagtggatgcacgcttggcttacgatacacatggaattattaggagggtgcatgacttgctgaggctgtatgatgagattgccgttccttcagaacgcttngttgttaaaattccttcaactnggcaagga

SEQ ID NO: 20633 - DNA, 498 bp, Gossypium hirsutum
  Clone ID: uC-gsflnu33B026e10b1
gtgatcacagctctacacagcagctgagtattttgaactttcctacaccaatgatgaccaaaaacagatagtggtagaaacattgaaagattataccatcaaagcacttgtgaatactatagaccatttgggttctgtgacatacaaggttaacgatcttttagacgaaaaagtcgaagaggtttcaggaactgagctccgagtctcttgtattgaacagagactacgaacatgccacgagtatattgatcacgaagggatttcacaacagtcatcggtgattaatacgccaaagtacaataaacgatacatcttgccagtcggggagaccatgcatggtgcaaaccttacaatgtcgaaatacgtaggatgtagtctagatgacgaagatgactggcatcagttcaagaatgccgttcgagctacgattcgagaaacaccaacatgttcagtccgggaaactccgacatcatcggccagtttcagaaaagggcgatc

SEQ ID NO: 20634 - DNA, 151 bp, Gossypium hirsutum
  Clone ID: uC-gsflnu33B026e11b1
gtccgtttctaacattggttaggaaccaggtcctacttttccatctggccaccaaagcacctttcatgtgaaaattttgtttttggaacactcactttgtttgctcttctccaaatttggtatttccactgaatgtgcaatgttgcctggt

SEQ ID NO: 20635 - DNA, 350 bp, Gossypium hirsutum
  Clone ID: uC-gsflnu33B026e12b1
ttttcgcgtacgggagtccctcactttattgcgtctatttgattggaattatggctggaaataggattgctgctatcccaccaagcgcccttgctttcaatccttccactgatgctgggcccacccttgtttatggtactggtttctcccgctttgttgaaccagcctatgtctctgtacggtactcattccctcgacttgttgggttggcgaacctgacatctctcggtgaactctcacgtgtccctctgtccacatcatttgcacctaccataactttcatggtttggggcatgaacgtgacatggccacaggagaaccttctgatacacatggcaacgtgcaagatc

SEQ ID NO: 20636 - DNA, 405 bp, Gossypium hirsutum
  Clone ID: uC-gsflnu33B026f01b1
gtctgcaagaaaggcacaaggatgggtgaagctgcgaaggtcatcggtgactgtgcgagcccctacagattcggggaagctctggggttggagatgacaggagttgcgtatgcatacatctacgatgagccagttgacgacgtgagcgaggagatgaccagatgcagagcggatcatatgagagtagcgacagttagcacacaagccaagcaatcggatgtggaatgcgttacactatgatacatgtgtggaaactgcggatgcatagatccctatttaggacaatgacccttatgacaaatccaccgatcgactctgggtgaggaccactgacgatggtgctatggtaccctttggctagctacatgtatcgccatgattgagcgcgaatatgtgaccaatgaa

SEQ ID NO: 20637 - DNA, 458 bp, Gossypium hirsutum
  Clone ID: uC-gsflnu33B026f03b1
ccctcgcgtccggtgcttttgtggttgctgacagctgcttgcatcaaaacgggaaggccacaaattgcaagacgcgcaatagaccttgctgagacacgcttgttgaaagatgggtggccagaatattatgacggcaaacttgggagatatgtcggtaaacaggctaggaagtatcagacatggtcaatagcaagatatttagtggcaaaaatgatgatggaggatccgtcgcacttggggatgatttctttggaggaggacaaacagatgaaaccattgataaaaagatcatcttcttggacttgctaaaaaaaggaaagaaaaaaaaccatgaattgggaaatggaaagagaccaacttcagaattttcattgtaccggtaccagtctttcttcttcttttacgttatgtttccaagtcaagaaaattgtgacaaacaagaagagaagaaaagaaga

SEQ ID NO: 20638 - DNA, 502 bp, Gossypium hirsutum
  Clone ID: uC-gsflnu33B026f07b1
tttacgcgtgggcggacgcgtggggagctttcgtgtttgtctattgaattctttccctcactttctcgaaaaaaaaaatgtcttcaggtcgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaagataacaggcctctgtaatgatatattgtcaaggatggatgcctgcaaggtctataattatttctctgtctgtgtcttgtgcaatagaagctttgattgtggtgaaaataatgcataagccatttggttgggagcaaattgtccttttctc

SEQ ID NO: 20639 - DNA, 542 bp, Gossypium hirsutum
  Clone ID: uC-gsflnu33B026f08b1
cccacgcgtccggtggctctatgatttttctgtttttatgtgcatttcttgataattcattatagatgctcattatgtatttgaatctgtgtgatatcaaattaatgaagtttacaaataattaataggatttcccaagctggttggcttcctttcacacgacattggtgcttagatagtattttaaaagacttgtctggtttttcaaagtagagcttgacctgctgagcaattcctgattctcatagtcatatgagaaacagatggattggcatctagttatttatgaattattaaactacagagtaagaatgtctaggcttttctattaggggcaagttctgctaatgtttttgagagaaatggtatcttgtgcaagtaatctttaatcttcatgcacgtggaaagtcagcttctcctggcctatctatctcatggtttgtttctcttatttaggctcgtgtcgaacaaaactagtccggcttgttatagggttatacataaactatagtgctattattttccactggcaaaaggatata

SEQ ID NO: 20640 - DNA, 468 bp, Gossypium hirsutum
  Clone ID: uC-gsflnu33B026f09b1
acggagggagcgggaacaagctctggaagtgatctcgtgttactgttaatttcagctgctgcacatgcggacatatactactagagattctcatactggagaccataaggcatactgcagctctggcatgggtcctgtcatgtacgctcgctgtcaaagggacttgattttccaaagaacattagtgtaattgctgtgtgccccaaaggaatgggtccatctgtaaggagactctatgtccaaggcagggagatcaatggcgctggaatcaattctagttttggagtccatcaggatgctgatggtagagctactgatgttgccttagggtggacggtggcccttggatcacctttcacgtttgctactactttagagcaggaatacaagagtgacatctctggggagcggagcattcttcttggtgctgttcatggacttgtggagactatagttagaagatacact

SEQ ID NO: 20641 - DNA, 571 bp, Gossypium hirsutum
  unsure (1)..(571): unsure at all n locations
  Clone ID: uC-gsflnu33B026f10b1
ccctcgcgtccggtagtagcaaatattcacatggaacctttcccctcttcggccttcaaagcccacgcgtccgttgaaacgcttgtttatgagcaaagttaacaagcctccgctatctctctctaggcttattgagttcatggaaggaaaggaggaaaagattgctgtggtagtggggactgtgacagatgatataagggtttatgacgttccagctttgaaggttacagctcttaggtttactgagactgctagagctaggattgagaaggctggtggagaatgtttaacttttgaccaacttgctttgagggctcctttgggtcagaacacggttctcctcagaggtccgaagaatgcacgtgaagcagtcaaacactttgggccggctcctggtgtgcctcacagccacactaagccatatgtgcgctcaaggggccggaagtttgagagggccagaggacgaaggaacagcacggggtctagggtttaagatgacttcagtgtttgttctgaggctggnttttcaattattactgcaaacaaaaatttgctatgcatagggttctct

SEQ ID NO: 20642 - DNA, 557 bp, Gossypium hirsutum
  unsure (1)..(557): unsure at all n locations
  Clone ID: uC-gsflnu33B026f11b1
ttcttctcctcttttctccactgagttcgtttttaaaaccagctcaactcggttctgcatatcgaacgcactctccccttctctttctatcctattccatggggcagaatccatcgcgtcatctctggaacctcaatcacctatcctttattctgtagaaaaaataataattcaagacattttttttatctgttgactttttttcccctttctttttggccatgaatcaaatagctcgaagccatttgattatgtttctttttgctctttcctttcttgttccttcaattgaagccagcgaaggtgatgctgatccgatttacaagacttgtttagaagactgtgaaaaaagtgggtgtgtaggggaaatgtgttttcaacactggaaattctcttccgatgggaaaccaattgatggaccatggtatttgcaagaacccctntatcagaaatggaaacaatgggattgtcggtccgattgtcggtaccattgtatgactgctagagaggaacagagatggaaactcggtgggaaaccgatcaaatatcacggaaaa

SEQ ID NO: 20643 - DNA, 424 bp, Gossypium hirsutum
  Clone ID: uC-gsflnu33B026g04b1
ttttacgcgtccgatcaaccaatctccatcggtggatccacataagaaactaaactagagccagggatgcgtattttatacaccaagatctagatgacggacccaaatctggatctggatgaatcgtttcggaaggaactcaggagagaggctcgaaagatcgagggcgatctggacttgaaagtatgtccttatgctaagctcggagctaggttcacccaaggagatactgggtcatcatccgttgcctaacgtagttgacgaaggtgtatggttatgggacttaaaccattgctcgagagactgcttgtcactgatcgatgccatgatgccgaggtgctgagtatgatgctcacatgacctgagtatacccacaatgtcgtaaggcttaaacgcatactacatgagcttactcatgcttatg

SEQ ID NO: 20644 - DNA, 239 bp, Gossypium hirsutum
  Clone ID: uC-gsflnu33B026g06b1
ttttttttttttttagggtgctttttatacatgctttgcgaggttcaagaagacatttgcttatgtttttcttgccaatggaaaatgtttagttttccctatagtcattccccaaacagtctttgggtcactatgtagaacagaagtgtagttaaagtttgagggatatataatgaagtatatatagttgctttctcaaaagatgtaccaaatgtaggtttttatgtattgttggtttc

SEQ ID NO: 20645 - DNA, 547 bp, Gossypium hirsutum
  unsure (1)..(547): unsure at all n locations
  Clone ID: uC-gsflnu33B026g08b1
ttctaaactcgccgagcaagccgagcgctacgaggagatggttaggttcatggaaaccgtcgtttcctccgtcgttgctcccgacgaacttaccgtcgaggaacggaatctcctctccgttgcctacaagaacgtgatcggcgcccgccgtgcttcctggaggatcgtttcttccatcgagcagaaagaggaaggacgtggcaacgccgatcatgtctccatcattcgtgagtacagggccaagatcgaggctgagttgtctgatatttgtgccggaattttgaagcttctcgaagagaagctcgttccggctgccgggaacggagattccaaggtcttttatctgaagatgaagggagattaccataggtacttggctgagttcaagactggtgatgaccggaaagccgctgctgagaatacgctctctgcgtataaatctgctcaggacattgcagtttccgagctcgctccaactcatgctattcgtttgggattggctctgaacttttctgtcttctactatgagatctngaattctcctgac

SEQ ID NO: 20646 - DNA, 556 bp, Gossypium hirsutum
  unsure (1)..(556): unsure at all n locations
  Clone ID: uC-gsflnu33B026g09b1
ttcaagcaactttgacgcagctgctatttcttttttgtggttttcagcagcagcttgtatttggaagaatggtgagggtgagcgttttgaatgatgcactcaagagcatgtacaatgcagagaagaggggcaaacgacaggtcatgatccgaccgtcctcgaaggtgatcattaagttccttttggtcatgcagaaacatggttatattggggagtttgagtatgttgatgatcatagatctggtaaaattgtggttgaattgaatgggaggctgaacaagtgtggggtgatcagtcctcgttttgatgtcggtgttaaggagattgagggttggactgctcggttgcttccttcaagacagtttggttatattgtgctcacaacatcagctggaattatggaccatgaagaagccagaagaaagaatgttggtgggaaagtacttggcttcttctactgagaaattgccttttttattttgaatcgaactcatattattaagatngcatctttttgaagttcacaattattggtttaatgttttgttacgattat

SEQ ID NO: 20647 - DNA, 503 bp, Gossypium hirsutum
  Clone ID: uC-gsflnu33B026g10b1
cttcaataatgtctaccacacacttgctaatattgctacttggagtggtggctctcgccactccctcttttggtacctatgagtctcccaactatgggaagccccctactcctgtttataaacctcctaaggtgaaacccccaccttatgaacatcctgtttataaacctcctaaggtgaaacccccaccttatgaacataagccccctgtctatgaaccaccaaagaaggaaaagcctgagcctaagccaccagtttatacacctccaaagaaagagaagcctgaacccaaaccaccagtatatgaacctccaaagaaggaaaagcctgagcctaagccaccagtttatacaccaccaaagaaagagaagcctgagcccaaaccaccagtatatgaacccccaaagaaggaaaagcctgaacctaagccaccagtttatacaccaccaaagaaagagaagcctgagcccaaaccaccagtgtatggaccaccaaagaaggag

SEQ ID NO: 20648 - DNA, 492 bp, Gossypium hirsutum
  unsure (1)..(492): unsure at all n locations
  Clone ID: uC-gsflnu33B026g11b1
tttctcgtccgcccacgcgtccgatttttttccttttctttttggggtgcggctccattaactcggtcatttgtttttcttgtaaactttttcttcaacatttgatctgataggggatgggaacatcaaaaaaaaagttttttttggggggggggggtgccattgttgatgattttaatgggggactgaggtgggagcccaagaatgccaaaattttcgtttacttagcaaacacatggcctaattgccaatgaacaaaatttgtataatgcatatgttggaaacttccaaaaaaaagaaaaaggaaataaaggtttatatcaaatatgaattaaaaaaaaaaaaaaaaaaaaaaaaaaaaaaaaaaaaaactaaaccccccccaacaaaaaaaaaacaaaaataaaaaaaaaaaaccnnccccccccccaaaaataaatacaccaccaaaaaaaaaaaaaaacaaaaccctaaccaccgggggggggccct

SEQ ID NO: 20649 - DNA, 235 bp, Gossypium hirsutum
  Clone ID: uC-gsflnu33B026h01b1
tctacgcgtccggtttgattttaatgttgagcgggggatattttctttttcatcttaaaacctatattgtcttctggttgctcagtaagaatgatggtggtggtgatcgaactttgatcatctttgatatataatgaaataaacaaatatataaactggcgaaatagaaatatttatacttatattttgtgaactcacataaatacagtggacgcgcgtttttaacataatctct

SEQ ID NO: 20650 - DNA, 277 bp, Gossypium hirsutum
  Clone ID: uC-gsflnu33B026h04b1
cgctgttatgggcttctaatccccaggacaaacgggagatttgcttaaaacttccttcaactccccccattgggcatgaggtgctttacatgcgaagcctgaagaatagaggagctgccctgatttgttgcaaatcaaacaatgggcatgacaacatcggctttaacgaggcgatggcggcaatgcaaatggaagctttgcagtaccagatgatgatggaaggacagtgtgtatacgaccaagaggccccttaactactaaatgagcttatgatcaa

SEQ ID NO: 20651 - DNA, 549 bp, Gossypium hirsutum
  Clone ID: uC-gsflnu33B026h05b1
tcttcacgcgtccggcggtagggaaccaactgttacacacagcagcagcagcagcagccatggtgaagtactcaagagaaccggacaaccctactaaatcttgcaaagctaggggttctgaccttcgtgttcattttaagaatacacgagaaactgcctttgcaatccgaaagctacctttgacaaaggcaaaaaggtacttggaagatgttattgcccacaagcaagcaattccattcaggcgcttctgtggtggagttgggcgaaccgcacaggctaagaatcgccattttaaggacaaggccgttggcccatgaaatctgcaaaattcattctcgatttgctcaagaatgccgagagcaatgctgaggtgaaaggcttggatgtagattcacttatcatatctcacatccaagttaaccaagcacagaagcaaaggcgccgtacatatcgtgcacatggtagaattaacccctacatgtgttcaccgtgtcacattgtactgatcctgtctgagaaagaggaagccgtcaaaaaagagccggagac

SEQ ID NO: 20652 - DNA, 501 bp, Gossypium hirsutum
  Clone ID: uC-gsflnu33B026h06b1
aaggcggatcccccggcgggatccggttccggaattccgggttgagaccacagccgtccgttcaggatgccgccaaacggaacaaaattgggggcccttttctaagccctggacgctcaccaattttttctaatctgggcacgctggtcccggacatcctacaacgcgaccagtaagcctacttatcccagatagcggaacatgccaaacgctacgaggcgatggatcaattgatgcagaacctacgcgctcggatctactactgcttccgagctgaccgcccgaggaacggaacctcttctcggtcgcttacaaaaacgtaaaccgatctgtacgcgccgggcggaggaccgttctttatatcgagcataaagaagaaagccggaagaaccaagaacatgtgaggctgcgcaaggagtactgatcagaggttgaatccttggcgtccgatgttcgcactagtatcttgaatctgttggactcgtatctgatcccatctgc

SEQ ID NO: 20653 - DNA, 389 bp, Gossypium hirsutum
  Clone ID: uC-gsflnu33B026h08b1
tgtcacgcgtccgccagcatcaaacatggatccttacgttgttacatcaatgattgctgagaccaccattatctggaagccttaagagggggtggaaattgaaggttgtgaaagacgagaaggaaaaacctcattcagattaataaaaccccctctctcatctttctttgttgggccactggttgaacttgtattttattgctttggtttgctggcttgcaatttaaattgtgcgacttattattattattatcattttagtttatagtcttatgctgctgctgatatgttcacatgaacgaatttatcgcgttttaaataaaattgtagttgattgttcgcatattaaaaaataagatataacaacaatactattgctttttaaacgg

SEQ ID NO: 20654 - DNA, 86 bp, Gossypium hirsutum
  Clone ID: uC-gsflnu33B028a05b1
aatacggaaaatgactaatatgactacacatattctgatttaacatggaacaatagggactagaacaaaccgctacggtggaatac

SEQ ID NO: 20655 - DNA, 236 bp, Gossypium hirsutum
  Clone ID: uC-gsflnu33B028a09b1
tccatagatacgcccacgcgtccgcccacgcgtcctttcgaaataccgtctctgtgtgcctcttgagcttcagagacttcagtatcgacactccggctaagctcttcagctgttctttcacaagcacttaccgttacatcagttgttgccccaaaatccacttgctacgcgtttgataattctagtcatctccttgatttgactgagtggagcggaagtactttagtgtacgaggg

SEQ ID NO: 20656 - DNA, 316 bp, Gossypium hirsutum
  Clone ID: uC-gsflnu33B028a10b1
gctgatgcccccctgcaccgcccgcgactgtacactctggctggacccacccacgcgtatgttttagccggcctttttatcaacatcaccgcgcttatgatccatctgactgataatattggcaacacccatatttgttatctcactttgccgggcggccgatccaatggtccaattctaagaaccactttcaaagctctgcctacgttcgctatggtgctacttttaaacaaccagcttacaggctgtatacgactatgagactggtgagctccaggcggctgcccactttgatgcccttgccaaccatgcgact

SEQ ID NO: 20657 - DNA, 184 bp, Gossypium hirsutum
  Clone ID: uC-gsflnu33B028a11b1
accgaccgcagcgcgtactggtttgagatccaaagaggaagctacgactgctgatatacataggcggattaccactttcggcgacaaagacagaccggtgagctggcatacagggcggactatccagaggatgcatgctaactaacacaggcaggcgacagcctacatcccctatcgtgtaaaa

SEQ ID NO: 20658 - DNA, 79 bp, Gossypium hirsutum
  Clone ID: uC-gsflnu33B028b01b1
gagggaccgggacggaccggccggaccgacccacccgatttgattaccaaccaagcgcacaccgggcacgggggggggt

SEQ ID NO: 20659 - DNA, 285 bp, Gossypium hirsutum
  Clone ID: uC-gsflnu33B028b02b1
tacatatcgaccgatccaaaacggggacccagtgcatttcgtgcatcgtatccgcggtgtcatctaatcgggggcccatggtagtcgatcacccagatcttattttgtatgaaccgtttgcgcattaaagtgcgtttgcggttgagaacggaaactatgctttgcggggctgaaaaggggagggcccgcacatgtgtacctaccatatgaataaggccatacgttcatcagaaagatccccaatggcatgtgacaaggaggccactttaccgccggaaacaggaa

SEQ ID NO: 20660 - DNA, 494 bp, Gossypium hirsutum
  Clone ID: uC-gsflnu33B028c09b1
tctcctacgcgtccgtgtgattttggggtattaagtggtcaacaaagctgttgcttattttatacattcggtgtttgatgctactgctattgagggtttgatctttgattcaaatcatgaattagaaccttttgactaattatggatcctaattaataagggatgacaaactccggtcggctgcatacggtataagggcgagattgatggttggagtgcggatgttagtttctaagttctgagatttatgaggaaattgctgaagttggtagtcatttgactgttgcgtaaccaaacatagggttgttgagattagatacactgcaaatatgtgtacgtgttgattatcttgtcactattaatatttttttctccttttatattatacaatgtatctactcctctaaaaatttctactcttatactctcatttctccgttgttaatactttatattttctcctgttttctatctttcttatatttttaaaattt

SEQ ID NO: 20661 - DNA, 553 bp, Gossypium hirsutum
  Clone ID: uC-gsflnu33B028c10b1
gctggtgcgcccgctgcaagcgcgcccgcggacggaacctggccggaccgcacccacgccgattttcgcagtatccacggggtattcttttgacgtacactttttacatcgggagacattgagatactgtcaagggacgagctatctggtatctccaattttgtttgtgatggcggatgagtcaagaatcattttggtgttttgtggctctgatggaacgccttgggcccaattttaatgggggtcaaaatggcatgcattctcagtttttcgcattatctaagctggtggagttgctggacagacctctgaacaaatatttcgagcagaatgactgcttgaattatttctttagatcccggtggattctgatacaagttaaatgggaacttgaatactagcaaacaatgcgattgtgggaagtattgtggacgcattatttgttggagcacctgcaactgtatgtgtgcgtagctatctcgaaccgctatcgagggaaaataatgggagagcaaatggactttgataccctcttgaagttatcaatgagctg

SEQ ID NO: 20662 - DNA, 461 bp, Gossypium hirsutum
  Clone ID: uC-gsflnu33B028d02b1
tttatagagatcaactctctaaaacagacgatgtctgacaagattggcacctgccattgccctgacaagagccagtgtgtgaagaatggaaacaggctgttcatggagactgaggtgagatacatcagcacccgagtggtcgagcctctggcagagaacgatggaaggtgcatgtgcggaactagctgcagatgcacaaactgcacatgtggcagtcactaagcagacatatagaatgatgaagtttgggacctaaaaagaataaaagttgggttgaataatttgagccttttgttgcagtttgagtgtgacttcttgaatatatgcccaacgatagtctatgtctctcattttatacaatgatggaatgaccatgtcaatggcctttgtctgatttatgaacaattattagtatagccaatacaacatggctcactttattgcctggcataatatctccc

SEQ ID NO: 20663 - DNA, 376 bp, Gossypium hirsutum
  Clone ID: uC-gsflnu33B028d05b1
atttcattagaggacgtcaaatatgattccgagcgcaaatatgcattagcaaatgacttctgtgaaactgcgcatggcccattaacctagttatggccggcctgaagctcagcgaacgcacaatcaacgctggcgtgctagaactattgcggtataaatgccctgaaggctaaaatcgacgccaaatgcgatagaaggacgcactgggctacgcgacgtagattgaacatgcatgtaacactaaaacggctaaaagaactcctgtagtcggagacctattattgagagttgtgtcgtatgtgtatctcatggtcgcatagaagcctacatacctggtgtcgaatgctttatgtttgctcatactttctgctttggt

SEQ ID NO: 20664 - DNA, 550 bp, Gossypium hirsutum
  unsure (1)..(550): unsure at all n locations
  Clone ID: uC-gsflnu33B028d09b1
gttactgcagaagaattggttgaggttttttccaagtgtggaataatcaaagaggaccctgaaacaaaaagacctcgtgtgaagatctatgttgacaaggagacaggaagaaaaaagggggatgcgcttgttacatatctaaaggagccctctgttgctttagctgttcaaattttggatggaacacctttacatcctgatggaaaaatccctatgtctgtaagccaagctaaatttgagcagaaaggggataaatttatagccaagcaagtggacagcaggaagaaaaagaaactgaagaaagttgaggagaggatgctcagctggggtggccgtgatgatgcaaaggtgacaattccagccactgttgtccttcgtaacatgttcacgcctgctgaaatgagggcggatgaaaatttgtgttcagagctggaggaggatgttaaagaggaatgcttaaagcttggtcttctggactcagtcaaggtttgttcgaacaatccccaaggtgttgttntggtcaaatataaggacaggaaggacgctcaga

SEQ ID NO: 20665 - DNA, 467 bp, Gossypium hirsutum
  Clone ID: uC-gsflnu33B028d10b1
tattatcactaaaggacggttcctttgatttcgagagtagatattcgctcgtttctctctttcgtcgaactccgcgtaataatcgctcatatttctcgcagacgtgaagaatggggctgtctttcacaaagctgttcagccggctttttgccaagaaggagatgcgtatattgatggttggacttgatgctgctggtaaaaccaccattctttacaagctcaagttgggagagattgtcaccacaattccaaccattggtttcaatgtggaaactgtggaatacaagaacatcagctttactgtctgggatgttggtggccaggacaagattcgtccattgtggaggcattacttccaaaacacacaaggactcatttttgcggttgatagcaatgatcgtgatcgtgtggtcgaagccagggatgagttgcacaggatgatgaacgaggatgagctgagggatgct

SEQ ID NO: 20666 - DNA, 526 bp, Gossypium hirsutum
  unsure (1)..(526): unsure at all n locations
  Clone ID: uC-gsflnu33B028d12b1
aataaaagtaaaggagaaaatgaagggtctgcaggcacttatattggcaatggtaacggttatggcgatcgctacaactgatgctcaaagcatttgcagcatgccagcttcaggtttgatggcatgcaaaccagcagtgacccctcccaaccctccgccgcccacgtcaacttgctgctccgccctctcccacgctgacatgcgttgcctttgctcatataagaactccaagctgttgccttcccttggtattgacccaaaccttgccatgaaattgcctagcttgtgcaagcttcctcatcctgcaaattgttagttcctggctctccatatttgatctcaaatgtgagggaaaatcatgcttattataagcctctacttcacattattgtactgagcttcgggttttctttttcctttatttctttntaatgtgttgggtntcgattggtatcttatagtcgtgtaatatcacatacgtgtgatttctcaccaataatcatatattagtattgtttncaccatg

SEQ ID NO: 20667 - DNA, 524 bp, Gossypium hirsutum
  Clone ID: uC-gsflnu33B028e06b1
cctatcttcgtccggagatttggcatcctaatgtttatcctgatgggcgtgtttgcatatcaattcttcatcctccaggtgatgatccaaatggttacgagcttgcaagtgagcgctggatgccagtccatacagttgaaagtattgtattgagtatcatatcaatgctttcaagccctaatgatgaatctcctgcgaatgttgaagctgctaaggagtggagagagaggaaagatgaatttaagagaaaggttggccgctgtgtccgacggtcgcaggaaatgttgtgatcaatgatggctgttgctgctgttccttttctagaatatatgaactcgtggaatgccttaatttttatcatgtacggagatgagttgcggctgattacaccgcagaatccttgtgaacctagggagtgccttaaacttaaagcccccctccccttcccctccctttcccatcttttctattttattaatgggctttaagggtagtgttctttggattcgaagcgtttggttctg

SEQ ID NO: 20668 - DNA, 367 bp, Gossypium hirsutum
  Clone ID: uC-gsflnu33B028e07b1
cctacgcgtccgattccttgcctgccttaaacctacttcaagcataggcatgactactgaaatggtaatggttgatgaaggccctactactacacagaatgacaactaccaagccactatgttttttgggtcatgctattaccgacattgagattcactttttgcaaatcaagttcacagtaaattggggattacctcgaaccagaagatgtaggacaattgcctcaatggaaggggaagcctgggaacgtgctaactgacgatgatgactaatgcgaggctcttattaatgctacactgtagaaggttatgagagttggggtgatcaaagggatcacaggttgccaatatcgtgtgcacatataga

SEQ ID NO: 20669 - DNA, 462 bp, Gossypium hirsutum
  unsure (1)..(462): unsure at all n locations
  Clone ID: uC-gsflnu33B028e09b1
tgcctacgcgtccgcccacgcgtccgcccacgcgtccgggaaggtagcttggttatacctgcagcaggtgactataagccaaatggagtccatacttctgtggctaaatctacagatagttctatgggagttacaagtggtgaaaccaaggctggttctttgatgggtctggaaactttaatcaaacccaatcacagttccactgctgctgatgaacaggctaaagctgcagaagaattcaagaaaacaatgtatggcacagctgatagtggtagcagcagtgatgaggaaggagtgtcaaaaacgaagaagttacagatcagaatacgagaaaagccgacgtcaggaacggnggatgttaataagattaaagaagcgacaaagcgacttggtgatggcttgggcctacctatagccaggacataatcatggactggccaggatcttggtcagagtcaacag

SEQ ID NO: 20670 - DNA, 415 bp, Gossypium hirsutum
  Clone ID: uC-gsflnu33B028f01b1
gcacgcgcccgtactgaccggcccgacccacccacgcgttttctcttcggcatacttcacagcccatctgtgagggcttattcgcttttcttcgccgaatctcccttttctcccgtaaaaatgtctctggtggcccaacgaaaagttttcaatcacattttgccgtgtcctgaacaccaacgttgatggaaagcagaagataatgttgctttgacctccatcaagggtatcggaaggcgtttcgccaacattgtttgcaagcaaagcccgatgtacacatgaacaagagggctggtgaactgactgcacaggaattggacaatctcatgacgattgtggcgaacccgaggcagtttaaaatcccagattgggtttttgaacatgcagaaggattacaaggatggaaagtattctc

SEQ ID NO: 20671 - DNA, 536 bp, Gossypium hirsutum
  Clone ID: uC-gsflnu33B028f05b1
acgggcgcggaaattaccggggggagcgacgcaggcgcgcactcaggcgcgtggttgtgtagagaaaatccagagactggtttctctttctttaaaaggggggatatagaacgaatccaccattggattcatggcgcaagagcacaggaatttcgagatggatggcacaagtgaaggtgcaaaaaaggagacactatctaagatcatggatcgaaaaaaaagaaaaaaatactgcgctatgaaaagctaaggggggggccgtttgagggagcccaggtttacgaccgcgggatgggaaaaaaaaaattttttaagggggcccccaaaataaatttccggggcggggcgtttaaacaaggtggggaggggaaaaacaccgggggtaaccaaattaaagggcctggaaaaaaaaccccttttggcaggggggggtaaaaccaaaagggcccgcccgatcgcctttcaaaaatttgcccatcttaaagggaaaaggggacgcgcccttgaggggcccataaagcggggggggggggggg

SEQ ID NO: 20672 - DNA, 431 bp, Gossypium hirsutum
  Clone ID: uC-gsflnu33B028f07b1
tttattattcgtccgtatagtgaaactaggtgtgaagcaatggccttgttggatcttattggatagcttgagactgacgaaccgatcgtgattactgccgtagagggccaccatgtgcggagccacaggacgaaccatggccatcacactagctctgaagacgtacatggatgcgatgtacatgagggagaatcaggtactgcagcagcctttgtttgctggagagacgcacatgatgggaagggtcagactgctgagctgggagttgatgctgtggaccatgctaagaagtctacatcttgcatgctgtttgatggtgatctgagggaggaacactacagctctgtgagtgcagtccaaactgtcctaagagctacgggaacggggtgtagtgactgtactctggagatggaaaagctgacgggggattt

SEQ ID NO: 20673 - DNA, 255 bp, Gossypium hirsutum
  Clone ID: uC-gsflnu33B028f10b1
ctcacgcgtccgcaagaatagaagtaggtggactgccttcttgagtgaaaaatgatggtatgaaattattctatccgattttttttgtgaatgtggatactaactctacttttgaataggaatcctcgaatgtttgagttcaaaaaaaaattttttgaaaaagaaaacataagaaaaaaaaaaaatattttaactaaaaaaaaatccaaattgggaggctaactttaaaacaccaaaaaaaaaaaacacagaatt

SEQ ID NO: 20674 - DNA, 450 bp, Gossypium hirsutum
  Clone ID: uC-gsflnu33B028f11b1
attttagggtgtggagagagggttcactcccatgcgattggaagtataatgtgcagggagaatttgaaggaggaatctccaattgagcaaatggtccaagaggcacaggattccgtgcttcctggcacaagtgaagctgcatttctggagacactctctcagatcatggatcgacatcttgatgagattactgggctatgaaaagctcaaattctgtattttctgggggggggggggggtttaccaccttttatagacaaacaaatggcttaagaaatgtggcatgccatcttaacaattgcaccatgtaccttgtgtatggttgaaaccaagtggcaacatccctgtattgttcgaggaaatgggtggcgatccgacacagcttgcttttgcaaccagaacgacggcaagtttgcgctcgcaatgatttgactctcacccattacccat

SEQ ID NO: 20675 - DNA, 551 bp, Gossypium hirsutum
  unsure (1)..(551): unsure at all n locations
  Clone ID: uC-gsflnu33B028g05b1
cgggtggacccacgcgcgctctatatttcccgcgcaaagaatcattcaatttagggggaaaaagaagaaaaaaaaacccaaccttgtcaaaatcggtgattgaaacgcctccaaagggtgggtttagcttcgatctttgtaaaagaaacgagatgctttcaaagaaaggtgttaatccgccgtcatttcgtaaaacgggtaccactattgttggcttgatcttccaggatggtgtaattcttggagcagacactagagcaactgaaggacctatagtttgcgataagaattgtgagaaaattcattacatggccccaaacatttactgttgtggagctggaactgctgctgacacagaggcagtaactggacatggtcagttcacagctccagttacaccgctatcatactggtaaagagtnagnggttgtgacagcattgacccttctcaagagacaccttttcaactaccaaggctatgtttctgctgctttggtacttggtggggtaagatgctttggcctcatttgcatactatatatccccatggg

SEQ ID NO: 20676 - DNA, 372 bp, Gossypium hirsutum
  Clone ID: uC-gsflnu33B028g11b1
tggtgcgcctgcatggtgccgccgcgccataattgcctcgaccgaccacgcctctttttatttgcatctttctttttcacaccagatctggggatccaagctatggctgaaaaggtgacgataatggtgctgaaggtcgaccttcagtgtagtgaatgttacaagaaggtcaagaaagtgctctgtaaataccctcaaatacgagaccagatgtacgatgaaaaggctaatacggcgaccatcacggtggtatgctgtagccctgagaagatcagggacaggttatgttacaaaggctggtggatccatcaagagcattgaactcaagtcggcggctaaacccaaggaacccgagaagaaaccggtcaaacc

SEQ ID NO: 20677 - DNA, 529 bp, Gossypium hirsutum
  Clone ID: uC-gsflnu33B028g12b1
tattcatactttggaattattacaattattatttttttaataattataatttatagaattttatatgatcttaaaaaatatggagaatataaatatattttaaaagatgataaaaaagcaaaagattattatttttattcatttattggatgtattatttatggtcatggaaatttattaaatgtaaatcaattaattgtaacaattatttcattattatcagattctttatttttaggaatttgtgaaaaatttattgcagtattatcttgtcattatgatgataataacaataataatgataaatgttggcatcatgaacattttgaatatgtttgttgtaatttaatattattatcattttatattccattatgtattatgattgcaccaatgtttaatgatacaagttcaaatgatgaaaaaaataaaaaaaatgaaataaaagaaaaaaaagaaaataatttttgttcatttgataatacaatagaatttattaatccatattaagtttattaactttaacaaa

SEQ ID NO: 20678 - DNA, 534 bp, Gossypium hirsutum
  Clone ID: uC-gsflnu33B028h04b1
ttttccctcaaccgatcctaacacccctctcttaagcaccgatctgcctctatcaatggtgacaaacagatttgggcctcgaaggacgacaatctcgaccacgagattccttctacgcttcgatttcaacgaagaagacggagtctcttagcacatcctcaaggtacggaggcaacgtgacggggtagttggcgcgtacggaggctattggtggcgcagctgctgctagggctagggtttgctgcaaacatgatttaggttttgggccctttttgggcttagggttttattagttttgggttttaaatttggttagggtttgtatgtattggggatataaatgttggacatttgctggtcaggcaagtatcggctgttaaggattaggccccttgagatggccaacattcaatatatgttactgttgttcccctgcgtgatgtaatatctgctttgtcgacctcaacttgcttagactctggagagtaaattagacccttgtatcacataaatcaatttgagaacatgtaggac

SEQ ID NO: 20679 - DNA, 498 bp, Gossypium hirsutum
  Clone ID: uC-gsflnu33B028h05b1
cccacgcgtccgaaaaaaagggaaaaaaaatctcagattttctgtcaaggaaaatatggaatcgagtaggggtcaaggtggaatccagcagttgcttgctgcagaacaagaagctcagcatattgtcaatactgccagaaatgccaagatggctaggctgaaacaagccaaggaagaggctgaaaaggagattgctgaatatcgagctcaagtggagaaggagtttcagaggaaactttccgagagcagcggggattcgggtgctaatgtgaaacgccttgagaaagagactgaagcaaagattgaccacctgaaaaatgaggctgcaagaatatcagatgaatgttgtccaaatgcttctcaagcatgtaacaactgtaaagaattaggccccttgagatggcaaacattcaatatatgttaactgctgttcccctgcatgatgtaatatttgctttgttgccctacctggtttagactctggtgagtaaattagac

SEQ ID NO: 20680 - DNA, 243 bp, Gossypium hirsutum
  Clone ID: uC-gsflnu33B028h06b1
ggttgtttattgtagttctagtcaagtaaggaaggactactattatagtattatctaccaaatgggtcaaagtataaatatatcactgtaattgcactattatagcttaggtgtgcgctcgctcttattgttgtattagatgtcctatattcttgttcgggaactgatcctgtcttgattgatgggatatttgtactaatactttggatgtcctcgctgacactataattgttactctgtgct

SEQ ID NO: 20681 - DNA, 489 bp, Gossypium hirsutum
  unsure (1)..(489): unsure at all n locations
  Clone ID: uC-gsflnu33B028h07b1
catatttcnacggaataaatggcgttttcaccgatgattttccatcaaagccggcaataccattcaattataccggcactccaccgtctggtctacaaacgatgaacggtaccaaggtatacagattggcctataattcaacagttcaacttgtgatccaagggaacactataatagcacccgagagccatccaacccatcttcacggatccaacttcttcgtagttggtagaggggttggaaacttcgatccggaaaaggatccattgaaattcaatcttgttgatccggttgaacggaacacggtaagcgtaccaactgcagggtggactgcactaagattcagagcagataacccaggggtctgcatttttcattgccatttggaaagttcatacaacatggggacttaagatggcattcttggtggaaaaacgaaaaagccccgacgagtcgaaccgaccggcttcgagcgatcttcaaagtgtt

SEQ ID NO: 20682 - DNA, 277 bp, Gossypium hirsutum
  Clone ID: uC-gsflnu33B028h08b1
ttttgtatgcgtgggcggacgcgtggtcggacgcgagggcggacgcatggacggactcgtggcatcgatagatgcagtggtgactccagagctctaacaatctacgccacgaagatgtacagaatggactactagaccaatgtgcaggttcgcggtcagctgaacacaataactggagtccctgatcacttcagtgcattgatacggcactcatatcatgaattgttcacaagagttggtgatgcaatgcgctatgatagatgcgttgaggtgcagt

SEQ ID NO: 20683 - DNA, 307 bp, Gossypium hirsutum
  Clone ID: uC-gsflnu33B028h09b1
ttgatttttggagtattggtcagatttttcccatagtccccattcatcgattggatgaaaggcctgaagtgagggggattttgtctgatttaacctgtgacagtgatgggaagattgataagctcatcggaggtgaaacaagcttgcctttacatgggttggaaggtaatggctggtggtagcagctgggggtgctgatgggcctgactatacagagatggcatgtggtactctgcatctgcagaacctgtgaccgccactggaccggtttacactctagaaatgtgcttggctggtttggacaggg

SEQ ID NO: 20684 - DNA, 533 bp, Gossypium hirsutum
  Clone ID: uC-gsflnu33B028h11b1
cacgcgtctgtttatattctccaaggcacaagtataggcgtgtcacatcaaacacagtatctaacatccctgctttgcctgcattctctggcagtgacagttctcccttgtctaatgcacaagggtttcacaccgtcaatgaaactcaggagcagactccttccaagcatcatataccaacaatgtcacatcagcctcaatttcatcctattcatcagaaccatcatcaaccagttcacccaaaccaacatggagctcattttccccagaatcatcaatgtgggccaccatcccacttacctgaaattagtcatgctcaccagtcaccaaccatgtctcaacacatagcttgcttacaacccttaacaggaggtcacgttggtgcacgcttgcatgttatgcctacaaatccagcgaaatactgcgatgaatgtggtgcaccttacctgagggaaacatccaagttctgttcagaatgtggcataaagaggttagggatatgatgcagttcaacatgatttattctgaatacc

SEQ ID NO: 20685 - DNA, 420 bp, Gossypium hirsutum
  Clone ID: uC-gsflnu33B035a02b1
agcgcgtttcttcgtccggtaaaagggcagagaaagacgtcgaataatttaacacatggtgctgattttacgaaagcaaagcgaatcatccagtggaagacctacgtttgcgcggagagcatgcaagccaatgggagtgcgctcggatcatgtgacccaacggatgggcatctgagccttgattttgccccctatttgatggctaccttgtcttacattatcatagttgagcccgcctcttggccggcaccagagcacgggatttggaaagcgtatccctgaacggacacaaatatatcgggacaagccgttgattcgggcattgggggcccaacggctgcgacagcagtatgggtcaactgccacaagctggtaataacatcatgtggcgattgccgagccgtgatttctaataacggc

SEQ ID NO: 20686 - DNA, 455 bp, Gossypium hirsutum
  Clone ID: uC-gsflnu33B035a03b1
tttcatgcgtccggaagcctttagggctagaaaaacgtgctgttataaaattaatagacaactgttgggaccgaagaatactatttaccctattccattatccatgtgcattagggcttcaagatgatgctttacccccactgttcaatgaataggcataagtgcctgcaaaacttcctccatgcttctatatttatgttaccggatcatataaactctacggtctccattccccaggaccaaagagaatgcattgtatcttgcactcaattcctgtatctgctattcaagaaggtggcactgcttcaacaccatcagctttcccccaatccttagatgaacaacctttctcccttgcatagttcaaaaggaaaggagccgattgtagacatcatattgcccagcattcaagccacaccagtattcttcccatgcttacgagaaccattagcccc

SEQ ID NO: 20687 - DNA, 91 bp, Gossypium hirsutum
  Clone ID: uC-gsflnu33B035a05b1
ttctttcgtccgatcagattaacgtagagcagaaatggtcacttcatagagccacaccactcacaatcagtcttacgtggctcacaagaat

SEQ ID NO: 20688 - DNA, 324 bp, Gossypium hirsutum
  Clone ID: uC-gsflnu33B035a06b1
ttcttttctgcggggaagatggtcgccctgatagtaatggacatattcatggttgaaggctccagggcaatgtccacgtatctgacggactaatcatgagtcacgacatgggccagaaggctatagccacaacaagctgtccaccctaaacgcgatggttgcaaggctaagaatggggctgactagacacagccatcgactgcatcagaatgtcggcgtgctgggtactacgaaagacgtgagccgacgatcgccttgaatttgcctccaatgaagcagctccaaatgcctagtgatggctcaagtttgcagatgagcatgaag

SEQ ID NO: 20689 - DNA, 547 bp, Gossypium hirsutum
  Clone ID: uC-gsflnu33B035a08b1
tttattcgtccggatttttctagggcgagcaatacgtatgttggtaaactaaggtcaaattttttgggtaccaagttcactgtatatgacagtcaatcctcatgtgactcatggatccaatctactgctcgaccgagacgtagattccactctaagcaggtgtctccaagattacctgcatgcaactatatcattggtacagttacttatgagctcaatgttctgcggacacgaggaccaaggagaatgcattgcatcttgcactcaattcctgtatctgctattcaagaaggtggcactgctccaacaccatcagctctcccccaatccttagatgaacaactttctcccttgcatagatcaaaaggaaaggagccgattgtagacatcatctcgccaagcatccaagccacaccagtattctccccatgctcacgagaaccattagcccttaaaaacaaggctcctagatggcatgaacagttacagtgctggtgccttaacttcaggggcgtgtgacggtggcctctgttaagatttccagctg

SEQ ID NO: 20690 - DNA, 555 bp, Gossypium hirsutum
  Clone ID: uC-gsflnu33B035a10b1
tcgtctctttgtcagcgtttccgataaaactccaatatcccaaaacaatgggttcaaccggtgaaacccaaatgactcccacccaagtctcggatgaggaagccaacttattcgccatgcaactcaccagtgcctcagtccttccgatggtcctcaagtcggccatagaacttgacttgctggagatcatggccaaagctggcccaggtgctttcctctccccaaaagaattggcttcccagctgcccaccaacaaccccgatgcacctgtcatgctagaccgcatcttgcgcctcctggctacctactccatcctcacttgctccttacgcactcttcctgatggcaaagtggagagactctatggtcttggccctgtctgcaaattcttgaccaagaatgaagatggcgtcactctttccgccctcagtctcatgaatcaagacatggtccttatggagagctggtactacttgaaagatgccgtgctggaggtggaattcccttcacatagcctatggtatgaccgcattcgagtatcatggcacggatcct

SEQ ID NO: 20691 - DNA, 284 bp, Gossypium hirsutum
  Clone ID: uC-gsflnu33B035b03b1
tcgttcacccgtccgttcacacgatagaccgactgaaatctaatacctgatcatctacatgacatcccatagcctaccttagttgtccgaagcaactatatgactgattacgatctaataaccagatgtactccttttaactatctacaacctaagagaccctccgaggctaaagaaatagaggaactattgccttctacgccctaaatgcttgtggcaataacttgcaccgataagccccgagatgttctggtccagacacgcactacactgacgcattcaac

SEQ ID NO: 20692 - DNA, 72 bp, Gossypium hirsutum
  Clone ID: uC-gsflnu33B035b04b1
ccctttcgtccgaacagctgtaaaatcatgggatgagactttaaaagtggatcctagagtctacttacttct

SEQ ID NO: 20693 - DNA, 282 bp, Gossypium hirsutum
  Clone ID: uC-gsflnu33B035b07b1
ttatgcgtcctcccgctggtgaggaatcccgtggatgttattgtaaagtggcgccgccgaggacggaggtactgcatgtcgctgaaatggctaactgatcagattaatagcctggtgacctagaacgaaccatattttgcaaatacgctgaagatgatcgtaagcaatgcctgctgtggaacgatgtttacattgcctgcattaatccatttgctgacgacaaaggtaaaatcagagcggaaaggatggactgccgatgtctcaactgagaccatgtagcct

SEQ ID NO: 20694 - DNA, 326 bp, Gossypium hirsutum
  unsure (1)..(326): unsure at all n locations
  Clone ID: uC-gsflnu33B035c02b1
ttcgttaggattgagatctgcatgctccctgttggcgatggaatcaccctctgccgccgcgtcaaatgaaccaccaccaatgctaccggcgacacaaancgttactaccacccaggatcgacagactttcatactgagtctgagcaacttgaaatacggggtaaattcaatctggcactcataaacgcactgcctatctaccattatcaactcatatgacattctaaaccaagcagtgccttaccatttagaccaaagagggaacggctaatagtgaggttgaaccgctttatgataaataccatgataacgggggggcgttcttt

SEQ ID NO: 20695 - DNA, 295 bp, Gossypium hirsutum
  Clone ID: uC-gsflnu33B035c03b1
tcgtccacgcgtccgtgtgatcgtggggtcttaagtgttcatcaaagctgttgcttattttatacactcagtgttcgatgctactgctcttgagggctcgatccctttgattcaaatcatgaatcataaccttttgactaattttggatcctaattaataagggatgacaaactaccgtcggttgcatactggctaaaggcgagattgatggtcgtagtgaggctgttggtttgtaacttctgcgatttatcgggaaaccgttgaagccggttgacatttgactggcgttgaacc

SEQ ID NO: 20696 - DNA, 343 bp, Gossypium hirsutum
  Clone ID: uC-gsflnu33B035c05b1
tttatgcgaacgtggtacatgatatacaatagagggactattgatagatctctgaacccatttactggcaggtgatgagcgcacagaaatcaacaattttggcagggatgtaggaagaggcagaattattttggcggtgcatagagctaatggaacgcacaggggcaaaactgaatctggaacaaaagggcatggaccttcaagtttgaacagtatgaaaaatgttggggtatctggagggagctataaacagaaatatggagtcgattgactggctagaacgatatctttctgttacaggggaaactgaacctgcagaaactgctgctctgataaagtcgac

SEQ ID NO: 20697 - DNA, 385 bp, Gossypium hirsutum
  Clone ID: uC-gsflnu33B035d01b1
ctctttcactgatcagacccataaccaatcaggagggcttaaagaaggtatgccggacagacacatactcagtcgggcggcccgaaaaggcgtctcatcctgaggctctgaaggcagctctagctaagctaatatcaagcctgatccttgaactcgctggatcaggctaatgaaaggctattaacatgtaggccgacaacagtgcaacaacgcactccgttcttgtatccaacactcactcgcacgggtcccgtctctctgtctctgtcacacgtggagccagcatataatgtgtggcgcgaagccccgcacacacctgaactgctttcgttggcgggaacatcacttgctggcgcggcagtaattactggatcgaccaacagct

SEQ ID NO: 20698 - DNA, 466 bp, Gossypium hirsutum
  Clone ID: uC-gsflnu33B035d02b1
tctttactttttaggtgtcaactgtctgaaattcaccatggctgacatgtgtggcaactgccattgcgctgactggagcctgggtgtgaagaacggtgacagcgtggtcactgagactgaggagagctacattagcaccgtagatgtctagcctcttgcaaaaaacgatggcacgtgcaagtgcggaactagctgcagctgtacaaactgcacatgtggcagtcactatgaagacatatagaatgatgaagttagggacctaataagatttaaagttgggttgactaatccgtgtcttttgttgtacttagagtgtgtgatcttgtatattctgtccgatgattgtctatgtctctgattctatacaaagatggaatgaccatgttaatggccgttgcctgactaatgaaccattattagtttaagcatcgagactccccaagagataatttgaacaatctttaca

SEQ ID NO: 20699 - DNA, 468 bp, Gossypium hirsutum
  Clone ID: uC-gsflnu33B035d03b1
ttcgttcactggtgcggaattggttgaggttttttccatgtgtggaattatcaaagaggaccctgtaacaaaacgacctcgtgtgaagatctatgttggccaggcgacaggtagaaaaaagggggatgcgcttgttacatatttaaaggagccctctgttgctttagctgttcaaattttggatggaacacctttacatcctgatggaaaaatccctatgtctgtaagccaagctaaatttgagcagaaaggggataaatttatagccatgcaagtggacagcatgatgaaaaagaatctgaagaatgttgaggagaggatgctcagttggggtggccgtgttgatgcaataggcgtcaatttcagccactgttgtccttcgtaacatgttcacgcctgcttaaatgagggcggatgataatttgtgttcagagctggaagaggatgttaaagaggattgcttaaagt

SEQ ID NO: 20700 - DNA, 324 bp, Gossypium hirsutum
  Clone ID: uC-gsflnu33B035d06b1
ttctttcgggcgcattgtcgtcgtttcgactccaataccatacacataatggtcatggatctcatctacctgcaacgccatttaaagaacgagggcctcttttttcttagatcggactgtgtccagtagaaagcctcaaaggaacacgggaaaccagtgtagtgactgccaaataccccattcatcttttacccaaacattaataccgttgttgagaacgaagatgatgcctatgactagcctcgctcgagggcctttaggttgattcttacacccacctgaagcccacggagacttcgactccaagtgaaaaagggaaggcca

SEQ ID NO: 20701 - DNA, 451 bp, Gossypium hirsutum
  Clone ID: uC-gsflnu33B035d08b1
tcttttggttcatcagattatgatgctaatacaaatgctaacaacgaggataatctggctccatcgttgggatgcgcggcagcttgttcactttgcatgtcacagattttggtgatacatgcaggtgctaaagtaaagatgacggctggtggaacacctacagtgcatattgcgcatgctcatggttgccctgaactaataaacagcttactgaaagctggagctgatcctaatgccactgatgaagatggcctgatgccctgtatggtgcagctgcacagaggtcattgtggagcatgcgagatactatatactatgacgtcaagaatagataccatcacagagtggactgtcgatggaagtataaatgtatgcagtctgaaactgtaaaacatttggagcaattgacagaactgacgagagccatgattacaggggacactggattgcc

SEQ ID NO: 20702 - DNA, 358 bp, Gossypium hirsutum
  Clone ID: uC-gsflnu33B035d10b1
tcgtccacgcggacggacggcagcacggacggggagaatagataataggtcgggggtctgtccagacaaaaaccgcataataagcacacatacgtgtacggccgatcatacatcaatggagacagtgtttcacacaggtggccagccggcatatacgccaagacggaaaagcgtatatagacggatggactagaggcggtaagcaaaaccacattacatcacaagctgaagcctgggagagatcgtgatgacaataccaaccatagggttcaacgtggaaactgcaaaatacaagagcataaactatgactgtccgagaagaagacgggcatggacaagattcgcccatggcggaggg

SEQ ID NO: 20703 - DNA, 138 bp, Gossypium hirsutum
  Clone ID: uC-gsflnu33B035d11b1
aaaacatttccttagtgcataaaaaaaagttgaggagcatgccgattgtgaagcgtgtaattgcgctccccagcatcgaggatcgttgatccgatctgaagtgagtacccgacgggtggaacctcatgcgctagaggg

SEQ ID NO: 20704 - DNA, 429 bp, Gossypium hirsutum
  Clone ID: uC-gsflnu33B035d12b1
taatgttccaaaaatcaattgggatacccgataagaagaagggagaggagatgattgcggcttcagcagtgttgaaaggcactgtattggagcctgaagattttgcacatgcagcactgtatttggcaagtgatgaggctaaatttatcagtggtgtcaacttaccactggatggagggtatagtctcagcaatcaatcatggaagctgggattcgcagcactttttggataaaccaccaagtcctctgcttcactctttgaattatattctcttaaataaggaaaataaaactcatccaaaattacacacatgaaaaactgtattgtcgtatttgatcagtctcctgtaatgcttttgaagtatcctttctttatcaataacacttgttttgctgttcaaatgaaaaaattacttccattttccaatc

SEQ ID NO: 20705 - DNA, 505 bp, Gossypium hirsutum
  unsure (1)..(505): unsure at all n locations
  Clone ID: uC-gsflnu33B035e03b1
tcgttcacgcgtccgcccacgcgtacgcccacgcgtacgggaaggtaggttggttatacccgcatcaggagactataagccaaatggaggacatacttctgtggctaagtctacagattgacctatgggagttacatgtggtgaaaccacggctggctctttgatggggctggacactttaattaaacccaatcacagttccactgctgctgatgaacaggctaaagctgcagacgaattcaagaaaacaatgtatggcacagctgacagtagtagcagcagctatgaggaaggagtgtcaaaaacgaacaatttacagatcagattacgagaacagcctacgtcaggaaccgcggatgtcaataagacgaaagaagcgacgaagcgacttggtgatggcttgtacctacctatagccaggaccaaatcatggactgtacaggatcttggccngatgtaacagcaaccttatgctgctacctgggcatctgtgactaataccaca

SEQ ID NO: 20706 - DNA, 350 bp, Gossypium hirsutum
  Clone ID: uC-gsflnu33B035e04b1
tttgtttcgtggtcacccccgcgtgtctctctagcaccctcactaataatgcctgccgctagggtataaggagactaacgccaggcttctacttcaaaacacagttccatggacctctgtaagacacccatcgatgggttctcgtccctagtgagtgctgcaagcaatacctgctattggagcggctctattatcataccacctgatactctatatgaagggggattgtgcaacagccatcactagctatccagccaattatgcaaacaggcctacatcagtgaaagtcacagcagagacacggcatgctaatgcatatcgctgcgggcgtgatggcatatcagtccttg

SEQ ID NO: 20707 - DNA, 380 bp, Gossypium hirsutum
  Clone ID: uC-gsflnu33B035e06b1
tcctatgcgtccggtgattgggcttcctaatgatcgctctgatggacgggcacgggtaccagacccgaactctctatgggctgaaagcaacggacacacgatttccggaaatcgcatgaagccgaaccatgccgtaggaggagacgaaccgagtataatatccgggcggatgggacctgatggagcctaccctgcgagtgctacaagcaatgatgagagaagcgggaagtgagcctcacgaaggagagcgaaaatgcgagacgttgcggcctatcatgaaaatgggacattagaagaggcggtacattgttgacccataccatgagaggaaggcaatatgaaaggaatagaatgagatctgctcggatcaaggctatgct

SEQ ID NO: 20708 - DNA, 337 bp, Gossypium hirsutum
  Clone ID: uC-gsflnu33B035e09b1
ttttctcgtccgccttgattgatgctatggaaaaagctgaagtgaagaactcgtggggagccaaatggggagaaaaagggttcatacggatgaagaggaacaccggcaaagctgaaggcctttgtggtatcaacaaaatggcttcttatcccaccaagaaaaactgatcaacacctttgatttcttcctctttttaagcttttttttatttttatttttatttttctatgttcacaaaatttgctgcccaatgtccctttggttataataaaaattcctcataatttcgtttttaaaataaactacaaataagataattaactgactataaatattt

SEQ ID NO: 20709 - DNA, 254 bp, Gossypium hirsutum
  Clone ID: uC-gsflnu33B035e10b1
tcgtccacgcgtccgcccgcgcgttcgaccggggggtcggcgcagcctataaacggcccgcccatcaagaagcttctggttgcgcttaggatgcccttattgtcatgcttcggtctgtgatcgcttcgtctcaagctgctgttgcaactccagaaggtgggccatcgttcgtagccgcccgtttcccggtggcctcgttacaggctcacatagctctgcaaggtgcagcagagatgcctgcggggactgtggtt

SEQ ID NO: 20710 - DNA, 267 bp, Gossypium hirsutum
  Clone ID: uC-gsflnu33B035f02b1
tcgtctcacgcgtgcggacgcacgcaggtaggcgcgtgcttcgaagtatgctcctatgactccaccactttccaccagatttacattgaagatgggttcatcaatgttaggggtttgaagggcggacttataatcttaggatcgctgtgtgccacagaggctatttccactggtgtgacggatctgagacatggggatactcatgagtgggggaaggctgaggggaactgatgccactattggcatgactgatgatgctcgcaatca

SEQ ID NO: 20711 - DNA, 483 bp, Gossypium hirsutum
  Clone ID: uC-gsflnu33B035f03b1
ttcgtcacgcgtccggaagcaagcagctagcagtttgctttgaattatactactataactccaccactttccaccagatttacattgcagatggcttcatcaatgctgtgggcttcaagggcggcttcttatcttaggatctctgtcttccacagaggcttttccactgttctaaaggatctgaaatatgcggattctcatgagtgggtgaaggttgagggtaactctgccactattggtattactgatcatgctcaagatcatttaggtgatgttgtgtatgttgaattacccgaagtgggagctgctgtaaagcaaggtgaaagttttggagcagttgaaagcgctaaggctactggggatgttaattctcctgtttcaggaaaagtggttgaagtttatgaagagctcagtggctttcctgctaggtaactcaggccatttgaggagggtggattataaaggtggagagaaagatgctgg

SEQ ID NO: 20712 - DNA, 474 bp, Gossypium hirsutum
  Clone ID: uC-gsflnu33B035f05b1
cactatattgaatgcagctcgcctcctgcaccggcccggacttcactggctggaccgacgcaggccgtttctcttcaaacgctgctgcatgtagggcacccacagactttggcccactagcatggtgttgagggtatgcatgcctctcggcacccgaatgacggggaaccaccgcctgagctgcgcgattccggaggaaacgctgctggagggccggacagatactgacttgcaaaccggtcgtctgacttgtcccttgcctgaaagaccataatggaaccattttatagctttgggcctaccaaggtggcctaacgagagcggtggactttagaggaccgccagcaatgccaagtactcccttagctgtggggggtgctactcccggagactattgaaaaacggcagatggctcgaatggttttagtttcttaccaaagcgggctaattatggttctagagaggaattcatgc

SEQ ID NO: 20713 - DNA, 559 bp, Gossypium hirsutum
  Clone ID: uC-gsflnu33B035f10b1
cccacgcgtccgcccactcgtccgcccacgcgtccgcccacgcgtccgcaagtcccgtggatgccgatttacctctttcagctgatgttgcagttataatgtatactagtggaagtaccggattgcctaagggtgtgatgatgacgcatggcaatgtactagctacggtttctgcagttatgacaatcgttcctggacttgggagtaaggatgtttatcttgcttatctgccgcttgctcatattcttgaattagcggctgagaatttaattcctgctgttggaggtatcataggatatggaacccctttgactctcaccgatacatccaacaagataaaaaggggaacaaagggggatgccactgttttaagtcctactgtgatggcagctgtcccagcaattcttgatcgtgttcgtgatggagtgcgaaagaaggtagacgcatagggtggactagccagaaattgtttgactggcttattccgtagatatctgcaatcatggtagatggtttgtgcctgtgcctggaaagttctatggactttctggctttaaaa

SEQ ID NO: 20714 - DNA, 321 bp, Gossypium hirsutum
  Clone ID: uC-gsflnu33B035g02b1
ttcttttattcttattgctgaagttagagactagaggcaagtttagcgattgcttaatgaatatcccgcagcgcttggtgaccggagaggaaagaagttgtttatctatagctcctatcgcaaacccattgctggcaaatagctctccaagaatacccttaagctcgtgcggaaagcatctgaacacacctgcttgaagagcggagtcatggaagtggttaaatgtattctggggtggcctaaatgaatattcgtgatagctggaaacatatctactactgaggaaatcacttacgttccgattcctatgcgaagaggctg

SEQ ID NO: 20715 - DNA, 229 bp, Gossypium hirsutum
  Clone ID: uC-gsflnu33B035g03b1
tcgttcactcggccgactgcaaagctgatctggagacccagagacccttgtctccgcctgaacacctacttattccgtaactatgtctgtggtagccacacgaagattttcaggacatttggcgtgccctgtacaccaacgatgaggggaacgcagaacaatattgatgctgcgacctacaccaaggacctcggatggccttaccccgacttagtctgcaagaaagcct

SEQ ID NO: 20716 - DNA, 444 bp, Gossypium hirsutum
  Clone ID: uC-gsflnu33B035g04b1
ttcgttatcaattggttcatactgttcgcactcacaagggttcagatgataaatgcttttcctgtgttacacaggaagaagactccatagggaagattggtgttacattgccgaaggatctcatggcagttgctggtgatgccttaaagaccaacattaccacattggggcctctggttcttccaatgtctgagcagcttcttttctttggtacatcggttggtaagaagctgttcaaaatgaaggtcaaaccgtacattccggatttcaagctagctcttgagcatttctgcattcatgccggaggaagagccgttttggatgaactggagaagaatttgcagctgtcagaatggcacatggaaccatggagaatgactctctaccggttcgagaacacctcaagcagatctttttggtacgaattagctgacttcgaagcta

SEQ ID NO: 20717 - DNA, 249 bp, Gossypium hirsutum
  Clone ID: uC-gsflnu33B035g05b1
ttctttgttacgtccgaagatgcactctctctaatggatgatgatattaggtagaggctacccgcctccaaagagaactgagatactctctacaaaaaagcactttaacgaacatctttagaaagtgaactttttgcttgaatgaattgagtgcttgcggcgggaaactggtagcctatgtcgagtgatttaatatttgaaatgctctactttttgactcgttgtagtccatatgaggccatataaaat

SEQ ID NO: 20718 - DNA, 485 bp, Gossypium hirsutum
  Clone ID: uC-gsflnu33B035g06b1
ttcttttctggatccgaactaaaagcaaccggaggcgtggcaaaccggccttgtcatggcgggcgactcaaagcaagtactcatgagtacctattgacaccagaagaaccgtccctggtatgataatgtgtcatcaacatcaaggcggtcatccgggtcctccacctaccggatgaaccccacaacctgactatgcgcccagtacgctgcatgaagaatatgcaccatgcgctggttaagtccaacgttcaatcggatattaaaaggtcttcccccattgccctttccgctctccaaaactcttacccgtcttctgccggatctttccgacccgaactcattgaacccgtttttaaacccatgttgaatgtcctccggcaaaccgggtctttccttatggacaatgcttatcctttctctgcttatgagttaaacacggacgtcatcttcttggactacactttgttcagggagaacccgcgtgt

SEQ ID NO: 20719 - DNA, 210 bp, Gossypium hirsutum
  Clone ID: uC-gsflnu33B035g07b1
ttctgtgaatcggacggccgaagacaaggacaagaggaaagattagggatagcttgggatacacccggcaaggctaaaagatgctaaataaaaatattgttgaaaactatgcacaagaaatgaatcttgatatgacgcatgaattttttacaaagatgagtctatccaatgacaaaaaggaggttgaggaatgggctactggatcaggat

SEQ ID NO: 20720 - DNA, 511 bp, Gossypium hirsutum
  Clone ID: uC-gsflnu33B035g12b1
tcggaagccagggcctgtgtgaaggcgttgaggttatgctccgatctagatgtacaaaacctgaaggtggagggggactctctaacggtgaataagaaggcgcccgactacagatgacacagattccttagaaataacgggatatatagaagatgtgaagagactaagtaaagtttttcgaagctgtaccttttatgcatgcgaaaacatcggccaacgaagcagcgaactagttagccaaagaaggccttcaacaagaacaagaattatttttgaggaatgggattccacaggttgcggcgattctggttgagcgagaccgcagtttgttggacgccccggactgaagagctctggtcgatgaaggaaagggaagcagaggagttctgttcgtcgcgtttccctggagatgagtagtttctctgggtttggtgcttctgtcattctactgatatgtagaatgtttaattttctgcgattagaatcttatcttagtaactttggggcatct

SEQ ID NO: 20721 - DNA, 66 bp, Gossypium hirsutum
  Clone ID: uC-gsflnu33B035h01b1
tcgttacacgtacggaacatcggaagactgatagactttagcaagtatttgctttgagccagccac

SEQ ID NO: 20722 - DNA, 338 bp, Gossypium hirsutum
  Clone ID: uC-gsflnu33B035h04b1
ccacgcgtcctctcgtacgggcgcgcggccagcccgaaatatctactgctactgtattgagagtctacctgcatgactggatctttgttattaacccttgttcttatcacctacgagcataggccacaggaagaatgtccatcccccgttgcacaattgaaagggcagtcacaggctgcgatacgtgtgccaccatcaatgtttgatgttcccagatgattgagtatacactggctccatcatccgaataattagtgcttcattgcttgaatttctttcagctgacaaaatgggtgggtttgaaatgtttcagattatgaataaatctgctcttcatc

SEQ ID NO: 20723 - DNA, 530 bp, Gossypium hirsutum
  Clone ID: uC-gsflnu33B035h11b1
tctttcacgcgtgggcagataaagaactttgtttcatctgcttcatttgtttcgaaatctctgaacaaaaatggcctgtttcaatttccttgctttagcattctagagcgctttgtcatttgcaagcattgatgttgggggagcagctcgtgaccttctgcagcagcctcaagcggagagttcaccatctttgcctaatctaccaacgccatcctgacaatgattcccatggcctggggcgcttgctccacttgctaccacattcccaacaggactgccccctctgcctagcattccctcagtgcccacaatcccaactgcaattccccctattcctttgtcttgtccaccattgccatctttcccttatctcccataccctgaggcgcttcctgcagcttctaccacattgccaagaggactgccgcctctgcaagcattgcctcaatccaactgcagtccctctattctttgttttatgcaccacttctgctctactcttgaataccccctttctgtatgctgatact

SEQ ID NO: 20724 - DNA, 536 bp, Gossypium hirsutum
  Clone ID: uC-gsflnu33B035h12b1
ttcgtttatcaattggttcatactgttcgcactcacaagggttcagatgataaatgcttttcctgtgttacacaggaagaagactccatagggaagattggtgttacattgtcgaaggatctcatggcagttgctggtgatgccttaaagaccaacattaccacattggggcctctggttcttccaatgtctgagcagcttcttttctttggtacattggttggtaagaagctgttcaaaatgaaggtcaaaccgtacattccggatttcaagctagcttttgagcatttctgcattcatgccggaggaagagccgttttggatgaactggagaagaatttgcagctgtcagaatggcacatggaaccatcgagaatgactctctaccggttcgggaacacctcaagcagttctctatggtacgaattagcttactccgaagctaagggtagaattagaaggggtgacagaacatggcaaatagcatctggttcaggattcatgtgtaacagtgcagtttggaagctttgagacga

SEQ ID NO: 20725 - DNA, 431 bp, Gossypium hirsutum
  Clone ID: uC-gsflnu33B036a01b1
ccgatgattccggcgaccccaccggaagtgagaggggtgtttttttgcagacttcgtcatgtatcactcacgatactttcgggacgggagctggtacaggccgactcgctcaaaggtgatggtaatgatgtctgggatgcggtgagcttgttcccagtccaccagaggcccataaactatggtgaccaggttctatcctaagtgacgtggaactctatggctgctccttttcatcgtctcacttcacgtaaccattctctttatggctcgcgccgcccctttctacaatcgccgaacccattttccgaacccagtatccgacccgtgctcgtcggttcgaatcttcggatacaacttgccacctgtttataacgaacaggtgttggataatagccacgcgctggaccggaggaatttcacgccgtgaagca

SEQ ID NO: 20726 - DNA, 535 bp, Gossypium hirsutum
  unsure (1)..(535): unsure at all n locations
  Clone ID: uC-gsflnu33B036a03b1
aatttttgcctgccggtgcgacggttgctcctgtaaaaacacttggggttcatatgagtgcaagtgtaaggggaatcttctgtatataaaagagcaagatgcttgcattgagagaaacggatcgcgctttgggtggttcctcaccctcttggtactggcagctgtggttgctgctggcttagctgggtatatattctacaaatataggctcaggtcttacatggactcggagatcatggctatcatgtcgcagtacatgccgctagacaatcagcataacaatgaagttgctagtgaggcgcagcctttgcgacaaagctcaacagcataaacgagggtaaggagaaagcatggattatggtattatgttggccctcccatgaaattcgagccgtccatatatacgtgtatatatttacagctcttatgaaattacaaaaagacacatgtttaactggtatacaggcacacccacgatgagtcatggttgtattcaaatnttccttcacatataagtgagaagagaagagaatcc

SEQ ID NO: 20727 - DNA, 555 bp, Gossypium hirsutum
  unsure (1)..(555): unsure at all n locations
  Clone ID: uC-gsflnu33B036a09b1
ttacgtaacaaggggaagagtgtgagcatggatgcatcaactcccttctttgatactacaaggaaagattatccttcaaatgaatgtcccttcagtggagtgcctgtagcaaatggccctactgtgcctccgttttcgtaccatcccttcagtccaagtaaaaggagctttgtatcgactgatggaaatgtcttgtttggtacattccacaagggagttcagtgtgatggtntgtggggttcttcccattactggacctcggttcaagtctaaagtaaaagacaactatgatctctgcagcatctgcttttctaaaatgggaaatgaagctgattatataagaatggacaagcctatgcattaccggcatccatggtgtttcagggcatcaaatgatcatgttccaagagttggcccagcactccctcatgtcttgaggaatcgtgtactaaagttgtctcggcctaaactagaaagtcactttatctggnatgtcaatgtattggatggggactgtatggctccatctacaccatttacaagatctggcgaatg

SEQ ID NO: 20728 - DNA, 468 bp, Gossypium hirsutum
  Clone ID: uC-gsflnu33B036b07b1
attattcctccgatgatgacggccacaactacgataaacatatcgatgattggacgggcgaacacggtcgatgcactgctcttattgaacgctgcttcgatacaaaggaagcggactaatccgcacaatgcaatgtctaccaggaacatcccatgatgtccaagggaggtcaaaagatccccggctgatatggcacctttgttactccaacgcccaattgcttgcgcagtagtgagcgcaaaagactcaccggctttaggcagccatgagacgctggtcgctctcttataatcttgcatggagcacatcgacctggcggtgtccaacatgctctcaagtatagccagatgttttattcgatgccaacaccacaaggaagcttttatgtgttgaatgacatattcaggttaaactaacggggggccgaaacagatatcactacaattaatcaggcgaagggaatacaaa

SEQ ID NO: 20729 - DNA, 543 bp, Gossypium hirsutum
  Clone ID: uC-gsflnu33B036b09b1
tggtaatctttccttcctctgcatatcaaccgggggaccaattcgaaaaacctgaacccgaaaaccatgcaagagcatggtgttttatttccacgacataaatctacaacggccatagcgcaaagaacgcaacatcagccattgtaggttcaccacaatgggggaacaagaccattttaacaggacaaaaccatttcggagacctggtcgtgttcgacgaccccattaccttggacaacaacttgcattcgaaaccagtgggtctggcccaagggttttatatctacgacaggaaagacatattcacagcttggttgggtttatccttcgttttcaattctacccaacataaaggaagtatagacttcgacggtgctgatccattgatgaacaagacgagggatatattactgattggtggaacaggtgatttcttcatggctagaggagtggctactttgaagactgatgcctatgaaggggaagtatattttcgtcttcgaactgatttaaattgtatgaatgttgctaaccattgagttt

SEQ ID NO: 20730 - DNA, 64 bp, Gossypium hirsutum
  Clone ID: uC-gsflnu33B036b10b1
caatgctctcatatgaaccaaacctttgcttgccactttggccttcagctgatgaggctaggaa

SEQ ID NO: 20731 - DNA, 405 bp, Gossypium hirsutum
  Clone ID: uC-gsflnu33B036b11b1
tatatgatggccaacgctgcatcgggaatggctgtgcatgatgattgcaagttgaagttcttggagctcaagacaaaaagaacccaccgcttcattgttttcaaaatcgaggagaagcaaaagcaagttattgtggagaagcttggtgaaccaaccgaaagctacgaggattttactaaatgtctccccgctgatgaatgtcgatatgctgtgtaccattttgattttctaacggccgaaaaccgtccgaagaggcagaatctttttcatcgcatggtctcccgacacgtcaaggatcaggagcaagatgatttacgccagctccaaagacagattcaagcgagaactggacggaatttaagtggaattgcaagcaacagatccaactgagatgggtctcgatgt

SEQ ID NO: 20732 - DNA, 427 bp, Gossypium hirsutum
  unsure (1)..(427): unsure at all n locations
  Clone ID: uC-gsflnu33B036c09b1
cccatgcttccgccgacgcgtacgaggacgatgaccagaaggggagcaatctctgcactaccaaccaagggcgatggccttgtcttaattaatggagctgatattttaagcatcatgaataatttgaacattggtctgactcccgtgaatattctttaatttcaaagagttctcaatttaattccctttgatatgcgacctatgtgcccctaacgccgaatggcttgggttcgaaagatggaaaagactgtgtggttgtatgcgtgaaggaacaatgtaacccatcattaaaataactgaagaggacaatcgaacttgtcctgacgatgtggaaatcgattaaggatttagctttggatgatggttaaacacctttcctgttnccatttcagctataaaagatgataaattaaaaagggggggcccg

SEQ ID NO: 20733 - DNA, 62 bp, Gossypium hirsutum
  Clone ID: uC-gsflnu33B036c12b1
tatactcagccgccgaaaagtaaagcaacaacggggtatgataaaaaaggcatagcggtgat

SEQ ID NO: 20734 - DNA, 558 bp, Gossypium hirsutum
  Clone ID: uC-gsflnu33B036d01b1
ccttcttgtccgcccacgcgtacggtcccggagggctgtttacacttttccgagttaacccaagccgacgagaacgatctgcctgaagtcgatatcgtccccgacgacgtcgtagcgctttcttattcgtcgggaaccacggggctcctcaaaggggtgatgttaacgcacaaaggtttggtcacgagcgtggcgcaacaggttgacggagaaaacccaaatttgtatttccatagcgaagatgtgatcttatgtactttgcccatgttccatatttatgccctgaactcgatcatgctctgtgggatacgtgttggggctgcgattttgatcatgcagaagtttgacatcgggctactgttggagctaatacagaaatacaaagtaaccattgctccgattgtgccaccgatagttttggccatcgctaagtcattggaaactgaaaaatacgacttgtcatcggtgaggatgctgaagtccggtgccgctcctgtgggtcaagaagctgaggatgcttgtgaaagtcaagttcctggtgccaaatttgacaggggt

SEQ ID NO: 20735 - DNA, 324 bp, Gossypium hirsutum
  Clone ID: uC-gsflnu33B036d02b1
atattatatagacaccgaaaaaaaacagaaaacaaaagggggaattcatgtaaaattttgggtcaaatcccacgagtgcaaattcgatgcggtgggcgattcatcaaggcgcttgcagcacacgggctggttttcgattgtcatttttgaggctctgcatactcaattcttgctctcaggcgtataacttgccctgcatggtgctatcaacatcgtaacaaaccacgttgttgtcgttaccactcatgctgttgcctataacaccccatgcacatgacgaattgcatacggcctactgggaaccccaagattactcgagatggg

SEQ ID NO: 20736 - DNA, 420 bp, Gossypium hirsutum
  Clone ID: uC-gsflnu33B036d03b1
ctctcgtttccgggggataagcttgaaaagattagctatgttaacaagtttgaggcagctgcaggtggaggaagtatttgcaagagctcaatgaaattctacactgttggagataatgttataactgaagatgaaatcaaggctcgaattaaagggagtgagacagtttacaagccccatgaagcttacctcttggctaatcccgaagcctgcaactaggatctaggttgctttgaattcttatgctttttaaagaagagtttgattttaatgttgtgcttttgatattttccttttcatcttaaaacataaattgtcttgttgtttcagtaagagtgatggtggtagtgatcgaacttcgatcatttaatatataatgaaagaaataaatatataaacccgcatgaaaaagctttacct

SEQ ID NO: 20737 - DNA, 466 bp, Gossypium hirsutum
  Clone ID: uC-gsflnu33B036d04b1
attatgctctactctcaaagaaaatgagaagctcaggtcttttgtagctttcttgactgataaactacaagccaaagatgtggttacagaagcaatagcaggtgaaaaggatgacgggttagcatctgatatggactccgccctccaattcagtatgaaggtggaggaccgttttagtagctggctgtgtctgaagcgcggtggtggatgaggatgccccacagctggtggacagcggctattcctactttccaagcgatgaatacttcagaggtattggcccttttgatggggttcagccggtatatgaggatggcagtgataattgcgggagttactttttcgatgtgttctgtcaaccacagagcatgaggcattatgattgcgggcctggtcctaacctaaaggatcctgcaacaatatatttgtctagtgattcaatgctaaggatgtcatgccttgaata

SEQ ID NO: 20738 - DNA, 239 bp, Gossypium hirsutum
  Clone ID: uC-gsflnu33B036d11b1
ctagactggcgcaattatctcacacctttcagggttgattgtaaggagatgcgtagtcaagacaaatagaatggctcgggtttaacatttaaactgttctccaaaactttatacaatattcgttcctcatgatcgtcgtgatgtttattctaggcttattggcagagacatctcttctattcccattttctttataaataatctgtactaatcatgataagaataaattgttttggggt

SEQ ID NO: 20739 - DNA, 520 bp, Gossypium hirsutum
  Clone ID: uC-gsflnu33B036e01b1
ccctcttttccggatatggctaagggggagaacagacgcaagctctattcttactggaggagctcctgctacttccgtatcacaattgcccttaacctcaaaggcctggaataccagcacatacccgtgaacttgcttaagggggagcaattcagtcctgaattacaaaagctgaaccctattgggtatgtaccgctgctggtggacggtgacatgaccattttagactcttttgcgaatttcatgtatctggaggagaaataccctcaacaccctatattgccatctgatcttgcacagaaggcactcaatttgcaggctgcaaatattgtttcctctagcattcagcctcttcagaagctagctgtactgcagaacattgaggtgaaagtaggtccagatgagacaattacttggacaaaatttcatattgagaaaggctctgaagcgcttgagaagctgttcaaagatcatgcctggaaatatgctactggagatgaagtttccatggcagatctgt

SEQ ID NO: 20740 - DNA, 232 bp, Gossypium hirsutum
  Clone ID: uC-gsflnu33B036e06b1
gccatggatccggagcggacgccctttattatggggggtgatagaaacacaatgggggggattctacaaaacacaagacaaaaaaggcagaggaacgcgctaaaaaaccccagctgaaggccaatggctaaaagagctaccgcttgatggaataccaaattgataacacctacgcctcaagaagaagcgagtgcgaatgaaccaacaactactaagccaacacttagggagg

SEQ ID NO: 20741 - DNA, 538 bp, Gossypium hirsutum
  Clone ID: uC-gsflnu33B036e09b1
ctacgcgtccgtccacgcgtccggttgtctgcgaggcttatatctttgttaccacgactggtaacaaggacatcatcatggttaaccacatgaggaagatgaagaacaatgccattgtttgcaacatcggtcacttcgacaatgaaattgacatgcttggtctcgagaattatcctggtgtcaagcgcattaccatcaagcctcaaaccgataggtgggtcttccctgaaaccaacaccggcatcattgtgttggctgaaggacgtctcatgaacttgggttgtgctactggccaccctagctttgtcatgtcatgctcgatcactaaccaggtgatcgcccagctggagctgtggaaggagaaggcaacaggcaagtacgagaagaaggtgtacgttttgcctaagcaccttgatgagaaggtggctgctcttcaccttggaaagcttggggctaaccttaccaagctcaccaaggatcaagctgactacattagcgttcccattgagggttcttacaagccccttactacagtact

SEQ ID NO: 20742 - DNA, 534 bp, Gossypium hirsutum
  Clone ID: uC-gsflnu33B036e10b1
ttattatcgcagaagatattattgggttattgtagctagctagctccacattgtctatggcttcaaagcttcttttgattgctgtctttgttcttgatctcattgcttttggtttagctgtggcagctgagcaaagaagaagcactgccaagattgtccaagacagtgaagttaattataactattgtgtctatgactcagacatatcaacaggctatggtgttggtgcatttttgttccttatggttagccaagcccttataatggctgcaagcaaatgcttctgctgtggaaagggtttaaaccccagtggttcaagggcctgggcagtcatccttttcatagtctgctggttgtttttcctgattgctgagatatgcttgctggctggatcggtgagaaacgcctaccataccaaataccgaaccattttcagcgagcagccttcctcttgtgaaactgtgaggaaaggtgtgtttggtgcacgggcagctttcattttctaaatgccttgtcaacaagttctatatattt

SEQ ID NO: 20743 - DNA, 284 bp, Gossypium hirsutum
  Clone ID: uC-gsflnu33B036f02b1
gccatgcttacgaacaacattctagtgctgaagggaggccatttatagcacttggggctgggatccaacataagcatatggattatggctagtatgacaaaaactcaagcttctagaatgccatctttcacatgagcctatgcgatgcggttgacgcactggttcctagctattactgctgacgacgtaagcacgctggttaccaacatacttactgcattgatagccagccggcgtcagacctctgacataggggctctatagggaaccaatctaatgttcca

SEQ ID NO: 20744 - DNA, 420 bp, Gossypium hirsutum
  Clone ID: uC-gsflnu33B036f03b1
gtggacccacgcgtccgccctcgtttccgcccagttgcacccacacaaccggggaattgatactgtcgggacggttgacagtccatcacttttccccaatcgagctccatctggcagggtgttgctcttgaacaacataggaggagctaccaacactggaatattgtccaagactgaaggggaacttgaagaagcagatgatcgtgatttgagaaaaatgctgataaatcctaatgcacaggagcctcttgttttgggtgtaagagtatggccacacgccattccacagatcttggttggtcatttgcatctccttgatagtgcaaaaatggctctcagggattccgggaatcatggactgtatcttgagggcaactatgtattatgtgtggcattaggacggagcgtggaaggtgctta

SEQ ID NO: 20745 - DNA, 293 bp, Gossypium hirsutum
  unsure (1)..(293): unsure at all n locations
  Clone ID: uC-gsflnu33B036f06b1
ngtcactcgtccgatttttggtgcttgaataactgccggttttcatgaagctgattgtcataaagggcaaccccatttgtggagccatgctgacgttcgtgatgctgtccatgccttatttttttgtagagagacaaatttatgagaacgggctggaggttccaagacacactctggaataccccagccgatcccacttaaagccgccaacaattcaattcatcgtgaacccaatgctttgataccccatgagagaagaaccgatcggaaaatccaacggtgatcatttggaa

SEQ ID NO: 20746 - DNA, 266 bp, Gossypium hirsutum
  Clone ID: uC-gsflnu33B036g02b1
gtcatgcttatcaggaacagcctagtgatgatgggaggcccttatatgtccttgaagacgggaacgaaaaaccggatacggaacagggcaagagttgcagaggcttatgcttcgagacacccctagatcactagacgctatctaaactggctgacccacattggtgggcatatcacgggagacgttgccagcacgctagcttccagctcaagaacagcattctgagcgaggatgcttcaactctctgaacacagaggctctatcgg

SEQ ID NO: 20747 - DNA, 351 bp, Gossypium hirsutum
  Clone ID: uC-gsflnu33B036g03b1
accaacaacattctactgttgatgggaggccatcaaaagtccttggggatgggttcgaagatgaggatactgaatatggctagatctgcagcgacctaagctcttagagagccctctttcacaagaccttagcgtatgtggttgacccactggttgcagactattacgttgaacgtcgctagcactgctggtaaccacctcatgtaatgcattgagagccaggtggagtccgattctgacaatagagactctatcgtgtacccatctaatgttccaccatgcatactcaggaagagacattttggggccttagaaagtgcattgtacatatcgtttaagaatagggccttg

SEQ ID NO: 20748 - DNA, 476 bp, Gossypium hirsutum
  Clone ID: uC-gsflnu33B036g07b1
taatttgaacacttcctccgcctccgatcacctggcggtggcagttaacggccataaaacttccttggatctgaacttagttccgctagataagaagaacaagcctcagccacctgctaaacagcctccacagaagccgttaactattaccgatttgtctcctgctccgaagcacggttctcagttgcgtgtggcttatcaaggagttcccggtgcttactcggaagctgcggcggggaaagcttatccaaattgtgaagctattccttgtgaccagtttgaagttgcgtttcaagcggttgagctttggattgctgatcgagctgttttaccggtggaaaattcactcggaggttcgattcatcggaactatgatcttcttctccgtcaccgactccatatcggcggtgaagttcaattacctgtccatcactgtcttttagctttcccgggaagtaggacagagtatttgacgc

SEQ ID NO: 20749 - DNA, 496 bp, Gossypium hirsutum
  unsure (1)..(496): unsure at all n locations
  Clone ID: uC-gsflnu33B036h04b1
cctatgtgtccgcccacgcgtccgaaaaacgacatcgctgcggctattacgaggaccgacattttcgatttcttggtagatattgtgcctagggatgagatcaaggatgaaactggtttgactccgatggttggggctaccgccagtggggtaccttacttttatccccctatgggtcaacctgctgctggtggtcctggtgggatgatgattggccggcctgccgtcgatcccaccggaggtatttacggtcagccaccttctcaggcttggcagagtgtttggcagacggcggtaaatgatgatggctcggtggaagtggagttaccggtggtcaagagaatcttgacggtcaaggctaacctaaaatcatgggtccgatatcgtacggtggatggtgcggaaaacgcgtggaactcaggtgatctactgnggaatttatgcttgtgtgcttactgatttatgaatgcagttgtgttggtattgtttatgggaa

SEQ ID NO: 20750 - DNA, 362 bp, Gossypium hirsutum
  Clone ID: uC-gsflnu33B036h11b1
tttctatttagtggtttaagggattttttcatttgtttcttcttacgctcgattacctcacgaaaagagaaaatgaccaagtgttacccaactgtgagcgaggaataccagaagtcagttgaaaaggctaagaggaagctcagaggtctcatcgctgagaagaactgtgctccactcatgctccgtctagcgtggcactcagctggaacttttgatgttaagaccaagacaggaggtccattcggaaccatgaagcatactgctgagctcgcacatgctgctaacaacgggcttgatattgccgtcagacttctcgagccgatcaaggagcagcttcctaacctcacctacgctgactttta

SEQ ID NO: 20751 - DNA, 95 bp, Gossypium hirsutum
  Clone ID: uC-gsflnu33B037a01b1
agcgaccgagcctcctagaagagaaaaaaaaaaaacaaacaggggggcgcctaaaaaaggaggccggcggaacccaccccctgaggaccacaaaa

SEQ ID NO: 20752 - DNA, 575 bp, Gossypium hirsutum
  Clone ID: uC-gsflnu33B037a05b1
accttacaaacagatgaggaaggaaaagtattttgagacacattagactcttcctgctggttacttggaaattggggagcctactgctgaaggggcaataagggaaacatgggaagaggcaggtgctgaagtggaagtcatttccccttttgcacaactagatattccccttattggacaaacttatgtaatcttcttggcaaagctgaagaagccccaattttcaccaggaccagaatcatccgagtgctatctctttgaattggacgacattctctttgattctttgacattttcttccatttttgttactttgaatttggttaagaagcgaatgaggaagcctatctatgtctactaccaactggacaatttctaccagaatcatcaaagatattgaaggtgcgacaaaggattcaatctcttcaagctggaaatgccaaggcttagcacttcttcaagtggaacgttatttatgttgcatttcatggtcatccatcttagtcagaaactgaatttgtgttatggaaatagggttttgtagctaccttggtaccagcttctttaccatgatg

SEQ ID NO: 20753 - DNA, 466 bp, Gossypium hirsutum
  Clone ID: uC-gsflnu33B037a08b1
ctttctcgtgggtgagctttgcaattcggatgccaataacttcgtcaatacaaaagaagcatcagcaagatatgagaagacagaacagtggtgcacaagttggtggtatcagttcaaggtgctgcttcaaaggggggttagagaaaggagatatgaagccttcaacaggctaagaattttccaagtgatcagtgtggcagtacttggtggactactatggtggcacaccccagcttctcacatcttcgaccgcattgcactgctgtttttcttctcggtcttctggggattctatccactctacaatgcggtattcacattccctcaagaacgaacaatgctaatcaaggaacgctctttcggaatgtatcgcctttcatcgtacttcctcgccagaacctttcgtgaccttccacttgagcttgccctcccctcagctttcgtctttataatctattggatgggt

SEQ ID NO: 20754 - DNA, 434 bp, Gossypium hirsutum
  Clone ID: uC-gsflnu33B037b03b1
gttcgtcctagatctcagaagatggcccgtaccaagcaaaccgcccgtaagtctactggtgggaaggctccaaggaagcaacttgctaccaaggctgcccgtaaatctgccccaaccaccggtggtgtgaagaagcctcatcgataccgtcctggaactgttgctcttcgtgaaattcgtaaataccagaagagtactgagcttcttatcaggaaattgcctttccagaggcttgttcgtgaaattgcccaggacttcaagactgatttgcgtttccagagccatgctgttctagctctccaggaagctgcagaggcataccttgtgggtcttttttgaagacaccaacctttgcgcgatccatgccaagcgtgtcacaattatgcccaaggacatccagttggctcgtaggatcaggggagagcgtgcttaat

SEQ ID NO: 20755 - DNA, 562 bp, Gossypium hirsutum
  Clone ID: uC-gsflnu33B037b09b1
tttttgggaaggctaaagaaaaggttgcagaggtgaatgtccctgtagcaggtggccatgcttgaaactaccattctcccactattttctcaagccacaccaatggccaagttacctgaagaggatatcaaaggctctcacagagaggacacatgatgggggcactgaagttgcggaagccaaggctggaaagggttcagcaacattatcaatggcctatgctggagccattttcgctgatgcttgccttaagggactgaatggcgttcccgacgatctggagtgctcatttgtgcagtcaactgatactgaactccctttctttgcttccaaggtgaggcttggaaagaacggtgtggcggaagctttggggttaggccctctctctgagtacgagaaagaaggtgtggagagcctcaaaccagaactcaaatcatctattgagaaggagatcatgttcggcaaccagaattaaacctgaactactgatgacttcttgctttgcgcaatccgaaattctaaaatgtttgtttttgtgctactgttgtattcatgctgcaag

SEQ ID NO: 20756 - DNA, 114 bp, Gossypium hirsutum
  Clone ID: uC-gsflnu33B037b10b1
cctcctatccaggacgagccaacatggagccaagggggactttaaaaaaattttccgagacttcacacaaacgcccatcacgcccaccaatagcattccaatcaaaacctaagc

SEQ ID NO: 20757 - DNA, 564 bp, Gossypium hirsutum
  Clone ID: uC-gsflnu33B037b11b1
tattctctttgaaaacctctctcatctctttcatcgtgactcttcggttctcaacctggctgccttagtcttcgattctccctccaacgatgagcatggtccggatcctccccctgcagttaatatcctattcctctcttcaaggcttctttggcaaggaaataggcacaatcattttctgatctagggataaaatgaaactcgatattctgaaaataaacctttttgctttgaatgtctctgatgaacgctcctatagtcaatttgtccggatcttttgattggcatttttttatcactgttttagagtcccccactatttgtaaactgttaaaacccattgaaatggctaactgaatcgcttgtaacccggcatctgttttcgctgctagcggtgtcggtatatcggagtggataaccgttttggataccaagatcacacccctttcatcacggacagccagacccgaagcagatctggaggatcccttgtcaaaagccgcatcaaataagacagttaccgtcgtgcttctggccgtgtattcatgacctttatcaacattt

SEQ ID NO: 20758 - DNA, 541 bp, Gossypium hirsutum
  unsure (1)..(541): unsure at all n locations
  Clone ID: uC-gsflnu33B037c05b1
ccctctcgtccgggtagttgttgcagaagagtaaaatagtaaagagtcacagctgaggcacggaagaagatgccttgcctaaacctttcaaccaacgtcaatctcgacggcgtcgacacctccgccatcctttccgaagccacctcttccgtcgctaaactcatcggcaaacctgaggcctatgtgatgattgtgttgaagggttcagtacccatgtcatttggtggtaccgagcagccagctgcctatggagaactggtatcaattgggggccttaatccagatgtgaacaagaaactgagtgctgcaattgctgcaattcttgaaaccaagctacaagtgcctaagtcacggttcttcctcaaattctacgacaccaagggttccaactttggatggaacggatccaccttctgagcctggcatgttctgaatttctcgaaacatcagtgatgtctattcaaaacaatcttactcgtatgatgaactggtgtgagaagaaatngttaaaacctggcatggtattttaagtgtttatcta

SEQ ID NO: 20759 - DNA, 559 bp, Gossypium hirsutum
  unsure (1)..(559): unsure at all n locations
  Clone ID: uC-gsflnu33B037c08b1
ctttctctaaagctaagaaagcaagccactagggttttaagagaagaccaaaatggcttcaaaaagatcagcttccatggccctctttttagcactcaacattcttttcttttccctagtcagtgctacttgtcgatcttgctcttcttccggctctaatcccatccccacccccactccatctgcacgaggtaggtgtcccagggatgctcttaaattaggtgtatgtgccaaagtgcttagcttagtcaatgtcactgttggttcacccccagtgatgccatgttgttcccttctcaatggtctcgttgaccttgaagctgccgcttgcctttgcaccgctatcagagctaacgtcttaggcctcaaccttaatgtcccagtttcccttagcttgcttctcaacgtttgctcaaggaatgttcctactggcttccaatgctaattttagtcatcactctccctacattctttntcatctttctatttgtgtttggtttttgaagttatggttttcccttatttgcattaaatcaatggctttatttgtatttttttg

SEQ ID NO: 20760 - DNA, 431 bp, Gossypium hirsutum
  Clone ID: uC-gsflnu33B037c10b1
tctactcgtccggatgaaaccccagaattcatgcctctcatccatgtccttgcaactaagcttggggcacgtcttactgaggttaggaagaatggtacctgcccctggctaaggcctgatggtaaaacacaggttactgttgagtactacgacgataatggtgccatggttccggttcgtgttcacactgtcctcatctccacccagcatgatgagactgttacaaatgatgaaattgctgctgacctcaaagagcatgttatcaagcctgtcattcctgagaagtatcttgatgggaagacaatcttccacctcaacccatctggccgctttgtcattggtggtcctcacggtgatgcaggtcttaccggtcgtaagatcatcattgacacttacggtggctggggagcccatggtggcggtgctttctc

SEQ ID NO: 20761 - DNA, 500 bp, Gossypium hirsutum
  Clone ID: uC-gsflnu33B037c11b1
cctactcgtccgcggtgatcgagggttatcagtatcttgttagactccatttctgcgatattgctagcatatcccttggattgttgtttttcaatgtctatgttaatggacatttggcatataaagatttggatccttcggccgttaccaattatttgttggctcctccgttttttgtggacttggtagttgatgctgatcattccggtatagtgaatgtaactgttggaccttcgaacaagagcatggcatacgcggtggatgctatcctaaatggagtggagatcatgaagataagtaactggatgggcagttccgacggtacgttgcctgcagagacagttttgaagtgtttgccaaggaaaagaagagttgcgttttctgctacctttgaccgcccttgttagctcattgctgagcttattcagcaattatacctaggaagattgaaaaggtggagtcagtgctttgtcaaaattgccaatgaggtccatgaattt

SEQ ID NO: 20762 - DNA, 468 bp, Gossypium hirsutum
  Clone ID: uC-gsflnu33B037d06b1
ctgttttcgtgtcacggaaaaagaagcaatcccaggagatttattgaaatggggttcgctcggtttttgcaggacttcgagatttgcatctgggttcaagcctttagaacccaagccattggattccatcatggatttgaacagatcaaagaaccgttcacctgaggaccttgcttctatttgggatgattatcacttgggaagaggtcatattgggttgaccatgaaggcaaaactttaccgtttattggaacaaagaggctcagattgccggtattttgtcgttcctttgtggagaggaagtggttatacaacagtgtttggtcaagtgcaattgccatacatgcttttcactggtctcgaagattataaagcaagaggaactcaagcatgtccttacttcactgcatccttttacacagaatttgcggaaagcaaggacttggtacttatccgtggagatattgt

SEQ ID NO: 20763 - DNA, 519 bp, Gossypium hirsutum
  Clone ID: uC-gsflnu33B037d07b1
ttttctcgtccggtttttcctcatttggccgaccaaaactcacccccgatcgccgcaccatcactgtaatagatggctagcgatgagttgggcttgatttcgaagaggaagaatgcaactctgacgaccggattgattcaggtacggaggagaacgtggagcacgtacggaggctatgcgctggcgtacggaggtagctggcgattggggctgcggcgtaaaaggggaacaaaaccttagggtttctgttcctaaaatgtttcggaccgtttgggccaatgtaactttgggtatgagttaatttgggctcgtattgagttttgaatttgggctatgtgattggacttcgatttaatatttggatattttttattttagctttattatcgttgtttgtaacgggccgggcaaatttggcccactacatgaattataagagaatgaaatgtgattatatgcaagtgaattatgaacacgtgaactaaatgtaatttatgaaatgaaattgtgatttgtgtg

SEQ ID NO: 20764 - DNA, 231 bp, Gossypium hirsutum
  unsure (1)..(231): unsure at all n locations
  Clone ID: uC-gsflnu33B037d09b1
ncttctttgtatttatgtttatgttggctgccttttttgggcatgcttttgaatggaggggagtgggatcaaagggaaggatttgattgaggagatttttgggcggtaatggtgggagttgagagctagggtttttggtttatggttttttgctgtattgttgtgttgttggtgtttcttgactgtgtgtatcttatgatctttatattgttagcttataaaaaactttaa

SEQ ID NO: 20765 - DNA, 585 bp, Gossypium hirsutum
  Clone ID: uC-gsflnu33B037d10b1
tctccactaagcttactccctccctccttccctgtctctgtttctgtcgcttccatgactgtcttgtttaaaatgcctgtcgttttgggtttctttgtgggtcttatgatgctgggtttggttagctctgctgagtttcatgagctttttcaacctggttgggcaaacgatcatttcatctatgaaggagagcttcttaagctcaaacttgataatttttctggtgctgggtttgcatcaaaaagcaggtatttgtttggaaaagtatccatgcagatttaacttgtagagggtgactctgctgggactgtcactgcttactatatgtcatcggagggtccataccacaatgagttcgacttcgagttcctgggcaataccacaggtgaaccttaccttctccagaccaatgtgtacgtgaatggtgttgggaacagagagcatagaatgaacctttgggttgaccccaccaaggacttccactcttactgtcttctttggaaccagccccatgttgtatttttagtggatgagacaccaattagagtgcacaccatcttgggacacaatggtattcctttccca

SEQ ID NO: 20766 - DNA, 544 bp, Gossypium hirsutum
  Clone ID: uC-gsflnu33B037e03b1
cccatgcttccgaatcgtgcttatggcacgcctctgattatgctgatggtgaattgaaagatgaacttctctgcattcgttttgcatcagtggaaaattgcaaaacctttatgcatatgttccaagaagttgctgattcacaaaaaccaaaagaggaaaacaaggatgcatctgatgctgctggacaacttgagaagttgagctttcaagagaaagctggagaggagaaggctgttgctaagaaggaagagaaggaaacaaaagtggatacagaaaaatcagatacagagaagaaagatggggagccagcttcctccacttgaaaagagtttggctctgctcttcatgccattggctcttggcgaatatggtgagattagtcagctgatcaaccctctcacccatgtctaggatatttttacgggtgaaactagatgggtagtctatgggttggaatggtcgaggtcgtctgtggtcttaggttgggtgtttgccaagggttggttaccccgagtcatttaattaatgttgcatgttagagttg

SEQ ID NO: 20767 - DNA, 360 bp, Gossypium hirsutum
  Clone ID: uC-gsflnu33B037e06b1
agcgcgccgttctcgcgtccgtgaagccacatggtactgggagtaatgtgcggattggggtgctggctgccactgaaactatagctgctgcttcttaccaggatcaactagggaatcaggggtttgaggtagttttgccagacaagcaaccatggaacacattctaattccagcgatcgagtcattgaacatacgagacaccgtaggggctcggaatctattaagaatagcaatccaggtgcttttgatcggagccgtcaatgttgtcattcttgtttttgatgagcttcagaatatattacctagagaagatcctcttctgaagaaatggatggatccgatggacgccttagcccgatc

SEQ ID NO: 20768 - DNA, 577 bp, Gossypium hirsutum
  unsure (1)..(577): unsure at all n locations
  Clone ID: uC-gsflnu33B037e12b1
tttatgcgtccgtgaagccacatggtactgggagtaatgtgcggattggggtgctggctgccactgaaactatagctgctgcttcttaccaggatcaactagggaatcaggggtttgaggtagttttgccagacaaagcaaccatggaacacattctaattccagcgatcgaatcattgaacaaacgagacaccgaaggggctcggaatctattaagaatagcaatccaggtgcttttgatcggggccgtcaatgttgtcatccttgcttctgatgagcttcagaatatattacctagagaagatcctcttctgaagaaatgtatggatccgatggatgccttagcccgatcaaccataaaatgggctaaaactggaaaacaaggtatgcagaagaatacttgctagtattacacacccaaaacttgtgaaaacaaatggtgtactgtcttgtaaggatattattatttgtgtatcaagtaatgcacaggcgtatatgattataccagatattaactgtgagacacgttctcatgtacaatatctccncttgttggttccatttgctgagccaacat

SEQ ID NO: 20769 - DNA, 326 bp, Gossypium hirsutum
  Clone ID: uC-gsflnu33B037f02b1
cctatgcgtccgaagcagtcccttcctccaggtttgagtgttcaagacctgtgaaaatatggcagcctcaggtttgtcacctgatttataggtgatgaaagctagattttagttttggggttattgtatttctggtcattctgcaacagtgaagctcaattttctgtaattggatctatgtttttttgttgattaaggattttagtgatatatgcacttttcaattacaatgaatgttctttttaatgaaaaacacagaaaaatttgatgttgcttcgctaaaaatataaatattattattttacaattattaaatatatataatg

SEQ ID NO: 20770 - DNA, 530 bp, Gossypium hirsutum
  Clone ID: uC-gsflnu33B037f03b1
ctgctgctcctgctggtacccctcctccgttaccggctggacccacgcgtccgaatttatttcatgaactcaacccaaaatgtaatgaatccttaatttttttcatttcttttttaccctttttcaaaagaaaaatggattgttgttctttttcatcgtcattaagcttaagtttaagcttaatgttgaaacctcgtccgccattaatgaccattaactataatggtaactctcagtggagtaaaaggaagaagaaaaggcattgtttgcttcaagtctctgcaatttcttaccagaacttcattcatttttcttttaatgaaactaaacgacatacccttttgcttccttctcctctacaggaaaagtatggttctatgatcgcaatggatgaacaaacaaggcttgaaatgttatcattcgaaactcccaaaatcagactacttagaagtatgagcattggaagtgaagctatgcaggtattagatttttgtggctttccgaaaccagaatttgatctacccatattt

SEQ ID NO: 20771 - DNA, 462 bp, Gossypium hirsutum
  Clone ID: uC-gsflnu33B037f05b1
ctctcatgttcttttctttgcttgatttcattttgcagccaaaaaaaacatggggttctcactgaaacttcagtattgcctagtttctgtcatggtgctattacctgcagtgtgttactctcaggactatttcgtcaagtccagagcaacttactacggcagtcctgactgcttaggcactccaagtggagcttgcggatttggagaatatggaagaagtgtcaatgatgccaatgtcgccggggtttccaggctctacaagaatggaactggctgcggtgcttgttatcaggttaggtgcactaaccctcaaatatgtgctgataatggggtgaacatagtggtgaccgactatggcgaaggcgacaacaccgatttcattcttagtccccccgcatatgcaaggatggcgcgaccagacaccggggcacatctgtttgcttacggcgttgttgatgtaga

SEQ ID NO: 20772 - DNA, 358 bp, Gossypium hirsutum
  Clone ID: uC-gsflnu33B037f06b1
ggcctccgagactgaggagagctacatcagcaccgtagtggtcgagcctctggctgagaacgatggcaagtgcaagtgcggaactagctgcagctgcacaaactgcacatgtggcagtcactaagcagacatatagaatgatgaagtttgggacctaaaaagaataaaagttgggttgaataatttgtgtcttttgttgtagttagagtgtgttttcttgtctatctgtccgatgattgtctatgtctctcattttatacaatgatggaatgaccatgtcaatggcctttgtctgattaatgaactattattagtttgtactgaaaaaaacgtagaaattacccaaaatcatattttt

SEQ ID NO: 20773 - DNA, 477 bp, Gossypium hirsutum
  Clone ID: uC-gsflnu33B037f07b1
ttcctcattacactcaaacatgaatgggagtctaccagggcctagccttcattttgcggattatcccagcaaggctcctttagagaattctgggcacccaggtatggctatggctgcttctctggcctctgctgtcggaccaagagtcgctgctgcctgtgcccaagcattccttggcagcaatgcctgaagatgtacataaggaaggtccgggacatggtcataggatgaatatggagagtgtacatagcacagaaggtggtttacatggctccgttcatcaaaaagagatctcagcattaccttcattttgtcaaaatgaggcatacggtcatccactttctgcagaaaaagttaaagctgctgccaaaagctgccttgcagctgcaactatgaaggcaaaactggttgcggaccatgcggaacgagttaattgaaaggtcatcagtcaacatcataaatcatccagtgcagaga

SEQ ID NO: 20774 - DNA, 605 bp, Gossypium hirsutum
  Clone ID: uC-gsflnu33B037f09b1
ttccgtatttccgggttggccccacgcgtcctttttttcctccttcgggttggcatgagaccaagggctgtaccatgctctgttccttttcatgttccagcaagaacatcaaatccagttatcaaacatgccaacgacatctttatgcttaaacacaatcatgtccctggaaagaaatcttccacatttcagatgagatcactctccaacaacacggttttcgaggatcaatcccagggtgtaatctgctatagagatgaaaatggagaaatagtttgtgaagggtacgacgaaggccctcgttttcctcgacgattccgggtaagtcctatcatctgagagatgctgagatccttgatcttatccgacatagatggctccaaattgttaatggtgacggcctcggcactgctattaaaggtgttatcatcgtgaacaatgactcctagtggaacgaatttaataggttcactaggtagaaagctgtggctcctactagagtccacagatttcattaaataattggttctacaagcaagacacttcaagtatgagagactgaatatagatagctacaagatctctctcttgtaatcacttttgtt

SEQ ID NO: 20775 - DNA, 544 bp, Gossypium hirsutum
  Clone ID: uC-gsflnu33B037g01b1
acattatggggagaggtggcgcgcgtgcgtgcccctccccggtatccccggcgcgccccacgcgcgcgtttttcagcataccattccagcattgtatgtgacacatgtgatgaggattccacactccgatatcctcttatagccgctcccagtttctcttttcttgtcgcacgttgtacttcaccatataacccaaataccttcctcagctataacagtcacatgatcaaatagccactatactgaactgtcaaatttcccgtccaaaacactagttcacatcatcgtatgcaccacatgttccatgaccatctctcttatgggaagaacaatcaccatccaagcggtactcagatagttacaatggcatacaccttgatggtagaagcatacacatgagaagcgattacgctgggttgaagctactacacacaagggctcgatagctacgagccatactaagcctgtctggcgcaacggcggctgacttagcattggcaccacagatgctttacacatttggaatcagctcacatggtatggg

SEQ ID NO: 20776 - DNA, 404 bp, Gossypium hirsutum
  Clone ID: uC-gsflnu33B037g04b1
aagctatatacacatagagagtgaaaaaacacaagaacaaagggcatcatcatcatgaagaaggcatcctatacggcggcattctcagcggcagcagtggtggtcctcctcctactggccgaagcaaaggtgtcaatggctgtaacatgtagcccaacacagctaagctcatgtgtgagtgccataacatcatcatccccaccatcaaagttatgttgcagtaagatcaaagagcaaaagccttgcctttgccaatatcttaagaaccctaatctcaagaaattcattaataccccaaatgcaaggaaagttgctagcacttgtggtactcccttccctaaatgctaaaagaaaagactcaagttgtgttgtgctataatatctctgttttggtgtttgtagtg

SEQ ID NO: 20777 - DNA, 250 bp, Gossypium hirsutum
  unsure (1)..(250): unsure at all n locations
  Clone ID: uC-gsflnu33B037g06b1
cccttgcgtncggaggatgatgtatagtcaatagcagtgatgtttaccttttacttttcttcgctttttctttcttaatggaagcgatcttttatacttttattatatgtatgggtatcctctttctttctttctttctttaaaaaaaaataaaaaataaaaaaaaaaaaaaaaaaaaaaaaatacaaaaaaaataacaaaataaaaaaaaataaaataaaaaaaaacaaaaaataaaaataaaactaaa

SEQ ID NO: 20778 - DNA, 442 bp, Gossypium hirsutum
  Clone ID: uC-gsflnu33B037g09b1
ccgtcgggccacccgtccgcgtaattgacatggctactgaagaagctgtatcatgttaacttccatccactcctaggggctcacgcttgtgcgaggacgtgtagcaggtctgaaaggagtggaagcgtgaatgagcggcgcgcaacatggacgccgctttgcagtctcggatgcttaaacaaaagcaggtggttgatctgatgatccaagggcttcagatcgcacacgaaagcaaccagatccttggtaacattaccatagccacacatgtctacttgatcatgtaggtcacattcgcggtgcttagagctgagatgggtgatctcagtgccaggcttgaatctctgaatgaaatcaatggatttaataaactcgaacaatgtgggtttcgtatatgatcatccgaacaactatgtagccggccatgatcacgatcatgatc

SEQ ID NO: 20779 - DNA, 404 bp, Gossypium hirsutum
  Clone ID: uC-gsflnu33B037h08b1
gacctttcttcgggcaaaaagcgaccgacaacgcgggcggatctaagaaaaaaaacccgccaattccccctttggttttcgatctgggagctcccataaaccctaacccgagagacagagaaaaggaaaactatggcgccgccagcagcagcgggcggaggaggaggaggaggaggaggagaagaaggacagcagccgcgacagcagcaacaacaaaatggatttggacagaccataactggaattattaggatcgccgagttttggcactttgcttataaattcttttctccaaaaaagccaaccgatccctctaacctgaaatccaatctcttccagaagggcgaacccccggaaatgtggctttaactttctgagcatgaaaagttcaaagattctggaaa

SEQ ID NO: 20780 - DNA, 395 bp, Gossypium hirsutum
  Clone ID: uC-gsflnu33B037h12b1
caaaaaaaccaaccccaaggaaaggaagggcaaacgggaacagtaaaacaccgacacagggcgcccaacacaaggaaagaagagcgcgaagcgacaaaacgcaattatccagaccccaagaaagagaccagaaggagccacaaacacaaacagcatgacctgggcggacaccaaaaaaaagaaaaaggccagaaaaacccaaagcccccaacaccagagacagaatgtctcgcacaaggccaaagaaatacgactgcccaaaaagccaaaaacaccctaagccaacgcaccgcacaacctaaacaagggcgggcccaaacaaccaatacactgcacccacagaacctcagagagcccaccgcgaaaaaaaaaaacgcgacccacccaacctaaaa

SEQ ID NO: 20781 - DNA, 576 bp, Gossypium hirsutum
  unsure (1)..(576): unsure at all n locations
  Clone ID: uC-gsflnu33B046a01b1
cctactcgtccggttgggttaaatccctggacaaaacaaaacagtttatcagtcctcactcagaaaattgggagattggaaaaagagaaacagagaagagaaagaatggcttggatatggttggaagcagcacttcccctcggaatcatagctggaatgctctgcgttatgggcaatgctcagtatttcatccacaaagcttatcacggccggcccaagcacatcgggaacgatatgtgggacgtcgccatggaaagaagggataagaagctcttcgagaacctctcgtcctccgattgatccctttttagttttcttctgtgtaggaaacttggtcgatggagtgagagaagaaataaaaaatgctctatgatattctgtaatgctgaagaagactaaagagcagatgaactcgagtattttctttatcattgtaatgttaagcatgaacttctgaaatgttgcacttttggcaacactggctaatggttacgctggtggtgtattggagatttgttgcttccaaaattcctgtgatcttctattngcaggtctatgaatcattttggataaaaa

SEQ ID NO: 20782 - DNA, 545 bp, Gossypium hirsutum
  Clone ID: uC-gsflnu33B046a03b1
gctcctcatctcatgaagctgttaaaacgaaaggaggaaaagaaacagacagggaaaaactgctaggtgcagcagatgattcaacacccagggttagaacagctcaagaaattattgcaaaatatagaaaaactggggatgcctcttcagcagcagcgcatgcgagaaataaactggtagaaagacaggaaaagctggagagaatcagcagacgcaccgaagagctgcagagcggggcagaaaactttgcgtcattggcagatgaacttgtgaaggcaatggaaaatcgaaagtggtggcaaatataacttgacacaaattgggaattatgtctcgtgatcatttcttcatactccatagtagttgatcactttcgagctcatgatggcgccattgttgttcacagtaaaaaaaattggaatcatatgatttggttggtgaaatagtgaattgaagcttcaatttacactgtgtgtcttgagagttgtttggtttctgatgaaagtagcatatagtcaacatttcagcttcttaaaaaaaaatca

SEQ ID NO: 20783 - DNA, 253 bp, Gossypium hirsutum
  Clone ID: uC-gsflnu33B046a05b1
agttgatgggccctaaggagatggcggtggacggacaattggtgcttaattgcttccttacaatccatgtttgaaccatgctgcttaaatggatgtttggggctggggactggattgtgctgcttgttttatttatttaatattcaagggttttgagaacattaatgttaatagctattattgcacgagatttttttaaaaaaaagttagtgccagtttgcgcggtccgtgtaaaaaaaaaaaaaggggaaaa

SEQ ID NO: 20784 - DNA, 443 bp, Gossypium hirsutum
  Clone ID: uC-gsflnu33B046a12b1
tcatcaggtagcttccatggcggctgttgcaacaccaccaacaacaacctttgagaacccaagggtgggctttctttcaccaaagcctgttcctatgaaacatgtctcttccaccccaccaaaagctgcgaagctttataggggtgtgagacagaggcattggggcaaatgggtggctgaaattagactccctaagaaccgaacacgactttggcttggcactttcgacacagctgaagaagcagccttggcttacgacaaggctgcttataagcttagaggagagttcgctaggctgaattttccccaccttaagcaccaaggagctcatgtttttggcgagtttggtgactacaaacccctgcatgcctcggttgatgctaagctccaggctatgtgtcaaagcttacaagcacatggcaatccagtgaagacgaagaccc

SEQ ID NO: 20785 - DNA, 602 bp, Gossypium hirsutum
  Clone ID: uC-gsflnu33B046b05b1
cctactcgtccgattcaggaggagaatgagttccccttggctgacaagaacatcaaatcagtcattgtggacgtttttggtgcgggaagtgaaacatcatccacaacccgtggagtgggcactctccgaaatgataaaaaatccatgggtgatgaaggaggcccaagctgaagtaaggcgagttttcggaccaaaaggaaacgttgacgaaacaggccttcatgaactcaaatacttgaaagcagtcattagggaaaccttccgaatgcgcccatccgtgccattgttgctcccaagagaatgtcaccaagcttgcgaaattaatggctaccatgtcccggaaaaaaccagagtcctcattaacgcatgggccctcggaagagaccctaattacgggaacgaacccgacaaattaaccctgaaaggttcctcaatggttcagtcgattacacgggaacagattacgaattcatcccatttggggctggaagaagatgtgcccagggatcacctgtgccacacccaacctcgagctggctgtggcccatctggtgttccattctgactggaagctacctaatggaatgaaaggggaagacttg

SEQ ID NO: 20786 - DNA, 474 bp, Gossypium hirsutum
  Clone ID: uC-gsflnu33B046b07b1
tgcgccccctggtgccgccgcggcgtaattggggggtcccacgcggccgccttttcgtgcggaaacgttgaccccgttttatcaaggacataagaacactagttacttaaaccctgttttcgtagggcagcaatttgttagacttggtgctgatgagacatcggagtttaatgaagacagggttaatggggtttatgatatcgatgtgaagttgtatttgaggattaggtttaagcttgggagggtcaaaactggtaggtttaagcctagaatttcatgtgatttgaaggttcctttgaacactgggaatggtggcttcggtggtacgtttaaaaccactatatgtgatttggatttctagtatgaatctgattcatgctttggtgcagtctgagattctatcttcattcagggatgtatacattttgttcttgtgtttgctataggtatgtgaatatatgttgatgtttggcg

SEQ ID NO: 20787 - DNA, 559 bp, Gossypium hirsutum
  Clone ID: uC-gsflnu33B046b09b1
tttttcgcgtccgtcgagagggaaccttcttgtcaaccaatatcaaaattagagttcgagtttgagagacgacgggtgacaaaggaggacgtaagggaattaatttacagggaggcactagaatatcatgctcagctgctcaaagactacctgaacggacatgaaggatccaatttcctttatcctagtcctgtcggccaattcaaaaagcagtttgcatatctcgaggaaaatggtggcagaagtgcaccagttttccctctggagaggaagcatgtgtccctcccaaggtctaccgttcattcaaatggtattactccaaatacacagtcaactttagtttcgtacgagaaccgacaagatagataagcggatgccaggaaagcgatgggtgtaatttctagtaaaccaaagccaacacggtcttcacctagggtgccttcagcaaagcccgggagagttgttggatcccgtgtaccatatgaggacgtgaaaaacattaaagatggttaccacgctaagatctctacagaatgcagccctcccagaatgctccccc

SEQ ID NO: 20788 - DNA, 86 bp, Gossypium hirsutum
  Clone ID: uC-gsflnu33B046c10b1
tcctaacctccgggaatggtaagcaaatgaggggtctttatgggggaaagctcatagtgccccgcataatacaaatagagcatcgg

SEQ ID NO: 20789 - DNA, 519 bp, Gossypium hirsutum
  Clone ID: uC-gsflnu33B046c11b1
gatctccagttcgaagagttcatccaatctaatgaaatggaaaccatagcacctcctttaccgttaaatggtggtacgtacgagtaaataaaatattactactctggaaatggagaattatgtgagtgtttgtcgattctacttgtacttgcatgtatcatttcatcaaattacattaggctttgagaagggtgttgaatctctgatgaagaatctgagtttggtgccatctagtcctggggtttgagcagaaccggcaaaatacgtggagaagccggcgaagactgtgaatgctaaaagtggtcgtggttgcatccatcaacctcgttgaatgtgtgtattagccgtccaggttttagctgagattctctggccgttttgaacaggttaacctttgtagattatcaagttgtataactctgctaccattctaatgcctttattctagttgacatatattataaatgtaaaaaatgtacaaaagatggttaatttagaaaaaaaatagaaaaaggaaaa

SEQ ID NO: 20790 - DNA, 536 bp, Gossypium hirsutum
  Clone ID: uC-gsflnu33B046c12b1
tgttacgcgtccgcagctgtcgtgctaacccaagctaacgtcacaagcaataattcatcagtgacatttgccaccctagttgccgttaatgatcccctcaggactggtcctgagcctgactcagaggtgattggaaatgttcagggtatttccctcttagccggatcaaatgcatcgagcacgcagtacatagaatttggatttaataccggtaagtttaacggcagctctctaagcgtattttcaaggggagaacaagggcttgcggtgttcggaggaagaggacgattcatgatggcaacagggactgcactatttaaccctatccttataaatgccaccaatgttattatggaatttaactttactgtagttcattactaagatgttgtttacagactcaattctcttggattgtgaaaaagtcatgtgattctgctccacttggttagaataaatgtatgagattaaaattctcatacttcatcattgtactgtattgatttattacaaataaagattaaattcttagctcc

SEQ ID NO: 20791 - DNA, 189 bp, Gossypium hirsutum
  Clone ID: uC-gsflnu33B046d04b1
attttgtgcacgatggcaagaaagggtaaacctgggagggattataatggcatcttgacacgttcacagatcttggacaggggaaggtatttgtagacctgttataaaaaaaaggaatcctcgtactgtgcaagtgatcttaggccaaacttattcagtgactgtagatattgcgtggtcaaaggttca

SEQ ID NO: 20792 - DNA, 361 bp, Gossypium hirsutum
  Clone ID: uC-gsflnu33B046d06b1
ccttctccttctcagaaatcttagtatcatcactatggcctcaaatcccatggtcttctctgacatgacgatcggtggtcagcccgctgatcggattgagatggatctttccgcatattgcactcctcgcactgcggagaacttccgagccctctgaactggcgagaaaggcgtcggtcgcaccggtaagcccctccactacaaaagctcttatttccatcgtgtgatccctaaactttatgtgccaaggaggttacttcaccgtcggaaacggtaccggaggagaatccatctactgatcaaagtacgctgacgagaactctatgatgaagcacactggtcccggaattctctcaatggc

SEQ ID NO: 20793 - DNA, 180 bp, Gossypium hirsutum
  Clone ID: uC-gsflnu33B046d10b1
tgtcctactgaggctcggggttccaaagaagaactgattgatagctattttgccgccacagaacttacaaatataaagtgctattgcttcttttcctttctatcactaaatccccaatattcattatcttcaattgcataataatggcagcaattgagttattttggattttgcttttaa

SEQ ID NO: 20794 - DNA, 70 bp, Gossypium hirsutum
  Clone ID: uC-gsflnu33B046e04b1
gtttttcgttcgctcctaaatcacgatatattcggcgcactgttttatagtctcccccccttcattcccc

SEQ ID NO: 20795 - DNA, 497 bp, Gossypium hirsutum
  Clone ID: uC-gsflnu33B046e08b1
gtctttacgcgtgcgtccacgcgtgcgccacttgtgcccctaaactttcatcttccagtaagctcgtaggttggagaaaccccaagtgtagttggctttttggccccgacgttgtgtctcgttgcctagactgtgaacccacttgcgaaaactgcactcaaacctgccctccttacataatacaatacggtttaggttccactgctgggcttctattagtagaaaacctggttttcccccagaaaaccttccaagatttccttgtcggatgctccatcctctccaaccgacagcccgatggaatagccgggttcggtcggagcgctgagtctataccctcccaatgaggcctgaagaaagtctcttactgtgtcgtttgtcgcctggtcgatgaacctggcgtcagcagcaacatgttggtggaaaccgggttgggttcctgtgatgccaagacccccagcctgagctacacaccggtttacaggaaccaagtggct

SEQ ID NO: 20796 - DNA, 316 bp, Gossypium hirsutum
  Clone ID: uC-gsflnu33B046e09b1
tttgtcacgtaagatcgcagggatgcataatggagtctatataggaggttgctcagcaacaaaaggaaatatattcatagatactttggggcggccgcaaaaacgcccccatgtttacatactcgagcagtcaacgagatgaatgttatatagtgtcacataaattcaagttaatggccggtgtataacaccgtcgagacagggaaaacactggcgtaacccaactaaaataccttgcagaacatccccctctaggacagctggtgtaatcaaaaatacgccctcaccgatcgaccctgccaacaggcgggcagac

SEQ ID NO: 20797 - DNA, 432 bp, Gossypium hirsutum
  Clone ID: uC-gsflnu33B046f04b1
ccttctcgtccgcccacgcgtccggaagagctgagaaagagagccgatgcagagaacaatgataaatctgtgaaggaccttgttctccttctcttcgagactgctctcctcacctctggctatagcctggatgagcctaacacctttggcaacagaatccacaggatgctgaaactcggcttgagcattgatgaggatgcaggagaaggtgaaggtgatgctgatatgcccccattggaggatgctgatgcccaaggcagcatgatggaggaagttgattaagcctaacatgtttttataagatcagtagatatatcttacttgtgaagcatctggtaactcgttttacattttgcatggtgcttttgcttttggtatgttggcagcagttattgtcgaggactcttaaatgataagtgcctgttttttctg

SEQ ID NO: 20798 - DNA, 504 bp, Gossypium hirsutum
  Clone ID: uC-gsflnu33B046f05b1
atttttctatcttcaggcaatagggccatttgtgattgcatctattcaccagacaagccattgaaaaggcaacaactcatacctgcacaggtattgggtgcactatctatgaagtcatcatcctcatactcaagcttcttgagttccgagcagtaagatgaaggaataaacaggcatggcaatcacattgccgggggtgttggtaacacaagcttcgacttcttgatcccaaatgggagggttcatggtgggggtcttatgtcattacttggtggaaatctgaagaacccccttgatagaatttgaagtccaaatttgctttggaatgaataaaccttttgtggattttaagttaattattcaactgtggaatttgttataagagctgctggttggagagagacttcgtttatatagacctttgttgattaaaagtgggatcattggcacggttttggttacagcatttggcaagatgcatgggctgctgactttttttttttt

SEQ ID NO: 20799 - DNA, 474 bp, Gossypium hirsutum
  unsure (1)..(474): unsure at all n locations
  Clone ID: uC-gsflnu33B046g01b1
aatggttattgataagaaaagattgattgatgatgttaggcaagctttatatgcgtccaagatatgcagttatgctcaagggatgaatttgttgagagcgaaaagtgttgaaaaaggatggaatttgaactttggagagttggctaggatttggaaaggtgggtgtattattagggctgtgtttttggataggatcaagaaggcttaccagaggaaccctaatttggctagcttggttgtagaccctgagtttgctagggagatggttcagaggcaagctgcttggaggagagttgtggggttggccatctctgctgggatcagcacaccaggaatgtgtgctagtcttgcctatttcgatacctataggcgtgcaaggcttcccgccaatctcgtggaggcacagagggacttgttcggtgcacacacctatgagaggatcgatcgtncagggtcatttcatacagagtggaa

SEQ ID NO: 20800 - DNA, 595 bp, Gossypium hirsutum
  unsure (1)..(595): unsure at all n locations
  Clone ID: uC-gsflnu33B046g07b1
ttgttgttctttcttggatagcatatgtctcaaaggcctaacgttccccactcttcttcaatagctcatggtctccattctcatctactggtttccagagagatgaaccctaataccaactggtctcaatagttccatctctttctttttcttctattgattttttgattaaacttcttctatatccttggagaaacaaagtaattgcctagcagatttgcacgcaaatgtttggaaagatctcaagcatttgagtttagatcttctttgagagtgcccctatgggagtgaagagttttgttgaaggaagcatatcctcaatcgaggccgggagtgcgacccacccatttgatgtgatcaaagtccgaatgcacctccagggtgaaagccatgcagccaaaccggctgtgaaacactccgccctgctgtagcctttaaacaaccactactactactttctctgatatgcacatgcctccttcgtcggcgcctgttgacctatggacacctagaccatgatctcncggaccgaaggcgtatctgattttttttttgaatcattgcttcccgccttcgcagaccctttttcaacacc

SEQ ID NO: 20801 - DNA, 270 bp, Gossypium hirsutum
  Clone ID: uC-gsflnu33B046g08b1
ttattttgaacaccccaaagctgcacatcatggcggaacaacttaccacataccgcgaggacatacaacgggctataatgtgattgagcccactaaggaggccaccccagaaaacgatgctagtgaaagaaatcaaactagagagcctgccgagacgtaaaaccggatgaataagtgttacccagagataatgctatctcattgaaacgaaatgcgaataaactagggcagctcgctgaagtacctaagatgttagccacatctcaacat

SEQ ID NO: 20802 - DNA, 259 bp, Gossypium hirsutum
  Clone ID: uC-gsflnu33B046h05b1
ggaaggggagctcttggagcttggtggggctgttttcattaacagattttgttcctggcccttacatgattcgagaaatggctgatagcgcgagggacaggtgcgtttatgataggcacaggatttgcactattgctgtccaggtgatctagcgccaagactggagatgctcatcctaaggcagaggtacctttgtaccactactaaacccatgtgaaggatatagagatttataactggaatcaataaaggggctcaa

SEQ ID NO: 20803 - DNA, 449 bp, Gossypium hirsutum
  Clone ID: uC-gsflnu33B049h04b1
ctcaatctgcagcagattgtcaatagccacattccagaattcagcacccgatgccacagtgtatcccttgaagatcagagagggagagaaaccaatccttgaggagcccatcacatttgctgagatgtataggaggaagatgagcaaagatcttgagcttgccaggctgaagaaggtggccaaagagcagtaacagttgaaggagaaggaggctgataatgagaagcccaagcttgaagccaagccattggaggaaatccttgcataaaacttttaccagcactgtttcgtcttccactatgatgtgtaaattttattgcattcctactttttttgtgggggcgataccccgtctctatttcttttctagcgagtaatgtatgtcatgttttccacatttgatgcttgtggcctattaaaaaaaaaaaaaagggcggtcgttttaagga

SEQ ID NO: 20804 - DNA, 263 bp, Gossypium hirsutum
  Clone ID: uC-gsflnu33B050b07b1
tctccgaaatacagcttcaactggtatttcaattggatcctgggttggttgggtgttgccttcagcctggccttctctattggtggcatatgcagcatagtgaacaatgaactcaagatgaagttcttcaagcccaattaagaagaaaagaaaaagacacttccttatatatataaaacctatatatcatactttagagatgcaaagatcaaatcaaatgatatatacgattccctctgatctctttttcaccacaaatacaa

SEQ ID NO: 20805 - DNA, 68 bp, Gossypium hirsutum
  Clone ID: uC-gsflnu33B050c04b1
tctccacgcgtccgaaaaaaaaaaaaaaaaaaaaaaaaaaaaaaaaaaaaaaaaaagaaaaacaatat

SEQ ID NO: 20806 - DNA, 364 bp, Gossypium hirsutum
  Clone ID: uC-gsflnu33B050f04b1
tgttgggatggattccatgccaaagcaggatgtttcaatctggttccagtaacaaaagtctcccccacttaagtgctaatgagcaccagcaaaaaagcccttttgttttttacttggtttgtttttctcatgtttgtagatgtagaagtttagtaagttttaacaggttttcatctgggcttcaataaaaaaaccaggaaagcccccatgatcctgcaatcctgttaccgatttacaaatagaatgcgattgtctcataaataagttagtgttattatttaccctggtttttatttcacatacagacagattttaaaggcaaacaaatttttttttggacaaatccgaggcttgaaacaatttg

SEQ ID NO: 20807 - DNA, 374 bp, Gossypium hirsutum
  Clone ID: uC-gsflnu33B050g10b1
cgcgtttgtttgcagttgcaatggacacttcaattcaccccaaaatttcaattcccggttcgttttgatccactgaatccccatcttccttaccttacccttctttttcttccccttttcctccattgtctaaagctcgaaatctctctattctccccacaatcaacagactggcacacaacgcataagctgagcctcttgaatctgcagtgaatatagaagctgatgctttttctcatttcaagcatttgcttgttccaataactgatagaaatgcttatctttctgaaggaactaaacaggctgctgcaactactgctgctttggctgagaagaatggagctgcaattactgtcgtggttattgatgaaaag

SEQ ID NO: 20808 - DNA, 364 bp, Gossypium hirsutum
  Clone ID: uC-gsflnu33B051a04b1
gttattactaaacaaaataaaaattaacccaggacaggaggatctctcagctactttttctctcaaaatttctccaattagctctggtttaggcgatggcttcaaagcggatcttgaaggagctcaaggatctacagaaagatcctcctacctcttgcagggcaggcccttgtggtggagacatggttcattggcaagcgactcttatgggttcccctgacagtccatatgcccgggggagtgttttctagtcacccattcattttccctccggactattccatttaagccacccaaggttggcattagggcaaagggctttcaccctaaaattaccagcaatggcagcatttgccttgatatt

SEQ ID NO: 20809 - DNA, 454 bp, Gossypium hirsutum
  Clone ID: uC-gsflnu33B051b01b1
tttatgcgtccgtgcacgcgtacacctgactgaagatgtatgctaggataagagatgaatctgtatgagctgatagtgctgtaccatgactgagatgagaataaactggttgtagtcgctgccgaaggagaatcgttaacaagctttcagagaagcagtggagagaaactgaggaaggaaaggcgaaggctcaggttgctaaagcacaaccagatgacgtgagtgacttctaccagtgaaaaagtagcaagggaatgagtcagctcgtataggaggatgaggtacaagatgatttagaaactgtgcaactggagagcatggcaaggatgctggtgatgcaaaaaagctaaatcgaattcttgaactgactggattgagtgacctagggtatgctgaagcaatatgagactggccattactatgatattggtcttgatgtcactgttattaatcg

SEQ ID NO: 20810 - DNA, 318 bp, Gossypium hirsutum
  Clone ID: uC-gsflnu33B051f07b1
tgctcaatcatgaaagaagaaacagggtggtggaaaagattgttaaagtcagaagagaaacccgcgccttacatcaaggttgattggaacaaatggtgcgatgaagacgatgaagatccaaattctgatttggcctctgatgatgatgatgccacgtatgttggtcaagaagaagaaagcagtgatgatgaaggattgctgtattttccagatttgtataatgcatgaggtaactaatttagaaatactaactatctattcttaagttgaccgtacttagctatttttttgtagttttcctttttatttggtcttttt

SEQ ID NO: 20811 - DNA, 453 bp, Gossypium hirsutum
  Clone ID: uC-gsflnu33B051h06b1
cattaaacaaaccactcccacattaaatattgttgctgaaacaatggcgttttcagctctgacaggtaagcttgaggcagatgtagagattaaggcttctcctgagcagttccatgaaatgtttgcccacaaaccgcaccacgtgcaccatacttgctatgacaagattcaaggatgcgatttacatgaaggtgaatgggggaaagtcggtaccattgtccattggagttatgtgcatgatggaaaagctaaaaaggcaaaggaagtagtggaagcagtagaccctgataagaatttggtcactttcagagtgatcgaaggagatctaatggaagagtataagagctttgtaatcacgattcaagttttgcccaagagcgagggtagtggcagcttaatgcactggactttggaataccagaagctgcacgatgggattgcgcattccgagac

SEQ ID NO: 20812 - DNA, 172 bp, Gossypium hirsutum
  Clone ID: uC-gsflnu33B055a03b1
gcggtttccttcgacacccaaaatggaggctcaccggctatcttctactaaacctgttcaagctctcaagccaacaaagaagatttctttagaggacgataccggcaaagcctccgacgcactgacgacttccttgtacctaacgaatgccctgtttttcaccctctttttc

SEQ ID NO: 20813 - DNA, 265 bp, Gossypium hirsutum
  Clone ID: uC-gsflnu33B055b09b1
atttgatgattacaatcatgctctacttggtggggtggaggacattgggcaacagcgactatactttcaaacgtaagattagcaaaagtaggaatgtaattccaagagattccccatatcgtaattttgactctcgaggggattatgaaaattccatagcttattgtaaaaggctctagattcggattgaaattaataggatttcgagtaccctccagtaataagtttgtaggtgcttataaccgaaaaattgtcaaacgatcct

SEQ ID NO: 20814 - DNA, 478 bp, Gossypium hirsutum
  Clone ID: uC-gsflnu33B055f06b1
cccacgcttccgcccacgcgtccgaaccgcttaggaaccttcactcttcagagcatccattgttatccccaagtagctttagtactctaccaccgaaatccaacccttaaaacaataccatttgcagagtggaaatgggcatctacgccatggattttgcactcaaattcaaccattctattttctctactccatacccacctaaaccttcacccaaatgtagatttctaaccgcaagatgctccctccctctctcctctgacggtgccgccactgggttggcagagaggccatggaaggtagcggatgctaggctggttcttgaagatggttctatttggagggccaaatcttttggtgcctctggtacccaagttggcgaagtggttttcaacacttttttaacagggtatcaggaaattctaacagatcctagttacgctggtcagtttgtcttgatgaccaatccacatattgg

SEQ ID NO: 20815 - DNA, 386 bp, Gossypium hirsutum
  Clone ID: uC-gsflnu33B055g03b1
gatgaatctgtttcctttttatggtgctctataatttggccaaatcatgacatctcttgtggttggtgcgattcttctcttgttgtcgttgaccggaattgtctcagccggtagagatgtaaccggagacatactccggttaccttcagaagctaataagttcttccatgggggcgacgatgatgaagttgaaggcacgagatgggcggtcttgattgccggatctaatggatattggaattacaggcatcaggctgatgtttgtcatgcttatcaaatgttgagaaatggtggcctaaaagaggaaaatatcattgtttttatgtatgatgatattgcctacaatgaagaaaaccctagacctggaatcatcattaacaatcccc

SEQ ID NO: 20816 - DNA, 132 bp, Gossypium hirsutum
  unsure (1)..(132): unsure at all n locations
  Clone ID: uC-gsflnu33B055h09b1
tgcctacgcgtccggaaaaactgcagaagctggggagatctaatagctgatgtcctctacataccaggnggctctatgtcaagctattgatgagaggcatgcttaagggaaatagacaaacgtattgaaaaa

SEQ ID NO: 20817 - DNA, 280 bp, Gossypium hirsutum
  Clone ID: uC-gsflnu33B056b03b1
gctgctgctccgccaggtgccgccgcgccggacccgggtgcgaccgcacccacgccttagtgactaatttctcgtagatgtgtacttgatccatagttagcttacatatatcgacggaggaattctacttttattatcagatttctggatggaaactattgttctaataacagacatctttaattccgtttatcttgaaactctcttgtagtttatgttcttccattagtacttgaatgcaagttcttcgtttttgaaatgatgatggcaatattcaacc

SEQ ID NO: 20818 - DNA, 374 bp, Gossypium hirsutum
  Clone ID: uC-gsflnu33B056b12b1
tctacaagagataatagcaccaaacgaaggaggaaattattggattagagaatggaaaatcaaaaaacagggggacccattggtgaagggcggtcttgcgtcagatgcccagctacatggaaattttaaattcgtgctctcaaaccaagaaaaagaggtcgaagattatcatgatcaattaggccaaagccatggccgtaccaagaaaaagcgcttcgagagcaacacggaggcagagcttggtttcttactagaaagggctttgcgctttcgactgctatggcaggattctttaaatcatggggtatgccactctctccagagttgttgcctcctgcctggactggtaaaagtcaagaacctcatttcctctt

SEQ ID NO: 20819 - DNA, 523 bp, Gossypium hirsutum
  Clone ID: uC-gsflnu33B056e03b1
tatatctccaagacaggttgattcatcaaaggaagcataagcatccactacacaagtcaaagcatcagggtcggtaggggcatctcgctttggttttggttttggctcacagcttctccagaagactgtgggattagtcttaaggcctcgctcagataaacaggctaagctgggtgaaaagaataaattctactatgatgaaaaacttaagagatgggttgaggaaggtgctgaacctccagctgaagaaccagccttggcaccacctccaaccactgctgcattccagaatggaaggtctgactacaacttgaactctacattgaacagcgaggtctctccttcgaatgggagcccagaattaaaaaatctaaccccagttgaacctgcttctggggtcccacctattcctaccatctccaatcaattctcagctcgtggacgaatgggtgttcgagcaagatatgtggacacattcaaccaaggtggtggtggccaagcaaatttattccaatcacctgct

SEQ ID NO: 20820 - DNA, 56 bp, Gossypium hirsutum
  Clone ID: uC-gsflnu33B056h12b1
ttttccacgcgttcgtccacgcgtccgaaggaaaatttttaaaaaaaatacaaaat

SEQ ID NO: 20821 - DNA, 443 bp, Gossypium hirsutum
  Clone ID: uC-gsflnu33B057f08b1
tatcctctagtagatgccctcctaatgccattaaaatctttatcccctatcaacgccatgaatcttgatcctaatggctgttgcctttgtttgtccttaacctccgccaaaaagtcccttctcccctgccttgaatgtctcttttccaccagcatccatagcccaaattcaggttctttctccttgcttcttgaaccgatggagtcaccgtctgatttgccttcatttgacacatcaacctcggtcgacagcttaccactagccaccgtcgaatttggatctgtttcaaccattgaacacatacgtttgatgtggccatacttgccacaagtgaagcaaacggtcggaagggctttcgattcgacgcattggatggctctaccaactaatacctatgaaattaaggcttttccaggtttatataaacagcccagcgagcgaat

SEQ ID NO: 20822 - DNA, 478 bp, Gossypium hirsutum
  Clone ID: uC-gsflnu33B057h11b1
ttgccattcatagaagcggcgtaagctggggagtttaaccttcaccggcgaagacgagcaccgcataaaccccgcccgaatcgacgcaatccggtctgcactcaaccaaatccgctccgactctacctctctctatggctccgttctcatcaccaccgctcacggcaagttcttctccaacggctatgatctcgcctgggctggctcttcaccagacaagatacgtttaatgtcttccaagctccgggaacttgtcgccgaccttatctcctttcctttgcctaccgttgccgacatcaccggacacgcctgcgccgccggattgatctttgctttttgtcatgattatattgttatgaggaaagatcgagggttcttgtacatgagtgaaacggatatcggtctgaaaattccggcttggttcattgccgatataagctgcaagattggtgacgcccaagtacggcgagatgtggtg

SEQ ID NO: 20823 - DNA, 271 bp, Gossypium hirsutum
  Clone ID: uC-gsflnu33B058c02b1
ccttgaagacacctggagttatctttcgatatccaattcgaaaatccaggtgttcggaggaggtttgataagctatataataagatgtaactttgcttccaatgtatgaaagttagattgtgtagggaagtgtatgaagttcatacatcataccccctcccccctcctctacttaggttgtgtaagacattaaaacaagttgtaaaatagcaaatatagcatatttcagaaaaaaaaaaaaataaactaaaatttgaaataaataagtaat

SEQ ID NO: 20824 - DNA, 199 bp, Gossypium hirsutum
  Clone ID: uC-gsflnu33B058c11b1
tcgctacgcgtccgaccgaatcggagccgtagtgggattgatggaactatggaatgacaatgagaggtttgagaataacagttgatgccatatgtgtgtattttaggttactgtaaatagggataaaaccagaaatttattttaggagtatcaagattaaattatatatttttaaggggattaaaaaaaaaaaaaaata

SEQ ID NO: 20825 - DNA, 460 bp, Gossypium hirsutum
  Clone ID: uC-gsflnu33B058f11b1
ttcgcctcacgcgtccgatttcgaatagcctcgaatattcccgaaattacctaatttccatttaagaaccttctcccttgactctcatcaatctattcttttgattcccaggaggtatataaggaatggcgagtggttttggtgaatcaacaagcatgcctcccccaagtccatcttgctcgagcagtaataatgctaacgatgctggtgattttgaatgcaatatttgctttgaattggctcaagatccaatcgtcacactttgtggtcatctcttctgctggccatgtctctacagatggttgcaccatcactcgcattctcaagaatgtccggtttgcaaggccctaatacaagaggaaaaacttgttcccctttatggcaggggcaaaaacaagactgacccgcgctctaaatcgtatacgggcatggaaatcccaaaaccgccagctgggcaaag

SEQ ID NO: 20826 - DNA, 537 bp, Gossypium hirsutum
  unsure (1)..(537): unsure at all n locations
  Clone ID: uC-gsflnu33B058h05b1
cttacgcgtccggcatccttttggttaatattgcagccaccgtatttgcctgtcagtactacaatgatcaacttcagcttccatggtggggggttctattagcatgtggcattgccattgtattcacacttccaataggcatcattacagccattacaaaccagacaccaggtttgaacatcatcaccgaatatataatcgggtatatatatccaggatatcctgtagctaatatgtgcttcaaggtgtacggatatataagcatgacacaggccattaccttcctgcaagacttcaagcttggtcactatatgaaaattccacctagaacaatgttcatggcacagatcgtgggaaccctcattgcttgttttgtgtacctgggaactgcctggtggctgatggagaacatccctgatatttgcgacacaacggcctccaacagcgtgtggacatgtncaagtgataccgtgttttatgatgcttctgtaatctggggttaatagcaccccgcagaattttccgggacttgggact

SEQ ID NO: 20827 - DNA, 473 bp, Gossypium hirsutum
  unsure (1)..(473): unsure at all n locations
  Clone ID: uC-gsflnu33B059a05b1
ctctatatctcatattccttcatttctttctaaatacttccatttttttgattttttttaagtgaaggaacagtgaaaagcaacaggaaatggcaaatatagatatcgatgggatcttgaaggagcttcccaatgatgggcgtatccctaaaaccaagatcgtttgtactttgggtccggcttcacggtccgtacctatgatagagaagctgttgagggctgggatgaacgttgctcgcttcaatttctctcatggcagtcatgagtatcatcaagagaccttggataatcttaggtctgctatgcacaacaccggcatcctttgcgcggtcatgcttgacaccaagggccctgagattcgaactggattcctgaaggatggaaaagctgttcaactgaaggaaggccaggaaattatccgtacaaccgattacgatattaagggatatgagaagatgatctncatgagctac

SEQ ID NO: 20828 - DNA, 438 bp, Gossypium hirsutum
  Clone ID: uC-gsflnu33B059a11b1
ttttctcgtccgcgcagggactgatcgctctgatgctaattctattgtatcttttgatgattataacaagcctctcatggacttcatgtctgccttgcctcattctgaacaggtaataatggtaggtcatagtgctggagggttaagtgtgacgcatgccactcacaaattcgccaacaaaatccgtctggcggtgtatgtagcagccaccatgctaaaatcaggcttcttgactgatcaagatctcaaagatggagtacctgatttatcccaatttgatgatgtgtacgaattgggatttggattgagagctgagcagcctccaaccactgccattgttaaaaaggaattccaacgtaaaatcatctatcaaatgagccctcaagaggattcgactctagcagcaatgcttttaaggccaggaccgatcctagcatt

SEQ ID NO: 20829 - DNA, 513 bp, Gossypium hirsutum
  unsure (1)..(513): unsure at all n locations
  Clone ID: uC-gsflnu33B059b01b1
ctatctatatccttatcagctttcaaagatggcaggaatcgcctttggtcgcttcgatgattccttcagtttggggtctgtcaaggcctaccttgctgagtttatctcaactttggtgtttgttttcgccggcgttggctctgccattgcttacaacaagttgacaactgatgcagccctagatcccgatgggctagtcgccattgctgtttgccacggatttgctctctttgttgcagtggctatcggtgccaacatctcaggtggccatgtcaaccctgcagtaacttttgggttagctcttggtggccaaatcaccatactcactggcatcttttactggattgcccaacttcttggatccattgttgcttgcttcttgctcaaggctgtcactggtggtttgacagttcctatccacggtcttggagctggagttggagctattcaaggagtggtgatggagatcatcatcacatttgcattggnttacacagtgtatgcaaccgcagc

SEQ ID NO: 20830 - DNA, 265 bp, Gossypium hirsutum
  Clone ID: uC-gsflnu33B059b05b1
tattttttggggatgcatagtttaccctatctaattgtgttgtttttgaatttaggagcattgctcacttcactaggctgccctgaatgttaccgccacccatctccgccgccgaaatgtcctccgccagactatccgcctaaacatcatcatcctcccattgtaaagccaccctatcaccctaaaccaccaaaacatcattctccaaagccacctaagcctccggtggtaaacccaccatatcaccctaaaccaccgaagccac

SEQ ID NO: 20831 - DNA, 396 bp, Gossypium hirsutum
  Clone ID: uC-gsflnu33B059c04b1
cccttttgtccggtttgtctattgaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaagggctataattatgtctct

SEQ ID NO: 20832 - DNA, 498 bp, Gossypium hirsutum
  Clone ID: uC-gsflnu33B059c08b1
atgagaagcattgtggtaaggataagtggctttgttcttgcggcaccacgttttcaaggaaagataagctgtttgggcatatcactcttttccaaggtcacactccagccattccttcagatgaaattaaagtagcacccgccggaacatctgatggagccactaataaggttggaagcgtgaatttcaacctttcctcttatgtttctagtgaaagtgaggttcaaagtagtagtatggacattaaaggggggattgatgatgctgttggttacttctcaccgttgagctttgatacatgtaattttggtgggtttcatgagttccctcgaccaccatttgatgactcagagagttcatttgcatttctactttctaggtcctgtaattacagtcagaaaagtggagaggagtaaagcccttgattgtggctaatttcttacttcaccaggagggattcagggatgtgttaaatttgtgttggaaggcagccctatg

SEQ ID NO: 20833 - DNA, 489 bp, Gossypium hirsutum
  Clone ID: uC-gsflnu33B059c09b1
ggtttcgaccaagtggaaggatttctgtctactttgtgcaggaaaaatgccatcgaatgacgatgctttgattaggatagaacgaatctcttggatactaagtccttccttagctgtaacagaccacggcactacaataattccagaagatgaccccaaattgcatgttcttagtatcgatgatcgtgacaactgggatgttcagattttccgctccattgactcgggatcagtgaaaggatttccaagaccaatgagaaaacccgagaaccagaatcttttagtttcaaaaaatgtggtcatagaaaaaagcattcaaacagcttatatacaggcaataagatccgctcagcattacatatatatcgaaaatcagtattttctgggatcttcgtatgcttggccatcgtataaagatgcaggggccgatcatctgatcccaatggagctggcattaaaggttgctagtaaaatccgagcaagagagag

SEQ ID NO: 20834 - DNA, 63 bp, Gossypium hirsutum
  Clone ID: uC-gsflnu33B059c12b1
tgactgttccttcttaaagattgctagcaaccaaaaaacattcccataaacaattccctccag

SEQ ID NO: 20835 - DNA, 309 bp, Gossypium hirsutum
  Clone ID: uC-gsflnu33B059d06b1
atcaccgcagccctgagtagatcctctgttcattcacgcatggctttatgcatgatcgcttgtcccaaagtccgaaccgagtatgtgacgtgcgagaccatggctcctgcctgattgaggcacatggttactgatcatgctcaccgatggatcattgaagaccactgtgacggtgagacgatgtacgcgaatcactcttatcagaccaaagcagagtgcactgagcgttaccctatgggggtaccacatgtgaggtgcatatatccggatgctgtacaatcgcgcattgatcgccttgcacatataagg

SEQ ID NO: 20836 - DNA, 537 bp, Gossypium hirsutum
  unsure (1)..(537): unsure at all n locations
  Clone ID: uC-gsflnu33B059d10b1
tttatcgcgtccgaagatgaacaagcaagaattgaagccgcaggtggcaaaatcatacaatggaatggccctcgagtttcgggtgttctcgcaatgtcaaggtcaatcggtgacaagtacttgaaaccatggattattccagacccggaagtgacattcgttagtcgagcaaacgacgacgaatgtcttgttttagcaagtgatggattgtgggacgtgcttagcaatgacgaagcctgtgaagttgcgcggaagcggatcggtttgtggcgtaaaaagtacagagataaatctaatggtgaagggattgatggtgcagctcaatctgcagcagagtacctatcaaggcttgctcttagtaaaggaagcaaagataatattagtgtcattgtggtggacctgaaagcccatacaaaatttaagaacaaaacctgacactgggatctcttgctggtgaatatttcacacggatcggntctatactgntttgggtttggngtggnggtaatttgatttaaaagctcctgttttttaagt

SEQ ID NO: 20837 - DNA, 505 bp, Gossypium hirsutum
  unsure (1)..(505): unsure at all n locations
  Clone ID: uC-gsflnu33B059d12b1
tctacgcgtccgaccaatcaggtaaatttcttctttttcctttaatgcctccgttgcaagcatatgagctagactatttgcttctctaggcgtgtgctcaaaatagtgtctttttgattgtattagtaactgatgaatatctcgaatatatgctccaacccttgatctgtcatttgcttgtgttttgcatttcttaatgattgaaagtgcatcaccttcaataataatatttggccattgcatgttcataccgatgcgagttgctgtcctgcaagcaattgcttctgcagcaaaggctgatgctacttggtgatgaagctctataatagataaaagggcgcttccttgactgtctctggccacaattcccactgccgattgtcgcgcgttttcatcaaaggctgcgtcaaagttaatctttataaagtgaccagattgcccaaagagcacaacaaaataccctacgcatnatgggattattctgatcgaaacccaggacactcac

SEQ ID NO: 20838 - DNA, 416 bp, Gossypium hirsutum
  Clone ID: uC-gsflnu33B059e01b1
ctttttgatatgactgcaggaatcactgaaagccagacatggctcccaacactgttgcatacactgctgtatttgttaccttgaacttgacgttgtacactttggttagcactacctacaggcctagctaaccaccacgaaagagacacacgcctacccacaaaagtacaccctagagacctgaacaggcaggcactcggccaagagatgcactgaaactaggactgagagctgatttgtgggcctcagtgcgcgtcgcagtgggaccggctaggaccacatgctggactataagctggggtttgactgatctcgaggctgatgtctgcctttgcactggtattaaagctaatgtgaaggctgatgacctaaacgttaatgtaaaattggctgtgctactgaattcctgcgaaaag

SEQ ID NO: 20839 - DNA, 177 bp, Gossypium hirsutum
  Clone ID: uC-gsflnu33B059e02b1
tatgatccgagattcattttatctcatcaatacctgcaataagttattcagtttgtacttatttcggacttctttctcatttgcactgtgaacactttgtctagatgtgttgattttggattgtcagataactagcataaaagttatttaatatataagagagaaaaattttatctt

SEQ ID NO: 20840 - DNA, 486 bp, Gossypium hirsutum
  Clone ID: uC-gsflnu33B059e03b1
cccactcgtccgcggacgcgtgggctttgatttcgagagtagatcttcgctcgcttctctctttcgtcgaactccgcgtaataatcgctcatatttctcgcagacgtgaagaatggggctgtctttcacaaagctgttcagccggctttttgccaagaaggagatgcgtatattgatggttggacttgatgctgctggtaaaaccaccattctttacaagctcaagttgggagagattgtcaccacaattccaaccattggtttcaatgcggaaactgtggaatacaagaacatcagctttactgtctgggatgttggtggccaggacaagattcgtccattgtggaggcattacttccaaaacacacaaggactcatttttgtggttgatagcaatgatcgtgatcgtgtggtcgaagccagggatgagttgcacaggatgttgaacgaggatgagttgagggatgctgtgctactggtatttgc

SEQ ID NO: 20841 - DNA, 571 bp, Gossypium hirsutum
  unsure (1)..(571): unsure at all n locations
  Clone ID: uC-gsflnu33B059e05b1
gttttattacagcaacaataaaaaaacatctttcttttgggtctattttttggcaatggaattagggagtgctcttcatttccttgataacaagtccattttagtcactggtgctgctgggtttttggcaaaaatttttgtggagaaaatactaagggttcaaccaaatgtgaagaagttttatcttcttttacgtgctgcggatcataaatccgctatacaccgttgcacaatgagattataggaaaagatttattcaaagttctgaaagaaaaatgcgggaaaaatttcagtttatttatatccgaaaaaattacactaattcctggagatatatctcatgaagatttgggcattaaagattgtactttagtgcaagagatgttgaatgaagttgatgttgtggttaaccttgctgcaacaaccaactttgacgaaagatatgatgtggcacttggtctcaatacatttggagctaaatttgttgcaaatttcgccaagaaatgtgtgaaactaaaagttttgttcatgtatccacagcctatgtgtcangagaaaaagacaggcttat

SEQ ID NO: 20842 - DNA, 535 bp, Gossypium hirsutum
  unsure (1)..(535): unsure at all n locations
  Clone ID: uC-gsflnu33B059e09b1
cctatcgcgtccgaaattattagagcagcatacaatttatctttcttggatacaaacagattgttcataaaagctcaaacactgaggtagattagtggcatcatcgggttttaatattccaattcatcttgaattgaatgcctttcccacctttgccttaatctaattcaaaaacagacagacgattgctttgtttttctacttcaaatggttgggtttttctttcgtcgtattttgcagcatcgctctcaaatcctattggtcagtttctcctcttttcacttttactgttactggcttcttcttctaccataacaatgatgagcaaatttataataaataaaaaattgctggtggaattgaacttatggatactttattgtggaaacagggacaacgactaagagctatgagatttagattgggaagggagagaaggcgtaatatgcgtgcgacggaattatggnaagattnggaagtgaagctgcagagatggaggaccaaattaggaggattaggggagagatgagagaca

SEQ ID NO: 20843 - DNA, 496 bp, Gossypium hirsutum
  Clone ID: uC-gsflnu33B059e10b1
cttagactcatcttggggcgaggaatgctgcccaaaggaagcttttggatgagctacggattcctcctgaagatgttcctgttgatcagttcgtcccactgagccgcatgctgtacaaggcaccttctgacggcaagtggggcgagcatgaacttgattacctcctattcattgtccgagatgttaacgttcatccaaaccctgatgaggtagcagaggctaaatacgtgaaccgtgaccaactgaaggagttactgcgtatagctgatgctggtgaagatggtttgaaactgtcaccatggttcagactcgccgcggatcatttcttgttcaagtggtgggatcatgttgagaaagggaccctgaatgaagtaagtgacatggaaaccattcataagctgtgatgtaagagcgtagaagcaaataggacatgatacacagtttgtcgatgcgtactttcagaaaaaaaaaaagaaaggccggcgatctagaggat

SEQ ID NO: 20844 - DNA, 550 bp, Gossypium hirsutum
  Clone ID: uC-gsflnu33B059f11b1
atcactgcgtccggaatttttttcccaagttgagggggtcttatttgactcgtctttttgctacgctctccaaactcccaaacaacttcaccaaaattccttccaagtatcgaccccaagccattcgagatgcccaacaagctctcacggattacctccactgttcccgttacatccctttcgtctacgccgagcacattgctaaaaactccttctttttcctctcttctcatcatctccggcattaatttctccaccacgagcttcaatcgaaacgtcctcagattcctcaggtaccatcccatttaacgagtatgagattttcttcgaaagtataagcattgattatgaggaagttggtggcctattgccgtccaagaagttcttcttttctgaaaatgagacggttctggaggctgcttgtgcgctttctggatttgggtttcccttgaacaaaatgggtaagctctaataagaggaaatcttgatttttaaggcagttctagagaataaaagctaggttttaagattaaggaaggggtttagaaaa

SEQ ID NO: 20845 - DNA, 337 bp, Gossypium hirsutum
  Clone ID: uC-gsflnu33B059g05b1
cttttactgatattgtcatagtatgccaatgctgctttcttcttctgctttttctgttttcgaatcttcacttcttgtgttttcatatgggattccaactcataatcaacaatgtggactgaacttgtaaacatatttctggaattttttttcttcctttttttaataccattaagctacttgtaaagtttcatttgtattattatgatgaatattgatttgggtacaatattgataaacttcaaatattaatagtattatctcataaattttttttcttttcaaaaaaaaaaaaagaataaaaacaaagaaaaatacataaaaaaaaaaacaaaaa

SEQ ID NO: 20846 - DNA, 547 bp, Gossypium hirsutum
  unsure (1)..(547): unsure at all n locations
  Clone ID: uC-gsflnu33B059g11b1
cgtgtccgnngaattccctgtggtcgacaccacgccgtcctgttctcgcgtccggcaaagcaaaaaaaaaaaaagagagggaaaaaaatggctatgcaattcaatcccatcgcttctcaaactaagaaactcccttcatatgctcttccacccatggcaagtcttagatctcccaaggtttctatggtctccactcttccacctcgctccaaaggggttgaagatctgaaacggcctttcatggctccaaagctggtacaccaggcttcccacaccatgccacctgagaagattgaaatctttaaatctttggatgattgggctagggataacattctgattcatcttaaacaagttgataaatgttggcaacccaaggattttcttcccgatccttcgtccgatggatttgaagatcaagttagagaacttagagaacgggcaaaggagattccggatgagtactttgccgtgttggttggtgatatgatcacggaggaagcccttccaacttaccaaactatgcttaataccttggatggaactc

SEQ ID NO: 20847 - DNA, 560 bp, Gossypium hirsutum
  unsure (1)..(560): unsure at all n locations
  Clone ID: uC-gsflnu33B059g12b1
tatttcccaaatttcagtttctttcttctgattttccatgttagggaagcgaggtcgacccatgatcggaaacttatctgaattactagttccaacacataaatccgggttatcggatccttcaaggagccccaaaagtccactagacttattcaagaccccatcatcatcatcaagaagagggtcgatgaagagatgctatgatgtttttggtgatggagtagggcttggaatcattgcttcaatggagaaatccactgttgatcatcatccttcttgtaagctacaacacaccatttgtagattcaaaggaagatttcaagaaaattcagaagaggattacacttttgttacaagacatggagaatcatctacaaaagtttattttaatggaggtgacgaagaagaagaacagagacttgttggaaaaattaaggaaattacatctttaaaacccagatttgtgcaagatttcaactacccaacatcagatttcctcagttcttgtcatctttgtaagaaaaaattgcatggcanagacatttacatgtatagggggg

SEQ ID NO: 20848 - DNA, 402 bp, Gossypium hirsutum
  unsure (1)..(402): unsure at all n locations
  Clone ID: uC-gsflnu33B059h07b1
cactagtgtatgagcctaagccaccaaagccaccggtttacacaccaccaaagaaagagaagccagaacctaaaccaccggtacatgagtctcccaagaaaccaccatatggtcactatccaggacaccctccactggggaagcctcaatagagagatcccatcggctagccatcccaagaactgagctactatggctatatggataaattagtatctatacaataaaagttgcttcctactcatgttctatgttcttgtatgttcttgtatgttatgtaggaatgttttcttttactagcgagaatgcttatggcagtactcattggaatgtctattctatgtcttcttatttctcaatgagcaatatcctgatttcaaannanaannnnnaataataaaa

SEQ ID NO: 20849 - DNA, 357 bp, Gossypium hirsutum
  Clone ID: uC-gsflnu33B059h09b1
atttatgcctgaacagaaaatagagacaaggtaatgaggatgcactccatgatgttgccatggattattatggaaaacgatagaagacggggtgcgtcttttctaggcatcaagatcattgacacatctgtacctagtttacactatcttattgtgctacctagaccactaatggactcggcctggggtttgtacgcttgggcacatgcgaagacgcagcagtccccgcctcaagtgcttatgatgccatcccgattttcccggaggaagataatcaaaaaaagcgggtgccggtccatgtttctaatgatcatacatcatgtatgaactatgttgcacgccctctccatgagcatt

SEQ ID NO: 20850 - DNA, 367 bp, Gossypium hirsutum
  Clone ID: uC-gsflnu33B059h11b1
tcttcgcgttctggggaccgccatgactcttactactctatgtaaacagcagtggaagccggtgatgacggaatcacttccactgaaggtgaaaacaacgtcacatctacaccgcacgtagaccaccacgaatgtagcgaacgtgacagccgggaccattcagctatgagagggctagactgtgaacagcgagtgaatgcgacgcggacctttcatgaagaggctgaagagaaacttcctgggagcgaagaatcttcgagaggaaatgcctaagatcgctctggctatctgcgcccgatgttgtatagtccatgatgatacagtgactgatcagattgaaccgaacggtcagcccaatccattaact

SEQ ID NO: 20851 - DNA, 363 bp, Gossypium hirsutum
  Clone ID: uC-gsflnu33B060a01b1
ccctttcttttcaaattaattgtcttaaattacgacgattttactttccagctacataccaaatatcaagtacgcatttgctagagcgcgacgagtcactttggagagagatgagaagggggaaaactgccccagatggcaatgaagcgagaaagaggagcccgaaaggagactccagatgcctcattgcctataccaagcagaggaagacacgaacagaagacttcaaatgccgggatcttgaaggagaaaatcagaaacaaatacgagaatcgggaaatgaaaataagggcaagccgggaaaagggttcttcgcttgctatcttgtaacctctttcagcccttgtcatgaagggcacacct

SEQ ID NO: 20852 - DNA, 444 bp, Gossypium hirsutum
  unsure (1)..(444): unsure at all n locations
  Clone ID: uC-gsflnu33B060a02b1
gcgttgtaacaagataaaaagtattttgctttgcctaatttgtaagctttgaggataagtgaaaaaactatggctgaagagggacaagtaattgcctgccacactgttgagtcatggcagcagcagctccagatgggaaacgagtccaacaaactggtggtggtggatttcacagcatcatggtgcgggccatgccgttttatatcaccaatcctggtggatcttgctaagaagctgcccaacgtcatattcttgaaggtggacgtggatgaactgaaatctgtcgctcagtcgtgggctattgaggcgatgccaacttttgtgtttctgaaaggaggcaccataattgacaagcttgtgggtgcaaggaaagatgaattgcagcagataattgccttccatacatctacctcggngcagacagcattgaataacatttaaaat

SEQ ID NO: 20853 - DNA, 586 bp, Gossypium hirsutum
  unsure (1)..(586): unsure at all n locations
  Clone ID: uC-gsflnu33B060a11b1
ggaccggccgaatttttttttttcccacccgcccgttcttttcgtcacctaacagaaacacacattttttttttttttaacacattattgtttttcccgannnacatccccgaatttcttttgcttgtggcattcctttttttttttgcacttccttttcttttttttttttttgctgattatctttggctttttctctttgtctttcctttgttccccttgtatttctctttttttggcactttacctttgtttttttcttttagttctttttttcctctttttgttatatcttttttttgttcctctattgatttttgtttgggtttttttttatactccttttttttttttttttaatattttttatagttttttgtcatgcctttttgttgtttttttttgtccagtttgttcttttcttattttattttttttttatatttttctattctcttcttctttatttgttttttttttttgttattctcctctttttcttttttttttttggttttatcttttcttttcctgtattttttctttttcttttctgtgcctttcctttggtttttttctttttttt

SEQ ID NO: 20854 - DNA, 225 bp, Gossypium hirsutum
  Clone ID: uC-gsflnu33B060d02b1
gtggagacgccgcggtcttataattctacggatttgagcggtgataacaacaggaaaagcaacggcgaagtatcagctgctcagaaattgcttttcacttcgacgagaagcttgtccgtttcgtttcagggagagtcgtttacttattagattagcaaagttaaaccatgtccatttccatctacaaccgctactagatatggaacgccagagaggccgatgcct

SEQ ID NO: 20855 - DNA, 359 bp, Gossypium hirsutum
  Clone ID: uC-gsflnu33B060e08b1
tgtaacttttaagaaggctaaatccgtcttgattggtaaggtggattgtgatgaacataagagtttatgcagcaaatatggtgttcaaggctacccaactgttcagtggtttcctaaaggctctttggaacctaaaaagtatgaaggaccacgcacagctgaggcacttgctgaatttgctaacactgaaggagggactattgagacgatagccactctgacatacaatgttgcagtgctaaatgcggataattttgatgagattgtccttgatgaaaccaaagatgtgttggttgagttttatgcaccttggtgtggccattgcaaaaaccttgctcctacctatgaaaaggtagcaa

SEQ ID NO: 20856 - DNA, 213 bp, Gossypium hirsutum
  Clone ID: uC-gsflnu33B061a10b1
tctacgcgtccggcgatccgcaagctttgggagataatcaggaaggataaggattccaagttcaggttgattcttgtcgtgagtaggattcacaggcttgctcgatactacaagaaaacaaagtagcttccacctgtctggaaatatgagttgacgactgccagcaccctcgttgctgagattttgcatgtggatagtgcagctaggggtaac

SEQ ID NO: 20857 - DNA, 505 bp, Gossypium hirsutum
  unsure (1)..(505): unsure at all n locations
  Clone ID: uC-gsflnu33B061c04b1
tatacagagctaagtgagttggtgtgaggatgagtcgtggtgcagcagctggagctaagggaaagaagaagggagcctccttcaccatcgactgtgcgaagccggttgaggataagatcatggacatcgcttctttggagaagttccttcaggaaaggatcaaagtttggtggcaaagcttggtgctctaggtgactccgttacttgtaacccgnaacaagacccctattacggttccctttgcctcaacctttttaaggggccctaaaacctccttaaaaagcccttaaagaacacaaccccggccgtggttgggggattggcttcgggtgactgcttccaacaaggaccgtattgtttatgaactccgctacttcaatattgctgagaatgaaggggaagaggaagaatgagcaatcagttcagttacttttctctgttacctaatctggttattagttctgaggaacttgtttgtgtcaaatcgtcgacttgttgggttgct

SEQ ID NO: 20858 - DNA, 415 bp, Gossypium hirsutum
  Clone ID: uC-gsflnu33B061g01b1
tttcttccacgcgtccggagaaatggagggaagcaaaatgagcatgattttgattgcctacatcacacttgttgcgagcggagcgatgggtttgagggaggaccaaggagcggttgcaccctcaccaatggaaagtggcggagtggctctgggtgttccggccgcacttgctgctgccttagcttctatgcttgcatttggctgcttcttttgattttaattcctttggtgaatactgttttccagtttccatttcctttcatttgccaactagtttctttctctgtaaatttcattgttatttttaagaaattgaataaaatcttgatttatttaaaagagctaacccaacaattaacagacaaaggaaatgatttactggtcctaacaccaaatataacaaaaaggtgacctg

SEQ ID NO: 20859 - DNA, 482 bp, Gossypium hirsutum
  Clone ID: uC-gsflnu33B061g10b1
tctttgtctaacctttttttctcggtgctgagaaattcagagaaaaaaatgattctcccagtttgttacttttctctttaatctacgtgactctctctcttcctgttcctttttctttgccgatctcctgtattctgaatctcaaattagctgagtactgataggaaattatcaaatccgaggcaccatggaagcagacgacaagtttttgaacatgggtattctcatagtagccactctagtagtggccaaactcatatcgttcctcataatgcccagatctaagaggcgggtgccgccagtaatcaaaagctggccggtaattggtgggctccttcgattcatgaaagggcccatcgtgatgatccgggaggagtacccaaagctcggcagtgttttcacgttgaacctgtttaacaagaaaataactttcttgatcggacctgaggtttcagcacacttctttaaggcttcagaatcag

SEQ ID NO: 20860 - DNA, 88 bp, Gossypium hirsutum
  Clone ID: uC-gsflnu33B063a07b1
gtctgcagggaaacaaaaggacctggctgtccttaataacccttaaaaggaatggccccccaaccagaattaaaccggccggtcaaaa

SEQ ID NO: 20861 - DNA, 357 bp, Gossypium hirsutum
  Clone ID: uC-gsflnu33B063b04b1
ttctctcgtccgaacccaagctaacatcacatgcaataatacatcagtgccatttgccaccctagttgccattaatgatcccctcatgactggtcctgagcctgactcagagctgattggaaatgttcagggtatttccctcctagccggatcaaatgcatcgagcacgcagtacatagattttggattcaataccggtaagttcaacggaagctctctaagcgtgttttcaaggggagaagctgggcttgcggtggtcggaggaagaggccaattcacgatggcaacagggactgcactatttaaccctatccttatctatgccaccaatgtcattagtgaatgcaacagctctgt

SEQ ID NO: 20862 - DNA, 535 bp, Gossypium hirsutum
  Clone ID: uC-gsflnu33B063e09b1
tgtgctacacaattggccacaccaggggatcttaattatccatcattttgagcagtttttaattctaatgatcatgtagttaagtacaggaggaaggtaaagaatgttgggacttcagctggtgcagtttatgaagctaaagtgaatgctccacctggtgtcaaaatcagtgattcgtcgagtaagctcctattcagtgctgtaaaccaaacgttgagctacgaggtttcattcgcaagtgacagacttggaggtgtcttcagttcgagtcacaagggctcggttcgactcgagtggagcgatggagtccatcttgcgaggagccccattgttgttcggcggactcagggagtgcaggatgagctcttttgattatcagactcaggtgaagcaagcaaattgttgcaatgcgtttctcaaccaacagagtaatcatgtgattgcttgaacataagcatgtttgtgataacattgcattgcacttgatgctcatatgccatcatcaatgaagaatgttcctgctgctctatgctgg

SEQ ID NO: 20863 - DNA, 472 bp, Gossypium hirsutum
  Clone ID: uC-gsflnu33B063g03b1
tccacgcgtccggaaaaacttttgcctctgaaactatggctccgttctctttacgtagccgtcttcaggcttctgcgctaagcaagaggcgtctcaaatccaaagccaagcatgggaggaaagggatgaagaacatggcggaaagcttcaaaagattgaaatctgaaatggaagaaataagcgaggaacaaaagaatatcagggaagggcaaaggcaagttaaagaaaaattcggaatcatcgaatccgagtgcgaggaattgaagagggaaactaggctcataatccagcaaagtgcgagaactcaggttaaacttgctcttatgttccgcatactgaaagcaagggaagccggcgagttgaataccgctgccactctcactgaaatgctccgtgaaatagtaggaagagagagggaggaaagcaaagctgacatctgaatgactatgataagcttctcggtgcagctgct

SEQ ID NO: 20864 - DNA, 83 bp, Gossypium hirsutum
  Clone ID: uC-gsflnu33B064a08b1
tcacgcgtccgaacaggcgggcaaagcgaggggaaaattgagtgggagggacggcataacccgctaacagcagaaacagcgct

SEQ ID NO: 20865 - DNA, 426 bp, Gossypium hirsutum
  unsure (1)..(426): unsure at all n locations
  Clone ID: uC-gsflnu33B064b05b1
tccacgcgtgcgcccacgcgtccgcccacgcgtccgcccacgcgtncgggcttttacagaaggatcattggacttgattttctcaaactggctgttgatgtatctctcagataaagaggttgagaatttggccgaaaggatgctcaagtggttgaaggatggtgggcatattttcttcagggagtcttgctttcatcaatctggtgattgcaagagaaagaacaacccaactcactatcgcgagcccagattttacactaaggtctttaaagaatgccaagcaactgatgattctggaaattcatttgaactttctcttgttggctgcaagtgcattggagcttatgttaagaacaaaaagaatcagaatcagatttgctggatcttcaaaaagttgtttcagataatgataagggattccagcgc

SEQ ID NO: 20866 - DNA, 198 bp, Gossypium hirsutum
  Clone ID: uC-gsflnu33B064c02b1
tttaacgcagcacggcacgaggaagactcataaccaagcattactcgaggttttcgaagggtgtaatagacttcatgtaatctacttcgatcttgcgaatcgagacaaaaatggtgacttcagccatgtcccaaaaacgggtggtcctgttttgaggcaactatgccgaggcttttagggtatggcccctttccaggc

SEQ ID NO: 20867 - DNA, 115 bp, Gossypium hirsutum
  Clone ID: uC-gsflnu33B064e05b1
taaacccaagattataaatttagtatcgatttgagtatttgaatagtttagattacaggaatggcaggggaactagtattgtgggatttctggccaaagtcatttgggatgagat

SEQ ID NO: 20868 - DNA, 356 bp, Gossypium hirsutum
  Clone ID: uC-gsflnu33B064g08b1
ttgattagatctggcggatgaactgagagtgtgcaaaattactgagcttgtgaagagcatagcagatcagttattaaggaacccatcagcgagataggaacagtcaaagccagaacattttagactatggagaatgaagcacaaacatgaggagcatatggactgggacagaaatcagatactggtggtaactacagtaggtgatcaatgaggatcttagatatgaggaacgttgaaaattctttcaccgaagggtcgttaaagatggcaaatgtccaggttgctgaatttcatcaggatggagggtgctacctgatctcacttgcagtcatttagacccatctcttcatgcaaat

SEQ ID NO: 20869 - DNA, 495 bp, Gossypium hirsutum
  Clone ID: uC-gsflnu33B064h11b1
tagtcaggcaatgctggtttggttgctgcacttgtggcattgtctggtgacaagtcaactggaattgacaagaataccatattttctgcagttccaccaatgttttccacaccggcaccacctgcagcaccttggaagccataaatatgcttttagatcctttaaatgtttcctttttgtgtgacttagtcttatgattttgtaagtgttttttggcaccttgatgaccttgaaagagaaagtagtgcaaagggcaaggaaggagatgtgcaatggaacatagctgcagtaaactgatggtggtttggctattagattggagaataggactagcattcaggatctgataatttgaatatgaagtccatttggatttcacggtatacatagtgtatatgtatgggattaatactgtattctttgaaacacgaggttaaacacttaaattgatttaacaataaattttgcgctaatatctaatgggttgccgttttc

SEQ ID NO: 20870 - DNA, 280 bp, Gossypium hirsutum
  Clone ID: uC-gsflnu33B066c05b1
atcttgagcttgccaggctgaagaagctggccatagagcagcaacagttgaaggagaaagaggctgagaatgagaagcccaagcttgaagccaagccattggaggaaatccttgcctaaaacttttaccctactgctggttattgtgttagcactgtttcgtcttccactatgttgtgttaattttatttcatttctacttttttttttgtggtgatacccgtttctatttattttctagcgagtaatgtatgtcatgtttcccaaaaaaaaaacacttc

SEQ ID NO: 20871 - DNA, 332 bp, Gossypium hirsutum
  Clone ID: uC-gsflnu33B066e08b1
gcgtggggtcgccgagtccctcgagttaccttgttaatactacaagtcggggtgcccggaaatattcccctattacagcaaactcaaacacgaggggatttgcatctacagaccatacaattgtccatatgctggttcggagtgttctgttgttggggatatccctttccttgttgcccatttgagggatgatcataaggtcgacatgcacaccggctgcacatttaatcatcgatacgtgaaatccaacccttgggaagtcgaaaatgctacatggatgctaacagttttccattgttttggtcagcatttctgcctacacttcgaagcct

SEQ ID NO: 20872 - DNA, 460 bp, Gossypium hirsutum
  Clone ID: uC-gsflnu33B066f05b1
attaaaaaaaatcgaacggcgataatgtctggttatggttcgaccgacggcgatcggcaccgcgaacagatcgtcatcagcgatgtcatccatgacaaccaccgtgacgatcgagaacacctcgggcgcgtcctcctcgtcgtcgcagccgcaagaagccctcgtcctcgaactccgccctaggaagaagaaagttacgtggaaagaaggcaccgtggacaacgaattcatgaacaagaagagttccaagatctgttgtatttaccataaagaaaagcccttcgacgaagacgacagtgatgacgacggacatgaccatcatcatcaccatcatccattcaacggacatgattcctccaaggatggctgcaggcccagcagcagctccagctccagctccagcgcctgattctgtttccaatctgtttctctaaaactttggtttggatgcaccgaaccg

SEQ ID NO: 20873 - DNA, 88 bp, Gossypium hirsutum
  Clone ID: uC-gsflnu33B068c08b1
ttttgtgcaattcaatgaagcaacaacattgccaagtttgcaaagttcattcaaagatgaactaacttatgaaaattgtatagaactc

SEQ ID NO: 20874 - DNA, 120 bp, Gossypium hirsutum
  Clone ID: uC-gsflnu33B068g05b1
ctagatatgtattttactatagctttgcgcgatgcaaataactcattaatctgtgcattaattcccattctgatggcaagacattctacattatttactgacatgaactatatgtatgag

SEQ ID NO: 20875 - DNA, 134 bp, Gossypium hirsutum
  Clone ID: uC-gsflnu33B070a08b1
cctccaacggtttgctcgcacacatttcccgtctgtaaagtacatggaatatgccgtccaagttgaaacatatacgctttccaaggctaacaaccttgtcctcaacgttgatggtgccattgggtctcttttct

SEQ ID NO: 20876 - DNA, 420 bp, Gossypium hirsutum
  Clone ID: uC-gsflnu33B070c02b1
ctaaaagagagccgggaaaggaagctagaagagcaaagcgaaaatgaagactatactttcctccgagacaatggacatccccgacggggttagcattaaggtcaaggctaaggtgatcgaggttgaaggtccaaggggtaagcttacccgcaacttcaagcacgtcaaccttgatttccatctcatcaaggacgaagagaccggcaagcgtaagctcaggatcgaggcttggtttggctccaggaagaccagcgccgtcatccgtacagctcttagccacgttgagaaccttattaccggtgtcactaaaggataaccgctacaagaatgaggttctgtcttacgcttacttttccgattaatgccttcatcactaatggctacaagtctatcgagaaccttaacttccttggcgagaag

SEQ ID NO: 20877 - DNA, 406 bp, Gossypium hirsutum
  Clone ID: uC-gsflnu33B070e04b1
ttggcaaaacacccagaaatcgatgttccaaatcttcaagtaataaagctgatgcaaagcttcaaatccaaggaatacgttcgtgaaacttttgcttggatgcattattactggtaccttaccaacgatggcattgaatttttaaggacttaccttaatctcccctctgagattgttcctgctactttgaagaagcaaactaggcccggcggtggtcgtcccatgggtccttctgatagccgcccacgtggtccgccacgctttggcgacggtgagaggcgattcggtgacagggatggataccgtggaggtccacgaggagtcggtgatttcggtgataagggtggtgcgcctgctgattatcagcccttattcaggggccctggttcaaggcctggctttggtc

SEQ ID NO: 20878 - DNA, 233 bp, Gossypium hirsutum
  Clone ID: uC-gsflnu33B070f10b1
gctccactcatgctccgtttagcgtggcactcagctggaacttttgatgttaagaccaagaccggaggtccattcggaaccatgaagcatcctgctgagctcgcacatgctgctaacaacggcctagatatcgccgccagacttctcgagccgatcaaggagcagttccctaacctcatctacgctgacttttatcagcttgctggtgtcgttgccgccgtgattacttcttc

SEQ ID NO: 20879 - DNA, 362 bp, Gossypium hirsutum
  Clone ID: uC-gsflnu33B070g07b1
gcgtccgcaaaaaggaaaacattttcaaaggtaacaacaaattactgaggaggcaatagtatccaaaacaccccatcattttcaaaggacaaatggataaaaattaagaagaaagcaaagggagaaatcagatcatgacatgtctactgcaataaatatttatataaaagataaaaatatattagaaaacttgagaggaatcgaaaatcactaaaaaacagagcatatttacggaaaactaatataaattcttacctaaacaaatatggccattgctataaatatgtggatggagaggtgtctgtcgaagaaatatttccttttttccatatgttcctcctaatgaatctatctctttaatg

SEQ ID NO: 20880 - DNA, 185 bp, Gossypium hirsutum
  Clone ID: uC-gsflnu33B070h04b1
ggtcattgtatttgactacaaacccaccgttgtacgttgctaagttacaagcatagttctgtctcaatgtagcttttgtcctgttcatgtctgttgttattttgaataaagtttgacgtcttgtactatgaaatgcatccatccctagtgatcaaggcaaaagttgattggctttatcttcttta

SEQ ID NO: 20881 - DNA, 576 bp, Gossypium hirsutum
  Clone ID: uC-gsflnu33B071a01b1
ttccacgcgtccgaaaatatgtggatgtgattgtgactgggacaatgtcacagtacattcccacacttgattactacagcaatggcctccctctcgtctgcaccatgtatgcatccagtgaatgctattttggtgtcaaccttaaccctctttgcaagccaagtgaagtttcctacactctcgttcccacaatggcctactttgaattcttgcgggttcaaaggaacaatggcgtcactagttctatttctgtgcccaaaactctcaatgagaaagaacaacaagaattggttgaccttgttgatgttaaacttggccaagagtatgagcttgttgtcaccacttattcaggactttatcgtttagagttggtgatgtgctaagggtagcagggtttaaaaacaacgcaccgcaattcaatttcatatgcaggaaaaatgtagttttgtgcatcgattcagataagactgatgaggttgaacttcaaatgctgtgaagaaagcagtgaaccatatgctgccctttggtgcaacattggctgagtacactagttatgcagataccacaacaattcca

SEQ ID NO: 20882 - DNA, 563 bp, Gossypium hirsutum
  unsure (1)..(563): unsure at all n locations
  Clone ID: uC-gsflnu33B071a02b1
ttaatgaagttcctgcgatggcgaattcagctcttggagaagagtataaggaagcttgatttcagtcctggtggtgtttccaccattttccaggttagtgatctcaaaaactcgcctggacctggaaaaaaggagcttagattggcaacaaaacaggctcttcaggttcttcaagataattatccagagtttgttgcaaaacaggtgtttattaatgttccttggtggtatctggcattctatacaatgattagtccatttatgacccaaagaactaagagcaagtttgtcattgcactgccatctaaatctgctgaaacacttttcaaatacataccacctgagcaagtgccaattaatatggtggtttgagtgtggattattgtgattgcaatccagaattcagtgatgctgatcctgccactgagatgactgtgaaaccagggacaaagcanactgtcgaaataacaatctntgagaaatgtattcttgtttgggacatcagggtagttggatgggaggtgagctatggagctgaatttgtgcctgatgctaaagatagc

SEQ ID NO: 20883 - DNA, 609 bp, Gossypium hirsutum
  Clone ID: uC-gsflnu33B071a03b1
ttcctactggctcttgttggaatcacagctaatcaaggtttctacttgttggggttagataacacatcaccaacctttgcatcagcaatccaaaactctgtcccagccatcacctttctcatggcagccatactaaggatagagaaagtgcggctagacaggaaagatgggatatccaaggttataggaacaatattatgtgtggctggagcatcagttataacactatacaaaggtccaaccatctacagcccagttccaccactgaatagacccacaccaacgtttgtttcgttgggggatgcaaatgggaagagctggacccttggttgtctctatctaatcggccattgcttatcctggtccggttggctggtgttgcaggcacccgtgttgaagaagtaccctgctagactctctgttacttcctatacatgtttctttggtcttattcagttcctcatcattgcgctagtttttgagagagactctcagcttggatgttccactcggcggtgaactattcactattctctaccgggagtggtggcatcagggattgcattgcagtacagatatgtgtatagacagagggggccctggtttcgt

SEQ ID NO: 20884 - DNA, 225 bp, Gossypium hirsutum
  Clone ID: uC-gsflnu33B071a04b1
tttttcctttctcatgtattttgatctgaatatgtatgtttagatcaatatgcagtcaaggggagggagctttgtattttcttgcatgtttgtctttttaattctgtatgaattcaatgtatcctatgcttttatttgtgttctaatgaatataagtaagtatgatttcgtaaaaaaaaataaaaaaaaaaaaaaaaaaaaaaaaaaaaaacaaacaaatacatg

SEQ ID NO: 20885 - DNA, 419 bp, Gossypium hirsutum
  Clone ID: uC-gsflnu33B071a07b1
ttgtacacgcggacaatagtgcatatctaggagatgaccctaccaggtatgactatagagatcacgggccaatacaaaggtgcgatgaccgacgctacaggcactaaacaatgcacggtaggagtcacacacgcccattatatattgaactacgacgaaaagataggggaccgacggcccacaatcgaggactgcactatctataacgtactaaccttgattttgatatgaagacctaaagggagaattaaaagaggcttatcaggagaaaaagaatcggaaaaacaccccagattaagaggatgagaccacagtgctatgcttcgttggcacctatgggccgtgaacgggagggaacataaccgctgacacggatcaaaagcgtggctatttatagacatcaagaaagaaacatatat

SEQ ID NO: 20886 - DNA, 522 bp, Gossypium hirsutum
  unsure (1)..(522): unsure at all n locations
  Clone ID: uC-gsflnu33B071a08b1
tttcccacgcgtccgggctattgctagggaggtttcatcagtgacacgcctgggcattgaggttgcaattgtggttggtgggggtaatatttttcgtggatcctctcgggcaggatgtagtggacttgaccgttcatctgctgattacatcggaatgttagcaactgtaatgaatgctatatttcttcaagcaacaatggagagtatcggcatcccaacacgtgtccagactgcatttcgtatgtcagaggttgcagaaccatatatacgtagaagggcagtgaggcatttggagaaagggangggtcgtcatttttgcagctggaactggtaatccattcttcaccactgatactgctgcagcccttcgttgtgcagaaatcaagccggaagttgtgctgaaggcaacaaatgttgatggggtttatgatgacgatcctaggcataatccaaatgcccagcttcatgatacactgacatatcatgaggtgacttaaaagatctctggtgatggacatgacc

SEQ ID NO: 20887 - DNA, 252 bp, Gossypium hirsutum
  Clone ID: uC-gsflnu33B071a09b1
tttcccacgcgtccgtggaggagaatttgaagaagacctcctgctgaggaaaagaagaaggaagaaccggaggaagagagtgatgacgatatgggattcagtttgttcgattaggtgtgttttggtcaattactagttatataacattaaggtagtgactcttttagagttgtattgctattggtatttgcatgttaattagaaatattacgtttttgttgaatgaagttgacactaagtagctctttcttt

SEQ ID NO: 20888 - DNA, 457 bp, Gossypium hirsutum
  Clone ID: uC-gsflnu33B071a10b1
tcgtggataggtcccgaaaagaggcagagtttgctctttcagcattgatggaaattccgtctcagtacaaagcaacgctggagctcaacatattgggtaataccagggggaaggctattgatagggttccccttccccctcctctttatggtgctggttcttttagcaactcgaaactttcgtggtcgagcagttttcgtccaagtgcaccttcttccgctagacgtgaagcaccagtccaaaccgctcctcctgcaagttctgcttcagataatcatctttgccctatttgcatttgcaatgcaaaggcatatggcctttggttgtggacatcagactctgttgtgagtgcggacaagaccttcgagttgtgtcccatctgccgaggcacaatcgatacgagaataagactctattaagcataatatgctttgcctggacttgcttatgctctctt

SEQ ID NO: 20889 - DNA, 513 bp, Gossypium hirsutum
  Clone ID: uC-gsflnu33B071a12b1
acaaaatccaaaaattaagccaattttcagtatttttttaactatggcttcaaatcccaaggttttcttcgacatgacgatcggaggtcaaccggccggccggatcgtgatggagcttttcgcagacgtcactcctcgtactgccgagaacttccgggcactctgtaccggtgagaaaggcgtcggtcgttccggtaaaccactccactacaaaggctctaagttccaccgcgtgatccctgatttcatgtgccaaggaggtgatttcacagccggaaacggaaccggaggtgaatcgatatacggatctaagttcgccgacgagaacttcatcaagaagcacaccggacccggcatactatccatggcgaacgccggtcccggaacgaatggatctcagttctttatttgtaccgctaagaccgagtggcttgatgggatgcatgtggtgtttggtcaagttgctgaaggtatggatgtggttaaagccattgaaaaagtgggtctagcagt

SEQ ID NO: 20890 - DNA, 563 bp, Gossypium hirsutum
  Clone ID: uC-gsflnu33B071b01b1
tttggacagcgaggtttccaaggaggtgatggatttcgttttgttgttggaaaatgaagtggagaaattcaatacctttttcgttgagaaagaagaggattatgttatcaaatggagggaactgcaagatagagcagaaaaggccaaagcatcagatggagggttgatgaatgttgggagggagattgtggattttcacggagagatggttctgttggagaattacagtgcccttaactatacaggactagtgaagataataaagaaatacgacaagagaagcggtgctcttgttcgcttgcccttcattcaaaaggtcttgcaacaaccgttctaccggaccgatgttcttaatgagcttgtgaaggagtgtgagatggtacttgatcgtcttttctccacaaatgaaccatcggcgttacctgatgtaaccaacgagaaagaccacaaacctgatacttctagcagaagtaatgaaaacttgctcaaagttccaaaagaacttgcagaaatcaaggatatggagaacatgtatatgaagcaaactttgtcagcactacacg

SEQ ID NO: 20891 - DNA, 419 bp, Gossypium hirsutum
  Clone ID: uC-gsflnu33B071b02b1
tttttcgcccaagagcgagggtagtggcagcgtagtgcactggactttggaatacgagaagctgcacggtgggattgcgcatcctgagactctgctgcaattcgttcaagatatctctaaagacattgacgcccacctcacccaagcaagctaaacagtatcacatgttgctattgttgccgctacttgaagcactgttcatctatttaatgaataaagtgacttcctttctcatgtattttgatctgaatatgtatgtttagatcaatatgcagtcaaggggagggagctttgtattttcttgcatgtttgtctttttaattctgtatgaattcaatgtatcctatgcttttatttgtgttctaatgaatataagtaagtatgatttcgtaaaaaaaaaaaataaatgattattaatc

SEQ ID NO: 20892 - DNA, 579 bp, Gossypium hirsutum
  unsure (1)..(579): unsure at all n locations
  Clone ID: uC-gsflnu33B071b03b1
tttccacgcgtccgcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggtgaaaataatgtataagccatttggttgggagcaaattgtccttttctccaaggatttttgctgctcattcatggtgacttggtttatggttttatctgttgttgttaaaatcttataaaaatatatatcggttgctgctctggntttgtatcaaatcattgtctggaaatatatggcatcttttatactttt

SEQ ID NO: 20893 - DNA, 505 bp, Gossypium hirsutum
  Clone ID: uC-gsflnu33B071b05b1
tttcactttccctctgaagttatacaatgagtggagacgggttgaacatgttgaccatgcccggaaatctgccgaacaggctgtaaaggctcatcaaggggcttgagaaggggcaatcagtcgacgaatatgactacttaccgtacttctattcccgttcctttgacctagcatggcaattctatggcgacaatgttggggatactgtgctttttggagacaacaacctacaattaccgaagccaaagttcggatcttattggatcaaagatggcaaggtggtaggggcattcctagaaggtggtagtgccgaagaaaaccaggcaattgctaaagctgctaagcttcagcctaaagctgagaatttggatgcgctggcaaaagaaggacttccctttgcctgtaagatatgaagagtagcaacagctgacatgccttacaaagagggaagaactctgttggcagaggactgtgtatgggaagggttggatctgcgattctactt

SEQ ID NO: 20894 - DNA, 412 bp, Gossypium hirsutum
  Clone ID: uC-gsflnu33B071b06b1
tgtacttgaagaccttgtttacatcccttcttcttttcctcttgatttttgcctcctccccaaggatcggctcagccactgcaactgctgatgcttcacttgctcatgctgcacaatcacattagatgagccagcgcatgaatcatggcagctatcgaggacctcgaaaacaccttctacaacccagctgttgaccatcctcttcagcttcccaagctgtctgtatagttttctatgtaaaccaaaatctgatcactagaagctataatagttcatctgatcttatgtttctctttttgtatgtcttttatattactaccaaaaccatacaattcaattcaaacagctgaacccaattcttggaaccgaactttcagctttgggactttagacaacaaagggtgcccgacag

SEQ ID NO: 20895 - DNA, 474 bp, Gossypium hirsutum
  Clone ID: uC-gsflnu33B071b07b1
tgaaaaaaaaaaaaaaaaaaaaaaaaaaaaaaaaaaaaaaaaaaaaaaaaaaaaaaaaaaaaaaaaaaaggaaaaaagttatagaggatccaaagttaaaaaacaaaaaaaataaaaaggaaaaaatttaatataatgaaatgtaaaattaaataaaactggccggggggttggcaatttttgtgattggaaaaatctttggcgtgtccgcgcttatttcgcctttgtagaaaatggcccttttaaccaagatggccccgtacttattttttttcgggccggttgctcttcccaaccgggtgcccgatctttatggcgattgggacgcatcctgttttggggctttaggggatgcgggagggggggattaccctttttgttttccgttttatttgccagtctctttggggacgggtcttttcccttttttcccttcctttttggcggggttggggggtttttcccggggggttt

SEQ ID NO: 20896 - DNA, 495 bp, Gossypium hirsutum
  Clone ID: uC-gsflnu33B071b08b1
tctatcgcgggggctgtgccttactatctgctcatgacacggcgcctcttctgctgatctgtggtggtggggctcacctcatcatctcggcctgctcttgtctatcggtcgagccgtgggtcttaccaagttgtgattttgaggctgccctacgcaatgagcagccacagacctattaaggtggtgggatatgctgtcggaggagggcatgttttacatggcatgcgatctgaccatggctgcggataatgctattttcggtcagactggacccaaggacggatacgatgtgactgctggatgtggacggagcatactgtggccggagcaaggctgtggaaatgccacacccatattgtatggaactgaaggaggcaacgagggggacagaggatgtgtggagcatagacactcagatcaatcaaaattgtcaaggcgaccataaagttgaggattgcatggattcacatgaggcatactattgaggctaccaca

SEQ ID NO: 20897 - DNA, 577 bp, Gossypium hirsutum
  unsure (1)..(577): unsure at all n locations
  Clone ID: uC-gsflnu33B071b09b1
ttgttcgtgtttgtctattgaattctttccctcactttctcgaaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggtgaaactaatgtataagccatttggttgggagcaaattgtccttttctccaaaggatttttgctgctcatncatggtgacttggcttatggttttatctgttgttgttaaaatcttataaaaatatatatcggttgctgctcttggttt

SEQ ID NO: 20898 - DNA, 465 bp, Gossypium hirsutum
  Clone ID: uC-gsflnu33B071b10b1
tcgaattttcagggtattggagtttcaccatggatgcagtcgaggctagatgcctccatgcttggtttgcagactgacatgtaccaagctatggctgctgcagcattgcaagagatgagaactgtggatccttccagatctggaactgcttcccttcaattccagcaaccccaaaatggcccttgcaggcctgctgctctaatgcaaccccagatgttgcagcagactctgcctcaggccattcttcagggtgttgaagacaaccagcatcagtctcagccacatctacttcagcaacaattgcagcaccagaattcatttaataaccaacagcaacaccagcagcagcctttgtttaacaaccaacagcaacagcagccacagcattcaatgtcccagcagcaccagcaactgggttgatcatcagcagattcctagtccagtgtctgccatgtcacagtatgc

SEQ ID NO: 20899 - DNA, 530 bp, Gossypium hirsutum
  Clone ID: uC-gsflnu33B071b11b1
ttgggaaagggaaataaaacagcatctattcgaggatcagcagcagcaacttgaggcaaatgttgagaaactttctaagtttttggaagagccctttgatcaatatactgatgataaagttatggagatacgaatgcaagtaatcaatctttctgtgatcattgattccctttgtaagaaaatgtatgagtgcattgagaatgatttgctgggttctctccaacgaaatacccataatatcgctccatacaaatccaagggcattgagaaagcatcagagcttgctgtctgttggagtggtaaagccagtactactactggtaaatgccttccttccgattgtggcactagcggcaaacgtgaccgatctttcagctttgggacttcggacgacaaaggttgcccgtcaccaaagcaacctaagaggaaagttatggaggtggtttctttgatctcaacttgccagcagaagttcttgacaggaattgatctctaagaggctttttttttagataagacatatgtacata

SEQ ID NO: 20900 - DNA, 181 bp, Gossypium hirsutum
  Clone ID: uC-gsflnu33B071b12b1
tggttctctgctgtcgattataatagtatatgcaatacaaagtgaggccatgtctcctgataatattggaaaatacactgttactttttaagcatctgaaagctacttaccggtaaagagatttcttcattgagaatatagccaataaaaaggataaaaaaggaagaagaagaaatatgag

SEQ ID NO: 20901 - DNA, 143 bp, Gossypium hirsutum
  Clone ID: uC-gsflnu33B071c02b1
tgggccgcccttttttttttttttttttttggtttttttttttttacgacaaaagaagaaaattatgttttaatgggaatcatatataaaatgtatgggttcaattgaagattattatttacgatttgtaactatattcgttg

SEQ ID NO: 20902 - DNA, 152 bp, Gossypium hirsutum
  Clone ID: uC-gsflnu33B071c03b1
tgtttttagtgacttgctctgtccttttcgtctcttttttggggaatctaattactagcattaaatgttgatttgtatcaagacgtcgattacagcagaatgaaatgaatatataagatactgtttctactcagccattattaggaagtatg

SEQ ID NO: 20903 - DNA, 478 bp, Gossypium hirsutum
  Clone ID: uC-gsflnu33B071c04b1
ttttgctgacattgttgtcttcatgttggtggaaaccatcacttgaacttgctgaaaatgtcttgatgttaaaacaaggaggttacttactatttgtcttccaatttttgtcggaactgttgattagtttgtttgctatatgacacttttctgaattgtctcaaaaaaaaaaaaaaaaaaaaaaaaaaaaaaaaaaaaaaaaaaaaaaaaaaaaataataaaaaaaaaaaaaaaaaaaaaataaaaagaaaaaaaaaaaaaaaaataaaaaaaaaaaaaataaaaaaaaaaacaaaaaagggggggccctttttaagggacccaatttttcatcccgggtattgcaaaaaaattttttttttttgggggcccaaaaaataaaataacgggccgggttttataaccctgggggtggggaaaaccccggggacccccaaaattaagggttgtgaaaaaacccccctttttcactgggggg

SEQ ID NO: 20904 - DNA, 505 bp, Gossypium hirsutum
  Clone ID: uC-gsflnu33B071c06b1
tgttaaatggagaaaaaattgcaacttaagtgccttcatttcaccttcttcttccttttcttcttattgtttgcatttaatattgtgggtgcttttggtactaggaaaacactatccatggaaggctctaatgcaccaaacggtggttccaatggtgctactggttcagcccatggtcctaactgggactacagttggggatggggctcaagccctggtagtggatgggcttatggttctggttcagggtaggtacctaatgggttcgggaggggttacgggttcccattcgcacgtggtactggttcaggttctggctttcgagctgaaacttggtatggtagcagcattgcttagacccatggatgaggtaactaactgcccgcagtctgcaaggcttctccattcctcttgttattatatgggccaatgctaactgtgccaagaatgatccaaaatcatgcgtaggtggattacttatattggatatataatgcttttgagt

SEQ ID NO: 20905 - DNA, 438 bp, Gossypium hirsutum
  Clone ID: uC-gsflnu33B071c07b1
gctgaaaaaaaaaaaaaaaaaaaaaaaaaaggggaaaataaaaaaaaaaaaagagggggggccaatttataggatccaagggtttccgggctggcgggtccagggttcccttctcttggggggccccgttgagggggtcctaggtggtctctcgtgtcaccgtagatgtctttgattgccctcggggtttcccccgttaaacctgggggggccctgtcctccctcgcctgtgggggcttccccgttttgcccctttccccaggtgctttcaggcctttgcgctccgcccggggggcctttggcacccgcggcccggcctgtttgcccttcgggacggtgctgttttcggcccgttaggcgggtcggctctggtgggcgctcccgccccctccggtagttttgtttcccccctatctcgcgctttttcggttttttccc

SEQ ID NO: 20906 - DNA, 602 bp, Gossypium hirsutum
  unsure (1)..(602): unsure at all n locations
  Clone ID: uC-gsflnu33B071c08b1
tttcccacgcgtccgcccacgcgtccgctgaagctagcaaaggggttcttgttccagttgatgatgatgaagtgatagttgaaacgtgtcacgctgaagccaatggggcatattgtttcaaggcatcaatctgttgtgattacagaccccaacttctaaccgacttacgacaagctctcgatgctcttccgattaagatggttaaagcggaaatatcaaccttgggtagtcggctgaggaaagattttgttttcaccggttgccgaaccaccgcaaatggagatgacgccgagtcacggcaatatcttgccggttccgttcgccgggccttgaattctgtcctggagaaggcttctatctcgccggaatacttgccatactcgacgtttccaaagaagaggcagaggatctcatactttgattcctcaagctcatcttcataaaaaagatgattgccattgtttcgtttgtgtcaatccactgcgacatctcctttattttctgcaggtgtttgtttgaatgtgcaaaggttggcttngaatgcanattagaanacatgttatatatatacatatcattagatgtaagagttcaatattaga

SEQ ID NO: 20907 - DNA, 503 bp, Gossypium hirsutum
  Clone ID: uC-gsflnu33B071c09b1
tttgctgccaacttcacctctcaggttatcatcatgaaccaccctggccaaattggaaatggttatgccccagtcctcgactgccacacctctcacattgctgtcaaattttccgaactgttgaccaagattgacagacgatctggcaaggaactcgagaaggaacccaagttcttgaagaacggtgatgcaggtatggtaaagatgattcccaccaaacccatggttggtgagactttctctgaatacccaccacttggacgttttgctgtccgtgacatgcgccagactggtgcccgcggtgtcattaagagtggtgagaagaaggacccaactggggcttagggcaccaaatttggttgccagaagaaatggaaggttatttgggaggggattaatttaagttttaattccagtttggaacattattctaaaattggaactttagaattaacttttgtggagacttttggattggctttttaaacaaatcctagttttat

SEQ ID NO: 20908 - DNA, 515 bp, Gossypium hirsutum
  Clone ID: uC-gsflnu33B071c11b1
ttgcccacgcgtccgtgtgtgtgcaaaaatggggttaattcccatgagaaacatacacattcttcttgtttttacggtgacaatagtactccttgaaacaaatggttgcaaagctgcttttctagtgaagagcaacttcagctacaagtgcaaaggccgtctcaacgaatgcaggatcgctgaggctttggactcggagctagagttggagttggacatggtgatgaattctaacgttgttagaatccttcagagcagtaacacgccggtaaccagtaacacgggaaaccggaatacgccggtgcaacagacttgcccgagtcctcagtatgctagttgtcttgccacaggaggtagagctaattgtaggggaacttactgccgcggctaatccatcttttgtatcattcctcttgttattatatgggcaaatgctaaatgagccaagaatgatccaaaatcatgcgtagttgtattactttatatgggatatataatgtttttgagtaagtaat

SEQ ID NO: 20909 - DNA, 432 bp, Gossypium hirsutum
  Clone ID: uC-gsflnu33B071c12b1
tcggcgagcagaagcaaagagcctccaaaaaacacttcaaccctctagccatgacattcaagcgtaggaatggtggccgaaacaaacatggccgtggccatgtcaagttcatccgctgctctaactgcggtaaatgttgccctaaggataagtcaatcaagaggtttcttgtgaggaacatcgtggagcaagctgctgtcagggatgtccaggaagcctgcgtctatgacacgtacactctgcccaagctgtatgtgaagatgcaatactgtgtttcatgtgcgatccattcccacgttgtgagggtccgatcccgcactgacaggaggaaacgtgacccgcctcagcgcttcattagacgcagggatgatatgccaaagcccggtcagcctggtcaggctcctcgtccgggtgttgcggctcctgctcgtg

SEQ ID NO: 20910 - DNA, 100 bp, Gossypium hirsutum
  Clone ID: uC-gsflnu33B071d01b1
ttttaaaaaaaaaaaaaaaaaaaaaaaaaaaaaaaaaaaaaaaaaaaaaataaaaaaaaaaaaataaaaagaaaataataaaaaaaaaaaaaaaaagatg

SEQ ID NO: 20911 - DNA, 580 bp, Gossypium hirsutum
  Clone ID: uC-gsflnu33B071d02b1
ttataaattttccaaagagggtcctctctctctctctctctctttctggaatcagaagaataattcttcggcatctcagaacacttttatttttaattattcaaattatttttttacctttttttttcatataaaactaaaaaattcttttgttagtttagtttactgtaaatttgaaagcaaaatttttagattcagttaaaaaaaattcaaaatcatgacttcagctgtcgagatcaacggtgaacaactagttaacgctcttcccgatctctcgattcaagatcagattgaagtgaagaagaaaggggctgttgttgaagaaggttgcgaaaaccacagtggaatatgcgcgatttgtttagataagataatgttgcaggaaactgcactcgtaaaaggttcgagcatgcttactgtgtgacgtgcatccttcgatgggcaacatacagtcagatgcctacgtgccctcagtgtaaacatccattgagttcttgatgtcatcgttcgcttgatgcagaatcatgactactgttcgaggaaggtttgctacttctagagccacatgttaaaccatgat

SEQ ID NO: 20912 - DNA, 584 bp, Gossypium hirsutum
  unsure (1)..(584): unsure at all n locations
  Clone ID: uC-gsflnu33B071d03b1
gaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggtgaaaataatgtataagccatttggttgggagcaaattgtccttttctccaaaggatttttgctgctcatncatggtgacttgggttatggttttatctgttgttgttaaaatcttataaaaatatatatcggttgctgctcttggtttgtatcacatcattgtctgaaaatatat

SEQ ID NO: 20913 - DNA, 614 bp, Gossypium hirsutum
  unsure (1)..(614): unsure at all n locations
  Clone ID: uC-gsflnu33B071d04b1
tcgggaaaattttagacaccgatcttccctttcccttccccttccccttccccttcgcttgacacctgatcttctgcttgccatcagccaacaccgattcttaacaccagacaccggctttcatcaaccttttttctatgttttgatttcggagcaataattgagggaatccgaaaattgagaaaactgatggaattgggaaagaaaatggaagcacagaagaaaagcaaagtttcaaagatggatcaatttgtgggtatacttcgcttcaccacctcttgagcgcaaatctcaagcctcaactctaccagcataatgctaatattatgcacaatcggagcccaccaattgtttacattttttgatcaaaccattgaaaaaaggaaagaaaaaatcttccatctacaacgctgaagcaaactctcaagtctcaaccttgaaanttgctggttcttaaaccctcaagatataaccggtattcctctntcagttctgtctcgtttaagcaatngcgtttggttgctgagaaaatgctggaatatataagtttaaccttntcttttaagattttcttgaagcaaataaaattgttagtggatggcaactaatgctac

SEQ ID NO: 20914 - DNA, 518 bp, Gossypium hirsutum
  unsure (1)..(518): unsure at all n locations
  Clone ID: uC-gsflnu33B071d06b1
ttgaaattgaagttgccggagcaaagaaagcgcttcagagactagctggaaataggctaaaaagcattttcagcaggacttggagggaataaccagtaaagctactcacctccccgccaactaaggaggaggtttggaattttctaactgtcagaactgctgtggttgaaaacgcggcaaacacacttcgtatactccaaaactttacctcaaaagcaaaatattaattattattatatgttttaaacactatgttaatttaaatgatgataactgaaggcatggatgcggtttttagggagtatcctcgtttttttttattagtaatatttgattcactgatgaaagctgagctgtaagagggagggtatgatgatngttatgtttccttccctctttttttcttttcctaattataatgattgtactttgttctataatgtaaattattaaaggattgtttgtttgtttaaaacacatacccccaccctttttttataaaaaaaaaaagggcggcc

SEQ ID NO: 20915 - DNA, 578 bp, Gossypium hirsutum
  Clone ID: uC-gsflnu33B071d07b1
tttctgctctctctgtcttaacgctataatcattgaagaaaaatgggtttgaaggaggaattcgaggagtatgcggagaaagctaagacccttccccagaacactaccaacgacgacaagctcattctctatggactctacaagcaagctactgttggaccagtgaacaccagccgtcctggaatgttcaacatgaaggaaaagtacaagtgggatgcatggaaggctgttgaagggaaatcgaaggaggaagcaatgaacgattatatcactaatgtaaaacagctgcaagaggctgctgctgcatcttcttgacgtgtgtgtgagaatagaaaatggtgtaattttcaagccctttgatacctatgggtttgaaaaggtctaaaactatgaataagcaatgtactatgttttattgctattaagttatattaatgaattatggtttatttaaagtcagagtgtaaagtttttattgtacttatagtatgaatgtgttcaaactaatcgatgattatgggttttgtgctaatacaaaactacctaaatacctaaatttaggataagacaatgcaatg

SEQ ID NO: 20916 - DNA, 611 bp, Gossypium hirsutum
  unsure (1)..(611): unsure at all n locations
  Clone ID: uC-gsflnu33B071d08b1
tcggttgacaatgtcctggtttgtaccaagcttaagagcatgcgaaggtgatgtgtgtgctgagccaaggaaggctcatgaagtggcctttttccttgccatatacttgatctccattggaacgggaggccataaaccttcattggagagctttggagctgaccagttcgacgatgatcacccacaggagagaaagaacaagatgtctttcttcaactggtggaactctggtctttgctctggactcttattgggcgtcactgtaattgtatacgttcaagaccatgtcaattggggcatttgcggatattattctcactgtagtaatggcttgtncgctgttaatcttcatcattggaaggccgtattatcgttacaggatgccatcgggaagccccttaactccaatgttacaggttttagtagctgccatttctaaaagaaaattgccccaccccttcaatcctgcagatttgtatgaagttcccaactcccaaaggctcaggggaggcttctgtgtacaccaagaacttaagttcctgncagagcagccattgttgaggagaggagaattatttgagaaacggatccatgagacttgcacagtgacc

SEQ ID NO: 20917 - DNA, 262 bp, Gossypium hirsutum
  Clone ID: uC-gsflnu33B071d09b1
tcgagctgagaacgatggcaagtgcaattgcggtactggctgcagctgcacagactgcacctgtggccactaagccaacatacaatggtcatgcttcagatcatggcatatatagggatctaaataatgaatttaaggttgaataatttgtgtctgttgtagtttgtgtggtgacttatatctgtcagttaacctttctctcctttactatgatgtaatggctatgcttatggccttatctggttaatgaagtatccttact

SEQ ID NO: 20918 - DNA, 576 bp, Gossypium hirsutum
  unsure (1)..(576): unsure at all n locations
  Clone ID: uC-gsflnu33B071d11b1
gactttctccgttcatgttcaagtccaagggtgtacctgtctaccgctgtatccaatatcctagggagtttgttctggttttcccaggagcctatcattcaacatttgattgtgggtttaatgttgctgaggcagttacttttgctcctcttgattggttacctcatgggcagaatgctgtagcactctatcaatcacagggaaggaaaacatcaatttcctttgataaattgttgattggagcagcaagagaagcagtgaaggcacaatgggaactcattctgttaaagaagaatactattgataatttaaggtggaaaggttactgtggaaagaatgggatcttaactgaaacactcaagtcacgtgtcaagcaggaaggtatgagaagggaatacctctgtagcacctttcagacaaagaggaaggacaaaaacttcaattctactagcaaaagggaatgtagcatatgttactttgatttgcacctctcagcagtgcactgttcatgttcttctcatagatattngtgtttaaatcatgcaaaagcgctttgttcttgcacatggacagaga

SEQ ID NO: 20919 - DNA, 72 bp, Gossypium hirsutum
  Clone ID: uC-gsflnu33B071d12b1
cccacgcgtccgcccaccgtccgtacccgctgagtttaagcatatcaataagcagaggaaattttcttgggg

SEQ ID NO: 20920 - DNA, 567 bp, Gossypium hirsutum
  unsure (1)..(567): unsure at all n locations
  Clone ID: uC-gsflnu33B071e01b1
ttccacgcgtccgaaaaaaagaaaaaaagaaaaaagagaaataaaagaataaaagtgaatgaaaatttctctcgtttgagaagtgaatcactacaaaatatatatcttccgcaggaggcagaattacttaaggctgtagagtagaaacggaggttgctttctcttttatgaatttcttgtaaagaataaagaagagaaaaatgtacaagatgaacatgtgcgacatggatatgtacagcatcaacactaactgcagttttaggattttcataacaagttttaggagacagtttcttttggtttggtagaagataggcctcatagtcgtttttacattagaagggttggttttaagcttgttgatagggattgatctaggtagaaatggaagcacggaacgccatggtatcggataataagcctgggtttctgcacaataggaagagaaagcgggctgcgcagcattcaacttattttcctggagcttcgcatgtgatattaccacaattgcccaacttgagtttaccatcccagaaagcatgcangctgaggagattggaggatcac

SEQ ID NO: 20921 - DNA, 363 bp, Gossypium hirsutum
  Clone ID: uC-gsflnu33B071e02b1
tttcacgcgtccgcccacgcgtccgaaatttgaaaagaagagaaaaaatgcataatccaccaccaccagacccccaccatcctcatcatccccaccacccacatccgcaaccccatgctccgcctccaggtccgccacatgctgatcatcctcctccaggccatgctcctcctcctgggccaggcccccatgcgccaccgccaggaccaggtggtccaggtcatcatcccgagccacacaagcctcgtccatgatccttataccgtgtatacaatattatgtaagcttaggctgggtaccgtacttatgtaataaattaagaaaacctatttctactataataataataaagatgtaatttct

SEQ ID NO: 20922 - DNA, 600 bp, Gossypium hirsutum
  unsure (1)..(600): unsure at all n locations
  Clone ID: uC-gsflnu33B071e03b1
tcttccacgcgtccgaagattttcaaagtcgacgaccacatcggcgttgccatcgccggtctcaccgctgacggccgcgtcctttctcggtatatgagaaacgagtgtattaactacaacttcacgtatgaatcgccacttcctgttggcagacttgtcgtccaacttgccgataaagctcaggtctgcacccaacgctcttggaaacgaccttatggggttggcctgttggtggctggcttggatgaatctggggctcatctctactacaactgtccgagtggaaattactttgagtaccaggcttttgccattgggtcccgctcacaagctgcaaagacgtacttggagcggaggtttgagaacttcgcagattcctctcgagacgatctggtcaaagatgctcttatggctataagggaaaccctgcaaggagaaactctaaaaagctctatatgtacagttgctgtggaggggtttggagagccattccatatcttggatcaggaaactgtacaacaaatgatcaatgcctntgagatcgtgggagagcaagaaatcagctgctgaacctgatgctgctgcaggacaagaggctgc

SEQ ID NO: 20923 - DNA, 135 bp, Gossypium hirsutum
  Clone ID: uC-gsflnu33B071e04b1
ttcattattgagttgcccgaacaagcagagatatataagtatcatgatggattttattttattttctttgataatgcggcatgacatttaatgtagggatattatgattttattaaaatgttttttgttggctcc

SEQ ID NO: 20924 - DNA, 598 bp, Gossypium hirsutum
  Clone ID: uC-gsflnu33B071e05b1
ttttatcgataaaacaccccacccagattgttagtttgcaatcccatcaaatcatctatcatcaattgcctaacgtttcctttttggtttattgccgtctcccataaatctaatctaagttgttttaaagaaataaaatgagctggtggtgggctggtgctatcggagctgctaagaagaaatttgaggaagatgaagcaccgaaaagcctcaagagcgttgggctgatcattggagtcaccggcatagttggcaatagcttggctgaaatcctcccgttatccgacactcccggcggcccatggaaagtatacggggtggctcgtcggcccagacccaactggaacgtcgaccatccaatcgagtacattcaatgcgatgtatccgacccgaatgataccgaatcgaagctctctcaacttaccgacgtcacccatatcttctacgtcacctggaccaaccgaacatccgaagccgagaattgtgagatcaacggttccatgcttcgcaatgttttgcgttccgtgatcccaaacgcacccaatctccgccacatctgtctacatacaggagtcacacattatcttggacccgttcg

SEQ ID NO: 20925 - DNA, 678 bp, Gossypium hirsutum
  Clone ID: uC-gsflnu33B071e06b1
tgtccacgcgtccgaaagaagcaaaaaaacatggccaaagttctgttgttcattgcactatgtgtgcttccagctttggttagtgctacacgcattctgaataatcaattggtggtagaaggctatgtgtactgtgatacttgccgtgctggttttgaaacccctaagactagaagcctagctgatgccatggttaggttggtatgctccgacaggaagagcggccaagttgtcttcaaaaaggagggatacaccgacaaaaccggaaaataccagattcgtgtatccgaggatcacttggatcagatctgtgatgcagttcttgtgaagagctcccagcttggttgtgccacaatgtcccccggtcgtgaacgtgcccgtgttatcttgaccaacttcaatggcatttcatccaccacccgttatgccaatgccatgggcttcatggttgacgagcctgaagcaggctgtgctgagatgatgaagatgtatcaagaggatgaagaggatgtctagtgtgttggtttggatttatttgcttaagaaatatgatggtgtcctgtttttgttttgtgaaatgttccttatttctacgtttgaggattctttaccttttttttaccaacctttacccacttttaaactaactttggctttttttgggagtattttttggtt

SEQ ID NO: 20926 - DNA, 560 bp, Gossypium hirsutum
  Clone ID: uC-gsflnu33B071e07b1
tgatcgcgagcgccgcccttttttttttgggttttttatattttttttttttttttttttttttttttttttttttttttattttattattttattaatataatttttttttttgttttacaaaaaaaaaggggggaaaaaaaaaaaaaattttcacaaaaaaaaaaggggggaaaaaaaaaaaaaaaaagggggaaaaaaaaaaaaacaaaaggggggcaaaagggggaaaaaaaaaaaaaaggggggaaaaaattggcgggggggaaaaaaggggaaaaaaacaaaaaaaaaggggggggaaaggtaaaaaaaaaaaaggggttggaaaaccccaaccccccccaggggagaaaaaaaaaaaaagggggctaaaaaaaaggggggggaaaacaccccccccaaaaaaaagaaagaaaaacagggggggaaaaaaaaaaaaggggggggggccaaaaaaaaaaaaaaaaaagggggaaaaaaaacaaaaggggaatggggcccaaaaaaggggggggggcctttgaaaaaataaaacaaaaggggaaatatttgggggg

SEQ ID NO: 20927 - DNA, 615 bp, Gossypium hirsutum
  unsure (1)..(615): unsure at all n locations
  Clone ID: uC-gsflnu33B071e09b1
tttcccacgcgtccgggagttgaagtgcctagataaagctgccatagtcactgatgttgaaaccaaaagtggggacttctcaaatccttggaggctttgcactgtaacacaagtggaggaattgaaaatcttgatccgcatgtttcccatatgggttactggaattgtgttctctgctgtatatgctcaaatgtcaactatgtttgtggaacaagggatgatgatggacacaaaaattggttctttcactattcctcctgcttctctctcaacttttgatgttattagtgttattttttgggttcccatctatgataggatcattgtcccaattgcaagaaagttcacacgtaaggagcggggcttctcagagttgcagcgtatgggaattggtctctttatttcagtcctatgcatgtcagccgcagctgtagtggagatcaggagattgcagcttgctaaagagctagatttggtcgataagcaggtcgccgtacccattagtattctttggcaaatacctcaatatttcttgttgggtgccgcagaggtctgcacattatcggacagcttgagttctctatgatcagnccctgatgccatgcgagttatgta

SEQ ID NO: 20928 - DNA, 575 bp, Gossypium hirsutum
  unsure (1)..(575): unsure at all n locations
  Clone ID: uC-gsflnu33B071e10b1
ttggaaactatgaaataggtaaagtctaccttaaaggcagatgctgacagcagcagtgatgtaaatttgaaaattcactaaaaatagtaggaatggaattaaatagtgaataaattatttaatcgaaccttgatgaatctactttcatatggaagaaacgaaacgatcatatgagtcgtattttaagatatatttaagtttttgtggaatagggccagagcgatttctggatcccctgatctgactttggaaattcactataaattaaccagagataattagaagtcattctatatatgtatagattcctttttgagtctagtttcattagaaacaaacggcataagtattgaatccctgtacagggagatatataagtcgtaatgcatgaaggtcagagcagtcgaaccctgaaacaggggagaatttaactaataaactgtactaattggcctgattaaaaattctataaaaaaatttgtagatggatatatgagtctagtttcggngaaaatttacggaatcagtttttgagcttcggaactcgagatatgattttaaagtgactgtgatgc

SEQ ID NO: 20929 - DNA, 515 bp, Gossypium hirsutum
  Clone ID: uC-gsflnu33B071e12b1
ttgttcacgcgtccgaaaagctaaaggaatttcttgtgacagttggcttcgttggttcaaaattggatgcttcgttatttgtgtcatgtacaacctgattctacactctacgtacttgtgtatatagatgatattatcgtaactggggatgtgcctactatcattgatggaattgggaagttgttgattgtggaggtctcggtaaaagatatgggtgacctttattatttccttggggttgaatttactcagattcgtgctgcgtactgtatctatactatgtcaaagagaagctatgtctcgtgatcttcttgaacgaagttctatgactattgatgcacgagcttatacgccaatgagtagctcgtcaaatctgtctaagggtgatggcaatagtatgtcagatccatctgagattctgagtcttgctagagcattacagcatgttgttcttactaggttagaccctgaagatgcaaccggcatgacttgttagttctgcatagtctaccact

SEQ ID NO: 20930 - DNA, 440 bp, Gossypium hirsutum
  Clone ID: uC-gsflnu33B071f01b1
ttatttcatgaaaaatgtctgcactgatgcttacaacaagtggacaactgctggctatgacctaatacagtatctgcagcaaggcattgagaagtgaagtcacgggtaattatctttgaggtacattatcgtttgtaatttataaatattcttttacccccatagttacagttttctcgaggaaatcccacctaagcaaggctcggaagtataaaatatgtggcacaagcaattgatttgataagagagaaaatgagttgagttctttgtaacccagtggtggacatccttgttagttaggtttgtaaacgatacgccctaaaaaaattgtttgggaaagtaatagtttgaatgaacgtgggggatagtttctgtttgaaacaaaaattctattgaattcttaatgtttatgaaccgagcctgagttccaaggcttatta

SEQ ID NO: 20931 - DNA, 521 bp, Gossypium hirsutum
  Clone ID: uC-gsflnu33B071f03b1
ttccacgcgtccgcttacattacctacaaaatctttgctttcccttttttttctttttttttgccgatggcttcttcaccaaaactcatctcttacttcttccttttagccctcttctccgttgaaatacatggtagggatttctttagcaaaatcccaagcgttaacacaaatgagaaagaggtgaccaacaaagaagaacaaaccactttggggaagaaggagcaagagccaaggtttatccccgagacccaaagctatgggctttacggtcatgagtctggtcagctccctcctagcaccaccagtaccaaagaaacctatgaaccctatgtcacacctgttaaataccaccctgatgaaccctacaatagcatgccagcgtccaaaaccaacaacaaagactcttacttttatagcaggacaaatgcctacgggaacgctgagcagcatagtgaagccaagttcaatgagaaaggatgggccaccaaagaaccaacaactacaatgtcaactattac

SEQ ID NO: 20932 - DNA, 168 bp, Gossypium hirsutum
  Clone ID: uC-gsflnu33B071f04b1
ttctttgtttgtggtgaaaataatgtataagccatttggttgggagcaaattgtccttttctccaaaggatttttgctgctcattcatggtgacttggtttatggttttatctgttgttgttaaaatcttataaaaatatatatcggttgctgctcttggtttgtatc

SEQ ID NO: 20933 - DNA, 613 bp, Gossypium hirsutum
  Clone ID: uC-gsflnu33B071f06b1
gctttttcacatagtgcttttgatcgaaaaatgaatctgatttatttcgtacccctcgctcaatgagaaaatgggtcagattctataggatcaaacctatgggacttagggaatgatggaagggaataaaataaaaaaaaaaaagaaatcaaaaaaagaggggaaaaaaataataaaaataataaataagtaaataaaaatgaagtagaagaacccagattccaaatgaacaaattcaaacttgaaaaggatctttctgattctcgaagaatgaggggcaaagggattgatcgagaaagatctcttgttcttattataagatcgtgtgattggatccgcagatgtttggtaaaaaaaatcttctcttttgagaataatcaaaaatggaaagtgttcaattggaacatgaaaacgtgactgaatttgtcctagttactcttcgggacagagtggaagaagggaggagattctcgaacgaggaaaaggacccaatgactttgaaagaattgaacgaggagccgtatgaggtgaaaatctcatgtaccgttctgtagagtggcaagtagggtgacttatctgtcaacttttccactatcacccccaaaaaccaaac

SEQ ID NO: 20934 - DNA, 456 bp, Gossypium hirsutum
  Clone ID: uC-gsflnu33B071f08b1
tcttagcgaaatgggtgaagaagtgaaggtttttggatattgggcaagcccttacagctacagggcagagcttgctttgaagttgaaaggtgtttcttatgagtacataaatgaggatatctttggcaacaagagcgatttacttttgaaatacaatccggttcataagaaagtcccagttcttcttcacaacggaaaatcaattgtagagtctgttgttattcttgaatacattgaggaaacttggaagcataatctttatttgccacaagatccttatgacaaagctaccgctcgattctggatcaagttcatcgacgaaaagtgctttcctaccctttggctagctgcatggagccccgagaatgagcgagaaaaagtgacgaacgaagcttgcgagtatatgaaaacgcttgaaagtgcgcttatggaaagatatctttggtggagaaacca

SEQ ID NO: 20935 - DNA, 588 bp, Gossypium hirsutum
  unsure (1)..(588): unsure at all n locations
  Clone ID: uC-gsflnu33B071f09b1
tttcccacgcgtccgagaaatgagacctctgggaaacaccggcctcaagctcagcagcgtgggcttcggagcttcccctctcggcagcgtcttcggttccgtttccgaaagcgacgctgtcgcctccgtcctcgaagccttccgcctcggaatcaacttcttcgacacctccccgtattatggagcgacattgtcagagaagatgcttggtaagggacttaaagctcttggagttcctagaagtgaatatatagtttcgacaaaatgtgggagatatcgtgaaggttttgatttcagtgctgagagagtaactaaaagcattgatgaaagcttggagaggttgcaacttgattatgttgatatatttcaatgccatgacattgaattcggctctcttgatcaggttgtgaatgagacgattccggcacttcaaaaactgaaggaagcagggaagattcgtttcattggtatcaccgggttgcccttggaaattnttacttatgtgcttgaagggttccaccaggcactgttgatgtaatattatcatatggccattatagcattaatgattcaacattggaggattta

SEQ ID NO: 20936 - DNA, 580 bp, Gossypium hirsutum
  Clone ID: uC-gsflnu33B071f10b1
tcgcccacgcgtccggtgacatttgggctgttcttgggaaggaaattgtcgttgacaagggcaatatactacatggtgatgcagtgcttgggagccatatgtggggctggtgtggttaaagggttcatggggaagacaaggtatggtgctttgggtggtggagctaactctgtgaatcatggctacaccaagggagacgggcttggtgctgaaattgttggcacctttgtgcttgtttacactgtgttctcagccactgatgccaagcgcagtgccagagactctcacgtccctattctggcaccattgccaattgggttcgcagtgttcttggtgcacttagccaccatcccaatcacaggaaccggtattaacccagctcgtagtcttggtgcagccatcattttcaacaaggacaagggctgggatgaccattggatcttctgggtgggtccattcattggagcagcactagcagcactctaccatgttgttgtgatcagagccattcctttcaaatcaaaatgatcaaaataaacggtccatatgatctgaacataatgaaaaattccactcatgc

SEQ ID NO: 20937 - DNA, 561 bp, Gossypium hirsutum
  unsure (1)..(561): unsure at all n locations
  Clone ID: uC-gsflnu33B071f11b1
tcgctttctaaatccctctttagcaaggactttggaccgaataccaaatttctgggaaaaatgcagttttccaggaattttatgataatttgttctgcattgctcctgtgctcttccttgacatatgggcaaacggctactccaccggctccggtggcaatgaccccaactccgacacctgcaccggctccggcacctgaatacgtaaacctaacttatttactctctgtggctggtccatttcacactttccttaactaccttgaatcaactaaagtgattgacaccttccaaaaccaagccaacaacactgaacaaggcattacaattttcgttccgaaagacgattcgttcaagggtcttaagaagccgtcattgtccaaactcagtgatgatcagcttaaatcgctcatccttttccatgccttgcccaaatactatgcccttgccgacttcaatganctcagtacaaaaggccctatcactacacttgctggtgggcaatacactttgaatttcaccgatgattccngcactgtgcacctcgattcaggatggagc

SEQ ID NO: 20938 - DNA, 677 bp, Gossypium hirsutum
  unsure (1)..(677): unsure at all n locations
  Clone ID: uC-gsflnu33B071f12b1
tcgcccacgcgtccgcccacgcgtccggaagccccctccgccgatgaacttttctccgacggtaaaatccttcccactgacatcaagaagagcaacccctctaaacaaattgaccactcttcttcaccaccaccgccgccattgccacctcagaaagcagcagaaagctcgaaagaagaagagaagcaaagttcaaagccaacttcattttggggtttcaaaaggagtagtagcttcagctgtgggagtggttatggcagaagcttatgtcctttaccacttttgtcaagaagcaattcaactggttctacaccaaatgctaaacacccttcgccaaataaccctaaacacatccattcacataaacatgctgctgctaattctattactaatccatctttcaagtcttccacaagttatcatcaaaagcctccactgaagaagactgcttataagccttattacggtaatggtgttcatcctgttctcaatgttccttctggtaatttgttcggtttaggttcgatcttcttcaatggcaacaaagctaaagacagctgcaagaggaaatgatatgatccataccatggattgatccttggtattacccattgagagaaaaatgcaatagagattgggtaagagacatcaangaaatggaatgtaatggggggggg

SEQ ID NO: 20939 - DNA, 543 bp, Gossypium hirsutum
  Clone ID: uC-gsflnu33B071g01b1
ttttcacacgtccgcccacgcgtccggaggccgcaccggagatgcctctggtcatgtctaacgccgtggagagcgttgagaaaacctctgccgcaattaaggttttgaaacaggttggggcatatcccgacgtggaaaaggctaaggacagcgttggaatccgacccgggaaagggaaaatgagaaaccggaggtacatttcccgtaaaggtccattgattgtttatggaacagagggggcaaagctcggtaaggcctttcgtaacattcctggagtcgaggttgccaatgtagagagacttaatctattgaaactcgctcctggaggacaccttggaaggttcattatatggaccaaatcggcttacgagaagctggattcgatttatgggtcatttgagaagccttccgagaagaagaaagggtacatcttgcctcgttctaagatggtgaatgcggatctcggtaggataattactccgatgaggtgcagtccgtggtgaagccaataaacaggagatcaagagggcaccattgaagaag

SEQ ID NO: 20940 - DNA, 504 bp, Gossypium hirsutum
  unsure (1)..(504): unsure at all n locations
  Clone ID: uC-gsflnu33B071g02b1
ttccagtcaagtgctaatccctatggccagccaacacaaccaaatgctgatccttatggtcaatctgcacaaccaaatgctaatccgtatagtcaaccagcacaaacaaatgctaatccatacagccaacctgtacaggtacatgctaatccatatggccaacctgctcagccaagtgctaatccatacaaccaacctgctcagccgaatgctaatccatacagccagcctacacagcctaatgctaatccatatggccaacctgttcagccaagtgctaatccatatgcccaacccacacagtctgtgtctgcagcccctcaaattccaggatctgctgctcagagcagcaatgggagcttaatgataggttctaatggctctgtcagttcacaaatggctgctcaacctccaactcctgctgcaccagctactcagtttaacactggaaactttatttanagcagggttctgctgtgccagttgagtcacagagtgctcctc

SEQ ID NO: 20941 - DNA, 593 bp, Gossypium hirsutum
  unsure (1)..(593): unsure at all n locations
  Clone ID: uC-gsflnu33B071g04b1
tttcaatgagaaggaatataagcctgaccttaacattgtctccaatgctagctgcaccaccaactgtcttgctccattggctaaggtgatcaacgataaatttggcattgttgagggtcttatgaccactgttcattctattactgctacacaaaagactgttgatggtccttccatgaaggactggagaggtggtagagctgcttccttcaatatcattcctagcagcactggagctgccaaggccgtcggcaaagttttgccagcactgaatggcaagctgactggaatggctttccgtgttcccactgttgatgtctctgtggttgacctcactgtgagacttgagaagaaggctacatatgatgaaattaaggctgctatcaaggcggaatctgaaggcaacttgaagggaattcttggttatgtggacgaagatttagtctcaactgacttcatcggagacaacaggtcaagcatttttgatgccaaggctggaattgctttgaatgacaactttgttaagcttgtgacttggtatgancacgaatggngttacagttcccgtgttatcgacttgatncgacacatgt

SEQ ID NO: 20942 - DNA, 104 bp, Gossypium hirsutum
  Clone ID: uC-gsflnu33B071g05b1
ttttgacgtataacttaataaattcaagttctacgtttgtgttttttgtctatacatttgtaaatcgcctattgttgtggttcgctattgttttccttgcttct

SEQ ID NO: 20943 - DNA, 570 bp, Gossypium hirsutum
  unsure (1)..(570): unsure at all n locations
  Clone ID: uC-gsflnu33B071g06b1
gtgttctcaaagggcagcagctgtagctgctctttcgtcggttcttactgctgaaaagaagaagcaaccgcatgatggatctcctataaaatccactagcagcactcctgctgtatccagcccactttctgaagcacagagtgaggcagacccttctgaagctgaggattctcaattggttgctgaagccaaggaggctggtgtagcatcccaaaccaatggggatgattcagaaccaaagcaaaagatactgcaggacgagaatgggagtggaagcactcaaagtgcatatagttatgagcaactgaaagccataactggtaatgctgcaaccggaattgatctcaaacggagagaggcttatttgtcggataatgagttccagacagtattcggtatggaaaaagaagcattctataaattcccaaagtggaagcaagacctgaagaaaangacagttggtctatctaagtgttggggatttaacaagtattatgtgcttatctccattcactagcaatccgcatcatttgatcttgattctgccaaaaatattgttcgttggatatg

SEQ ID NO: 20944 - DNA, 487 bp, Gossypium hirsutum
  unsure (1)..(487): unsure at all n locations
  Clone ID: uC-gsflnu33B071g07b1
tttcccacgcgtccgcggacgcgtgggcaagcgagtttgctgctgcacttaagacagtgttccaacgatacgcgacttacttggatgcatttggtcctaacgaaacctacttgcgaaagaaggtagagaatgagttgggatcaaagatgatctacctaaagatgagatgtagtggcctaggttctgagtggggaaagattactgttcttggaacctcgggactctctggatcttatgtggaacaaagagcttagcagtaaattgttgagacatttcatgtgaactcttttttttgttctgttttagatcatgtttatgaatagtaggagacagttggntgtttgttctcctagaaaaccttgggagtttgcttggaaagctaaataaaaaggcttatgttgtcaaaaaaacaataaatcaaaatgtaaaatcatgtttctgaaatttttttcatgggaaaattttgcatgaaaattttatgggaaaa

SEQ ID NO: 20945 - DNA, 495 bp, Gossypium hirsutum
  Clone ID: uC-gsflnu33B071g09b1
tctagaatatgaagttcattggctgttttctggtgtttcttgctattttaggcattgccttgcttaatgttgcagaaggagctggtgaatgtgggagatcatcccctgatagggaagcctggaagttagctccttgtgcaatggttgcacaagattctaacgctccagtttccagcagttgctgccaacaggtgaagaaaataggccagaatccgcgatgcctgtgcgccgtcatgctttccaacacggctaagagttctgggatcaagccggaaattgctatcactattccaaaacgctgcaacattggctgatcgtcctgttggttaccagtgtggagattacactttgccttgagcacgaaggctgaagtcatggttcccagtattcgtcgtttgctggattctgtgctttccgttagctagttcatctagctgatgaatgaaccgtgaaatctagctatttgaatgataaataaaagtttaaaacttcaat

SEQ ID NO: 20946 - DNA, 455 bp, Gossypium hirsutum
  unsure (1)..(455): unsure at all n locations
  Clone ID: uC-gsflnu33B071g10b1
caaaatccgaactctactttatggggctggagcttttatattctcctggttgctgggaaccttcttgatggtatcagtgattccacctattcctattcttaagggcccaaggagttttgaagtgctgacatcattgataacctatgtgctactctgggtttcatctacatatcttaagtagtgctaaagcaccaggttttcttattatagactcccaattttgaagtaatggataaccaaagattttcttggtagtagctcattgatcatgttattttagcttatgagagctgtgtcatatttctactttgggcattgatactaaagcatagtttgtggatgatttttttttgttgactggtaaaaaatgtaaaaccagttcaaagtaaagataggttgttgattttctgaattgtggtttcttatatgcttttacttcttgttgttttcccanc

SEQ ID NO: 20947 - DNA, 538 bp, Gossypium hirsutum
  Clone ID: uC-gsflnu33B071g11b1
tcggtgccatttcgtgggttaagggattttttgaattcgagacttctcacgctcgatgaccttacagaaagagaaaatgaccaagtgttacccaactgagagcgaggaataccagaagtcagttgaaaaggccaagaggaaggtcagaggtctcaacgatgagaagaactgtgctccactcatgctccgtttagcgtggcactcatatgcaacttttgatgttaagaccaagaccggaggttcattaggaaccatgaagcattctgctgagctgggacatgctgctaacaacggcctagatatcgacggcagacttatagggccgatcaggagcaggtccctaacctcacctacggtgacttctatcaccttgctggagtcaccgccggtgagattactggtggacctgaaaatccattccatcccggaagagaggacaagcctcacccccctactgagggctcgatttctgatgctacaagggtgatgatacttgaggaggtgtttagtgctcaacggtctgagtgacagcacatgt

SEQ ID NO: 20948 - DNA, 604 bp, Gossypium hirsutum
  Clone ID: uC-gsflnu33B071g12b1
tcgcccacgcgtccggtgcttctgaatcagttcctcagaaatcaatccatgaattcactgtcaagaatagcaaaggccaggacgtggaccttagcatgtacaaaggaaaggttctccttgtggttaatgttgcttctaaatgtgggtttacggattcaaattacacccagttgactgagctttacaacaaatacaaggacaaagggttggagatcttggcatttccttgcaatcagtttttgaagcaagaaccaggtaccagccaagaggcagaagagtttgcttgcacaagatacaaggctgaatatcctattttcaaaaagcttcgttgcaacgggccgaatacagaacccgtcttcaagttcttaaaagcaaagaaatctggtttcttgggatctaggataaagtggaacttcactaagtttttagttgataaggatggtaacgtcctctctcgctatagcccaaccaccacaccactggccatagagggtgacatcaagaaagcattgggagtggatacatgaaaatataggaggtggagggaaaatggaaactaagaacaatgtaaataggatgaaagcggtagcgtggcccataatat

SEQ ID NO: 20949 - DNA, 496 bp, Gossypium hirsutum
  Clone ID: uC-gsflnu33B071h01b1
gtgtttacgcgtacggactgtctttaaccaggggaattacactaaaatagaggggtgaatctatacaaaaaaaactaaccaaaatctatcttcatttcaatttggcactgaacccaaaaaaaccagaagtccctttctcagaaaagagatgggggggccccttgcgggagcccagattgtggggcgcgggctactaggtctatgtttattctgggtgcgtagcctggttcacacactatgggggcgtatatgcaaggcttggctggggaaacccgggcggtccccaatttaaaaccgtgtgtatgcgattgctcttttcacgcggtgcttacactcaaagggggcccgaccgttggtctttcccaacattgggcaaagcgtgagggggaagggaccgcgccttctggggggaactatgggggggggggggggggggatctgcccctgggaaccgttaaatttgcggagcgctaggggccggctcctttgggttttt

SEQ ID NO: 20950 - DNA, 491 bp, Gossypium hirsutum
  unsure (1)..(491): unsure at all n locations
  Clone ID: uC-gsflnu33B071h03b1
tatttccccgactttcctctctgcgtatcttcttcttttatgccttgtctgctgtttgaaggaggggtatggcttgggacggagagcaactgcagagagccaccaccttgagcacagccatacaatccaagtcacttctcttctgccctcctctatttgcagccccgcaaccaaagaattgaataaaaagtcatctttacgagttgtccacaagcatggtccatgctcccaactccatcgtcaagataaagcaaacatccccactgacgccgagatccttcgacaagatgaatcccgggtcaagtccattcacttgaaacttgccaggagctcaggctcgagcaatgtcgaccagattgatgcaaccaacctccctgcaaggatggtagcggttggggtcaggcattacgtagttactgtgggtctaggcaccccgaagaagatttaactctatattngatactggagtgacatcacatggcacaatgtca

SEQ ID NO: 20951 - DNA, 603 bp, Gossypium hirsutum
  Clone ID: uC-gsflnu33B071h04b1
ttttagaatgaagccaacaaggggcagagaagctgcaacaatgaaggacaagaaggaagcaaaaaagcctgctgagaacaaggtcgtcggtaagcgaaaagcggcgagccgggccgataagagtgaccgaaagcgcgcaaagaacatagcatcatcgaccaacaaggacccgaataaaccgaagagacccgccactgctttctttgtgtttatggaagagtttaggacaagttacaaacaagaacatcctaaagtgaaggctatctcagctgtgggcaaagcgggcggagagaaatggaagtcgatgtcgaatgcagaaaaggctccgtacaaagtgaaagcaacggaaaggaaatcagaatacgagaagctcatggcagcctacaacaagaaacaagaaagttcagatgatgaggaagaagccgagtccgaatcatcaaaggatgatgaagaaagtgaggacgatgattgaatccaggatggttttggattaggttctgtaaatgaaaccatgtttaaaaatactgtctttagcagcattgtatgatggtatgtttgcttgatatgtcgtgtgctcggttttcgatgtgaaagaaaacgcag

SEQ ID NO: 20952 - DNA, 338 bp, Gossypium hirsutum
  Clone ID: uC-gsflnu33B071h05b1
ttttcacgcgtccgcccacgcgtccgcccacgcgtccgcccacgcgtccgcccacgcgtccgagcaggccagttccattagcaatataattgcacaggccacaaagtaggttatgaccgagagtggttgcggattgccatttgtattggggttggttttggtgtctcatctgttgtgagaactctttctggattttagtttgagaacttaattgtatgtttatgaatgtagattcgggagccttttgtagaaatgatcacatataatgatcatattaattatgttgaagaaagaaatgcaagatggtgaggaatcgcgactaggacatacaataagtg

SEQ ID NO: 20953 - DNA, 589 bp, Gossypium hirsutum
  Clone ID: uC-gsflnu33B071h06b1
ttcacgcgtccggatggctactacccatttgctaatattgctacttggagtggtggctctcgccactccctcttttggtacctacgagtctcccaactatgggaagccccctgctcctgttcataatcctcctaagctgaaaccgccaccatatgaacataaacctccggtctatgaaccaccaaagaaggagaagcctgaacctaagccaccagtttatacacctccaaagaaagagaaacctgaaccgaaaccaccagtaaatgaacctccaaagaaggaaaagcctgagcctaaaccaccggtttatacaccaccaaagaaagaaaagcatgaacacaagccaccggtgtatgaaccaccaaagaaagaaaaacctgagcctaaccaccagtttatgcacctccaaagaaagaaaaaccagaacccaaaccaccagtttataagcctccaaagaagccatcagtgtatgagcctaagccaccaaagccaccggtttatgcaccaccaaagaaagagaagccagaacctaaaccaccagtatatgagtctcccaagaagccaccatatggtcactatccaggacacc

SEQ ID NO: 20954 - DNA, 591 bp, Gossypium hirsutum
  unsure (1)..(591): unsure at all n locations
  Clone ID: uC-gsflnu33B071h07b1
tttaaaacaaatcaactttcgataacctttgtcttaacctcaaatcgatctctgaatctatacaaaaaaaactaaccaaaatctatctccatttcaatttcgcactgaacccaaaaaaaccagagtccctttctcagaaaagagatggcaatgaaccatgcggcagcggtgaaggtggggttaggtttactaggtctatgtttattcggctacatagttggtccaccactatactggcatctcatggaaggcttggctgccgtcagccgtacttccaacacttgccccccgtgtctttgtgattgttcttctcagccacttctcacactccctgaaggactgagcaatgcttcctttgcagattgcgcaaagcatgacccggaagtgaccgaggatactgagaagaactctgcagaacttttaatggaggaactgaagctaagagaagctgaagctttggaaagtcagcgacgggccgacatggcattacttngaggctagangatagcatcacagtaccaaaaggaagcagacangtgcaattcangtatggatacatgtgaagaacangggagaaagccgaagcacact

SEQ ID NO: 20955 - DNA, 437 bp, Gossypium hirsutum
  unsure (1)..(437): unsure at all n locations
  Clone ID: uC-gsflnu33B071h08b1
tttcaaaaaagttgtggagaaaaaaatattacgtttgggaagcgagaaagtgcgagaaaatgagcggagcaggaaagaaagtagtagatgtggctttcaaagcaggaaagagcattgattgggaagggatggcgaagcttttggtctccgatgaggctcgcaaagagttcgccactcttcgtcgcactttcgatgaagttaactccactttacagaccaagttcagccaggaacctgagcctatcgattgggaatattatagaaaaggaatcggctcgcgattggtggatatgtacaaagaggcttatgagagcgtagagatccccaagtttgttgacacagtcactcctcaattcaaaccgaaatttgatgcattgttggttgaattgaaagaagcagaagagaattctttgaaagagtngagcgtttggagaaag

SEQ ID NO: 20956 - DNA, 527 bp, Gossypium hirsutum
  Clone ID: uC-gsflnu33B071h09b1
tttgcagaaaagaggggcaaacggcaggtcatgatcaggccatcctcaaaagtgatcatcaagttccttttggtcatgcagaagcacggttacattggagagtttgagtacgttgatgatcacagatctggtaaaattgtagttgaactgaacggaaggctgaacaagtgcggggtgatcagtcctcgcttcgacgtaggagtgaaggagatcgagggttggactgccaggctgcttccatcaagacagtttgggtacatagtgctgacaacatcagctggaataatggaccatgaagaagccagaagaaagaatgtaggtgggaaagtacttgggttcttctattgaggggatttcattagaattaaaacttttatgaattatgtttttttcctttaaacctcttagttagcaatgcctattttctaaattttggtactcatctatatgtatattgcttatgatgtttggagattttgaattgctgaatattcatcctaatatgagactccaataccattagcatt

SEQ ID NO: 20957 - DNA, 459 bp, Gossypium hirsutum
  Clone ID: uC-gsflnu33B071h11b1
tcgcccacgcgtccggtcccgacgtgcaagatggagatctttatatcaagaagagacgttccttacctggtgctaatgggaagcagcattctccaagaatccaaccatcattgggtgtaaaaggaaatgatagaaaatggcaaaggtgaaggcttttatgcgaagcaaccgtattaacatgttatcatggtaatcgacatttcggatcacaaaccagtgcagattgttggtctttactatctagttttatatatatacacacacacatatatatatacatattatcatgtataactttctgcatggatggtatgcttgtatgtttggttcaacagtgtattgtgtgatattattgctttcctgcaccaagtttttggaatgtcttttatgagtattggtcataaagtctttgaaactatcagacgtagatcagattataataacgttcatgcagtaagt

SEQ ID NO: 20958 - DNA, 600 bp, Gossypium hirsutum
  Clone ID: uC-gsflnu33B071h12b1
tcgccgggattgatatggtcatggttccttataacttcacagaatttattgatgacctaacctatcaggttaaaaacaatatcattccaatgagccggattgatgatgctgtaaagcgaatcttgagggttaaatttgtgatgggtctctttgagaatccaatggctgataacagcctggtcaaccaactcgggagtcaggaacatcgggagttggcaagggaagctgtgaggaaaagtctcgtcctactgaagaatggtgagtctgccgataagccattgttaccccttccaaagaaagcaactaagatactagttgctggcactcatgccgataacttgggctatcagtgtggaggctggaccattacatggcagggtcttggtggcaacgatctcacactggtacgactatcctcaggctgtcaaaatacagttgattcaagactcaagttgtatacagtgagaacctcgagcagggtttgttaaatctggcgaattctcttatgccattgtggttgtgggagaaccgtcgtacgcagaaacatatggtgacagcctgaatcttacatatcagagccgggtccaatacctattacat

SEQ ID NO: 20959 - DNA, 459 bp, Gossypium hirsutum
  Clone ID: uC-gsflnu33B072a01b1
gttttaaagccatggatggagcttggctatgtgtcgcttcaagacataagggagcaggagagattcgatgggtactaccacaaccagttcttggtggtgaacgattgcttgcacaggtacaagtttatggcaaaatggatattcttcttcgatgtggatgagtacatctttgtgcctcccaagaccacccttggttctgtgctcgattccctctccgactattctcagatcactattgagcagatgcctatgagcaacaagctttgccactctgttgatgctgctaaacgtcacaggagatgggggttcgagaagctggtatatagagatgtgaaaagaggaataaggagggaccggaagtacgcaattcaaccacgcaacgtgtatgcaacaggggttcacatgtcacagaacctaagggcaggggccaagaccacccacaagacggagggcaggatc

SEQ ID NO: 20960 - DNA, 434 bp, Gossypium hirsutum
  Clone ID: uC-gsflnu33B072a09b1
ttttacgcgtccgagtcaagaaaagaagacccagaagcaatggttctctctctgtcatcaacaggatgggaatgaagttttctttaggatcaaaagaaacactcaactgaagaagctcatgaatgcatattgtgatcgacaatctgtggatttcaactcgattgccttcttgttcgatggtcaccgcctgcgaggcgaacaaacttctaatgagctggaaatggaggatggtgatgagatcgatgttatgcttcaccaaactggtgacacaagcgcttgatgttgtcaactgtgtgaagattgggacattagtattggagcataaggatgagcgcgatttgcggctccatttgctgcagtttgctgaggttcgtgaggaggcttgttccaatttgttactgaatggtgcgtgtaactacctctataagttatct

SEQ ID NO: 20961 - DNA, 211 bp, Gossypium hirsutum
  Clone ID: uC-gsflnu33B072b06b1
gtttttcgtacgttttcactgtcttaagaagtggagggaagaaatgttagcctttgaagctatgaatcaccttaatgattatggtgttagtaaaggaaacaaccctttcggtcttaggcagcttgagctggaacggtgggagaacgcagacagagagcttgaactgggggctttttcttattgtttgccgcacctacaagtatatttattg

SEQ ID NO: 20962 - DNA, 459 bp, Gossypium hirsutum
  Clone ID: uC-gsflnu33B072f12b1
ttatggccataattgcagatttcatgcttgtgtatcttcctgctcctactgtttctctccggcctcctcttgcagtcagtgctggagctatttccaagttcttctatagctgccctgataatgctttccaggttgctcttcctggtacttcgtattcacttttgcagagattaggagcagtaatgcgtaacggcgcaaagctttttgcagtgggcaccacttcttcgctggttgggacagccatcacaaatgctttgattaatgctaggaaggccgttgataagacatcggcagctgaagttgaaaatgttcctatactatccaccagtgttgcctatggtgtatatatggcagtttcgagcaacctcaggtaccaagtgctggctggtgtaattgaacaacggattctggagcctttggtgcaccagcacaagcttatgttgagtgcaatatgctttg

SEQ ID NO: 20963 - DNA, 248 bp, Gossypium hirsutum
  Clone ID: uC-gsflnu33B073a12b1
ttgtttcaattccacatattgagatggcaacaggttattatattgcccgttcaaccccaactctgacccaatgtataatcccaacccaattcaaaattaatttattgtatatttgacccgaatctaattcgacttgttctttatcttaatagaataatatttctatattcattatattatttttgtaatgatatttatcaatcttttttttagggttaacttattgttagaacacaatattaaatata

SEQ ID NO: 20964 - DNA, 258 bp, Gossypium hirsutum
  Clone ID: uC-gsflnu33B073c06b1
tttattatctcaaagtgctttaagaagatatatgggatttatgtcctcaagtcttataaatacaaaaatgccgggtatagtttcttcaccctctgatatctaaggcaataatgaggttggttcagaaacacagctgcaaaatctcagttgagacatttattaggggatttgatccactgaatatgttgtatgatttgtgtaatgcttcttgtggtaatattaacaaaaaaacaaaactagtcttagttggaattttaa

SEQ ID NO: 20965 - DNA, 223 bp, Gossypium hirsutum
  Clone ID: uC-gsflnu33B073f11b1
actttcacgcgtccggaaaataaaagaagggtaattctaggagaaaaaaccgtaactataatcaactaggaataatgagctatactagtgattaaaaaaggagggatgagataatgacaatgtagatcgcccacataaaatataatccattatggaggaagaaaaagaggcatataatggcagcaaacatactagagactagagaaagggcaagactaagagt

SEQ ID NO: 20966 - DNA, 187 bp, Gossypium hirsutum
  Clone ID: uC-gsflnu33B073h05b1
tttttcgcgtccgaccacgctgttcgagcaaaagtggagcaaatagttctccatcttgtgataagattacacgcttctctagcccaagctatcattcactacccaatcttcgagtttctattctgcagcaaacaccgaaagaaatttttgtatctgccaaaaatttagagaagaagtcaccatgcaa

SEQ ID NO: 20967 - DNA, 99 bp, Gossypium hirsutum
  Clone ID: uC-gsflnu33B074a11b1
tcggtatatatagttgtgtgttgattaattaacttaaattccacaataggtgttcgcccctcatgcggacagatgttggtggtggatgataaaggaatc

SEQ ID NO: 20968 - DNA, 317 bp, Gossypium hirsutum
  Clone ID: uC-gsflnu33B074b08b1
ggcttatggcgacgtaatgacttgtaccgtttgttaactaaaaaataagaagaagatttgctagttggatacaattagaagatgatatgtagtgagaattctttagctccacatggatgttgggtggttctaaggcgatttaggatactgttttttcttgacctgaaagtttatgttttatcattttttttgagggttcatgtcacatgaatcaatcactttctttgaatttgccttaacacattcttggaaaagactctgggatttgtaagacccaaatgaaagtgttttattctcttttttggtgccctaaaaat

SEQ ID NO: 20969 - DNA, 443 bp, Gossypium hirsutum
  Clone ID: uC-gsflnu33B074c05b1
gcttttaatacatggaaagatatcatcattcctggaaatgttgatgatgggatgacgaaaacaggggctactgttttccagccgttgcctctatctaagagaaagtatttggcaaactatttaggccgggcgcaaaaaaaggttggtcgtcttaagctgattgagcttgcaaagcaatatccagataagttggaatgtccagagttacagttcagtggtcctaacaaattgggaagagtggaatattttcagcacctgggcaattccaaattttgcctcgcaccacgtggagagtcatcttggacccttcgtttttatgagtcgttatttgtggaatgtgttccagtcatcttatcagaatcagtcgaattaccttttcaaaatgtaattgactacacagagatttcaatcaaaatggccattcacaataatagggcctgagc

SEQ ID NO: 20970 - DNA, 408 bp, Gossypium hirsutum
  Clone ID: uC-gsflnu33B074d11b1
agtggcgggagtgcacggagtgatgggatgtctggccctggcaaggccgttactcaagtgctggctttgcctgccccggatggcacagtgcagccagaaggacagcaggatccatatgccgaatcgcttacagggccaccgccttcgaatgagcagatagcggacatggagcagaagcagcagctactggtgcaggagcaacagctatggaatcaatacggaagggatggaatgcaagggcaatcaagcttggccaagatcacaggaaggaccgtgtactatggtgctgctgcacaactggtaatgatgcacgatgggatgccacaagggaatggtatggggcaggtaggacggtactagtatgccgcctactaaaatacacatctgaatcatggctcaacggtataa

SEQ ID NO: 20971 - DNA, 441 bp, Gossypium hirsutum
  Clone ID: uC-gsflnu33B074f05b1
tcgaacgcccacccgcacttaggagaagactgaatttgctccaggctgcatgagcggatctgactgcggctgacgagacagctggtactgcggctggaacggaagccttatatattcatagatgacaacctgccctcagaccatgatttccggaggtgcgcctgaggaaatcaccttatgcggaccacacatgagcagctctgaagttatgacatggatgcaagtggggatcaaactgttttagtgatccatgcaacttgtgagagagcttgctgaaagcactacaattatgagaaaaaatgaggcgggagaagtaacaggcctctgcaatgatatattgtcaaggatggatgcctgcaagggctataattatggctctgtctgtgcctagtgtaatacaagctttgtttgtggtgaaaataatgtataagccatttggtt

SEQ ID NO: 20972 - DNA, 465 bp, Gossypium hirsutum
  Clone ID: uC-gsflnu33B074g02b1
aaacaaaaaagggaagaattttggtgactggtgattcgtgagtattgtaaacagctgcagcagcaatggagctgttctacttcgtggtgttcggggcattgggagcggtggtggcagcattagagctaagcaagaacagcaaagatcgaatcaacacgtcctctgctttcaattccttcaagaacaattatcttgtcgtttattctctcatgatggctggagactggttgcagggtccgtatgtttactatctttacagtacatatgggttcggaaaaggtgaaattggacaactttttattgccggatttgggtcctctatgttgttcgggacaattgtcggatctttagcagacaaacagggccgaaggagggcttgtgttacttacctgcataacttacatgcttagttgcataacgaaacattttctcaatacataattttgatgtaggtcggttctggga

SEQ ID NO: 20973 - DNA, 381 bp, Gossypium hirsutum
  Clone ID: uC-gsflnu33B075a09b1
tataaatttggcaaactaaataataaaagtatcatgaaaagactggtttcgctaggctgccaagttatgtacatatgtttgatggtatgattttcaggatataattgtaatttcagagttaggcgagctttgcataaaacaaaataaaaaaaaaaaacacaataataaaaaaaaataaaaaagggctgcctttattagagagaaccatcttttctatctcctaagcatgcaactaccattttctttctttatgttattcctaaatttaatttccatttccttcttttctatatattattcttcttgcaaatccttttcatttattctcatcttatttgatattccttctattcctcttttttcctcttttaattaatcaat

SEQ ID NO: 20974 - DNA, 507 bp, Gossypium hirsutum
  Clone ID: uC-gsflnu33B075c03b1
tctacgcgtccgcgtggctttcctatcttcatttcattgctctctccgacgaaagaaaccagagaaaaatgaccaagtgttacccaaccgttagcgaggagtaccaaaacgccgttcaaaaggctaagaggaagctaagaggtctcatcgctgagaagaactgtgctccactcatgctccgtctagcgtggcactcagctggaacttttgatgtcaagaccaagaccggaggtccattcggaaccatgaagcaacctgctgagctcgctcatgctgctaacaacggtctcgatattgcagtcaggcttctcgagccgatcaaggagcagttccctatcctttcatacgctgacttctatcagcttgctggtgttgttgctgttgagatcaccggtgggccttaagtttcattccatcctggaagagaggacaagccttacccaccacctgagggtcgtcttcccaatgctactgagggagctgatcacttgacgcaagtgttttagt

SEQ ID NO: 20975 - DNA, 382 bp, Gossypium hirsutum
  Clone ID: uC-gsflnu33B075e06b1
ctgtcgcgtgggttctcatcgtcggaccgatattccgatctcaccgacgactcatcattactcgttcaagccatggaactgtctggaccaaggtgaagcagaaccaaccccttataaaacgtgactataaatcttttcttgttttctttacggagatttcagtgagacttataaaattatagctaaaactcctatagctgcatactagcgggatagcataagagcaaagggctttgatttttttgggtttgtttgattactacaagtgtacagattatgtgcctaagaagacattattgaagatctgagaggactgagtgtggattaatagcgagagacggaacttctttcaatggggggcttgggatggtaattttaaaaa

SEQ ID NO: 20976 - DNA, 129 bp, Gossypium hirsutum
  unsure (1)..(129): unsure at all n locations
  Clone ID: uC-gsflnu33B076c02b1
cctacatcattttcttttcactccaaaactgtgtgattgattagatatcattgcacgaggaacacagagttgagggggacggtcattaanggtgctaatgccttgatgtctaattagtgacgcgcatga

SEQ ID NO: 20977 - DNA, 268 bp, Gossypium hirsutum
  Clone ID: uC-gsflnu33B076c11b1
gatggtgactcgagggccgacgcgtatgcgagggaggactgtgggacaccaatggcattagacaacacgtactacaggaacatactggacaacaagggtttgccgattgcggatcaccaactggcggacgacaaaaggaccagaccttatgcgaagaaaatggccaagagccaagactatttcttcaaggagttctcaagggccattactctcctctttgagaacaatcctctcactggtagcaagggtgagatcaggaagctatgca

SEQ ID NO: 20978 - DNA, 420 bp, Gossypium hirsutum
  Clone ID: uC-gsflnu33B076e05b1
gcgggggccgcgccggagaatctgggggaccacacgccgtcttgacgccggcaccaagaaggaggcgagggcgaacatcagacagacgcaccagaggggacacaaggcatacaggaggcagaaagcgaaacagacagagagtgagagaggacatggctcggaccctgcaggaagaattctcgcagctagctgcggcagaagctgacgaaatgtctcatgctggggaagagcaggcgcaagcatcctgtgaacctcatgattggcttactccttcaacaacagactactgttattcaggctatgaatatggccgggatgaatccgatgattcggtgccacatagatcatgctctagccctagccccagtgattcagaggaatatcctggccctttggagcagaccgaaggaaaaataactc

SEQ ID NO: 20979 - DNA, 534 bp, Gossypium hirsutum
  Clone ID: uC-gsflnu33B078a02b1
cctactcgttcggcagtatctcactgcttctaatggcctcagatttgatggccaaaatctttatggcaatggctttcacggagctcagcctacccaaagctgtgcgttttaaagtgatctaacttaagacattaaatgtatgagtatgtgagacagacgtaatctatgggattgcatgcatcaacctcaattctaatgatgatgcgaagtgcttttttatagccatgggagcctatcaaccatatcatttatcattaacggaaccagcacgaggtcaggtccatggtttccgtttgtcactgtggtatgagcaccttggcatgcttgatgacacattcctcgcaccagaaagtgaagagtgtgtcaggaaggtgaatcacgttgctgacaaatcttgggatctctattcaagtgagtcacttgagcgagacttgcctggacacctacttccgttccccatcggtgtttctagtgatggatctgtcactgaattggctggcatcgagttcttccctgacacaaagcttgtgttct

SEQ ID NO: 20980 - DNA, 526 bp, Gossypium hirsutum
  Clone ID: uC-gsflnu33B078a03b1
ctttcttgttcgggaatttcgtacgggttcctgcgggcagggtgataattgagagtatgcacatgccacatttgagtgctgaattcatcctgctcaatgtcgctctcacacatgcgaggtagagacatatcgcaccaactggtattgattatgacctcaccatcacggggagcttctgtacatggtgtgcttaaaaagggtcagccgtggctctttcaacaagatatgcaggtgcatggtccttcttatacgtgggtgctgggagcccacgtgcgcttggctctgcatctatgatgatacctgcgacataacaccacccttgacccgtaccggtgccacttctcctatgggtggagctatgtggcctaatgagtctaacatcttgcctactactttgcagctttctggtagtaagttgaaagctgcgttcagtgcctggcatatggatctagacatggaactatttggtttggaaagtcatgatctggaccagcacacgcagctaattgatgagatatctgggttt

SEQ ID NO: 20981 - DNA, 547 bp, Gossypium hirsutum
  Clone ID: uC-gsflnu33B078a06b1
gctctcaaatggtttctcagttcggcatttactcaagtttttggccataccgatggcggtaacttgcatgccaaggcagtggtatcgtgcccaaacgaaggacttatcggttgcaaggaaatggaaagagggattaccagcatcaaaacctgcaaggaagactaccctaatggcttccaaatgccagttcattatcctcgatactcgaaggccgattacgagaagatggaagaatggaggatcgatatgcagttgaaggaatatggattcagctttaatggtggcaccgtcgatgagaaaagggcttttgccatgggagcttttctttggcctgaccaactttaagtcacatatatacatgtatgtagattatgtttgattggtagattgtgtgattaggaagagctagcaaaagggaagcttttatttatgctctggtgatgttgaggtgtagtaattaaccatgcctaagcgtgatttgaatgacattatgtgttaattagctagtcttaataagctgttatatatatattccttccttagagaa

SEQ ID NO: 20982 - DNA, 538 bp, Gossypium hirsutum
  Clone ID: uC-gsflnu33B078a07b1
tgatattacctgttttgagggtttattcatttgtagccatgaaattcagaagcttttgtttttgcatcccaggatcaaagcaagaagattcagacagttcttctaacaaagcaaaatcccataaaaagtccgacaaaagtgggaaaaaggaagggaatgtggatgatgctgattatcagggtgccactactactactacggcagccagcagtgatgctggaatggctgctgctgtagcagtgggtgccactacagcacatgcctccgctgtggaatgaagtggttgcgatggttgtcatgcaggtggaggtggtggcggctgatagccggacactatttcaaaaaagctggttcagtttttggcctttggcgttcttcatcatattgatttcagaatctttctttcatcttgcatgacagatgcttgtttttttcatctttatatttttggtgttctttttttcccccgagtctaagttgtggattgggattactggtttttattttcagttgaacgtgtaatcgttcttgtttcccg

SEQ ID NO: 20983 - DNA, 489 bp, Gossypium hirsutum
  Clone ID: uC-gsflnu33B078a08b1
ttatttttctgccttgggaaccgagaggttaagaagagtggagaatatgaaccttctgaaagaccagaccctgatacagattatgccagagctcaggaggcccgtcgtttcatgatctatgttcatgcaaaaatgatgattgttgatgatgaatacataataattgggtctgccaacatcaaccagcgatccatggatggtgctagagactctgaaatagccatgggagcctatcaaccatatcatttatcattaagggaaccagcacgaggtcaggtccatggtttccgtttgtcactgtggtatgagcaccttggcatgcttgatgacacattcctcgcaccagaaagtgaagagtgtgtcaggaaggtgaatcacgttgctgacaaatattgggatctctattcaagtgagtcacttgagcgagacttgcctggacacctactccgctaccccatcggtgtttctagtgatggatctgtcactgaa

SEQ ID NO: 20984 - DNA, 406 bp, Gossypium hirsutum
  Clone ID: uC-gsflnu33B078b02b1
gttgttttgactaacatgtacaggagtgaaaatgagggttaaataatgagaggtgaaatttactgatagatgaatgacaaacacctagaggagcattcgctccggtttgaagaattcatcaagagcggaaatgaggaggaaactggcaaggaaacggtagcgagaggaaatgcaattgtgacgagtctaaaccggataataatgtaaggaagtatactatatgaggacaacacttccgatgggtgcaactataaggctgattactcaaacattcggtgtgatggctacacattcgacaccacggcgggacatactactggggggactgcttttgatgaccgtgatagatgtgcatggatggcatgaccatctggatgatggatatgatagcattctatagatgggc

SEQ ID NO: 20985 - DNA, 520 bp, Gossypium hirsutum
  Clone ID: uC-gsflnu33B078b03b1
cttttagcttacagcttccattgtttttcagtagtgaagagctaaaaaagaagggaaaccaatggaggggaaagaagaagatgttagattgggagcgaacaagttctcatagaggcaacctattgggacagcagcccagtcccaagatgataaggattacactgagccacccccagcacccttgtttgagcccagtgagttgacttcatggtcgttttaccgagctggaatcgctgagttcgttgctactttcctattcttgtacatctcggtgttgactgtgatgggagtccttaaggacaaaaccaagtgtacaactgttgggattcaagggattgcttgggcttttggtggaatgatctttgctcttgtttactgcactgctgggatctcaggtggtcatatcaatccagcggtgacatttgggctgttcttgggaaggaaattgtcgttgacaagggcaatatactacatggtgatgcagtgcttgcgagccatatgtggggctggtgtggttaaa

SEQ ID NO: 20986 - DNA, 510 bp, Gossypium hirsutum
  Clone ID: uC-gsflnu33B078b05b1
gtttctcttttcttcaagcgggtgagagagaagaagaaaatcctaagaggccaaagatgccagctggtcacggtttacgttctcgaacaagggatttgttcgccagaccctttagaaagaagggttacattcccttgtctacttacctcaggacctacaagatcggcgactacgtcgacgtcaaggtaaacggtgccgttcacaagggtatgccccacatgttctaccatggtcgtactggtcgagtttggaatgtcacaaaacgtgccatcggtgtcgaagtcaacaagcaggtgggaaacaggattatcaggaagaggattcatgtacgtgttgagcatgtacagccttcgaggtgcgctgaggaattcaagctcaggaaggtgaagaatgatcaactcatggcagaggctaaagcaaagggtgaggtcattagcacaaaaaggcagccagaagggcctagaccttgattcatggttgatggtgctacaacttgaacttgtacgccca

SEQ ID NO: 20987 - DNA, 461 bp, Gossypium hirsutum
  Clone ID: uC-gsflnu33B078b06b1
gtttattgaattcatgaagggaaaggaggatacaatcgatgtgtttgtggggacagtgacagataatattaaggcttatgaggttactgctttgcaggccactgttcttaggcttactgagactgctagagctaggatcgagaaagctgtggtagaatgcttgactctagatcagcttgctatgagggctcctttgacgtcaaaacacgatactgctgacagtgacaaagaaattcggtgaggcacttaaacactaatgatactgctcccggtgtacctcacagccacaccaagccatatgtgcgctcgaagggacggaagaatgagagggcttgaggaagatggaacagcaggggattgagagcttaatattactttactacttgatatagagggctggctgttatgtaggttttctatgtgagatgttcactggcttatgcctgcctctcattcatgga

SEQ ID NO: 20988 - DNA, 545 bp, Gossypium hirsutum
  Clone ID: uC-gsflnu33B078b07b1
ttgtaataattgaggtaatgattttttctttttctttttctttatattttcattttagtatttctttatattaaaaaatatcattccatcccactgcctccttattaaagaaaaagaagagtggcagcctatttacaaagcaattaatccttgtaatatagtatttgcactcattagcctgtccctcatggaatcccatcttgagaaacaaaatggagatgtgcttcaaaaatctttcaaagagatgatttctactctccctaaaaagagttgttggggtcttcctgaagatcaatatcaatatcaaagtttttggttcagcccgccttttctacaaggagcattgtcggctcaacaacaattccaagctcagccaactgatatcatcctttgtagctttccaagaacaggcacagcctggttaaaatccctcactttcgccactattacaagaacttcatacaatgattccaccacccctttactttccaagatgcctcatgatgttgtgccttacatggagtttgatcatgcccagatttcca

SEQ ID NO: 20989 - DNA, 286 bp, Gossypium hirsutum
  Clone ID: uC-gsflnu33B078b12b1
tttacacgggcggatacagtcggtgcgcaaggggccgatcatgcggatcatattgtgcctcctgaggctggaacagctataaaacttattcaaagacaggctcatttgattgactagcggtgggaaaacaaccaagagagcgtggaaacctgcacgttacacgacgtgatgtgcttggtgaacattccactgataacaggtatccgagttaagtattgggatgaagttttgctggacacaaacaaaaaaacggtctgacactctaaaggaacccagcttactgacg

SEQ ID NO: 20990 - DNA, 207 bp, Gossypium hirsutum
  Clone ID: uC-gsflnu33B078c02b1
atgtttatcactcgcaatgtgaaacagtttgtgaccattgtacagtgataaaagattctggaaacttgaataaggtttaaacttgtagtaagtgagaatcttgttggtgataatgacaatagcattggtttctaaaaaaaaaaaaaaaaaaaaaaccccgacttctggaagggatgcaatttattagataaaaggaaaacacaaact

SEQ ID NO: 20991 - DNA, 507 bp, Gossypium hirsutum
  unsure (1)..(507): unsure at all n locations
  Clone ID: uC-gsflnu33B078c05b1
cttgttatgtttggtgaaacaaagcccagtggcactgagcttcttcttggtgttttgattccaaaactcagctccaaaacaatcaaacaagccgtgggagttgtgggttgcattattatgcctcacaatgtgttcttgcactctgctctcgtccaatcacgagaaatcgatcacacgaagaaaggccgagttcaagaagctctcaattattactcgatagaatctgctgctgcgcttttaatttcgtttataatcaatctgtttgtcactactgtctttgccaaggcattttatggcacagaagtagccagtactattggtcttgtgaatgcagggcagtatcttcaagacaaatatggaggcgggttgttcccgattttatacatttgggctatcgggttgttagcagccggacaaagtagcactattactggcacttatgctgggcagtttatcatgggagggttcttgaaactgaagttgaaaaatgctaagagcatngatcac

SEQ ID NO: 20992 - DNA, 475 bp, Gossypium hirsutum
  Clone ID: uC-gsflnu33B078c06b1
attatttcagggaaagaaaagcagcgtaatgggtgaagaagtgaaggtttttggatactgggcaagcccttacagctacagggcagagcttgctttgaagttgaaaggtgtttcttatgagtacataaatgaggatatctttggcaacaagagcgatttgcttttgaaatacaatccggttcataagaaagtcccggttcttcttcacaacgggaaaccaattgtagagtctcttgttatacttgaatacattgaggaaacttggaagcataatccctatttgccacaagatccttatgacaaagctaccgctcgattctggatcaagttcatcgacgaaaagtgctttcctaccctttggctagctgcatggagcgccgagaatgagcgagaaaaagtgacgaatgaagcttgcgagtatctgaaaacgcttgaaagtgcgcttaatggaaagaaattctttggtggagaaacc

SEQ ID NO: 20993 - DNA, 563 bp, Gossypium hirsutum
  Clone ID: uC-gsflnu33B078c12b1
tttacgcgtccgtatacatccggtgggcagtttaccataccaatagtcattcgtgggcctggtggtgttggacgtcaactaggggctgagcattctcaacgtcttgagtcatactttcagtcaatccctggaatccaaatggttgcatgctccaccccatacaatgccaagggcttaatgaaggctgcaatcagaagtgagaaccctgttatcttttttgagcatgttttgctttacaacctcaaggagagaatcccagacgaggattatatctgtaatcttgaggaagctgagatggtaaggcctggagaacatgtcaccattctaacctattcaaggatgaggtatcatgtaatgcaggcggctaaaacattggtgaacaagggttatgatcccgaagtaattgatattaggtctttgaaaccatttgatctttacactattgggaactcagttaagaaaacacatcgtgttcttattgtggaggagtgcatgcggactggtggtattggtgctagcttgatagctgcgattaccgagaatatcaacgactacttggatgc

SEQ ID NO: 20994 - DNA, 490 bp, Gossypium hirsutum
  Clone ID: uC-gsflnu33B078d05b1
cctactcgtccgcccacgcgtccgcggacgcgtgggcagatttcagcaaagagtaaacgcctcgtttccgcaaaaaccctagagagaacaaaatggcggaaagagctccaatcgagtccgtacaatgtttcggtcggaagaagacagcggtagccgtaacctattgcaagagaggccgcggtctgatcaagatcaacggttgtcccatcgagttagttgagccggagatcctccgtttcaaggccgtggagcctatccttctcctcggtcgccaacgtttcgccggcgtcgacatgaggattcgagtcaaaggtggaggtcacacatctcagatctacgctatccgtcaaagcattgccaaagccctcgttgctttttaccagaattacgttgacgagcaaagcaagaaggagattaaggatattttggtcaggtacgataggactttgctggtggctgatccgaggaggtgcgaaccgaagaagttcgt

SEQ ID NO: 20995 - DNA, 531 bp, Gossypium hirsutum
  unsure (1)..(531): unsure at all n locations
  Clone ID: uC-gsflnu33B078d09b1
tttacgcgtccgcttgcattaagtctcaaagatatcactgcaagaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaaaagcccaccctcggcacctgaacagccaggcacttgccccagagatgcactgaaactaggcgtttgtgctgatttgttgggctcagtgcgcgttgttgttggaccgtcgaggaccaaatgctgctctctcatttcgggtttggctgatctcgatgctgctgtttgcctttgcactgctattaaagctaatgtgttgggggttaacctaaacgttcctgtttcattgtctttgctcctcaattcctgcgaaaagcaaatgcctgctggttacaaatgtgcttaagctcatttccactgtttcctcagcaatgtttgggtttttactttacgtgttctttntttttc

SEQ ID NO: 20996 - DNA, 483 bp, Gossypium hirsutum
  Clone ID: uC-gsflnu33B078d11b1
tgatcgtttattttttgctttcttatcgacgccatggcacctaacggggtcgtttccgacaagagttcaatcgtgagtttcggtgagatgctcatcgacttcgtccccaccgtctccggcgtttctttagctgaagctccaggcttcctcaaagcccccggtggagccccagccaacgtggcgattgccgtctcaagactaggcagtaaagcatccttcatcggaaaactcggcgacgatgagttcggtcacatgcttgccgatattctcaagcaaaacggagtctctggtgacgggatcttatttgaccaaggtgctaggaccgctcttgccttcgtaactctacgcgccgacggagagcgtgagttcatgttttataggaatcccagtgctgacatgctgttgacgccggaggaattgaatcttgatcttataagatccgccaaagtattccactacggatcaataagtttgatcgtagag

SEQ ID NO: 20997 - DNA, 474 bp, Gossypium hirsutum
  Clone ID: uC-gsflnu33B078d12b1
tttacgcgtccgactctacaccgtagaccccgtttgagtcactggatatatctgccactacaatgtccacagcatatattacgaactggacgattcaacccagataagaccggccgtgcgaacagatctggctttatgctgaactgtttacataatgacaagctttttcggatttcttctatttggtgacgccacaatggatgatgtgcttgccaactttgataccaaccttggcgtcccctatagttccctgcttaatgatgctgtccgtgtcagctatgctgctcacctcacgctcgtataccccattgtcttctatccactgcgactcaacatggagggggtcctcttaccttattcaaggcctctagctcagtctaatacaaggactgcttgcattactgccggactcgagcaggtatcttgttgggtgcgaatttcataccgagcatctgggatgcttttccagttgct

SEQ ID NO: 20998 - DNA, 478 bp, Gossypium hirsutum
  Clone ID: uC-gsflnu33B078e01b1
catgagttttggcctaaggaatttcaggtacattgagaccatcaaagaagctctttaaagggaatgctctggagtaggttcttgagctgatatccttgttctgtctgctagagacggcatcgtttcgttgtgaggcccttacattcctctcaaaactggaagaagagacggtagaaggagcagagcagatgttgactgggagaatcttacggaccacaatgagaccatctctggcgttctcgacaggtttgccgccttgggtattgacacccctggagtcgctgccctcctaggagctcacagtgtcggcagaactcactgggcgaagctggtgcatacgttgtacccagaggttgaccctgccctcagccccgaccatgttccacacatgctccaataatgccctgatcaaatgccaaaccccaaggccgttcaatatgtgagaaacgatcgtgggacacccatggttttggacaac

SEQ ID NO: 20999 - DNA, 435 bp, Gossypium hirsutum
  unsure (1)..(435): unsure at all n locations
  Clone ID: uC-gsflnu33B078f03b1
cacgcggtttagtttctactgaatcaggacatggatgcaagtgtggatcaaactgctcttgtgatccatgcaactgttgaaaagcttgatgaaagccctagattatgaaaaaagaaagcagcaaaataacaggcctctgtaatgatttattttcaaggatgaatgcctgcaaggtctatgactataattatgtctctgtctgtgtcttgtgtaatagaagctttgtttgtggtgaaaataatgtataagccagttggttgggagcaaattttccttttgtccaaaggattttttgctgctcattcatggtgacttggtttatggttttatctgttgttaaaatcttataaaaatatatatcgattgctgctcttggtttgtatcaaannggacgaaaaaaaaaaaaatttcttcccgtacccctctatggaggtt

SEQ ID NO: 21000 - DNA, 539 bp, Gossypium hirsutum
  unsure (1)..(539): unsure at all n locations
  Clone ID: uC-gsflnu33B078f04b1
aatcatttatccgaagggaatcccaatttcttcgcttttcatcttctctcgcttccatttctccgtttttcccctccggcaatggctatcgattctgattctttcaaacaatcacttctccctagcttcctttactcttctgctcccaactctttctctctggatcgactcctcaacgccaacagccctgctttctctgcttcgcgctccactatacccgatgctcctgcggcctcttcctcgccatcgatcaaggcgagaactttcatgatcccctcccccaatgagcccgggaagaagatcgagatgtattcgcctcagttctacgctgcttgtacctttggcggtatccttagctgtggtctcactcacatggccgttactcctcttgacctcgtcaagtgtaatatgcagattgaccctgcaaagtacaaaagtatctcatctggtttcggagttctattaaaggagcaaggagtgaggngcttcttccgttgttgggttcctacccttcttgttacagcgcacagggtgcttgc

SEQ ID NO: 21001 - DNA, 462 bp, Gossypium hirsutum
  Clone ID: uC-gsflnu33B078f12b1
ttatgttcttagaaatggagaagatctgctgcatcggtgctggttatgctggtgggccaacaatggctgtcatttcattgaagtgccctgaaattgaagtggctgtcgtgggattagattaatgtaagtcaagttgaattgataataggctacatcttactcaaaatgttgtagggttaaaggtcgagttgtgcaggttgctggaagagaaaagatcagctgatctaagctcatggacatgagcttcctcgctatggactcgaagttggccttacaaattatgcagcagctgattgtgttggactccttttggctcgccgaacactgaagcagctggagatggatgctgaatacaagggcaatgttggcgtatgcattagccctggattctgaggtgcgtagattgactactatttattcatgctttttgcattatataaacacccctgtttcaatgtacta

SEQ ID NO: 21002 - DNA, 545 bp, Gossypium hirsutum
  unsure (1)..(545): unsure at all n locations
  Clone ID: uC-gsflnu33B078g11b1
tttttcgcgtccgcccacgcgtccgcatcttttgggcaatcaattttgtaagcaagtatggctaaggacgttgaggttggtggtgagttccaagccaaggactaccatgatcctccaccagctccattagtggacggggaggagttgacaaagtggtcattttatagggctgtaatagccgagtttattgccacgctcttatttttatacatcactgtgttgacagtgatcggatacaagagtcaggttgaccctgataagggcagtgacgaatgcggtggtgttggcattcttggcattgcttgggcttttggtgggatgatctttatccttgtttactgcactgctggtatctctggaggacacatcaacccagcagtgacctttgggcttttcttggctaggaaggtgtccttagttcgagccatattttatatggctgctcaatgtttgngagccatatgtggatgtgggctagtgaaggcattccanangtcatattacaacatgtatggaggaggagccaacagcctcgctgatggata

SEQ ID NO: 21003 - DNA, 304 bp, Gossypium hirsutum
  unsure (1)..(304): unsure at all n locations
  Clone ID: uC-gsflnu33B078h02b1
nttggatatgttagcagagangacatcgngggagggagctaaaaattgcctttttgagggccaaacccatagaagcaccagcctttgtctaggacacaatattaaagagttcgacatgacctggatggagatatgtagcactcctgacgcagaaaaatgcgcagaaaaagattggactttttggaggtgcgtgcagaatactccaaattcggtagaagcagatagtgaaccagcgacagttgttggatcttcgaatgtgccggagacacttgacgggcctgcaaaatttcaaatggtgggacgc

SEQ ID NO: 21004 - DNA, 548 bp, Gossypium hirsutum
  Clone ID: uC-gsflnu33B078h10b1
tcttttctccaaacatgtattctctaaaatcatatgttttggttgtaagcttaatctttattccctttttggctaacaattttcttgtttttgttaactccataacttcttcgtcttcttattcttcttcgtcgggtaatcaatacaccacttttttcaacgctatatcttcttccaccaatcccaaggcttccttaaactccggtaagaaccaaacgacgtcgtctctgatatcatccagcttctgcgacgtatgggacgtgacctgctctgggaggtgttgggcctggcccgggagcccgacaacgtcgagtggattaaagggttgagaaggaagatacatgaaaaccctgagctagcttttgaagagtacgaaaccagtaaactcgttcgatccgagttggaccgtatggatattgaatataggtaccctttagccaaaacgggtattcgggcttggattggaaccggtggcccgccctttgttgccatccgagctgacatggatgcccttcctatacaggaagctgtagaatggaagcataaaa

SEQ ID NO: 21005 - DNA, 504 bp, Gossypium hirsutum
  Clone ID: uC-gsflnu33B078h12b1
tttatgtgttctttttagagtttgatcacaccagatattacaatgggttcaatcggtgaaactcaaatgacacccacccaagtctcagatgaggaagccaacttattcgctatgcaacttgccagtgcatcagttctccccatggtcctcaaatcagccattgaacttgacttgctggagatcatggccaaagctggtccaggtgctttcttgtccccaaaagaagtggcttgcaagctccacaccaccaaccctgatgcacccgtcatgctggaccgtatcttgcgtctcctggctagctacaacgtcctcacttgctgcttgcgtacccttcctgatggcaaagtggaaagactctatggccttggccctgtctgcaaattcttgaccaagaacgaagatggtgtcactctttccgcccttagtctcatgaatcaagaacaggtccttatggagagctggtactacttgaaagatgctgtgcttgatggtggaatttcattc

SEQ ID NO: 21006 - DNA, 398 bp, Gossypium hirsutum
  Clone ID: uC-gsflnu33B079e07b1
tacatcactggctgcaacaaggatcacgcagggtctgtttcaacaaaggaaggcattgcccaccagactatttttggacatgaaggtggagccggtggcgctgtttacaggccattatgtggcgggggctcatgctccggcccctactactaccttagatgccaccgcattcgagccgacggcgtttgcttcccttgtcggtcttgcgtttggtctcctgtcttaaaacgggtgaaccgtggccgacctggataacatactcaagatgtaatgcttgagggctacacctgccaagaagctgattgatccacgggcgcatgtatgtgcttgggggaaagggatcactgctaggcctgctggggctgaggtcctcggtttgcaaaaacaatgtaaggttt

SEQ ID NO: 21007 - DNA, 428 bp, Gossypium hirsutum
  Clone ID: uC-gsflnu33B079f04b1
taccaggttcaactgtttatggtgggttgactggtgctggtgcggcgggtgggttgggtgctgcaagtggagggtcttcattgtatagaatgccgccgagttcagctgggatgccaactggtggttatccagagactgctcattatagcttgtcttcctcggctgctttccctagtcagctccaccaaggggctgggacatcccctgcgccaagagttccacccggtgcaatgtatcccaatgggccaccgttctactgaggtttatgacagcttgttgggcgcagacgctttttgtggttctggtgattgcctgaatgcagactatatatactctggctcgatgaatgcattagctgggctcttacagccacttctcttgatttgctactttaagatgtttgcttctgagtgctgggtggcaaacat

SEQ ID NO: 21008 - DNA, 506 bp, Gossypium hirsutum
  Clone ID: uC-gsflnu33B079g01b1
atcatcgcgtccgcccacgcgtccgtgatgagcccatggttatccagaatagccgctgggcgagccttccgccagagctgttgcgtgatgtgatcaagagattggaagcgagtgagagcaactggcctgctcgcaagcatgttgttgcttgtgctgcagtatgcaggtcatggagggaaatgtgcaaagaaattgttagatgtcccgagttctccgggaaaatcacctttccagtttctctgaagcagcctgggtcaagggatggaaccattcaatgcttcattaagagagacaaatctaatttaacttatcaccttttcctttgccttagtcctgctttgcttgttgaaaatgggaagtttcttctttctgcaaaacggacccgtagaactacttgcacagagtatgtaatctctatggatgcagataacatatccagatctagcagcacatacattgggaaactcaggtccaacttttttggtccaaattcatatttatgacac

SEQ ID NO: 21009 - DNA, 538 bp, Gossypium hirsutum
  Clone ID: uC-gsflnu33B079g10b1
tagatctgagagcaaggtacgttactctttctcctttttatgcttttttgaataataaaaaaaaaactaaagcaaaagaatggggaaaaatgaaaggaaacttgctccttactttcaatcactgtttttcgtattatttcaatggaagttacagaatctcttctcctttttttacaaaaatgaaatggctttatatatagcttgaaaaagaagaaaaaatagatcaaatatagttgctattttgctgttttttttcttcggactcttttagtccgttttgcaagcgaacgtggtggaaacggcacgcgtggaggccgaaacttgcggcgactggagactgctggggtgtttgagggcggcggctacttgctgctactagggttttctgctcttatttaagtattgggcaatttagtgattgggctagggctaaatgtttgggcttgtttgttggtctgggcccgggcatatttgggcttgtacaccccaagcttaagttatccatatttcaagctatatataccttgacattgaatat

SEQ ID NO: 21010 - DNA, 272 bp, Gossypium hirsutum
  Clone ID: uC-gsflnu33B080a08b1
cgccccggaacacccgggacgacccacgccgttgttaacaacccaaaaagaaaaaaaaaaaagggggggaaacagaaagaaaaacagccgaaaacccaccaaaaaccgcaaggaacaaaacgaaggcaccacccagacgaggaagcgggaacacaaccgaacaggagaccccacacagggggcgccgccagaaggccccggccaccgggagccggcccccgaaggagcaccccaaccaaagggggggcggcagaacaccaacccggggcggg

SEQ ID NO: 21011 - DNA, 320 bp, Gossypium hirsutum
  Clone ID: uC-gsflnu33B080a09b1
tcgtactcttttgcggagggaacgagcggaagccggaaagtttcatcgggtcatcatttgctgcacccggggagcctgaaacactcattaactgtggggacgcgaaaagcaggtcccacaaaaccctacgagatcccgatatatccctaacttcctaattatcctgctgtgatgaatgcccaaggcaagtaagggaaaggcaaatagagcctggaataacagcgagagaggcatagagaatcgcactggccttgaagtcctcaaccaattgttgaaactcgaacactacgaaatcgcaaaaggacaaatagaaagccctt

SEQ ID NO: 21012 - DNA, 430 bp, Gossypium hirsutum
  Clone ID: uC-gsflnu33B080b01b1
cctactctttctcactcccacattaaatattggtgctgtatcaatggcgttttcagctctgacaggtaagcttgaggcagatgtagagattaaggcttctcctgagcagtttcatgaaatgtttgcccacaaaccgcaccacgtgcaccatacttgctatgacaagattcaaggatgcgatttacatgaaggtgaatgggggaaagtcggtaccattgtccattggagttatgtgcatgatggaaaagctaaaaaggcaaaggaagtagtggaagcagtagaccctgataagaatttggtcactttcagagtgatcgaaggagatctaatggaagagtataagagctttgttatcacgattcaagtttcgcccaagagcgagggtagcggcagcttagtgcactggactttggaatccgagaagctgcac

SEQ ID NO: 21013 - DNA, 452 bp, Gossypium hirsutum
  Clone ID: uC-gsflnu33B080b02b1
actactctttcgcccacgcgtccgcccacgcgtgcgctacaattttcgaaattgtttcaatgaaccggaaaagggattttgtaacaaaaaaaaaaaaaaaaaaaaaaaaaaaaaaaaaaaaaaaaaaaaaaaaaaaaaaaaaaaaaaaaaaaaaaaaaaaaaaaaaaaaaagggggcgccccttttaaagaacccaagtttaacgacccggtgcatgcaacgaaaaagcttttcaaaagggccaccaaaattaaattaactgcccgcgttttaacaaacgtgaaatgggaaaaaccctggtgtaccccaaactaaaacgccttgaaaaaaatccccttttacccagttggggaaaaaaaaaaaaggcccaccaccatatcccctttccaaaaaatttcaccaacctaaatggaaaaggggaccccccttgtaacggcaaataaagcccgggg

SEQ ID NO: 21014 - DNA, 157 bp, Gossypium hirsutum
  Clone ID: uC-gsflnu33B080b03b1
ctatcagatagtgaagagagtcatggctagaattcagaattgcgcactcctcaaacaaaaccatgttcatgtcactctaactgattgaagaacgccgatcgaattcatacccgggctcttgacgctttacccaaaacacccaaattcaacacacaac

SEQ ID NO: 21015 - DNA, 458 bp, Gossypium hirsutum
  Clone ID: uC-gsflnu33B080b04b1
gaatgcttttctttgggaaaggccccatgtgaacggcacttgcacatgggttagtcgatcctaagagacgggggaagcccgtccgacagcgcgtccagcgcgagcttcgaaagggaatcgggttaaaattcctgaaccgggacgcggcggctgacggcaacgttagggagtccggagacgtcggcgggggcctcgggaagagttatcttttctgtttaacggcctgcccaccctggaaacggctcagccggaggtagggtccagcggccggaagagcaccgcacgtcgcgtggtgtccggtgcgcccccggcggccctttgaaattcggaggaccgagtgccgtccgggccggacgtactcattaaccgataggtctcaaggtgaacagcctttggtcaatgaacaatgtaggccagggaagtcggcaaatggatccgtaacctcggaaaaggattgc

SEQ ID NO: 21016 - DNA, 430 bp, Gossypium hirsutum
  Clone ID: uC-gsflnu33B080b05b1
ccctttatgttttcattcagccaccaagaacaagggcgacgcatattctgagacgacaagtgagtcagaccctttcccatgccagccctaaccctaatcctgcctcagtatttctctttagctagacatttctcttcggtaaccgacaccattcgagccactctcttccccggcgatggcatcggccccgtgatcgctgagtccgtcaaacaggtttttagaactgctgaagtgccaattgaatgggaagaacattatggcggggaccaagttgatccaaagaactcaaagctttctaacttgggaaaggctagaatcagtaagaaggaatcggttaggcttgaaaggcccaatggctactccaattggtaaaggccatcggtctttgtatcttacacttaggaaagaacttaatctgtatgccacgtca

SEQ ID NO: 21017 - DNA, 487 bp, Gossypium hirsutum
  Clone ID: uC-gsflnu33B080b06b1
cctactcttctttctgaagcaggaacaggcgcaacttgcagcatcatcaatcggaagcatcgtgaatgccagctcaactgggaacggtaaggaaccagccgtggctactgctttggatgtacaatctggaaacgccgacaccaaaatggtctcaacagagctacccattgacccatccggaacgacttcatgtgggatgaaaatgaaagagggtcctaacaggtgtaccaaatgctgtaaacgtgttggtttgacaggatttaactgcaggtgtggaaacctcttctgtgcagctcatcgttactccgacaaacatgactgccctttcgattaccgagctgctgttcgcaatgctattgctaaagccaacccagttgttcgggcagagaagcttgtaaaatctgagaacaacccgggtcaagatgaagatatgtggatggtctatgtaagttggttacttgtctaatcaagtgtccccctgattgat

SEQ ID NO: 21018 - DNA, 219 bp, Gossypium hirsutum
  Clone ID: uC-gsflnu33B080b10b1
acccccgcggagccccccccccccaattggtgggtcgccccccccctttgttttttcttcggacgggcgcaaggacggcggggcttctacaccggctcctcggatctaccaggctggggcaagacccacgtcatcttactgcggcctcagatctgagaggaaagacactcttctcttcctcatacgtgactggggcgaccgcaacaggtcacaagaaac

SEQ ID NO: 21019 - DNA, 256 bp, Gossypium hirsutum
  Clone ID: uC-gsflnu33B080c01b1
gacccgccccccaaaggccggtaagacccacccaccccgtaattaaagacccacggacagaaaaacccaggggggggatggtggaaccaaacagccccgcccccccggggaaaaaaaccccaaaaacggcacagggaaagcagaagacgaccacgacaagaaccgggcagaaacccaacgcgacaaacgcgccggacagcccaaagaaaggcagagaggcaaaaacccaggccaaaaagaaagccaagacccaacc

SEQ ID NO: 21020 - DNA, 475 bp, Gossypium hirsutum
  Clone ID: uC-gsflnu33B080c02b1
ttcttaaagtctcccttatatgaccatactaggggctttcaaaaaaaaaaaaacccaaaaaaaccaacagaaaaaaaaaaaaaaaaaaaaaaaaaaaaaaaacggggcggccgcccgagaggagccggggcggcgcccccgggggggcccacgcccaagcccctccaaggcgccaccgaaggccactcagctggccgcgcgggaacaacagacggggcggggaaaaccccggcgctccccaacgaaaacgccgggcagaacaccccccgtccgccggggggcgcaaacgccaaggggccggacccggcccccccacccaaccaggtgcccaaccggaagggccaaggggacgcccccggaaagggaccaaaaagcccggcggggggggggcaacccgcgggggggaccggtacgaatggccggagccccacccccccacactgcccgcaccccccccagcccgcctggcgacgac

SEQ ID NO: 21021 - DNA, 297 bp, Gossypium hirsutum
  Clone ID: uC-gsflnu33B080c03b1
ccgcaggcccgtccccctattcccgggtcgtcctacccgccctactacgccttcgaaccagccgcccagcgctgggaggccatttatgaaccatttcgcctctaatccccgagagcaatggctaggcctttcttattacagtagtaacgcactctttttgagaccatccagagcaaacgatctaattcgacagactccgacttgtgcccttttcttcaatgattagaaattcttactctgttcaccccaaacaacaaaaaaaatcaaaaaacactccatacaccacaaagctaatta

SEQ ID NO: 21022 - DNA, 484 bp, Gossypium hirsutum
  Clone ID: uC-gsflnu33B080c08b1
taatttttgtcattttcgtcattgatcaatcaaatatagttcaaagaataccccatttttggatcgcaggaaagccaaaaaaaaatgctagcagtttttgacaaatcggttgccaagagcccagatggtcttactgttgctgatcagccacaagcactatcagctctcaaagatggtttcttagctaatcattttggctcagttcatcctggttcagtcaccatcaatcttggatcttcgggtgttatggcttattctcgtgaaaaacagaacccacttctccccagactgtttgcggtagtcggtgaaattttctgcatgtttcaaggacatatcgagaacgttgctgtccttaagcaacaatatggcttgaacaaaacagcagacgaggggattatcgctattgaagcttatagaaccctcagagacagaggcccttaccctccagaccaggttgtgagagatatccaggggaagtttgttt

SEQ ID NO: 21023 - DNA, 469 bp, Gossypium hirsutum
  unsure (1)..(469): unsure at all n locations
  Clone ID: uC-gsflnu33B080c11b1
aaaaangcaagggcttctttgacgtagggcctcttttttttggtatgtttttctcagttacccgacccgagattcaccaatattgattttaatcttgatttctaatttcctaaagagtgggatcatccatttcaattttgggggttttcatcaaagaacagagagttggctagtcgagaagcttaagatattcgtagtgcaagagccagttgtagctgcctcttgcctcatcgctggttttggtctcttcctaccagctgttgtaaggcccattttagattccatggattcatcaaagcaagtcccacaacctgctttaagagacgtggtttcaggtgtgattgggaaaaaacagggttgatatgatttatggatcgaaaagaggcaaaaatttatgtgtagctcgtaatcactgacgaaataagtccaacttttttaatttatggaactctctaaagtgcctttcaac

SEQ ID NO: 21024 - DNA, 245 bp, Gossypium hirsutum
  Clone ID: uC-gsflnu33B080c12b1
gaatgcactttttggggaaaggccccatgcgaacggcacttgcacatgggttagtcgatcctaacagacgggggaagcccgaccgacagcgcgtccagcgcgagcttcgaaagggaatcgggttaaaattcctgaaccgggacgcggcggctgacggcaacgttagggagtccggagacgtcggcgggggcctcgggaagagttatctcttctgtttaacggcctgcccaccctggaaaccgctc

SEQ ID NO: 21025 - DNA, 245 bp, Gossypium hirsutum
  Clone ID: uC-gsflnu33B080d02b1
gcgcaagagggagcaggggtctttagagactttctgcggtttcccggcggtacacgaaaaggtatccacgatacttcgagaggatgcgtttgggtccgatgaaagaaatggtcgcgctcccagtggagactaagcataagaataatagtcccatgccctaccatggctgggtcggaccttgcaaagcaggcttccgcgtcgtatgaaggctttggagtaggagatgtctacaactatgactttgt

SEQ ID NO: 21026 - DNA, 308 bp, Gossypium hirsutum
  unsure (1)..(308): unsure at all n locations
  Clone ID: uC-gsflnu33B080d05b1
cctggntagttttttatcggcttactcatgcctgtcatgaatgcattcatcatttccataatctgtccggaagaggagtggtttgccttaataggattagctgcagttttgaataaaaaaccgttctagatgaactgttagagattggtaagcgacgtcctctgatcgagatcttcattatacttgtcacttgttcatggatattttggatatttcaccggtaatcccggattttaagctccaattttaaatgggataatcgacactgttggtgacttttttttgtcaatcataagcccatctccttt

SEQ ID NO: 21027 - DNA, 417 bp, Gossypium hirsutum
  Clone ID: uC-gsflnu33B080d10b1
ccctcctacgccttctccccccgaggagggcgaaatgggggcttatgccagctgctgtacgaatcgcgggataagagtgcctcaccagagatggccgccatcgcagaatctccgccgtggcttaagacataccgaggggaagaaaattttgatatgagaaaaaaaaaattgagaggagagagggagatgataaaactaagttacaacttggaatagtgtgggtagtgctggatttgtcaatagaagattaaaatgagatgatgggtgttaaattgttgggtctttgatgatctggggatgggattttccttgcataaaagaactagaggggagcaaaaacaaggtttattgcccccactcttgacagggttcccttttttcttttttttttgcttcctttaattattaaatactgca

SEQ ID NO: 21028 - DNA, 487 bp, Gossypium hirsutum
  Clone ID: uC-gsflnu33B080e03b1
cctcaatctttttacggcaatacgccaggaaggtgtcatcttacttgttttgagtttagtggctgcagataaagaaaaaatggctgaggagcataccaaggctggtggtgaggaagcagtggagagcaaggagcgagggatgtctgatctcttggggaagaaagaagatgagaagcctcaacctcaagaggaggcggccgccacccagtttgagaaagtcaagatagaataggaacataaggaagatgagaagaaacactatgttctgggcaggtatcacctattcaacatcatctccaaatattgtagtgaccaggaataaggctaaggccgggagaagaagcagtacatgaaaaaggaggaggggaagtaagaacaggacagtgcaaaccccgtggagaaatgcgatgaggtagcaacagttcaccactcagagacccccgaaaagaagggtttcatggataagaccaagacaacttccaggaca

SEQ ID NO: 21029 - DNA, 529 bp, Gossypium hirsutum
  unsure (1)..(529): unsure at all n locations
  Clone ID: uC-gsflnu33B080e06b1
ccccgcaggcaccgccccccanttnccggttcgacccacccccccgcgtcgcttttgcggacgcgcgggtctatcttccccaaaaatccccctttacaaactgatttcgcttcggttttataactgattacaatagaaaaaaatcgctactatttctcagttgttgctgctatcttttgctgttttttgccctcttttcttgctgtttgcaggtccttggaggtgcaggcgatgggacggggccagggagttgttgagcctcgagcgtcggacgtgctgaccaggcacgtggggagcggcacatactgctgctagggtctcttggatgctgaaactattttaggtctgggccattttgggcttgttttagttagggtttagctgattgggtattaaggttggttttacacaatctgggcttcatattctttgcctattattgcaatgggcccgggcaaaatttgggtttcacaatcctcaaggcacctcctgtaggtatctatatgtagatcataaatgcaaaagccta

SEQ ID NO: 21030 - DNA, 419 bp, Gossypium hirsutum
  unsure (1)..(419): unsure at all n locations
  Clone ID: uC-gsflnu33B080e07b1
nttggaccaccttagctgaaaaagaaaaagaagggatggtagttttaggcaaagtggtggatgggattctattgctaacattcgtgtccatgtcggtggttgccagcgtgcttggacgcccaggtacttttgactaaagcgcttttccccgatgtgctgggtcgtgtatattcatggtatacgaccacataccaagattatttgctgttggatgagcctcattttttcatggcacttatgaaattggagcttgttttagtattgccgcttgctatacttaacacttaatggcttgttgacctccaagccctggttcaacaccacctgccctatctatggttctgctctttgttacctccacgacagctatggtgggagacatgctgggatccgacataccatcagcaggtaaactggcg

SEQ ID NO: 21031 - DNA, 447 bp, Gossypium hirsutum
  Clone ID: uC-gsflnu33B080e08b1
tatttttggactcccgcccaaagagagagccaattatggcagggaaaatatcggctgcatcagctcgggctcacactagaaaatctaagcaaaacactttcttcaagcttctctcagggatattcacaaagacactattggtcttgtttgtgggagctttggcatgggcttatcaggccattcagccgccgccgcccaagacttgtggctctcctgatggtccacccgtcaccgcgtctagaataaagctcagggatggacggcacttggcctacaaagagcatggtgttccactaggggcagcaaagtataaaatcgtcaaagtccatggatttgattctcgtaggcttgatgctgttcctctgtccccggaactcgttgaaaggtcagggatctatttttgcgtctttcgacagacccaggtacggagagagtgatcctaatcca

SEQ ID NO: 21032 - DNA, 388 bp, Gossypium hirsutum
  Clone ID: uC-gsflnu33B080e09b1
ccctcctgcctaattttatgataggcccgccaagcagggggtcagtcagggtcatgtactcgacctttttgcatccgcacttgaacagggtggagtctgctgaaatgaaagctgcagttgaaaggacaggtggccttgctgttctagcagaaagttttggtcattctgtattcaaagactctctcaagcgtgtgctttaaggatggggagcagactcttggcctatgttttaatggcacactcgagatcaaccgttctaaagatgtcaagattcagggggtcatcgggcctcgcacttctttggagaagaaaggacctaaccgtgctgacacattcatcgtggaggggaacactacagcatggaaaatgtgtggtctagcaagagtac

SEQ ID NO: 21033 - DNA, 491 bp, Gossypium hirsutum
  Clone ID: uC-gsflnu33B080e11b1
taatttttttccgccttggtttttcttcttcattttcctttttccttgatcaaaatcctcagctctcttaccgccaaaggaggatcatcttttcaggttttacgatggcatcgaagcggatcttgaaggaattgaaggatttacagaaggatcctcctacatcttgcagcgctggtcctgttgctgaagacatgttccattggcaggcaacaatcatgggtccaccagacagtccttatgctgggggtgttttcctggtgaccatccattttcctccagattatcccttcaagcctcccaaggtggcatttagaacgaaagtattccaccctaatattaacagcaatgggagcatttgcttagacatcttaaaggaacagtggagtcctgcgctaacgatatccaaggtactgttatcaatctgttctttactgacggacccaaaccctgatgatccattggtgccggagattgctcacatgtacaaaacc

SEQ ID NO: 21034 - DNA, 81 bp, Gossypium hirsutum
  Clone ID: uC-gsflnu33B080f02b1
ttctcgcgtccgccacaccaaacatcccaacgggggatttttatgaaatttttcgtctctttcccccccaaaccccaacaa

SEQ ID NO: 21035 - DNA, 486 bp, Gossypium hirsutum
  Clone ID: uC-gsflnu33B080f03b1
tgctaaaccaacctcctactccgcacccatgccgatctggaccttactcgccaatccgacgtcgaatccttcttcgccgatgagaaacctcactatgtcgtactagctgccgctaaagttggtgggatccacgccaacaacacttaccctgccgatttcattgccatcaacctccaaatccagaccaacgtcatcgattcctcttaccgccacggcgttaagaaaatcctcttcctcggttcctcttgtatttatcccaaatttgcgccgcaacccatccctgaaaacgcgctcttatccggtcccctggaacccaccaacgaatggtatgccgttgccaagatcgcggggatcaaaatgtgccaagcgtacagaattcagcacggtttcgatgctatttccgctatgccgacaattttgtacggccccaacgataatttccattcggaaaattccacgttttgcccgtttgatgcggaggttcat

SEQ ID NO: 21036 - DNA, 476 bp, Gossypium hirsutum
  Clone ID: uC-gsflnu33B080f05b1
actcatctttctccattactggacctcggttcaaggcttttgtaaaagacacctatgatctctgcagcatctgcttttctaaaatgggaaatgaagctgattatataagaatggacaagcctatgcattaccggcatccatggtgtttcagggcatcaaatgatcatgttccaagagttggcccagcactccctcatgtcttgaggaatcgtgtactaaagttgtctcggcctaaactagaaagtcactttatcttggatgtcaatgtatcggatgggactgtaatggctccatctacaccatttacaaagatctggcgaatgcgcaacaatggtactctgccctggtatcgtgggactgcaacttgtctggattgggggagacaagctaacaaatgcaatctcggttgatatagacattcccgcccgaaggtgtgcctctcgatggggacctggacattgctgttgattttactg

SEQ ID NO: 21037 - DNA, 472 bp, Gossypium hirsutum
  Clone ID: uC-gsflnu33B080f07b1
aactcatttttttcgcctcgcccgcagctcaaggggttattattacaagcatgcaagtatctggcagactcatcattggagcccctttacaaggaaggtgctttacaagaactccgggatttggacttgtcatatggtaccctgtgccagtctgccatagaggagcttcttgcttattgcacgcatcttacccatgtgagcttgaatggatgcataaatatgcatgacctaaattggggttctactggtggtggatttgaatcacttaacggatctagcatgtttccttttgagaacgtgaatgagtcaattgagccaaccaaatcgtttactgcagaacctcaattgcgttggttgtccaaaatatcaggaaggtgctcattccaccagctgcacgttgtttccacttatcatccctaaatctttctttgtcagtcaatttaaaggaagttgaccttgcttgttacagcct

SEQ ID NO: 21038 - DNA, 480 bp, Gossypium hirsutum
  Clone ID: uC-gsflnu33B080f09b1
tcctaccactcttccggttcggatcgcggcgacgtgggcggttcgatgcccgcgacgtctcgagaagtccactgaaccttatcatttagaagaggaagaagccttggaaaaagttgttgaattcttccagtctaaatatttcaagaaggattcagtcatcacttaccattttccagcaaattcagccactgctgagattgcattcacgacggagggaaaggaggaagcaaaaatcaaagtagagaatgcgaatgtggtcgagatgatcaagaaatggtacttaggaggaacaaggggagtgtctgcaactaccatttcctccttagctaataccctctccgctgagctttgcaaatgaacccatgccgttttgataccaagtctttcctactaagaaccatcctgtttgttgtgctttctctaccaataaattatgatatgattggagttttcgcttatttacagatccattttctttac

SEQ ID NO: 21039 - DNA, 256 bp, Gossypium hirsutum
  Clone ID: uC-gsflnu33B080f10b1
ttgttttcttttctagacccagacccgccatcagagaggcttttatgagcctatcttctgttggccccccaaacattgttagagacagcctggacacaaccggttgtctatggaatgagcacaaaggacgatgatagacgcaagatgcagcaacatggcactcattgccaagggcaggggtctgccccgacgaatttatcccactggacctggccgcgtcatgccagctcctgacacctacccgcgcttgacgcat

SEQ ID NO: 21040 - DNA, 380 bp, Gossypium hirsutum
  Clone ID: uC-gsflnu33B080g02b1
ccctgctaacggggtttaccggacaaaacggccgaggagggatcttactttttgatcccatggctccagaaacctttcatctatgatatccgcatgaagccccataccttctcatctgtctctggaactaaggatctccaaatggttaatcttacccttcgagttctttctaaacctaaggtggagaaacttcctgaaatttatcaacaccttggtctagagtatgatgagaaagtgcttccctccattggcaatgaggtcttgaaagccgtggttgcacagttcaatgctgatcagcttctcaccgagcgtccccaagtgtcggccttggtcccgaattcactgacacagcgggcaagggacttcaacattgagctagc

SEQ ID NO: 21041 - DNA, 475 bp, Gossypium hirsutum
  unsure (1)..(475): unsure at all n locations
  Clone ID: uC-gsflnu33B080g03b1
cctacgnctatttcccacgcgaccgcccacgcgtgcgcccattcgtacgtttttttgtaccccaaatctctccttctcttggcagcaacttacaaccaaaaatctactagctaaacttatgctacatcttaaaacttaagctttcataacatgtagaacccttaaaccaattcttgaagctccatagcttcatttcttaacttttacgcacatagaaaggttaagaaccttatttgcttgctggcttccctaatttttcatcttaatccttatgaaatctgatctatatagaaccttccacaacattctcttctctaaagcaaccaaagatgatgaagaaaaagagggaatgagaccaagtggggaagaaaatcaaccctgaaagccatcttccagctatttataagcattccctcactattacccaaccttagggaattcgcccatggctattatcatgtctcccacttagaac

SEQ ID NO: 21042 - DNA, 323 bp, Gossypium hirsutum
  Clone ID: uC-gsflnu33B080g04b1
atcatttcgttcgggcagagccagcctatcaggcagagttgcctgagaagatcggtttcgtcgcgaagaacgaggaggaactgcctggacaagacaggaaagctgaagaggccaggggcccagcgacagccccagcagccgaggcccatcacgtaggggagacgaaggaaaagaagggaattctggaggagaccagggcgaagctagctgggaaacacgccaaatcagatgaagaaaaagaaaaggcttgaggaacacggtcagatagaaatacaggggggatcgggggccacgccagtagagcaaaaaaaagcatggggatg

SEQ ID NO: 21043 - DNA, 410 bp, Gossypium hirsutum
  unsure (1)..(410): unsure at all n locations
  Clone ID: uC-gsflnu33B080g06b1
atactctttcgngagcacatngatgaaccggaaatacttttccaaaagttgtctttgtccgcatcccatttggatgaaaataagtggggcgttaatgttcaaccattgtctggttctcctgctaattttgaggtttatacagcaattcttaatccgcatgatcgaataatgggtttggacttaccacatggcggacatttgtcacatggatttatgactcctaaaagacgtgtatctggtacatcaatctatttcgagtcaatgccttatcggcttgatgaatccacaggcctagttgattatgacatgcttgagaaaacagctaccctttttcgaccaaaactcataatctgtggtgccagtgcatatccccgagattttgattctccttccatgaggaagattgcaga

SEQ ID NO: 21044 - DNA, 387 bp, Gossypium hirsutum
  Clone ID: uC-gsflnu33B080g11b1
acccccccggaaaacccgggacgacccaccccgactaaacctccagagccgccgacccaccgggggaacaccgccagacaggccccagctcccccacgaaaaggagaaaaaaggcgaagaacatgacgcgagccgctcaagacaggaaatacaacggaggcgccgctgacctcaagcacgcagaagccccgggacccagcccaaaaaaggaggaagccccgagcaaagcagaggcagcaaggatcaacccaatcgacaggaaaagacaggagggggcagcgcgcccatcagtacctggcaaaaacccccacataccaggcaccgacgcagcaggagaaaccggacaaggaggacccaggcgcccagagacacaaagacggggaaaca

SEQ ID NO: 21045 - DNA, 266 bp, Gossypium hirsutum
  Clone ID: uC-gsflnu33B080h01b1
gtactcttgcggccggcggcacagggcaggggcggtttggttaggctaaacttgcgtgtcaaccccctaagaaggcaacatgccggacgttagcaggccaaaaacgtactccatgggacttgatttattgttgaataacgggacaggtccggtccccggatctttatcgtcggcgaaggtcgtccgacattgagatcccagccataaccacctttgcgtgacgagtccggtgggaacgccgtgcgatcacaattgaagcttcaatc

SEQ ID NO: 21046 - DNA, 405 bp, Gossypium hirsutum
  Clone ID: uC-gsflnu33B080h03b1
gctaacaatttttttaaagcctgccatataagcgggtaacctggctacgttgtggtactcttcgcccaccacaatgccgaaaatcgccttgggaacaagccaagaggctgctcagcctgactgcatcaaagcccttgtggtcgagtctatcaccactttccttttcgtattcgttggagtaggagctgccatggccgccgatgagtcggtggcaaatgcgctggtgggattgtatgctgaggcggcggctcatgccctcgccgccggcgttatgaatatcggccggacacatatgaggcggacatcttaacccagacggcacgcttgggttgctattcggtggccccatcacggtggtacgcgcgatcctttaccgaatcgatcagctgttggcacgccagctgc

SEQ ID NO: 21047 - DNA, 478 bp, Gossypium hirsutum
  Clone ID: uC-gsflnu33B080h06b1
atactctttcgcccacgcgtccgctaaatcgtgcacttttcaacctccttccatgacctttgatagaaaggggagtgtttcggttgttaaccactatgcggttatggtatcatgtcgctgcaactacacggaatcaagattgtttttcaagcagccaacaagttggagaccacgagtttcaagggatcttatgatatctgtagcatctgagatgtcaggacaatattctggacccaatgaaggaatcactcagcttccagttcaggttttaactcttcaggcttcaaatttgtctgatgaagatctaactatgacagttcttgctccaacatccttaacctcacctccatctgtggtgtccttgaattcttctccaacaacaccaatgagcccatttgttggttctctgagcttgagggaaagcgtgtgatgagaggcgcactgcagacataaacttggcttatgcccagtctatctg

SEQ ID NO: 21048 - DNA, 287 bp, Gossypium hirsutum
  Clone ID: uC-gsflnu33B080h08b1
tcttacacgcgggcgcaccagcaggcaccagggggcaaactggaaaagtattggccagcgccccccccaagaggggcacaggcacaagagcgagggctgcaaggacgaccccgcagggaagcaccaccgaccgggcagggagacccgccggcccggaaacagagggccaacaagcaaccagagcccaggaaggcaccaaacaaacagcccacgaggccagaccaacgccagaacaaggccgggacaacaaccagaccaaccaccacaaaggcccggacccaaaacaa

SEQ ID NO: 21049 - DNA, 216 bp, Gossypium hirsutum
  Clone ID: uC-gsflnu33B080h11b1
actacactcttcggccgggcaaaacccagggggattctgcactgttcggcttattgcccaaaaccaccatggagacacaggcgcattctaaaaaacagcacaagccatccagggaggaggcgccgaatgggaaaccaaccccaacatggaatgacccggtttgtctcctacaaaaaagcccgctcttagaataaactaaaggggaacggagaacaa

SEQ ID NO: 21050 - DNA, 319 bp, Gossypium hirsutum
  Clone ID: uC-gsflnu33B081b01b1
ttgtataaaaaaaaacgcgtacagaaacaacgaacagggaaaaaattaaaaaaaagggaaagagaatatgcggaaactaaaataatttgcgtcattctaaagatgggcgtttgttttgggggacctaggtttacttccctgggcgtgggaggacatcgtttttttttgggggccccttgttttactccactggccgtggtttgaccccggtgggccttggaaattccttgggtgttcccaatttagtcttttgggggcggtttccttttggccgggtggggtaattgctgattggccccccccttttgccttttcaaaa

SEQ ID NO: 21051 - DNA, 428 bp, Gossypium hirsutum
  unsure (1)..(428): unsure at all n locations
  Clone ID: uC-gsflnu33B081b03b1
tctcttatgatgtgggtcttgatgctgacaactgcaaggtcctggtcaatattgagcagcagagccctgatattgcccagggtgtccatggccactttaccaagcgcccagaagatattggagctggtgaccagggccatatgtttggttatgccactgatgaaaccccagaattcatgcctctcagccatgtccttgcaactaagcttggggcacgtcttactgaggttaggaagaatggtacctgcccctggctaaggcctgatggtaaaacacaggttactgttgagtactacgacgataatggtgccatggctccggttcgtgttcacactgacctcatcttcacccagcatgatgagactgttacaaatgatgaaattgctgctgacctcanagagcatgttatcaagcctgtcattcctgag

SEQ ID NO: 21052 - DNA, 400 bp, Gossypium hirsutum
  unsure (1)..(400): unsure at all n locations
  Clone ID: uC-gsflnu33B081b07b1
cctacgcgtccgcccacgcgtccgcccacgcgtccgggccgccctttttttttttttttttttgatatgcttaaactcagcgggtnataaaaaaaaaaaaaaaaaaaaaaaaaaaaaaaaaaaaaaaaaaaaaaaaaaaaaaaaaaagaaagggggaataaaaaataaaaaaaataaagaaaaaaaaaaaaaaaaaaaaaaaaaaaaaaaataaaaaaaaaaaaaaaaaattaatttacctggctttaaaaatacaaaaatgggaaaagcaaaacacttaccaaactaaaataaatgggctaaaatcacatttggctaagtggagaaaaagcaaaaagggccaggcctaaaaaaatttccaaaaaaaaaaaatagctgaatgggaaaagggaatggccct

SEQ ID NO: 21053 - DNA, 392 bp, Gossypium hirsutum
  unsure (1)..(392): unsure at all n locations
  Clone ID: uC-gsflnu33B081b12b1
ctgccaaaagaataaatcnaaacgggtgaagaggagtgtgcaggatattgtttacttggccatttagggctcgtgggtcgggttcaggatcaggctataatgcggagaccaggcaagaagatctggattgagaactattgaaatacaacaaaaagtatcaggattttttgaattagacatgatggtagaacaccttgtttcaaagttgtgtatgcagagttatatgtcaacatgaaaaacctattattagtttggtaaccttttttaaggagtgctgttttgggctttttaatattacatgcccattcggggctatttgtttatatatataacagatttggttggctaaaaaaaaaaaatacccccggttattttttttttttccctttttt

SEQ ID NO: 21054 - DNA, 461 bp, Gossypium hirsutum
  Clone ID: uC-gsflnu33B081c02b1
cctacgcgtccgcaactgttgggattcaagggattgcttgggcttttggtggtatgatctttgcccttgtttactgcactgctggtatctcaggtggtcatatcaatccggcggtgacatttgggctgttcttggcaaggaaattgtcgttgacaagggcaatattctacatggtgatgcagtgcttgggagctatatgtggggctggtgtggttaaagggttcatggggaagacaaggtatggtgctttgggtggtggagctaactctgtgaatcatggctacaccaagggagatgggcttggtgctgaaattggtggtccctttgttcttgtttacacttgtgttctcagccactgatgccaagcgcagtgccagagactctcacgtccctattttggcaccattgccaattggttcgcagtgttctggtacacttagccaccatcccaatcacaggaa

SEQ ID NO: 21055 - DNA, 530 bp, Gossypium hirsutum
  unsure (1)..(530): unsure at all n locations
  Clone ID: uC-gsflnu33B081c08b1
cttctctagaaactcaatgtgagatggagttgtttactgtgtttggtccttataggaatcgccattgaaggtgttcaatgcaaggtggttcagtttattttcggggattcattgtcggatgtgggcaacaacatgtacctttcaaagagcttggctcaggctaacttgcctttttatggaatcgattttggcaatggcttgcctaatggaaggttcactaatggccgaaccgtcgccgatatcataggtgacagcactggtctcccaaggccaccagcatttttggatccatcattgaccgaggatgtgatattagaaagtggagtaaattatgcctctggaggaggtgggattttgaatgaaacaggaggttactttattcagaggttttccctttggaagcaaattgagttattccgtggaacgtcagaattgattactaacaaacttggcaaacaagcgaacgacaagtttatttggagaggctaactttgtggtggcattagggagcaatgatntcatcaacaatt

SEQ ID NO: 21056 - DNA, 517 bp, Gossypium hirsutum
  unsure (1)..(517): unsure at all n locations
  Clone ID: uC-gsflnu33B081c10b1
tcgattgccgactgaactcccccgccgtcatattgaagtgccgccgagtccatgtaaaatagaccaatggccacgggaacgccaaagaaatctgggcctcctaaaatagttactctgaataacgcattgaaactggccgaacaatggataaataaaatgaatggatctgcagaatatgaagtagtggaagcagaaccagaagctcggccagaaaggcttggactcggagcaaaagttccacgtcaatcaaaagttggactctctaacgacccagttgagagaaaactatctgctaagttgggtgttggaaaaagaaaagttttaaaaaaccaggattctaccatcccttctagtaaagacagggtcgatgaagatgatggtgatgaggatttagatagtagaagtagtgcattttctaagaagagagcagttcctctgacttcccaatacaggtaaaagaaaaaccgaaataacttgtagctttgaaatccttgaatgtagcanaaatccatgtact

SEQ ID NO: 21057 - DNA, 473 bp, Gossypium hirsutum
  Clone ID: uC-gsflnu33B081c12b1
tcggttcaaagtggccagagaggttgcaagtcgcacctgagcgcatctcaaatgttcccggtgggagtagcagtgctttaaagcatgatgacggcaagtggaaggtccgagccaagaactacaaaaagttactccctgcacttgggaccaatgagataaggaatgttatggacatgaatacagtttatggaggttttgctgcagctgttattgatgatcccctgtggaccatgaatgtggtgtcttcctacgctgccaacacactgcctgtggtctacgatcggggtcttattggaacttttcatgattggtgtgaagcattttcaacatatcctcgaacatatgatctccttcaccttgacggcctcttcacagctgagagccacaggtgtgacatgaagtatgtactgttggagatggaccgaattctgcgacccagggttatgcattaataccggaatcaagctatttta

SEQ ID NO: 21058 - DNA, 430 bp, Gossypium hirsutum
  Clone ID: uC-gsflnu33B081d01b1
tgagcccctgccgtgccggaccggaatcgccgtcccggcccaagccacccgttttttttcacgtacgaagaaacagagcattagaaagagatgatgggagtgacgaaggaacacgtcgagtcttgatggacttaaaaattgaagccttctcatctggatagaatcgatacatctggagggtgcggtgcaagctttgctattgtgattgtatctgagcaattcgaagggtagagactcctggaaaggcaccgcattgcgaatgctgctctcgaggaggagatgaagcgaactcccgccctgtctaaaaaatacgcttatactatatatcccctgtaagatcatcaccagatttacctgcttaatcacatatcttgacgacacgctcaaatctacacattgtacatatgtatgacatgtcctgccagctcac

SEQ ID NO: 21059 - DNA, 566 bp, Gossypium hirsutum
  unsure (1)..(566): unsure at all n locations
  Clone ID: uC-gsflnu33B081d06b1
cctcacgcgtccgttcgtgtttgtctattgaattctttccttcactttctcgaaaaaaaaaaaatgtcttcaggttgcaattgcggatctagctgcagctgcggatctggctgcaattgcggtgagaactgctcaatgaaccttaaccttggatactcggagaagacaaccagcactcagaccatcatctccggagttgcgccagtgaagatgacctttgagggaccagagatgggcactactgaatcaggacatggatgcagctgtggatcaagctgcaaatgtaatccatgcacctgttgaaaagcttgatgaaagccatagattatgaaaaaagaaagcagcaaaataacaggcctctgtaatgatttattttcaaggatggatgcctgcaaggtctataattatgtctctctctgtcttggggaatagaagctctgtttgtggtggacataatgtataagccatttggttgggagcaaattttccttttgtccaaaggatttttgctgctcattcatggtgactggnttatggttttatctggtgtggtaaaatcttataaa

SEQ ID NO: 21060 - DNA, 336 bp, Gossypium hirsutum
  Clone ID: uC-gsflnu33B081d09b1
ttttcttatacgtgaagaggagccgaatcagaggcgtcactccagccacagttcacagagtatacctctgcgttcattttatccataacaagagttttccgcttcagataccgaatatgataagggttacgctgcagttgtacctgaaatttgctaacagcacgctgactgttcggatccggccatggcttgacaatgctaaataacttctggacctactatctctgagcatcgatctgactggatgggtaccgtgcgagaacaggtacttacagaacagccaccgttactgacagaagaacgaataatgtgaccgaccctataccacattcagtc

SEQ ID NO: 21061 - DNA, 438 bp, Gossypium hirsutum
  unsure (1)..(438): unsure at all n locations
  Clone ID: uC-gsflnu33B081e06b1
gttattgttattttcagattgcacccaaattggggaaaaaaaaaagactcaatttttctgtgcataaaaacccgaatatgaggactaaggagaaggaaagttattgccattttggcaattcaaaatctcaactcccagttgctggtgcttttttttcctgttttggatgtgaaagaattagtcatttacttttgctgtaactgctgttgcatttctggatatttgcagacttgtatttttctttctttgaagtttctttctaaatattgtcttgagttttatgaaagcaaatgaactgaatgatgaaatattataggcaaatctagtgtgcaattctggtnaaaaaaaaaaaaagaaaaataaacaaaaaaaaaaaataataataataaaaaaattaattataaagaatccattcaaaattaaaaaatcaaaaataat

SEQ ID NO: 21062 - DNA, 229 bp, Gossypium hirsutum
  Clone ID: uC-gsflnu33B081e11b1
tcgcccacgcgtccggttggatgacaaagtatgcatgttgtgttacatgtgctttccagttcagtggatgattatgatatgtttggaagtttgtttggctatgttgcttatgttagacctttatatgtgttgaaatattctgtggtttggtgcttaaaaaaaaaagaaaaaaaaaaaaaaaattaaaaaaaaaaaaaaataataaaaaaaaaataaataatagaaaaac

SEQ ID NO: 21063 - DNA, 551 bp, Gossypium hirsutum
  unsure (1)..(551): unsure at all n locations
  Clone ID: uC-gsflnu33B081f05b1
gctctgggttatggcttcccaggcgttttatcttcttgtttcaatcattgttctcttatccgccattgttgtctcaggttcgggttcggtcgggattaactacggtcgtgtagcaaacaacttaccgtcaccggaaaaagtcgtggaactattgaaatcacaaggaataaacaaagtgaagctttacgacaccgacgcgacggttttgacggcgttagcggattccggtataaccgtggtcgtcgcacttcctaatgaactactttcatccaccgctgctgatcagtcgtttgcagacaactgggttgaagcaaacataacaaagttttacccaaagacaaaaatcgaagccatagctgtcggtaacgaagtgtttgtcgatccggccaacacgaccaaatacctcgtaccggcgatgaagaacatccacgcttcgttagttaaatccaagcttgattccgccattaaaatctcttctccgatagctntcagtgctttaaaaacctcgtatccttcatcggccggttcgtttaagccggaattgattgaac

SEQ ID NO: 21064 - DNA, 547 bp, Gossypium hirsutum
  unsure (1)..(547): unsure at all n locations
  Clone ID: uC-gsflnu33B081f06b1
cttacgcttccgcccacgcgtccgcggacgcgtgggtcaaattaaagctcatccttggttcaatgacgttgtatgggataaactctatgagatggaggcagcatttaaacctgaagtgaatggggaattagatactcaaaattttatgaagtttgatgaattggatgctccagcaccagcaagaactagctcgggaccttcacggaagatgcttttaacacccaaagatttaaattttgttggttatacatacaagaactttgatgcggtcaaagggctacgccatacttttgatttcaagaatccatcaatggaacagcaatcccatggttctatatatggtgattcaggggtaggttattctactaagcgatccgctgaggaaacagagatgcaaatgcttgcatcggcaggtgatcccatgttgccataaagtaactgaagggaaaacttgttacagtgatatatggatatttctgcttggnttaaagtaggcaatccttcaagatcttcagttcttgtgcagtggctgccatctgatttatgg

SEQ ID NO: 21065 - DNA, 311 bp, Gossypium hirsutum
  Clone ID: uC-gsflnu33B081f12b1
acaacacgtctgtgaacgcgggggttgaactcaagtttccatatattcaaacgagggttctaagcttcatttttttgctgtgttggcattcgatcaaattgcttttggtgtaggtgttagagctgagcaatgcttaagcgctgccaagattgtgcaggaaatagaaatcaagtacaggtatcgagtgtttatgtaagacatatcgaatggctatggaggtggagcatgttggtttttcatgggtagccaagttcttatactgagggctagcccatgcttttgatgtctagaggtttttaaccctacaggtt

SEQ ID NO: 21066 - DNA, 444 bp, Gossypium hirsutum
  Clone ID: uC-gsflnu33B081g01b1
tcgggttttcatttttctgtttggtgtaagtgagaagggcaaaaatggtggctgacagaggaaagaaggcgaaactagaagagaagggagtcgaagagaactctgaacagattgatggcgcactcgtcttttccatcgagaaactttaagagatccaagacgagcttgagaagatcaatgaggaggctagtgagaaagtgttggaagtggagcagaaatacaatgagttacgcaagccagtctatgataagcggcacgacataatcaaatcaattcctgatttctggttgacggctatcttgagtcatgctgttctgtgtgaacttttgaccgacgaggatcagaagatcttcacgcatattaactcacttgaagtggaggattacaaacatctgaaatctggatactctaatacttttaacttcaccccaaatccttattttg

SEQ ID NO: 21067 - DNA, 223 bp, Gossypium hirsutum
  Clone ID: uC-gsflnu33B081g11b1
aattcccgaggctcctcatggcattaacgacatttgcactgtccatgcaaactacgcagttaatccatctgctatcgtatcggctatcgacgctgctattgggagcctgtctcttggcgagagccgaggtcccctgacccggagggacttcgctcttgacgtgccgccatgactggcggttcgctgtagggtacagagccatgctttgggcgcacggccgccg

SEQ ID NO: 21068 - DNA, 383 bp, Gossypium hirsutum
  Clone ID: uC-gsflnu33B081h03b1
tctggtctactacataaggagtcgcccatgtggtgaatccatagcgaacaacagtgtgcatcgagctatgcaagatgacccaacgctggctgcagctcagtggtggatgcattaccacgattggactgggaaaacatgggagggatccatcttaatcgacttgaccaaggacaacatcagcacagatggactcacctggaaacggaaggtagcgagggtatcaagcaacagatgatgcaccggaacggctagaggatcacggcccgggcagtggcatcaagggtgatattggtggaaggtacgcccaagatgacatttactcttgacagggacctgaggatgatataccaaaaggaagaaaagatggtaggaggcccaagata

SEQ ID NO: 21069 - DNA, 325 bp, Gossypium hirsutum
  Clone ID: uC-gsflnu33B081h07b1
ttttaattttcgcctgactcacattttcgaagagggtccgttccaagaagaccccctgttggccgccagcccgaacggttccagggagctcccgcctccacaagggtgcctgtaaaattggccaaacacaccggaggggtgaaaaggcctcctcaatcccgctcgggcactggcgctgttacttgactatgttagcatgtctctaaccttgagagggttaaactagaaaagtgctttagaagggcttgaaattagttataaattgcgatatattattattattaaaaaaaaagacaagctgttataacttttcaggaaggtgctt

SEQ ID NO: 21070 - DNA, 551 bp, Gossypium hirsutum
  unsure (1)..(551): unsure at all n locations
  Clone ID: uC-gsflnu33B081h12b1
tatccctgaagattctgatgctggtagaccatcatatggggacttcagtaatcaggctcagctattcaacaatgagggatcaaccgtcggtgctcatggtgggccagcaagtaattgaaactaagcaaaatctgttgacgtacgttttccttgctaaaaattcctggaagataaagagtagagaatgattttgacgccatgggttattatttgcctctcttgaaggtactggtttttgaactttgctacgatgaatcacgatttctcgtacagcaaatttaccgaattgttttcctttgttcttttctttttttacaaatggggatgttnggattttcttttactatttgttattggtgatggngggtgtttaaatttgggannaattctattttaattttcgaaaaaacataaaagaaaatctttggagggctttgatagcctctggttgaggggtgaaaaaaaaaagaacatacttggattgaggtctatggagaaaatggctcctgcagctgtggcagcaacagctactactgctattatttatgcct

SEQ ID NO: 21071 - DNA, 437 bp, Gossypium hirsutum
  unsure (1)..(437): unsure at all n locations
  Clone ID: uC-gsflnu33B082a02b1
atttttatggatgctgctacaggcagtgttaatggggatctagataatccattgttagttgtgcctcttaaaccctctgttgcggagtttccattcgccaagaaggaagagcaaagtgatcgattgagtaatttggctggagctggttaccaagcttttgaagatgctattttaaataaactgacaaagactgccgaaaaacaacaaaaatgatgacaaaaaggtcttaggagcagattgcaaatgcatcagtggcattttatccacagatgttttgccaacatgtcctaaatttactagttcgggattgaattttagctttctgaagtataccttttaagaagagagatgaaccattccggttaaagacataagttcttatgtatgtaaattctattattcgttattaatgctcaataccttaaactattntatct

SEQ ID NO: 21072 - DNA, 536 bp, Gossypium hirsutum
  Clone ID: uC-gsflnu33B082a03b1
gtttattcaagcagctagggttttcgacgatttggctgtcggtttggtttccgggttggacaatgatgatcgggtataatttgagctcagttgaactacctgctccctgggtcatatactcttttatgggaataggacttacgatatgtcgccttgctctcattggttgcatagctgctgaatctattaatggatgctgccttcgtttctatacacttctaaaaatcattctcgttctaatagaagctgctttgcgagcatttattgcaattgaccgtagcttgggagaaggatcttccgttgtacccaactggagaaattgatagcttccgatcctttgtcgaagacaacattgatatatgtgaatgggttggcatcagtgtggtcattattcaagcattagctatgctagcggcaataatgttgcggactatcgtttctgctagcagaagagacatcgatgatgaagatgaatatgagtatgaaagcattacaggtacgacttgtgagccatgctaaaccctagtctagccact

SEQ ID NO: 21073 - DNA, 452 bp, Gossypium hirsutum
  Clone ID: uC-gsflnu33B082a05b1
ctgcccgccgggcgaccggccggattccggccgcccatgcgttagttttcggggtacagatatacttgatcatggtgaggagttacttttggcataaaacctgatcttgatacttataccatattgattgataatgtttgtacttcaaagaatttacgtgaggcaatgagattgggtggagtgcttaatgattcaagggttaaaccagattgtgttggttataatactattatgaaagggtattgtatgttgagtaaagggagtgaagcaatagaggtttattagaaaatgaaagaagaaggccttgaacccgatcttgtgacatataacactttgatttttgggttatcgaaatccgggagagtaaaagaaggttagaagtatttaaatattttagtcgaatcgggtcatttcccggatgccggtacatacacttcactgatgaatggaat

SEQ ID NO: 21074 - DNA, 476 bp, Gossypium hirsutum
  unsure (1)..(476): unsure at all n locations
  Clone ID: uC-gsflnu33B082a07b1
cacttctcgtgataaatggctgggcaatgatggggtggagctaccagataaggctggtctttactccacagcaaccgaggatgcagagtacaaagatgacaagatcgaattatggaataatgcttatgggttagacatgagtagcatcaaacagcacgctatgatagaacctcttgaggacacagtcgaccacaatcaaattgcgacgaatagccaccttctcaagacaatggatatctacaagaaggcttcaggtgatgcttatttcactgcatcttttaagcttgttgcacaacgagatgattacatacatgctttagctgcgtactgtgatgtattatagaaccagagccacacattgatgggcttctctacagggccaaaatcgcgagctacacattggaagcaaacggggntgaacctagaggatgtgctaaccatacgtgagggagaggcaatagtctgtagcatgactg

SEQ ID NO: 21075 - DNA, 439 bp, Gossypium hirsutum
  Clone ID: uC-gsflnu33B082a10b1
gctcgatcgacgccatgcgttttgtttttcgaaggagggtaaagaatcacaggagcagctgacgagtacagatgccaccaatgggccatatgaagctgctggaactgaacagaatgaggaggatgcatcagctgctgacgtgaaagagcggctaaagaagatggcatctatgaagaagaagaaatccagtaaagacatggatgcagctgcaaaagctgctgcacaagaggctgctgcaaggagtgcaaggcttgctgctgcaaagaagaaagagaagaaccattacaatcagcaaccagtgcggtaaacgcctccttttttgttctacattacatatacatatatgaacatgttttctacgttgttcattcaacaatgcgaaataaacagtgggccaaaagatgactgttttagttttatttgaatggacgagaagaaa

SEQ ID NO: 21076 - DNA, 393 bp, Gossypium hirsutum
  Clone ID: uC-gsflnu33B082a11b1
tctactctatcgggtttacagttttattgatcgtggtggcagatctaaaaaaagcacagatgttatccgaccactatcatcaaaaagattgttaatgttttgccttgagaaagtttacgaaaggtcttctagttgtgtagattggctcgtgagagaaatgcttgaaatgagactgagagacaaggtggaccatgatgaagacagagatagtgaaccagaagtagttgatggagtgggtgctgaaacagggcatgtgataagaaccaccattggtggtcgaaatggtcaatcaaaacagaatgttagttatattgctaagcatgcagttggaactggttcttttggtgttgttttccaagcaaaatgtcgtgaaactggagaaattgttgccat

SEQ ID NO: 21077 - DNA, 502 bp, Gossypium hirsutum
  Clone ID: uC-gsflnu33B082b02b1
ggtcgccctttttttttttttttggtctcatttcgctgtaaaatctaccttcgatatttccttgggactgctaagaaaaatatgtttaaacaacgaaaatttaaaaaactcgtttttttgacctttcctctttgacgatctgcgaatattaaaaaaaaatcaggcaatttccggaacggcaggttggttgagatcgatattgagaagcgggcgcgacttgacctcatggtggttcaaatcaacgacggatgatgagtcagagtcgctttgtacaccattaaacgtcgcatgaagatcatgatgatcgaatccaaaccgttcaaagggtgtcctttcactgcaccaggccgaacgaatggttcaaagtagaaaactttgcggcccgcaatatatggcaccggtgaagcttgctggaaaggaaatctaacagccgtaggcacgtaaccggtaaccgcctcaccttgtacgaggttgagatctaaaggcgaagagtaaccatgag

SEQ ID NO: 21078 - DNA, 535 bp, Gossypium hirsutum
  Clone ID: uC-gsflnu33B082b05b1
ctgtaattccacaaaaccaacttctttttatacgtagaaaaaggagaatatgaaggcatcatatattgcattgtgtgcagtgatggtgatcctcttggcagaagcagtaggggtgtcaacggcggtgacatgcagcccaacgcagctgagctcctgcgtgagcgccataacatcttcatctccaccatctcaactgtgctgtagcaagatcaaggagcagaagccatgcctttgccaatatcttaagaaccctaaccttaagaaatttattaacactggcaatgccaggaaggttgcttacacctgtggaactccttttccaaagtgctaagctagaccctttgcttaaggctttctttctctctattttcactgcagaatggatagagaggaagtactataattattaatattatgtcgttgcggtgtgtggaatatatatataatatcggttttgctgcttctagtatatattaagcactaagattagctctgtggaaaattaaaaaatgttgggcgtcatggttcgtgactg

SEQ ID NO: 21079 - DNA, 523 bp, Gossypium hirsutum
  unsure (1)..(523): unsure at all n locations
  Clone ID: uC-gsflnu33B082b07b1
ttccacgcgtccgctttctttctctaatataggtgttttcctgtagaaaaacacaagccaatatctttgcaaaaggaagatagtaatacgggacatgaagagttgtgcgtgtttttaccgcccagtgattgtggccaaatccatcgaccagaaagacatgagctttgtatcgacaaatagagtggcgttcggtgctgggattttatctcaagctacaacaaccgcaaggtccaagggttcaaaggttttggctgtcagagcttctgctgttgattcctatgggagctcttccgattttgttgagcgtatggaaaaagcttggctcatctctcagcaaccgaggccagttgtttgttcttcatgcaactccaaggggcacgttgaatgccagtggtgtagaggtacaggcttctttatccttggggataatatgctctgncaagttccttctaggaataccacttgcgtgatttgtgctgggaagggatcaacgtgcttctctgactgcaaggaactggatttc

SEQ ID NO: 21080 - DNA, 501 bp, Gossypium hirsutum
  unsure (1)..(501): unsure at all n locations
  Clone ID: uC-gsflnu33B082b09b1
taaaaaaaaaaaaaaaaaggcgtagcaatcatgatgtcctctcccctctgcttcctctcatcattaacccttagctttcatcatcgccactccatgttttgctatctaccaaccgcacaaaacccaccgccttacccaacccagctcccaacaccaagaaaaggaagaagaagaagaaaaaagacaaggaaaaagagaatttagatgaagaagatggattctctcaagaagaagaaacgaaaccctacctcctccatctgcatgccttcttcactgagttaaagggttctctcttttcttcatcaatgaacaaaggcctttttcattttacttcatcttttcttcttttctcttctttcttggggaaatgaagcatcatggtccgatttgtatgctacatatgaactaaaacctaatactataccatatatttactgctgcacatgtttggggaagctgttcctttatttntctggatggatttttatttcacagcatctg

SEQ ID NO: 21081 - DNA, 322 bp, Gossypium hirsutum
  Clone ID: uC-gsflnu33B082b11b1
tcggttaacttactgtaactggatactttttggatgatgggtgagtgaggaattgggaacagcaccattagccattatgatgatgtgcgttacaaaggtgagatcatagagatcttactatttgaccctaaacctgtcgatctacacatgagcaggataaatagagctaataacaggacttgtgggaccgaatctacgtatgaaggaaaaatacggttatgacttgtggttcgacatgaaaggctaactaagatgctatatagctggttgttcgggaaatctatgtacaaagaggcgtgtgatgttaatacactcgaggtag

SEQ ID NO: 21082 - DNA, 539 bp, Gossypium hirsutum
  Clone ID: uC-gsflnu33B082c02b1
ctttcttcattttcttttcactccaaaactgtgtaattgatgagatatcattggatgaggaaaatagagttgtgggggaaatattgattgtttcatgggcaatacatgccgtggatctttaaaggggaaacttcataagggcgacaatcagcccaaagaccattgttctagccgcaacaacacttcttccggccgttcaaccaccaccaccgattattccccttctactttaaactctcaacaactgattgctcaagaattctccaaagaaaccaaccaaaaagaaacccattttcctgtcattaaccctaccaagaaagacaacaacaataacaccatgagacgtggtattgatcaccaggcttactatgttttgggtcataaaacacccaacatccgtgacctttacactttaggtcgtaagttaggacaaggacagtttgggactacttacttgtgtactgagatctctacaggcactgagtatgcctgaagtctatatccaaaaggaagtgatctccaaggaggatgtggagatg

SEQ ID NO: 21083 - DNA, 485 bp, Gossypium hirsutum
  Clone ID: uC-gsflnu33B082c06b1
gttgctaatctctatcccaagccaaatgttggaggtcaacagaagctccaaattgggcagaatgtctcaagaaaggacaaaattaagtttcttgtcaccacacttcttgatcttaaagacagtaaagaagctgtctacagtgctcttgatgcgtgggttgcttgggagcagaattttcctattggacctcttaaaaatgtaatccttgctcttgagaaggagcatcagtggcatagagttgttcaggttgttaaatggatgctaagcaaggggcagggaaacacaatgggaacatatggacaactattacgagctttagatatggataatagagcagatgaagctcatcaattttgggtgaagaaagttagtgctgatctacattcagtgccttggcagttatgcggcctcatgatatcagtatactatcgaaacaacatgctggagaatcttgtgaagcttttcaaagcttggagcttttggtc

SEQ ID NO: 21084 - DNA, 432 bp, Gossypium hirsutum
  unsure (1)..(432): unsure at all n locations
  Clone ID: uC-gsflnu33B082c08b1
taaatcttagttgttgtccaaggcacactttacgtcggttttgttacgtcaaacccagataatcgtctcttcactaaagtgctataccctggagatgtctttgttttcccactaggtctgattcacttccagttcaacatagggcataccaatgcggttgcctttgctgctctcagtagccaaaacccgggggtcgtcaccattgcaaatgcagtgtttggctcagacgcggatatcaatcctgatgttcttgccaaggcctttcaactggacaagaatattgttaaccaacttcaatcccggttttggtcggataacgacaataggaattaatgttgacttctacagccccatcaaacttaactatgtacccaattctctgcaattgctaattntattttacattttaattcaaatttaattactcttttt

SEQ ID NO: 21085 - DNA, 496 bp, Gossypium hirsutum
  unsure (1)..(496): unsure at all n locations
  Clone ID: uC-gsflnu33B082c09b1
cttcaagcgggtgagagagaagaaaatcttaagaggccgaagatgccagctggtcacggtctacgttctcgaacaagggatttgttcgccagaccctttagaaagaagggttacattcccttgtctacttacctcaggacctacaagatcggcgactacgtcgacgtcaaggtaaacggtgccgttcacaagggtatgccccacaagttctaccatggtcgtactggtcgagtttggaatgtcacaaaacgtgccatcggtgtcgaagtcaacaagcaggtgggaaacaggattatcaggaagaggattcatgtacgtgttgagcatgtacagccttcgaggtgcgctgaggaattcaagctcaggaaggtgaagaatgatcaacttaaggcagaggctaaagcanaaggtgaggtcattagcacaaagaggcagccagaagggcctagaccctgtttcatggtggatggtgctacactttgaactgtacgcccat

SEQ ID NO: 21086 - DNA, 333 bp, Gossypium hirsutum
  Clone ID: uC-gsflnu33B082d01b1
gttaatgggacttgcgcatgggttagtcgatcctaagagacgggggaagcccgtccgacagcgcgtccagcgcgagcttcgaaagggaatcgggttaaaattcctgaaccgggacgcggcggctgacggcaacgttagggagtccggagacgtcggcgggggcctcgggaagagttatcttttctgtttaacggcctgcccaccctggaaacggctcagccggaggtagggtccagcggccggaagagcaccgcacgtcgcgtggtgtccggtgcgcccccggcggtccttgaaaatccggaggaccgagtgccgtccgcgcccggtcgtact

SEQ ID NO: 21087 - DNA, 51 bp, Gossypium hirsutum
  Clone ID: uC-gsflnu33B082d03b1
ccgcgcggtatatccgcgcggcgacccacgacgcgcgcttttagatcgcgt

SEQ ID NO: 21088 - DNA, 415 bp, Gossypium hirsutum
  unsure (1)..(415): unsure at all n locations
  Clone ID: uC-gsflnu33B082d08b1
tggacgcgtgggtggagacagaggcggtttaagcctgtgttcgatctggtttagtttcacgcctcagatgaacggttatcactctgttaaagttcagacaattataaacccagtttttactttctaacaaactcctattcactatatcttttattgtttgtaggactttgtaatgaattaatggtgggaatggtctaacatttatgagccatactaggtttgtgcatataggaagctaatccctagcatctattctgaattttggcattatcatgtatgacattcattgtgggtgtttgatgtttatggatggctggtttagtggtttgaatattctaactttggtactaaagctgtttaatcatgtcaggatgtattgattatatggaanagcatttggtgttggcaatgtgag

SEQ ID NO: 21089 - DNA, 509 bp, Gossypium hirsutum
  unsure (1)..(509): unsure at all n locations
  Clone ID: uC-gsflnu33B082d09b1
gcccggaaccccgggcgacgacccacgcgtccttatttattacctgttttgagggtttattcaggggcagccatgaaattcagaagcttttgtttttgcatcccaggatcaaagcaagaagattcagacagttcttctaacaaagcaaaatcccataaaaagtctgacaaaagtgggaaaaaggaagggaatgtggatgatgctgattatcagggtgccactactactactacgacagccagcagtgatgctggaatggctgctgctgtagcagtgggtgccactacagcacatgcctccgctgtggaatgaagtggttgcgatggttgtcatgcaggtggtggtgttggcggctgatagccggacactatttcaaaaaagctggttcagtttttggcctttggcattcttcatcatattgatttcagaatctttctttcatcttgcatgannagtgcttggttttttcatctttatatttttggtgttctttnttttttccccgagtc

SEQ ID NO: 21090 - DNA, 426 bp, Gossypium hirsutum
  Clone ID: uC-gsflnu33B082d11b1
tttacgcgtgggctcgccaagactgtgaaatagccggttatgacattcccaagggaactagagcctttgtaaacgtttggacaattgggagagaccctagcctttgggacaaccccaatgaattttggcccgacaggttcatgggaaagagtattgatgtgaaaggacatgattttgagttgttgccatttggagccggaagaagaatgtgtcccggatatcccctaggtattaaggtcattcaagcaagtttagctaatgttttacatggatttacttggaagttgcccaataataccactaagaagatctcaatatggaggaaatattcgggctttccacccctaaaaagtacccacttgaggcaattgcagagcctaggctcccacttcacatgtactcttagtgattttagtcactgagatt

SEQ ID NO: 21091 - DNA, 452 bp, Gossypium hirsutum
  unsure (1)..(452): unsure at all n locations
  Clone ID: uC-gsflnu33B082e09b1
ttttcagacctagggaaaagcttatcgagtatcagaaatattttcaaggcatccacaaacacacttacttgaaaggtccttacgataagatcacatctgtcgccattcctgccgctctagctgcaagttccttgtttttaatcggacgagggatctataacatgtctcatgggattggaaaaaaggattgagagctctcactcgtggttagaagacatgtttttctttttttgggtttcattttagcatgaaattgtttgtttatttgctctaataattgtttggtttttatgccaaatggagatcttaaaagataccctttgcggttatgttttttagtttggttttggattctcttgaaaagctaaatgataagaaactcaaggattcaacatgatgttttatgattattattgcataatttggatttggattttgagtttgtaaanaaa

SEQ ID NO: 21092 - DNA, 327 bp, Gossypium hirsutum
  Clone ID: uC-gsflnu33B082e10b1
tattacgcgtgcgagttactggagaatacctcacatttcctggtggtggaacccagtttaagcacggtgcgcttcattatatcgacttcatagaagagtctgtgcctgatgtagcttggggaaaacggtctcgcgtagtattggatgttggatgtggggttgccagctttggaggttttctttttgacagaagtgttgttgccatgtcctttgcaccaaaagatgaacatgaagctcaagtacaatttgcacttgaaaggggaattcctgctgtgtctgctgtgatgggtactaagagacttcctaccctggcagagtatttgatat

SEQ ID NO: 21093 - DNA, 518 bp, Gossypium hirsutum
  unsure (1)..(518): unsure at all n locations
  Clone ID: uC-gsflnu33B082f07b1
tttttatgttgaggccaattatatacttaataccacacacaaatggcatacattttactaactaatgcattacatattataactcaatacgcatccatcatttactccataaccgaacaccatcatatgaaaatatataccttgagatattatatatgtcatgccaatacatcatgtgcaaacatatatatatgtgtgtaagagccgaatcacaaggttgattataaccaaacataaacataaatccaaaacacaaatcttacctaccatgcaataagcataaatcatacttatggatataccatggccgaatacatcacaacaccttaccatttcaattttgatcatggttaaacaaagaacttaatgtctcactcaaaaatgctaaaaagaaaaatccaagagttaatcaatccaccatcacatgtatcattaacaagcttcacatttagcatgcaatgacattaacacanaatccaccttggccgatatcatccccatgacatagcacagatttg

SEQ ID NO: 21094 - DNA, 535 bp, Gossypium hirsutum
  Clone ID: uC-gsflnu33B082f11b1
ttcacgcgtccgcccacgcgtccgcccacgcggccgcccacgcgtccgggaggagttccgctatgattcttctgtttcagctgaggttgggggtaggcaaacacccagcctccaattccctcgaaccaaggaagttatggttaatggggttcatgtacgggtgaagtattgtgacacgtgcatgctttatcgtcctccccgttgctcccactgttccatttgcaacaattgtgtggagcgttttgatcaccattgtccttgggtgggccaatgtattggattgcgaaattaccggtatttctttatgttcgtttcttcggcaactcttctctgcatctatgtattctccatgtcagcattgtacatcaaggttctgatggatgatcaccaaggaacagtttggaaagcaatgaaggaatctcctccatctgtcatactaatggcatattgtttcatctcactgtggcttgttggcgggcttactgggtttcacttgtacctcatctcaacaaaccagacgacatatgaaaattcc

SEQ ID NO: 21095 - DNA, 466 bp, Gossypium hirsutum
  unsure (1)..(466): unsure at all n locations
  Clone ID: uC-gsflnu33B082g01b1
catctgctgggccagactacataccttgcctagacaattggcaagttatcagaaagcttccaagcacattgcactatgaacatcgtgagagacactgtcctgatgaagctcctacatgtcttgtccctctgcctgaaggatacaagcgctcggtaaagtggcctaagagtagagataaaatatggtactacaatgtcccccacaccaagcttgcagaggttaaggggcatcaaaattgggttaaggttactggtgaataccttacctttcctggtggtggaactcagtttgtgaatggtgctcttcattatatcgattttattcaagagtctgttcctgaaattgcttggggaaaaagaacccgtgttgtattggatgttgggtgtggngtgggctagctttggaggctatcttttcgaaagaaatgttcttgcaatgtcatttgcacctaaggatgagcatgaag

SEQ ID NO: 21096 - DNA, 520 bp, Gossypium hirsutum
  Clone ID: uC-gsflnu33B082g02b1
ggtagagctaccttttttttctccttttccaccggcggcgatctcgatccttatcctcgttttcaaacaagctcaaaaaagatggccaacgctgcatcgggaatggctgtgcatgatgattgcaagttgaagttcttggagctcaagacaaaaagaacccaccgcttcattgttttcaaaatcgaggagaagcaaaagcaagttattgtggagaagcttggtgaaccaaccgaaagctacgaggattttactaaatgtctccccgctgatgaatgtcgatatgctgtgtacgattttgattttctaacggccgagaacgtcccgaagagcagaatctttttcatcgcatggtctcccgacacgtcaaggatcaggagcaagatgatttacgccagctccaaagacagattcaagcgagaactggacggaattcaggtggaattgcaagcaacagatccaactgagatgggtctcgatgtgttcaaaagccgtgctaacttgataccgttcttttaggcat

SEQ ID NO: 21097 - DNA, 411 bp, Gossypium hirsutum
  Clone ID: uC-gsflnu33B082g07b1
ttggtacgcgtgggcggacgcgtgggttttggctactcgtcacctgcattgctgcagtttcattgggatcaccagtggaaacccaaggttttgggggatgcctcatgtcgttcgcaagtgtaaaaggttgcgttgaggcaatccacgaggttgtttcgcacgagaagttcgatgcactccaacctaaatgctgcaaagcaatcattaagctgggcgacaattgttggccaattgtttttcccaatcaaccttgccttcctgtcttactcaagaccgtttgtaaggttttagggatggttgtgaaagttgagaatgttgcagcagcaccttgatagtttgcgttgttgagatttaacttccttggattgagagatgacacagctctattcgttcttttagtctttcaaatct

SEQ ID NO: 21098 - DNA, 541 bp, Gossypium hirsutum
  Clone ID: uC-gsflnu33B082g10b1
ttgctataataggtgacaaaacatcgttgaagagttccatcttcctcccctactctatttagaagctgtggtgaaagagacgttacgaattcacccaccggctcctttgctaatgccacacatgctgagcgagaccactgtcgtagccggttacactatctcaaaaattctaatattttcttcaacgtgtgggcaatacaaagagatgctgaatttttggaaaaccctcttcaattcgagccggaaaggttcttgaatgtcattgagaaaaggaattataagggaaatagtttcgattttttcccgtttggatcagggaggaggatttgtgttgggatttcaatggcagagaaaattattatgctgatgttggcgacgttgcattgttttgaatggaaattaccgaacaggcgagaacctgatgtgaaagagcagctacatttgttgttgcaaaggtggagccgcttgttgtcgtgcccatttcacgttcatctaagtggggatattgtggttaaatatgctttacgtcactatattttta

SEQ ID NO: 21099 - DNA, 302 bp, Gossypium hirsutum
  unsure (1)..(302): unsure at all n locations
  Clone ID: uC-gsflnu33B082g12b1
tttttatttggggcatgtaatcaagacaatacgctgtcagtggttcaactctaattaagtggactgttatatcaggacatggaccctaaactgacgggtacgtactggctatatttagatttagactaatcattatttatgttgtgcttgtgattctgtaatgtattaaaagttttaaacctcatgaagctacctttgaagccgcttggtgtactgattgtagtattttcttgataataactgaaatttatataaaaccaatgttgtgcanaaaaaaaaaaaaaaaaaaaaaaatataacaa

SEQ ID NO: 21100 - DNA, 528 bp, Gossypium hirsutum
  Clone ID: uC-gsflnu33B082h04b1
gttatctttttaaaacagtcaaaagtatttatgaagcgaggtcttttcgaccatgggagggtcaacattctctttcgctttgagccttgccattttctcaatctgagccgttgatgcagctcaccaccatgcgacagcgccgtccccttcttattctctattattctcctcttactccactgcggactgcatcgactctgatactgaacatggcggattgtttgtcgttcgtgtcaagtgggagcgaggtgtcgaaaccggaaggaagttgctgttctggattgaacaccgtgttgaacacgggccctgagtgtttatgtgaggcatttaagagcagtgcttcaatgggtgtgtcattgaatgtcactaaggcctccactttgcctgctgcttgtaaaggttctgctccttcttctactaactgcgctgcatctgtcactccagctggtgccacagatgtggaaccatcagcagcagcaggtgcacccacaacattctctgcagcaaatgaggtagcaccaacaccag

SEQ ID NO: 21101 - DNA, 540 bp, Gossypium hirsutum
  Clone ID: uC-gsflnu33B082h10b1
tgtctctcaagcttgccactccaacttttggggatcttaaccacctcatatctgctaccatgagcggtgtgacatgctgtctgcggttccctggacaactaaactctgatctccgcaagctggccgttaaccttatccccttcccacgattacacttcttcatggttggatttgctcccttgacatccagaggatcacagcagtaccgggcactgactgtgcctgaactgactcagcagatgtgggatgctaaaaacatgatgtgtgctgctgacccacgccatggccgttacctaactgcctgtgccatgttccgtggtaagatgagcactaaggaggttgatgagcaaatgattaatgtccagaataagaactcgtcgtactttgtggagtggatccctaacaatgtcaagtctagtgtgtgtgacatcccacctaagggtctgaaaatggcattcactttcattgggcaatcgacctcaatcacgagatgtttaggaggggtagtgagcagtttacaagcatgttcagaaggaaagc

SEQ ID NO: 21102 - DNA, 343 bp, Gossypium hirsutum
  unsure (1)..(343): unsure at all n locations
  Clone ID: uC-gsflnu33B083a04b1
tcgcctacgcgtccgctggaattaaagagagacccgagtgccgactaactgttgtagtgagggaaatgacccctgaagaggaggctgagttagcccgactgagggtaagcaaatttcgcaagcttactaagcgcgaaaaacgacttgtacctcataaacttattgaaacctctcctatttggaaccgcaaaggcagcggcaacggcaggactcaggaaccaaatggtatggttgcatgagatttctcacttttcgtaaaactagaaagtgttgaagtgctaaaaagtttgtagtctttaatcattttttcttggtacattacaacttggagancagatgatgt

SEQ ID NO: 21103 - DNA, 270 bp, Gossypium hirsutum
  Clone ID: uC-gsflnu33B083a07b1
tttacgtgtgtgcgtacacgtgaggagatccatgcgggggatttgttaatacggtagggtgttttcagcatcctagttttgagtgtagtggctcgtgataaagataatatggctgaggagcataccaatgttggtgctgaggaagctgcgtatagcatggagcgatgtatgttaggtttcttggtgtaaaaagaacataacaagccttcaatcttaagaggaggtgtgtgacacccagtttgagaaagttaagtatgaaaaagttcatgt

SEQ ID NO: 21104 - DNA, 266 bp, Gossypium hirsutum
  unsure (1)..(266): unsure at all n locations
  Clone ID: uC-gsflnu33B083a11b1
aagctgcacgcctgccngaccggtcctccattgccgacccaagcgacccgttacgtttccggaaacaagcttgcctttacatgggttggaaggtaatggtggtggtagcagtggtggtgcttatggccggacctattcgaggatgttttgggctggacatcacaatcatccatcggaggcgttcacaacctttttggtgaaccaaatgatgatagcgaagaacatagtgatgatccatatagctatgctaaggcataagcaacgcc

SEQ ID NO: 21105 - DNA, 232 bp, Gossypium hirsutum
  Clone ID: uC-gsflnu33B083b06b1
tcgatttataaataaaaaaatgtaaaaaaaaaggaagggagaaataaaaaaaaggggtggcaagaaaagagaaaatggatttggtgtgcaatggcttttttagctactattggggggctggcttccttgtgttgatcgtgttgattactttacctttgctttggattttcatgctttggattgtaatctgggagcatttattgctctaagctcccagaggattttgactttc

SEQ ID NO: 21106 - DNA, 488 bp, Gossypium hirsutum
  unsure (1)..(488): unsure at all n locations
  Clone ID: uC-gsflnu33B083b09b1
caaaaatggattcatcgaaattgggttcagtccctgaagaagagctgcatcgagaagagagctacaagccacatagtttctgcctttgcctcgcttcccgatcgccgtccaactaagagttctgagaaatactcacctttagattggtccggcttttttgatggagaggaagatgtctgcataccagactcaaatgatgtctttcatttatatatggcaggaacagaaggaccagttgttttttgtctacatgggggcggctactctgggctctcatttgctctgtcggctagtaaaattaaagagaaagctagagtggttgccatggaccttagagggcatggaaaatcatccacagaaaatgatcttgatctatctattgagactatgtgcaatgatgtttttgctgttttgaaggcattgtatggagattctnacctgcgattgtgctttgtgccacagcatgggaggctcagttgctgtacaca

SEQ ID NO: 21107 - DNA, 403 bp, Gossypium hirsutum
  Clone ID: uC-gsflnu33B083b11b1
tattttcttcgatttctttgaatccaaatcctgtctggtcaccgtcagttaacccctatggctcggaccaagcaaacagcaaggaaatcaaccggtggtaaagctccacgtaagcaactgactacgaatgtggatcataggatagctacggcaacacggaggagtgaagaagcctcatcgttttatgcccggagctgttgctctgagagaaatcaggaagtaccagaagagcaccgagcttttgatcaggaaacttccattccaaaggttggtgagagaaatcgctcaagatctcaagactgatttgaggttccagagtagcgctgttgccgctctacaagaagctgccgaggctgaccttgccggactgtacgaggataccaatctctgtgccattcacgct

SEQ ID NO: 21108 - DNA, 404 bp, Gossypium hirsutum
  Clone ID: uC-gsflnu33B083b12b1
cttacgcgtccgctttttgagctttcgtgtttggctagggaattctttccttcactttctcgagaaaaaaaaaaatgtcttcaggttgcaattgcggatctagctgcagctgcggatctggctgcaattgcggtgagaactgctcaatgaaccttaaccttggatactcggagaagacaaccagcactcagaccatcatctccggagttgcgccagtgaagatgacctttgagggaccagagatgggcactactgaatcaggacatggatgcagctgtggatcaagctgcaaatgtaatccatgcacctgttgaaaagcttgatgaaagccatagattatgaaaaaagaaagcagcaaaataacaggcctctgtaatgatttattttcaaggatggatgcctgc

SEQ ID NO: 21109 - DNA, 541 bp, Gossypium hirsutum
  Clone ID: uC-gsflnu33B083c02b1
gtaattttgaagaaaaaaaaatccatcaccgatctaagttccccaaattctgttcaaatcgccggcgaaattttgatctgaaaatctaaaaatgtcgtccacattcagcggcgatgaaactgctcctttttttggcttcctcggtgccgctgctgccctcgttttctcctgtatgggagctgcgtatgggacggctaagagcggtgttggtgtggcgtcgatgggagtgatgaggccggagctggtgatgaaatcgatcgttcccgttgttatggctggcgttttgggtatttatggtttgattattgcggttattatcagtactgggattaacccaaaggctaaatcttattaccttttcgatggctatgctcatctttcctctggccttgcttgtggtcttgctggtctctccgccggcatggctattgggatcgtcggcgatgctggcgttagagccaatgcccaacagccaaagctttttggtggaatgattcttatcctcatttttgctgaggctttggctctgtacggactcatc

SEQ ID NO: 21110 - DNA, 195 bp, Gossypium hirsutum
  Clone ID: uC-gsflnu33B083c04b1
tcggcctcctccattttcccacattctgcaaccattcttttctgattaaaaagcaaaaaaaaaaaaaaaaaaacaaaacaaaaccaaacttcaaacaaaagggaattttcttgtcataattttctgaggaattcatcgatggcaaccaaagtgtatattgtatactattccatgtatggacatgtggaaaaacta

SEQ ID NO: 21111 - DNA, 518 bp, Gossypium hirsutum
  unsure (1)..(518): unsure at all n locations
  Clone ID: uC-gsflnu33B083c07b1
ctggttaaaggcagaggtgggtctctgttaagagagaaaatggtggaaggagcttgcaagaaatttgtatgtatcgttgatgaatccaagttggtcaagtatttgggaggcagcggtttggctatgcccgtcgaagttgttcctttttgttggaaattcactgccaaaaaactccaaaacttgtttcgagattctggttgcgttgccaagctgaggaatgattgtaaaggggagcctttcgtaacggataatgggaattacattgtggatttgtatttgaagaaagatattgnggatttgcaggtggcaagcgatgctattttgaggattgctggtcgtggttgagcatggcatgtttcttgctatggccactactgttatagttgcaggggagcttggaatcaccatcaagaataagtagtacaaactcaaactaactttattttaataattagggaattgctattgcagctgggaatggattcttcctttttggtatttattgattgatgacaaga

SEQ ID NO: 21112 - DNA, 547 bp, Gossypium hirsutum
  unsure (1)..(547): unsure at all n locations
  Clone ID: uC-gsflnu33B083c08b1
gtaactcaagattataaatttagtatcgatttgagtatttgaatagtttagattacaagaatggcaggggaattagtattgttggatttctggccaagtccatttgggatgagatccaggattgctttggctgagaaagggataccatacgagtacagagaagaagatttgaggaacaagagtgatttgttgctgcagatgaaccctgttcacaagaaaatccctgttcttatccataatggtaaacccgtttgtgagtctgtcattcaggttcagtatattgatgaggtctggcatgataaagctcctttgatcccttctgatccttatcaaagagctgttgccagattctgggttgatttcgttgacaagaagatatatgacctgnggagcaaaatatggaagacaaagggagaagaacaagcaaatgcaaagaaaggaattattgagtgcctgaagctgttggaaggagagcttggagacangacttactttggaggagaaagtcttggatattgtgatgttcattagtttcattttatacctg

SEQ ID NO: 21113 - DNA, 362 bp, Gossypium hirsutum
  unsure (1)..(362): unsure at all n locations
  Clone ID: uC-gsflnu33B083c10b1
ctgcattntcccacataccctaggccgggttttctgaataaaaagctgggtagagaaaaccccggctaacaagttccggctaaaacacaaggggattttgttgggataactatctgtcagattcatcgatggcaaccaacgtgtgtagagaatactaaaggaatgtatggacatgaggaaaaactcgctcaaggactcttggaaaggggcgcaatctgttggccgagtcaaagagcaactttggcaggtccctgagactctgtaagatgatatgtttggaaagatgcgagcaccaccaaaaagtgaaggaccggtcaacactccacatgacctttctgaggctgatgggataatttttgtat

SEQ ID NO: 21114 - DNA, 299 bp, Gossypium hirsutum
  Clone ID: uC-gsflnu33B083c12b1
tcgttctctcgtccggatatgctgcaattgcggggggatgaattaaaaaaatggggttttaataacggagcaaattgaacttatagcacttggcatttttagttgcagaactgctactggcacctttggcttaatctgtaaaataacactaccttgcattcagaccattcatgctctggaatggcaactggaagaaacctagcgctacctcaatgggacttcactatctaaccagaatcacattcaatacatactaaggatgtaaacgaccgccggaggacctgaaaaggctaagcgac

SEQ ID NO: 21115 - DNA, 434 bp, Gossypium hirsutum
  Clone ID: uC-gsflnu33B083d01b1
cttacttggattcatggaaattgggttcagtgcctgaagaagagctgtatcctgaatagagtcacacgccggctgatactggctttgcctcgtttgccgatcgcctagcaactaaaagttctgataaacactcacctttagattggagcggctcttttgatggagaggaagacggctgtataccacactgatatgatgctttttattcatatatggcaggaacagagggacctgttgatcattgactacatagggggcgggtactgtgggctgtcatgagctctgccggctcgtacaattactgtgaaagctagagtggttgccctggaccttacagggcatgggaaattattcacagaaaacgagctggagctatctattgagactatgtgcacagatgtctttgctgccctgaaggcgtcgtatggggacac

SEQ ID NO: 21116 - DNA, 529 bp, Gossypium hirsutum
  Clone ID: uC-gsflnu33B083d07b1
tcgtttacgcgtccgccagtcgtctccacacacccgaatatccgcttaaaacctttgaacagcacctaaacgagagtaaaatgaaccctttgttaactgcccatatatgaacctacaaagaaggagaagcccgagccaaagccaccggtttatacacctccaaagaaagagaaacctgaacccaaaccaccagtgtgtgaacctccaaaaaagcctccagtgtacgaacctaagccaccaaaaccatcggtttatacacctccaaagaaaaagaaacctgaacccaaaccaccagtgtgtgaacctccaaaagagcctacagtgtacgaacctaagccaccaaaaccaccggtttatacacctacagagagagaaaaaccagaacccacgccaccaatgtatcaacctcccaacaacccaccaatatatgagcccaaaccacctaagccaccagtttatgcaccaccagaggaagagagccaaaacctaaaccaccagtttatgagccttcagcatatgagccaccata

SEQ ID NO: 21117 - DNA, 430 bp, Gossypium hirsutum
  Clone ID: uC-gsflnu33B083d09b1
cccactcgtccgcccacgcgtccgcacaatttgagggtcactttgggttttttcagtcttcttcgccatctcctgaccagctacaaaataaccagtggctttcaggaaatcaaagagcatggagttggaaatttgagattaaagcaatggaagaaaggagttgccataagtcaaaagaataaagatctcaaacagaattttattttatttttttataatgggtagggtagggagctgttcaggaatcaaatttagaactagtgttaacccagtactggcaattgcaatgggaaataaattttgttcagtgtttgttttctaaaaaacaaaacaaataaaaagaaaaaaaaactaaaaaaaaaaaacttgaagctaacaatatgcaaggtaattggtaaaattagacctatttagcccttaaatttggggg

SEQ ID NO: 21118 - DNA, 336 bp, Gossypium hirsutum
  unsure (1)..(336): unsure at all n locations
  Clone ID: uC-gsflnu33B083d11b1
acccaacccacccgtattatctcccttgctgcacgtttgtgagcaagtaaggtgattttgattcttcctcctttgttctctatcttgaactagacctttttgctggtgccattgttccaacatgttgcagaaatggataacgcaatcatgccacagcttcagtccttggaccttcagagttgcgggaagttaaaggctttgccgcactaccttgttggattgacaagcctaaaggaacagagccctgattggggccctggtcttgcagaatactgccaaatagagcggtccaacatatctcgcattccgaacatcaaaatctaaggagtnttatgt

SEQ ID NO: 21119 - DNA, 528 bp, Gossypium hirsutum
  Clone ID: uC-gsflnu33B083e01b1
gtaatgttgagattgatgcagcaattagcaaacttcgtgattggtatccccagattgttcaggtctgtacactattcgattttgtctactgttgtgaaaacatatatcaactgtcataagaggattaagttatgttgtcaatgcatgtgaatgggacttgtatgtggctcctttaatgtcattctagaactttgtttctttgttctgttaaagcatttgtatatttttttgtcagttaaaatatgcagttagtccttgtactttacaatgattaatggcatattttaaccttttttgcctcttgattctttcttttctggttccattattgttgttttggccattgggaactcaaggagtgccctgcatttataaatatcaaatttaacttgcattcttgccttttacttcagtaattcttgtcattccttctttcccttttcctctgtccctatattatggctaggatagagatgtttaaactgggtcaggttagccagtgatacaacagaatatgctaaatatctt

SEQ ID NO: 21120 - DNA, 278 bp, Gossypium hirsutum
  unsure (1)..(278): unsure at all n locations
  Clone ID: uC-gsflnu33B083e04b1
aaganccaaaaagggggagattttttttttatagggacagttcatacagaacctactgagactatggactacaattgtgtataacaatctttaggaccgatagccaatccagccataacttaaggggtggttgccgttaaagtttccatgacgaagataactcgggagcctgacacgggatctgcctcaacatccattattttgatgttggcacacagatggtctagccattcatgaggaacaccatgggttttaggactactaaagcgaattcccta

SEQ ID NO: 21121 - DNA, 557 bp, Gossypium hirsutum
  unsure (1)..(557): unsure at all n locations
  Clone ID: uC-gsflnu33B083e12b1
cccactcgtccggtgaatcctctcacacacacacaaaaaaaaaaaatggcttctttcaattacatgttcttgagctttgtcctggctctgtcatttgcaagctttgatgttgggtttggagcccgtcatcttctgcaactgcctcagttacctccaatgccaatgatcccaactctgccaatgccaacgataccaacattgccaacgactcaaccgtctttgccgaggccaggcgcgatgcctccactccccgccatgcctaacatgcccactttgccgaatgtaccaagggccactttgccaccattaccaagctttccctcaatcccaactacgatcccttccatcccattcctctccccgccacctgcaccgtctactccatgaatcttctgccttaattctggatgcctatggattggattttatgttttatggtcctatcatttatacccacttnnatagctgtttgtgttgatgttatagattaagnctgctttttctttttctttttcttttttttactcttcactacccatatatgtttgtctggaaaa

SEQ ID NO: 21122 - DNA, 511 bp, Gossypium hirsutum
  unsure (1)..(511): unsure at all n locations
  Clone ID: uC-gsflnu33B083f01b1
gcgcctacgcgtccgcttctcttcctgttgaggagattacaaaggccttagcaaagaagggatttgaggtgatgacctccgatgatgcaggacggtttgtgtgcaattatgtttactatcactcccttcgctttgccgaacagaatgggatcaaatctctctttgtccatgtccctctcttcttgaccatagatgaggagacccaaatgaaatttgccgcttccttgttggtggtactcgcttctctatgtcagtaacatactgcatccactcatctttatgtccagaaattgatatggttgtacggttgtatgtgagtggtggagngaaaggatgcattntttgtnngaaagtctttaataaaaggataagtgtatgtgaatgaataaaaactgtatttcagcacatacgccttatgtatttcttttatttctctaatgcttcctctgctgcatggaaatttcttgaatcttcatgttaatatgtcaataaattcctgtttgcttctaaa

SEQ ID NO: 21123 - DNA, 423 bp, Gossypium hirsutum
  Clone ID: uC-gsflnu33B083f03b1
cccacgcgtccgctagatgtggatctccttgctgagcttagcaccagcatccagttcagggctgatcgagagggcaagttgcactctttacatcctgaggctacaatactcagatacctcaccaaagcccctcttggtccaccaggcacaccggtggtgaacgcactgtccaagcagcgtgcaatgctggagaacatactaagggccagcattggctaggctcctgaaaacaacatgattttggaatacatgtgaagaagttgaggagagaaaagtggaacaaagctgtggttcttagaactttacgaccatcatccctttctctgtcgtattcataaaagctcgaggtactgcagtcacagacctgaacgtgtgacgatggtatatgcttgggtatatgatgcttcctttcttctcatctat

SEQ ID NO: 21124 - DNA, 469 bp, Gossypium hirsutum
  unsure (1)..(469): unsure at all n locations
  Clone ID: uC-gsflnu33B083f04b1
caacattacacatcaacacctgaagaagctgctgcagatgccatcaaagcaggtctggatttggattgtgggccttttttggcgcaatacactgaaaatgcagtaacaagaggattgttaaaggaggctgatgttaacagtgccttggcaaacacgctcacagtccaaatgagactcggcatgtttgacggtgaaccgtctgcacaaccattcgggaacttggggccaaaagatgtgtgcacacctgctcaccaagagctcgccctcgaagctgcgagacaaggcattgttctgcttaacaatcgtggtccttcattgcctttatctcatttacgtcaccgcacggttgctgttatcggacctaactacaatgctactgttacaatgattggaaactatgcttgtgttgcatgtgcatacacatctnctttgcaagggatagggaattacgcaaagacaattcataaat

SEQ ID NO: 21125 - DNA, 355 bp, Gossypium hirsutum
  Clone ID: uC-gsflnu33B083f07b1
tcgccttcgcgtccgaaaaaaaaaaaaaaaaggagggagagaaattaaaaaaaaaggaggggaaaaaaaaaaaaaaaaaaaagaagaaaggggtgggcgtttttggggttccaaggtttcgttcccgtgcttgggacgtaataactcttttcttggggggccttatttcttttggctggccggttgttccccgcggggtgcctgggaaaacccttttggttccccaacttatttgcctttccgttgtttccctttttcccagttggggttttggcaaaccggtccgtccccatcgccttttccatcaggggcgccccctttttggcggttggttctcgccctttgggggcgcgtt

SEQ ID NO: 21126 - DNA, 428 bp, Gossypium hirsutum
  Clone ID: uC-gsflnu33B083f08b1
acgcgttcggctatcgcgtccggtgttctgctatccatggcaggaccggttagaactgagtacgggggaccccaacctcgcaagactttgtatttcccaagggaaccaaaggacccttctatgcctgaccaggcacacatatcattggctggcgaaaatcacatgcgaatctcatggatcactgatgataactccgttccttgaattgatgaatacggaagcttgcctggacaatacacctttttatcatgaggagaggccacctcttataattactgattatatagcttctgaaagatacaccatactgtcattgggcctttggaacatgataccgcttatttctatcgttgtggaagacaaggtcccgaatttcaactcaagaccccacctggacaatttactgctacttgtgccgtggctggaga

SEQ ID NO: 21127 - DNA, 480 bp, Gossypium hirsutum
  unsure (1)..(480): unsure at all n locations
  Clone ID: uC-gsflnu33B083f11b1
ctttgatgtcttccagttttacttagtccttcatcttcttcttcatttcagtgtttttgggtttgttttttttcctactgttttggacaataattgaagcaagagataaccttgggggcggcggcggagggagaggaacatctctgaaattactttcacttttgccggtgggtgtaaaatgagtgcatcaaggttcatcaaatgtgtcactgttggtgacggtgccgtcggcaagacttgcatgctcatctcctacaccagcaatactttccctactgattatgtgccaactgtctttgacaactttagcgcaaatgtnggttgtggacggcaacactgttaatcttggattgtgggatactgctggccaggaagactacaatagattaagacctttgagctatcgtggagcagatgtcttcttgttggcattctctctcattagcaaagccagctacgaaaatgtttctaagaaatgga

SEQ ID NO: 21128 - DNA, 450 bp, Gossypium hirsutum
  Clone ID: uC-gsflnu33B083f12b1
tggactcgtgggtgttgctaaagatccatctggcaaagacatcaatgcattggaacagcacatacagaacctactgagtccatccactccatttttctttaacactctttatgacccataccgatccggtgctgacttcgttcgtggctaccctttcagtctccgtgagggtgttaccactgccgtctcacacggtctctggctcaacatcccggattatgatgctcccacacagcttgtcaagccactcgagaggaacaccaggtatgtcgacgctataatgacgattccgaagggaaccttgttccccatgtgcggaatgaatctggcatttaaccgagaattgatcggccctgcaatgtactttggactcatgggagatggtcaaccaattggacgatacgatgatatgtgggctggctggtgcaccaaggtatttgtgatcacctc

SEQ ID NO: 21129 - DNA, 427 bp, Gossypium hirsutum
  unsure (1)..(427): unsure at all n locations
  Clone ID: uC-gsflnu33B083g02b1
cttacgcgtccgcccacgcgtacggtatcttgaatgtgtgtgctgaggacaagactactggccagaaaaacaagattacgatcacaaacgacaagggtcggttgactaaggaagaaatcgagaagatggttcaagaagcggagaagtacaagtccgaggatgaggagcacaagaagaaggttgaagccaagaacccattggagaattatgcctacaacatgaggaacactgtcaaggatgagaagattggttcaaagattgacccggacgacacgaagaagattgaagatgccattgatggagcaatccaatggtttgattgcaaccagctagccgaggtcgatgaattcgaggataagatgaaggagctcgagagcatctgcaatcctatcattgccaagatgtaccaaggtgcangggctgacat

SEQ ID NO: 21130 - DNA, 468 bp, Gossypium hirsutum
  Clone ID: uC-gsflnu33B083g03b1
gttacgcttacgcgattacatagacattacaccacttgcagtgctagatacagatctggaggttgacggcgcgtttgccgctgccggggaggctatcatgcagaagaatatggtgcctgatggcatccttgtggacacccctgattacactgctcctcttacggaggctctgaagagtgcattaggctggccttcaggaccaccaaatgtatgggctgatatagcgggtgccatcggaagcgccggaggaggcttaggacgtgcgcgatcacattatcatgttggccaagttgtgctacatcttgatctacattccatgaataaacccgaggtgtactagaatgcgtctcagcctgcgggcaattgcgatagcgatggccaccttattgatgagggtatcaaggagagaatgaatcacgttcttgtattcttgctagcatttacccttcgactccgacctaaccactg

SEQ ID NO: 21131 - DNA, 360 bp, Gossypium hirsutum
  Clone ID: uC-gsflnu33B083g07b1
tcgcctacgcgtccgacgaataaaataaactaataggcaggaattgataccaagcgggggaatactggcctatttgagggactgggccggcgccttttgaggaatcaagacttacatactctgaacttgcgatctagtagcatatgatataacctggccctaaagttcattcactgaggagctgtgattcaagcagttgcctggtaaaaaccttatgttaccaagattaatggacttgtaaaaattgctcttttcgaacgagggcttaatggtgataaaagacaaaccggtactccttccaaaccgtagaacaaccttgatgggaaatggaacgcgctctgtaagagtatatttaaccct

SEQ ID NO: 21132 - DNA, 431 bp, Gossypium hirsutum
  unsure (1)..(431): unsure at all n locations
  Clone ID: uC-gsflnu33B083h03b1
gcttcgttttgggtgaagaagtgaaggtttttggatacggggcaagcccttacagctacagggcaaagcttgctttgaagttgaaaggtgtttcttatgagtacataaatgaggatatctttggcaacangagcgaattggttttgaaatacaatccggttcataagagagtcccggttcttcttcacaacgggaaaccaattcgggagtctcttggtatacttgaatacattgaggaaacttgggagcataatgcctatttgccacaagatccttatgacaaaactaccgctcgattctggatcaagttcatggacaaaaaggctttgctaccctttggctagctgcatggagcgccgagaatgagcgagaaaaagtgacgaatgaagcttgcgagtatctgaaaacgcttgaaagtgcgcttaatggaa

SEQ ID NO: 21133 - DNA, 437 bp, Gossypium hirsutum
  Clone ID: uC-gsflnu33B083h04b1
agttttctgagcagcttatccatcaatggcttgctttaacccaagtgggtacgaaaagtattcaggttcagcagcagaagcaaccaagtttggccaagacgccgccacgactgggattccagttagctcctccaacgcctactacaccgacacttctcaaaacaccaacactcgtcctcagactaaaacgagagtccgttggtcatctggcctctgtgactgcttctctgactggagaaactgttgcataacgtgttggtgcccttgcgtgacttttggccaaattgctgagattgtagataaaggatcatcatcgtgtggggtaaatggagcactttacacactgatagcatgcgtgacggggtgcgcatgttgctattcctgcttttaccgagccaaaatgaggcagcaatacatgttgaagaaacacccttgcg

SEQ ID NO: 21134 - DNA, 226 bp, Gossypium hirsutum
  Clone ID: uC-gsflnu33B083h07b1
gtccggaattccattgccggctcaatccacgcgtttgcctacgcgtccgatcagaactccgcagttaagcgtgcttgggcctatattgttatgggtttggtttgggtttggtagttggtaattctaaagttactctgttactgtttgggttgggttctctcgtttttgatcgatgtggttactgttctcttaaaagcataaaaatggaatgaagtatcttcttttc

SEQ ID NO: 21135 - DNA, 213 bp, Gossypium hirsutum
  unsure (1)..(213): unsure at all n locations
  Clone ID: uC-gsflnu33B084a02b1
gacaaagaaaccaanaaccacgaagacgggggctctaacacgtaataacagcaccaacaaagaagaccggccccccaagaaacacccaggaagctccactgacaccggcggaggaggcgggagaaaagaaaggcagaaacgcgaagaaaggagcgaaggggctgacacgagctcacacgaggccaacgaaaacaaaagggcgcaccagaaaca

SEQ ID NO: 21136 - DNA, 458 bp, Gossypium hirsutum
  Clone ID: uC-gsflnu33B084a04b1
atccatgaaactcatccacatcacatagctttctccactgctgttctcgccgggaaccaaccaaccaagaaacaccattttttccccttcccattttctctccaattccttcactttttctatcaaaccatccaatcatccttctttttcgatctccccatttttgggttattattttttttcataatatttttggtcgtttgtttttgtcatccggagaaggaaaataaatgagaacaggaaagcaaagtcaagaggaggaagagtacgaggaagaagagtttggttccaaaaaaacaaggcccatcttctaatcaaattatgtgcggaaacgccattaacaactccaacaaaggtgggaagaacagtgataaggctaacgctataagatcgaaacacttggttaccgagcagaggaggaggagcaagattaatgaaaggtttcaagtattgagaga

SEQ ID NO: 21137 - DNA, 349 bp, Gossypium hirsutum
  Clone ID: uC-gsflnu33B084a10b1
tttctcacgcgtccgtttgcttttagctatccagcttgatcccttttgcaggctatagatgtaaaacaacatgccactgctgttaatcttcctattattatggaatctaacggtaagaggaaaacagctgaacatagctacagacatatgagactgcagatgcatttgaatgagttatctgactgtgataaaaaaagctttcttcatgtgcagatataagccttcattcaaccataaatctagttaatccccagtttattttgtcaatgcacttttagggtgagtattggttaatttctggcatttatgaattaatttcaataccactttgggcctaggcatatatttt

SEQ ID NO: 21138 - DNA, 379 bp, Gossypium hirsutum
  Clone ID: uC-gsflnu33B084b01b1
tttttgcgtccgctcaagtacttggtcgatgagggcgagtgggagactttgacgtgtgatgctgaccttgaggagtgtagagatatatacaaatcatcttaatgccacacactcaaaaactccctacataaagctgctcatccgaatctaggaagttgatttggtatcagtgccccattataacataagttccctttaggatatatttgatggtcgtagcagtttgattaggatcatatgatcttaattccctatactatttgcaacaaataataatacattatgagctatataagacaccatgcaataaaagcaaatcgggtggaaggccatctcgatctataacccaagtttcaatatgtcctcaacgggcgtgcct

SEQ ID NO: 21139 - DNA, 536 bp, Gossypium hirsutum
  unsure (1)..(536): unsure at all n locations
  Clone ID: uC-gsflnu33B084b06b1
cattggtctcggggaagacggaccaacccaccaaccaattgagcacttagctagcctccgtgcaatgcctaatgttttcatgcttcgtccagctgatggaaacgaaactgccggtgcatacaaagttgctatcctcaacagaaacacaccctccattatcgcactctctcgacaaaaactaccccaactacccggaacttccatcgagggggttgaaaaaggtggctacattatatcagacaattcttcaggaaacaaccccgacataattctgattggaactggttctgagctggaaattgccgctaaagccgccgatgaactaaggaagggcggaaaagctgttcgggtcgtctcccttgtttcttgggaactcttcgataatcaatcagacgcctacaaagaaagtgttttacatctggtgtatctgtagggtaagtattgaggcaggatcaacttntcggtgggaaaagattgtgggatcgaaagggaaggcaatncgaatcgatcggttccgggcaagtgcaccggcagta

SEQ ID NO: 21140 - DNA, 570 bp, Gossypium hirsutum
  Clone ID: uC-gsflnu33B084b09b1
tcgttcgaaccttcaggccatccatatagagagaatcgaacatgttttgcgcaatttcgggaaaagtacctgaacatccagttgtttcagtcaaatctggaaatgtgtatgaaaagagactcattgaacaatggctcgaatctaatgataatgttgaaccaacaactaaacaacaaatctcaaaagatgatctcgtcgaagtaaaaggatcgaaaaccgtcattcctagaccaactaccgccactagcattccttcaatgcttcaactcttgcaaaatgaatgggatgccgtcatgctcgaatccttctcattaaaacaacaactcgaaaacgttcgtcaagaactcgctcacgctctctatcaacacgacgccgcttgccgagtcattgctcgtctcatcaaggaacgtgacgaagccagagcactctctgccaatatccgagctcaattgcccgccgaacaaacatcgagcgactcgatggaagttgaagccggattacccgaagaagttaaatttaaaattcaagctttttcacaagatttggccaaagagagaaagaagagacaag

SEQ ID NO: 21141 - DNA, 450 bp, Gossypium hirsutum
  Clone ID: uC-gsflnu33B084b11b1
tgacgcgtgggcggacgcgtgggcggacgcgtgttcatacgcgtgtgtgttgtttcatgtcattagcggtctatatggggaagacatggcaagtattactaaagtagttatctcagtgacctacatcttctcaaatgcctgaatttcaagtgattttcaacgaccaattcacaaacgatttcaataccctcttcacgtatctcccacaagacaagcaataccttgtagcttccgatcctggttctttccataaccaagtattgcccaaatcatcactccatttagcccattgctcgaattcgttgcattggttttctcggctgccgaaggagctgcgagacgagcgttttccggcgtggaacaaaggcacgatttactacaccagtgcttcccctgaagttacaatggcgtatgcgacgcacttcgcttgagatctagacaattttttga

SEQ ID NO: 21142 - DNA, 508 bp, Gossypium hirsutum
  Clone ID: uC-gsflnu33B084c03b1
ttcttgcgtacggtaaaaccatcaataatcaatagagtgcaagtgggaatgagcactatgagttcattgtagaatatgcatacactcaacacttgactgtcagaagattctgacgatgaaagggcccaagcccctgaactgattggctgtgctcaagaggcactgaaggacctggtgcctaggaaagtgaaggatatatggctgaaactggccaaggacttggttggccaaaaagatgccaaaaacaggggggaagtgcagctggcgctactttactggcctgttgatacagaacgatgaatcaagatcccatgtgaccttgtgcttttattaacatcattggagatggcccttaagactgcaactgctgcaaaggagggtgacagtatcattcatacaatgactacgaatagagagatattcaatgcattgtcgggatcaccggtgggcctgaaattccatttcatcctggaagagtggacaagcctcacccaccacctgagggtcg

SEQ ID NO: 21143 - DNA, 403 bp, Gossypium hirsutum
  Clone ID: uC-gsflnu33B084c05b1
gttttctcaacttgcaatcgcatggtgcgctgcaaatcccaacatatcatcggttattactggtgctacaaaggaatctcagattcaagagaacatgaaggcacttgatgtaatcccattactgactcctgctgtcatggagaagattgagaccgtttttcaaagcaagccaaagcgtccagattcttacaggtagacgccggtacctgttgcttccttagcatgtcattggcatagctgtgttttggagcagatgtgtgagcatcaatttatgtacttggtttggtgttttatagtactttgcaactttagttgtatttggcacccttatcattgtggaaagaagacttgggagatgaaatgaatttggaactggttgtgattgttggtggattgtgaatgt

SEQ ID NO: 21144 - DNA, 468 bp, Gossypium hirsutum
  unsure (1)..(468): unsure at all n locations
  Clone ID: uC-gsflnu33B084d02b1
tctttcacgcgtccgattccaggtcttgcagttcaattgatgctaaaattaagatgtatggttctcttgactctattgaacctgtaaaagacattttagaaaaggaccaaaaaggctttgacacatctttagtggctgcaattgatcgaaccatgaagaaacatactgataatttgatgcacatgttagaaggtgttggtgaccgacttacacagctggagagtagaaccagtaaacttgagacttctgtggatgatttaaagatgtctgtaggaaacaatcatggaagcattgatgggaaaatgagacagctggagaacattntaaaagaggtgcaaacagaggtgcatgttgtaaaagaaaagcaggagagtgttgaagctcttttacagcatgcaaagctgcaggagaccaagatggaccagccatcggaaactcattacactgcacatataggttccatgcaac

SEQ ID NO: 21145 - DNA, 558 bp, Gossypium hirsutum
  Clone ID: uC-gsflnu33B084d03b1
tttttaacgaaggaatcactcctgggcacagcagggtgttcggttcttttgaaagttctgattacagctcagctcaatacaaggaagatatgaagaagttcaggaagatagcactggaaagccaagagcttcctagcagtgaatacagtgtagtcaccagtgattatggtgttaacccatctagctccagcactgaagggcaacaaagcacgcaaattgaaacatcaaaaggggagaaagaaaccaaagatgtaagtggaagctcgtaacaaaatctaccacgaaatttgcttggacaacagtaaaaattctttttccacccagttttatattcaccattgtattgcctcgtttgcaactagagggcatcacttctaaagcaaatttgagatttctgctatccgaaatatggcagcaaacaatggaattgggtggattttgtcaattccatcgatttcaaagtattatttgattggttgagttgtaaaaacctctattgcatgtatatttaatgtagctcacggctagtaagttgagtgctgtatcaaactcaaaaat

SEQ ID NO: 21146 - DNA, 545 bp, Gossypium hirsutum
  unsure (1)..(545): unsure at all n locations
  Clone ID: uC-gsflnu33B084d04b1
ttcaagcgctccggcaagattgagcttccttcatggactgatattgtcaagaccggcaaactcaaggaacttcctccatatgatcctgattggtactatatcagagccgcttccatggcgaggaaaatatacctgaggggaggtcttggtgttggtgcctttagaaggatttacggtggggctaagagaaatggaagccgtcctcgccatttctgtaagagcagtggatctgttgctcgccacattcttcaacaattgcagaacgttaacatcattgatattgatcctaaaggtggtaggagaatcacatcgaacggccaacgcgacctggaccaagtagccggaaggattgcggttgccatctgagtaacttttaatacccaaatttgcttgtttttgctgttaagcaattttcattttaggtaccgagagagtgaagacatggaatatgtttatcttaggangggatgacgttgtcactatgtatcaccgtcgatcttgaaccttgttgatgaaaactcgaatctttaaatttggctttttta

SEQ ID NO: 21147 - DNA, 486 bp, Gossypium hirsutum
  unsure (1)..(486): unsure at all n locations
  Clone ID: uC-gsflnu33B084d07b1
tcgttcacgcgtccgattccaggtcttgcagttcaattgatgctaaaattaagatgtatggttctcttgactctattgaacctgtaaaagacattttagaaaaggaccaaaaaggctttgacacatctttagtggctgcaattgatcgaaccatgaagaaacatactgataatttgatgcacatgttagaaggtgttggtgaccgacttacacagctggagagtagaaccagtaaacttgagacttctgtggatgatttaaagatgtctgtaggaaacaatcatggaagcattgatgggaaaatgagacagctggagaacattttaaaagaggtgcaaacagaggtgcatgttgtaaaagaaaagcaggagagtgttgaagctcttttacagcatgcaaagctgcaggagaccaagatggaccagncatcggaaacttataacactgcacatataggttccatgcaacaagctgcatctgctcctt

SEQ ID NO: 21148 - DNA, 453 bp, Gossypium hirsutum
  Clone ID: uC-gsflnu33B084d09b1
tactcttggctgagcctagttgttatatttgtttgccggtggctaatttaccaaaactaatttcttacttctaccttttaggcctgttatgcgttgaaagacatggtggggatttgtctagcgaaagacagagcgtcaacacagaggagacagtggtgaccaacaaagatgaacagacctgtttggggaggacggagcatgagtcaaggtttattcacaagacccaaggctatgggctacacgggcatgagactggatagttgcctcctaggaccaccaggaccaaagaaacctatgaaccgtatggcacacctgcataataccaccctgatggaccctgcattcgcataccatggtgcaggaccaactgcaaagactcttacttttgtcgcatgcacaatgcgtactggaacgctgagcagtagagtgaagcccagttcaatgagaaaggat

SEQ ID NO: 21149 - DNA, 525 bp, Gossypium hirsutum
  Clone ID: uC-gsflnu33B084d11b1
taagcctacattttgctctctttctcaccctaaactcttcaaagaagcagcagcaactaaagctttgaggaaatggcgttggctttcgatgagtacgggagacccttcattatactcaaagagcaagaccagaaaaccaggctgagagggatcgatgcccaaaaagccaacatttccgctggcaaagccgttgcccggatcctccgaacctctctcggacccaagggcatggataagattctccaaagccccgatggcgatgttaccatcacaaatgacggggcaacaatattggagcagatggatgttgacaaccaaattgctaagttgatggttgaactatctcggagtcaggattacgaaattggtgatggaacaactggtgttgttgtcatggctggagcacttctagagcaggcagagcggttattagaacgtgggattcatcccatacgaattgcagaggggtatgaaatggcttcaaaatcgccgttgagcatttgagcacatatctcagaagtttga

SEQ ID NO: 21150 - DNA, 356 bp, Gossypium hirsutum
  Clone ID: uC-gsflnu33B084d12b1
tcgaagccacgcttgcttacgatggctaccttggaactttcttttttttcaggggacgtgattacaatccattgagctgcgggatattacctctgatgcgggagataaaacgctggtactcacataacttagattggctacgaatatctgtttaacatggctggctgaataaatagttataaggctcggatcgagcttccttccaaacagttgaccatgactggatgatgggaggaaccctgtgttgacaaccaaattactcacgttgtgggtgatgtatacaggctgaccgatccctttactagcgacctagctaccgccggttccgttatgtttcctgcctttctagcaacagc

SEQ ID NO: 21151 - DNA, 342 bp, Gossypium hirsutum
  Clone ID: uC-gsflnu33B084e02b1
cggaacttggccgggtccgaccgcaggccttttgttgtgcggtgcaaaactgaaatccatcaccaggacatcctgagggcagctgctggtaaagctctcggatccttcaagcgcaactgtaccatggaatgaagcaatcattctccagccacaagttaggacagaagataggttaaaaacggggcggtggccatggacgattgaattaagatttatacatgaggttgagaggctatctcagcccactcaatcttgaaattatgatggaggatgtcatgcttttatgtatgccgcacttactgggaacgggcctcatcattatcccgtgctttttcttatcct

SEQ ID NO: 21152 - DNA, 540 bp, Gossypium hirsutum
  unsure (1)..(540): unsure at all n locations
  Clone ID: uC-gsflnu33B084e06b1
ttctttgttctttgttaacgaataaggatcttttaagatacgccggatccgctaaaatacgccgatccccgttcgtcttccgatcatatggggctgcttgaccagttgtgggatgataccgttgcgggtccccgacccgataatggtctcggcaagctccgaaagcactccactttcactttccggcctaactctgccaaggaatcggatggcgggagtgtaagatcgtacggtgatgaagcgccggaggaagcgacgagagtgacacgtagtattatgatcgtaaaaccgcctggttaccagagcggatcgccttcggtttcgccggacggatcgacccctccggtatctcctttttccggaggcagagaatcatatcggtttcggagaaggtccacatcggatgcatacgaganggctaacgaggttggaccaaggagccctcgtactccttacgacgtgtgagatatgagtcctctcccatatttggcgacaaatcaaatgggttttggtactggttgcatgcttaggtctttcaat

SEQ ID NO: 21153 - DNA, 526 bp, Gossypium hirsutum
  unsure (1)..(526): unsure at all n locations
  Clone ID: uC-gsflnu33B084e11b1
tttcacgcgtccgaaaattttaaacaaactaaaacaaaatttgcagagaaacacagcagcagccatggcagctcgcaagagagcttcagcggcagatacaaagccaagccctcctcctcaaacccaggaaacaaccacccaaattgacccgcctatcgctccacctaagaaagccttaatcttcaaattctgtcttttcttttcaatcccatacttttaccttctttaccaacactacacgatcgagcaagaactcaggagatccatccttatcaatgcttccctttgtgttaccggcttcttccttactcagagaatgatccctgttgcttctagatatgttttgaaacgcggtttatttggatttgatattaacaagaagggtacccctcaaggcactgttaaagtgcccgaatcattgggaattgttgtaggcattgttttcttggtattggctattctattccagtattttaacttcacagcntgattcaaatggctcgttgagtataatgcagccttagca

SEQ ID NO: 21154 - DNA, 165 bp, Gossypium hirsutum
  Clone ID: uC-gsflnu33B084f02b1
tctctcacgcgtccgcacaataataataaccaaggctctgtatcaaggaaaaaaaccatttcttgcagaccaacatgaggcctaaaggcagccaagccctctatcttaaggtccggcgttaaaggagttttcactgcttttcatcctcctattcgagtaagatca

SEQ ID NO: 21155 - DNA, 340 bp, Gossypium hirsutum
  Clone ID: uC-gsflnu33B084f03b1
tttatatacagctatctggcatgtccaaaaaggtggctacgttaacataaatgttccttacactattcactagactgagcttgatgattaatttgctatcttattgaagaacccttgtattaatataaaaagaaagtggataatgtatacctttttgacctgagatatacgatattagtacctagtacctaggactatcacaatctaagggttttggcgatcaaggaatctatctttagctaacgtggtggactgcaacagaaggaccacaaaagcaccgtgccaacatcatgggttaccaaaattttaaagtactggatggaagattaagacgtggaat

SEQ ID NO: 21156 - DNA, 466 bp, Gossypium hirsutum
  Clone ID: uC-gsflnu33B084f07b1
tttcacgcgtccggattttattaaatctgatgtgattataggaagcaagaaaattgaggctcctgtacttttccagggcattggccattcactgaatcctgtcaatagcttggtgttaaaggttctctcagcttctccatctgcctattcagctaatcccttatccaagctgtcaactccaccatcattgacgggttctgcaatctccttggtttcagttgtccaggcaaggaacaatgcacgaattctgattactggttcactaagtatgttcagcaatcgattttttagatctggtgtccagaaatctgggagctcaaccaaatatgagaaatcaagtaatgagcaatttttgaccgaactttaacaaatggattttccatgaaagaggtcatcttaaggctgtgaatgtaaaacaccacaaagtcgtagaaacagatgaacctgcttgtacaggattaatgat

SEQ ID NO: 21157 - DNA, 470 bp, Gossypium hirsutum
  Clone ID: uC-gsflnu33B084f08b1
tctttacgcgtccgcacaaatataataaccaatactctgcatcaaggaaaaaaaccatttcttgcagaccaacatgaggcctaaaggcagtcaagccctcaattttaaggtcctccttttaggagttttctttgcttttctcctcctttttgtgttaagatcaagtatatcatcttcccaagatgatacatcgaatttacaaacatttgccgcagctaaaacctctaatggtgttaaagaaagcaaaagtggagcaaattgctcgccatcttgtgacaagattccacgctctctagcccaagctctcattcactacgcaacttcgagtatcactccgcagcaaacactgaaagaaatctctgtcactgccaaaattctagagaagaagtcaccatgcaatttcctagtatttggcctaggccatgacagccttatgtggagttccctaactacggtgggcgaacagtttt

SEQ ID NO: 21158 - DNA, 575 bp, Gossypium hirsutum
  unsure (1)..(575): unsure at all n locations
  Clone ID: uC-gsflnu33B084f09b1
tcgtgtgccatgttattgtatattaatataatcttccaatggttaaccattggccaactactgccagaaaatagttaattgagaagcatttttgtagcctgttgcatcaatccttggaattcagcaagaaaacagtttttgggatttgatgctaatgagctcacttcgaggagtagaggaaaagctactgctgttcaacaaataagaaaggttaagggatacaaggcattagacatgattggtgatggtgctactgatcttgaggttagtaaattcatcttacctttctttagatatagttaatctttaaggttaccatataaagtaatttttccttcaatgcattggcaatcaatatattaacggttaatgaacccgcacaaaagagagaaaatggaggtcatcctgttgcagggttttcatcttctgcatctggtatgcgaggaaataacatgaatcgtgtagagtgtataatgtgctttgaaatttcactttaaaagaattaaacccagaagttataacttnttgcaggaaaaantttttgaattagttcaactttatttaactaataaata

SEQ ID NO: 21159 - DNA, 500 bp, Gossypium hirsutum
  unsure (1)..(500): unsure at all n locations
  Clone ID: uC-gsflnu33B084f10b1
tcgttcctactggattcaagtgcggtatcaactaccagccaccaactgttgttccaggaggggaccttgccaaggttcagagagctgtctgcatgatctccaactcaaccagcgttgcggaagtgttttcccgcattgatcataaatttgatctcatgtatgccaagcgtgcatttgtgcactggtatgttggtgagggcatggaggaaggagagttttccgaggcacgtgaagatctcgctgccctggaaaaagattatgaagaagttggcgctgagtctggtgaaggagacgaaggggatgaggaggagtattggngngatgtaccgttatccgtttgctactgtgatgtattttcttgttgattttggatgtgtgttttcagggttgaatacctcggataatgtactagtttttggtattttctatgaataaagtgcacggtaaattttttcatatatatccatttttcttatttatttttctattccttttttatt

SEQ ID NO: 21160 - DNA, 427 bp, Gossypium hirsutum
  Clone ID: uC-gsflnu33B084f12b1
aggaccgtccggaattccggtcgccacgcgtttgtttaaaaaacttcccacattcaccatgtggtggcacgtgcggcaactgtgactgctctgaccgcagccaatgcacgaagaagggaaacagtaacaccatgatcgttgagactgagaagagctacatcaacaatgttgagatggatgctccagctgagaacgatggcaagtgcaattgcggtactggctgcagctgcacagactgcacctgtggccactaagccaacatacaatggtcatgcttcagatcatggcatatatagggatctaaataatgaatttaaggttgaataatttgtgtctgctgtagtttgtgtggtgacttatatctgttagttaacctttttctcctttactatgatgtaaaggctatgcttatggccttctggttaat

SEQ ID NO: 21161 - DNA, 504 bp, Gossypium hirsutum
  Clone ID: uC-gsflnu33B084g04b1
tttcttgtgtccgaaaaaagcaattcaattaggagggaaaatggcaaccgaaacctgattggatcacgacagaaccaaagagttgaagcaattcgacgacacaaaagctggtgttaaaggactcgccgatgccggaatacttaacatccccaagatttttgttcgaccagccgaggaccttgccgccgacgaactgaattctggccacaaaaacgtcgaagtcccgatcatagatgtaagcaacgtcggagacagtttccggcgacaggagatcgtaaacgaagttaagattgcatcaggggaatggggtttcttacaagtgataaaccatgggatcccattaagtgttttggatgaaatgattgaagggatacgtttgcttaatgaacaagatttggagttgaagatggagctgtatagccgtgacggtgcaaagaaagtgaaattcctcttttacttttatatttatacttgaaaagcccctgattggaaggacactttgca

SEQ ID NO: 21162 - DNA, 383 bp, Gossypium hirsutum
  Clone ID: uC-gsflnu33B084g06b1
ttctttcgtccgcaaaaaaccattttgccatctagtgagagagaacctgagacactggcgaaattcgcttttggttcgtgaagtgatcatgcccagcaaatgcaagttgtgcagtaactccgatgattcaatattgccaaaccttgtttacagcacacatgatgatgataggtacgattttttcttgtgttatctttttgtgtaccatgagtttggttcattctaaaaagtaggaacatgtgaactgtgggcacttatgttttgaagcaaggtgtggcaaccttttgaattatacaccaatgatgtcaacgtttcgataattggctccaggattaggtatattgaacatccctggtttattatatatatatatattctcgact

SEQ ID NO: 21163 - DNA, 297 bp, Gossypium hirsutum
  Clone ID: uC-gsflnu33B084g08b1
tttttagtctgtaaactcgataaattaagatgacctctttcatctcctcgattggtggtcgtctgggcgccgcgaccggtatgggctctctgttccgtcgcatggccaacaaaccgacgaaagtccgtcaccaccaggagctgtcgctcgccgatccggacggtgcctccttcgaacgcgctcacaacaaagccgttgcgaaggcccggcttctggctccgttcgcattgttgcttacctccattccgccgggtttggccgttttggtgggtgtcatgaacaaccgccagaaaacca

SEQ ID NO: 21164 - DNA, 352 bp, Gossypium hirsutum
  Clone ID: uC-gsflnu33B084h01b1
cttttgtagaagctgtgaagcaagcaaaatgggggaggcagagttgggttgcaaagacgaatgatcccgccctcaaggcgtgactgcacttgtcaccggcggtaccaaaggtattgggcatgcaatcgcggaggaataagctggacttggagccaccgtgcatacatgtgctcgaactgaaaccgaactcaacgattgcttactcgaacggaaagcaaagggttttcgagttaccggatcagtgtgtgaagtctcgcaataagcttaaagggaaaatacagtaagcacttgttactctgcgttcactggaaggattaacaaccttgatgaataacgctggaacgaatacagg

SEQ ID NO: 21165 - DNA, 560 bp, Gossypium hirsutum
  Clone ID: uC-gsflnu33B084h04b1
tttttatatccctcattctcagataagaaagggcacagcatcacgcttattattctcaaaacagactataccacattattatttaacagtggatacatgtgttgacaaacttatggatttgcggagccaactcaactcattacaggaagcttcaggtgggaagcgtatatctgtcaatgatcttgtaattaaggctgctgcattggctctccgaaaggttcctcagtgcaatagttcatggacagatgactatattcgccagtataacaatgtgaatattaatgtagctgtgcagacagacaatggactttacgtccctgttatcagggatgctgataagaaaggtttgtcctcaattgctgaggaggtcaagaatttggcacaaaaagccaaagagaacagcttaaaaccagaagattacgagggaggcacatttacagtgtctaacttgggagggcccttcggtattaagcaattctgtgccatcattaatcctccacagtctgggattttagctgttgggtctgctgagaagagggttatccctggcttgggccctg

SEQ ID NO: 21166 - DNA, 359 bp, Gossypium hirsutum
  Clone ID: uC-gsflnu33B084h07b1
tctgtagaagctgagaagtaagcaaaatgggagaggcagatgtgtgtagcaatgacaaaagatggagtcttcaaggcatgactgcacttgtcaccggtggtaccaaaggcatcgggcatgcaatcgtggaggaattagctggacttggagccattgggcatacatgttctcgaactgaaaccgagctcaacgattgcttactcgaatggaaagcaaagggttttcgagttacaggttcagtgtgtgatgttttgaatcaagctcaaaagggaaaaactataaagcactgctttctctggggtcaatggaaggcttaacaatcctgataaataacgttggaacgaatatagggaaaatgg

SEQ ID NO: 21167 - DNA, 268 bp, Gossypium hirsutum
  Clone ID: uC-gsflnu33B084h08b1
ccggtcttcccaccctttgtactgagcatacatctccccaaataagggggggcttttttgatgttgcggtgatttataccaccactccaatcatcgttggaaattgcacacgtttgctgtcaataggatgttcttcccacatactcatgcaggcctttcccttggtgaacggggaacacatgttcatcgcgctgaccgagctaatactaatgttggaatgcctatgggcccggtttggcttgctgaccttggtggctttggtgctgca

SEQ ID NO: 21168 - DNA, 416 bp, Gossypium hirsutum
  Clone ID: uC-gsflnu33B085a03b1
acttatgtaggactattggttgggatcagaacccacaggggcgatggggtgattctcgaaatgcatcgtatggtgcactatccaactatcagttcatgaggccccgtgcacgtgacaagaaacttcaggaagaatgggctactcctttgaaaagcattgatgacattcaagagaaatttaaaaaccattgtccgggttagttgagaagtagcccttggtccgtgttggatggtcttcagccagagacaaagatcatacatgagcaactaggaaagatcaattcgacgggattgcttaccatcactagccaaccagccgtgaatggggagcgctctgattttgcatctgtcggctggggaggcccaggagggtacgtccaccaaaaggcttacctcgagtttttctgcttactggat

SEQ ID NO: 21169 - DNA, 486 bp, Gossypium hirsutum
  Clone ID: uC-gsflnu33B085a04b1
cattccttcaaaaaaaaaaaaactaaaaatccagcagtgaggtgcagggaaacagaacacaaaatggcgacagttccaggacagttgatttgggaggtagtgaagaagaacaattgttttttggtgaaacaatttggaagaggaactgctggcgttcgattcagcaaagagcccaacaatctctacaatgtcaactcttacaaacactctggtttggcaaacaagaaaactgtcaccattcaacctgcaggcaaagaccaggctgtactcttagccacaaccaagtctaagaaacagaacaagccttcgagcttgctccataagtctgtcatgaaaaaggagttccctaggatggccaaggcagtcaaaaaccaggtgacagacaactactacaggtccggatttaacaaaagctgccctagcaaggttgagtgctgcgaaccgaagtctgaaggtgccaaatccggtgtcaagaagaggacagac

SEQ ID NO: 21170 - DNA, 313 bp, Gossypium hirsutum
  Clone ID: uC-gsflnu33B085a05b1
tgttttatttggcgtgctttctttctttttgtcttgctgctccagtaccttatgtttggtagtgtttaagtaagctttaatagtttatatatcttaaatttgtgttgtcttgctattttgaatattttgctgtttatatcaatctaggaaaatttggcagtaaggaaaaaaacaaaaaataaataaaaatacaaaaatgaactaccactatgaatgagatgctggctgaaatagaactcatgacgacagtgaacgatgaagaggctcataagttatctgcatgcgttttcgaaactgcactcttgactacctg

SEQ ID NO: 21171 - DNA, 212 bp, Gossypium hirsutum
  Clone ID: uC-gsflnu33B085a07b1
gacttcactaactcttgatagcgtcacttaaagtacatctcactggccgaggcatcactactgaatgactgggaaaaccttcgacctaacgaactgaatcgatttgcagcacattcgtctttggtcagtttggccgatataacgaatagtcctctacgcgatctgctctcacgatcatgataggcagccggatatggcaaatgggacagcgg

SEQ ID NO: 21172 - DNA, 510 bp, Gossypium hirsutum
  unsure (1)..(510): unsure at all n locations
  Clone ID: uC-gsflnu33B085a09b1
ttgaccagcagaggcttatctttgctggtaaacagctggaggatggccgtacccttgctgactacaacatccagaaggaatccacactccatttggtcctccgattgaggggtggtatgcaaatttttgtcaagaccctcaccggaaagaccatcacattggaggtggagagttctgatacgattgacaatgtcaaggccaagattcaggacaaggaaggcatccccccagaccagcaaaggctgatcttcgctggtaagcaacttgaggatggccgcacattggctgattacaacatccagaaggagtccacactccacttggtgcttcgcctacgtggaggaatgcaaatttttgttaagactttgactgggaagaccattacattggaggtagagagttcagataccattgacaatgttaaggcaaaaattcaggacatggagggaatccccccagaccaacagaggctgattttngctgggttagcactggaggatggccgtaccc

SEQ ID NO: 21173 - DNA, 478 bp, Gossypium hirsutum
  Clone ID: uC-gsflnu33B085b02b1
ctctcgcgtccgatgacctcgtagagttgaatcacctctcaaaactactgtataatcaatatgctgaactgattttgctgcagaacaaagattgttgcatatatctttgatcagcacagtagcctgcaaaatgttaaatctttagtcggtcaagagaaaagtaaagagaaatttgatttggttgaaataaattttcactaaaaatatttccatggtaatgcaaaatgagatctagggataaaataacttgacatttgacgaaaaattctttaccttctcagagcttagtgctctagagttagtcaaaatatagaagcatataggttctttcctaaactgttcaacaagtgattctatactcctgcagatggcaaacataagtgaaggtaggaattccttctagatggcaaaactgttatataatacagctgacatgatagatatatataactgtcatatatcaataatagtatagagg

SEQ ID NO: 21174 - DNA, 460 bp, Gossypium hirsutum
  Clone ID: uC-gsflnu33B085b03b1
tgggaaaggtgtttcgcctgcgggtgccccgccgcagtttccgggtcgacccacacgcgcgccctcacgtccggactgtgagctcagagacctcagtctcggtcccggtgcgtggcctctcttggcatgccgaagaatctgatggtcacaatgcgaagctgatcgccacctgcacctggttactaaacacacggcgggactccgttccgtatcgcatcctaccaccaggtattagtgctatagccacttacggctagatctcccacgatgtcgataccacctctgaagctgcatgccgaacgctcaataccatgctgactgaagcaccaatatatccccttcgagaacattcgctttccttctaagacaacatgggggtgggcgaagctgcttccaatggatcttccgttaacgacacatccaggcttgcgctatttgatggcccagccatgtctgaata

SEQ ID NO: 21175 - DNA, 497 bp, Gossypium hirsutum
  unsure (1)..(497): unsure at all n locations
  Clone ID: uC-gsflnu33B085c06b1
ttggttttagactctcttctagaagtagtggatatgttggggatgataatgataacagacctggtgatggtcgccgtgcatcttgcaaaagaaaagctcttgaaggaaacgttgggcagtcctcttcgagtggaagttctagctacttccattgtgcagaaagtagcgctgggcatggtgtttctgctagttctagtgtaggaaacggcatgaatatatctgcctcctcaggacaggcacaccctagacttggttagaggtgggaggatcaggttctgatgccaaccctggaccaatcgttttaccagctgcaaagggctcccacaggaacttccggctaagaataagtccatcaagcatacaggaacctattgctcntccggtattttctacaggtgatatgaccaggcggtctgttatttcgtcttcacagcaatcgtcaaggctttcaactgatcattctttggacataaggtcagcaccggtgctagataatg

SEQ ID NO: 21176 - DNA, 554 bp, Gossypium hirsutum
  unsure (1)..(554): unsure at all n locations
  Clone ID: uC-gsflnu33B085c09b1
ttaccgccacaaactccaccacctcaaccacctcaaactcctccaaccacagctccagctcaaccgccagcagtgccaccaccatcaccaccaccagtatctcctgcaccagcaccagcccagaaaccaccagctcctgctccagtaaagctgcccccagcacctgcacccattattttgccaccggctcctgcaccagctcccaccaagcacaagagaaggcacaggcacaggcacaggagacaccaccgtgcaccagcaccagcaccaacagttccaagccccccagcaccacctgcagtgccaactacagatgacacgacaccagcaccatcacctagtctcgatttgaatggaggagattcattgttggtggcaggaacaaagctttggtgggcaaggacaggattgactattgccattttgatcgctattacaggctatagtttctaggaactcataagataaggggtgaatgtgatttactntacaattgcttgtcataccttttttctttntggttggaatttctctgtcacataacagagaatatt

SEQ ID NO: 21177 - DNA, 432 bp, Gossypium hirsutum
  Clone ID: uC-gsflnu33B085c12b1
tgtcagaacaggcatctataagaacaaagaacgtgctgagttgattggacgaatatcccttttctgttggatgggatcatcaatatgtaccacattggttgagcttggggagcttggaaggctatctgcatcaatgaaaaagttggaaaagagatttaaggatagtgataagtacaagaatgaggagtatcgtgcgaagctccaaaaatcaaatgagaggactttggcccttgttaaagccggaatggatatagtagtagcagtctgggcttcttcaattggcaccaaagaaagtcacccctcgagtaacgggagcctttggatttgtttcatctctcatctcctgttatcagttacttccgtcaccgcccaagtctaagacaccttgaagttggacgcctgttttgcccaacaagcttgggtatctctatc

SEQ ID NO: 21178 - DNA, 90 bp, Gossypium hirsutum
  Clone ID: uC-gsflnu33B085d03b1
ggcagcgcgtgcgggccccggcccgatatccggggggagccacacgcgcgctttgcgatgagacttggtcttgacaaacaagggatatta

SEQ ID NO: 21179 - DNA, 531 bp, Gossypium hirsutum
  Clone ID: uC-gsflnu33B085d04b1
ttttgacaaagcttcatattatcttttttagttccgacatatgaaaacgaaaaaaaagaagaagaaatacaatcgttttctttttgaagtcgggttttagtttttggggtgaaaaaaatgttgggagtatttagcagtgcgatagtgtctccgccggacgagctggtggcggccggttgccgaactccatcacctaagataacggcggacgctctggtgaaacggttccttgagacgaactcctccggcgtgtccatgcacatcggagaccatgtccaattcgcttattctcaccataaagagtctcctttacagcccagatcatttgctgtgaaagacgaaatcttctgcttgtttgagggagcccttgataacttgtggagtttaaagcagcaatatggtctggcaaagtcagcaaatgaagtgatattggtcattggagcttacaaggcccttcgtgaccgagcaccttatccttcaaaccatgtggttggccatctaattgggagctatgctttcattggacttgat

SEQ ID NO: 21180 - DNA, 243 bp, Gossypium hirsutum
  Clone ID: uC-gsflnu33B085d05b1
ctcctcgcgtccgatcatggttgggagcatctgtcctaggccttggtgagtggtttatcaagcggatgccatttgttcgtcatatctacaatgcctccaagcagatcagttccgctatatcaccagatcagaacacacaggcattcaaggaagtagccatcataaggcatcctcgaattggttaatattctagcttaaaaaaaaaaaaaaaaaaaaaaaaaaaaaaaaaaaaaaaaaaaaaca

SEQ ID NO: 21181 - DNA, 504 bp, Gossypium hirsutum
  Clone ID: uC-gsflnu33B085d10b1
gtttgaatggagggtcagatgaagatgcattggtatcaggtgctcgccagtttaaaaccttgagtggttatgaagctgctgatgagcggaacagttgggattccttcaagcatttagttgccggcgaagaattgcgatatgatgcctcagtaaaaatgaaagctgctgatgaagcttctcagagtgtcactttgatggtatctgtggaagatactggcattgggatccctttgattgcccaggacagtggttttcatgccctttatgcaggcggatagctcaacctctagaaattatggtgggactggcataggcctgagcatactaagtgtcttggttgagctaatgggtggtcacataagcttcatcagcagaccacaagttggaagcacattctcattcccacagtcttgggaggtgtaaaagagcttatttagtgatacaaaaaacccaagccgaagatcttcctctgtttcagagattgaagctgggtagtgacgaaaa

SEQ ID NO: 21182 - DNA, 352 bp, Gossypium hirsutum
  Clone ID: uC-gsflnu33B085d12b1
gtttaatgcacatggcacactctgttataacgaagaaacctgtctctttattgcaaaaggagatagtgatgtaggcaaagaaaactacatggctaaacttgttgctactgtcttgttggctatcattgccatctgcatgaggtagactttgggtatggcactcacactggacatggaggtcaccattatgataacaaacgttctggacctggaagtgtcaagccttaccaatgtccatgtgagtgcacaaggaggtgtatccagacacagatgcataaaccatgcaagcagttctgtcagaaatgttgcaggacatgcctttgagctcctgcagggtattatgggaacaaac

SEQ ID NO: 21183 - DNA, 136 bp, Gossypium hirsutum
  Clone ID: uC-gsflnu33B085e01b1
cccacgcgtccggctctcttgtgttaatttgttgcatgtaaaactagtcctttaatgctttggatataaatttcagatggttaagcatgaaaaaaaaaaaaaaaaaaaaaaaaaaaaaaaaaaaaaaaaaacaaaa

SEQ ID NO: 21184 - DNA, 398 bp, Gossypium hirsutum
  Clone ID: uC-gsflnu33B085e05b1
tcgtacacatttttctcacttatttattctggggggtatttttatgtaatgtctgggctcatgttcaggaagtggacgatgatgtggtggcagacgtatgttgatgatcacctgatgtattctactctttgcttcccatttgtctgccgttgctttcattggtcaagactgcagtgtttgggctcagagctccagtttccctttatttttgctagaagatttcgattggcatcatgaatgactttactgaaccctgatcaattgccccaaccggattgtatccaggtgtctgtttttcatgttgattcatgtgtttaccaggatctttttttgagggtagaagggacctgcaggtgttcctgtttaatagaccaatcacgccttgattcatcggcatt

SEQ ID NO: 21185 - DNA, 483 bp, Gossypium hirsutum
  Clone ID: uC-gsflnu33B085e07b1
tctcctcactttttgcaacaaaattcacggagagactacaccaacaaatggaggcattgaggatgagactatttttggccatgatggtggtgttgatggccatgtcggcggtccaatatgttgcggcagctgatgcaccggcccctactcctacctcagatgccaccgcattcgtgccgacggcgtttgcttcccttgtcgctcttgcgtttggtctcctcttttaaaatgggtgaattgtattagttgttgatatttcaatattggggtttgtgtagagttcttttgtcttcttttattctttctctctaaaggccatacaactttgattatgaagatggaaaagagatagagaaaaggtggaggaatttttctgttgttgttgggattttacttatgacaaatggtggatattttcattgtttcgattctaatgtatatctgattgttgctgagctaatgaaagtgttgttacttcgttcc

SEQ ID NO: 21186 - DNA, 473 bp, Gossypium hirsutum
  unsure (1)..(473): unsure at all n locations
  Clone ID: uC-gsflnu33B085f02b1
tcactatagggagaggtggcgcgcgccggtgcacctccgcagttcttgggtcgacgccacacgcgcgcctttactcgtctacctttttcagacctcccggatccattctgtggaatgttagcgctccaaaatactaagctcgccaaattccaccgtcaacccatattgtgtactaccaagtcctcacccgatcctacacaccttaacctgctgcccctcctcttccaaaaaagttgctgatcggctcgtcaagctcttcgccatcgaccctgaaggccagaagcgtgaggttgtcggcctcgctggccagaccttacttcgtgccttgactaacagcggcccgatcgaccccgactctcaccgtctngaggagatcgacgcttgctccgccgaatgcgaggtcaacactgaccaagagtggctcgagaagcttccgccgcgtacctatgatgaggagtatgtgctggcgagga

SEQ ID NO: 21187 - DNA, 498 bp, Gossypium hirsutum
  Clone ID: uC-gsflnu33B085f05b1
ccctcgcgtccgcggacgcgtgggcaacaaaaaaaatctttccagtttctattttctaaaaacaaaactgaaaatgtcttgctgcggaggaaactgtggctgcagctctggttgcaagtgtggcaatggctgtggaggatgcaagatgttccctgacataatagagaagactacaactgagactattgttcttggtgtgacaactcagaaaatgcactttgagggatctgagatgggagttggggttgagaatggatgcaagtgtggagacaactgcacttgcaacccttgcaattgtaaataagagggggggaaaatgaacaacaaagagaagcagagaggcctttgtctttttaactaaataaattctattactctagtatgtatcagcaaatcttcatgaggatttggttcttaattatgcgtaatgtgggcttttctgctatgtcagaatgtattatgatatttaagaaagctttgttccatttgaagaaataa

SEQ ID NO: 21188 - DNA, 524 bp, Gossypium hirsutum
  unsure (1)..(524): unsure at all n locations
  Clone ID: uC-gsflnu33B085g01b1
gcgttctcgcgtgcgtcgacgcgttcgtgatgagggggtggttatccagaatagccgctgggcgagccttccgccagagctgttgcgtgatgtgatcaagagattggaagcgagtgagagcaactgggctgctcgcaagcatgttgttgcttgtgctgcagtatgcaggtcatggagggaaatgtgcaaagaaattgttagatgtcccgagttctccgggaaaatcacctttccagtttctctgaagcagcctgggtcaagggatggaaccattcaatgcttcattaagagagacaaatctaatttaacttatcaccttttccttagccttagtcctgctttgcttgttgaaaatgggaagtttcttctttctgcaaaacggacccgtagaactacttgcacagagtatgtaatctctatggatgcagataacatatccagatctagcagctcatacattggaaaactcaggtccaactctctggtaccaaattcataatttatgacacgcaacctncatacac

SEQ ID NO: 21189 - DNA, 547 bp, Gossypium hirsutum
  Clone ID: uC-gsflnu33B085g04b1
tttatcgcgtccgctgccatctgccagcaatgtggccttgtccccattgttgagcctgaaattcttgttgacggatcacatgacattaaaaagtgtgctgcggcgacagagcgtgttcttgctgcttgctacaaggctttgaatgatcaccatgtcatgctagaaggtactcttttgaagcctaacatggtgacccctggttccgactccccgaaggttgccccagaggttattgctgagtacactgtccgtgccttgcagcgtaccgtccctgctgcagtccctgctattgtgttcttgtctggtgggcaaagtgaggaggaggctacccttaaccttaatgccatgaacaagctccagaccaagaaaccatggtcactctcattctcatgtggacgtgcccttcagcagagcactctcaaggcctgggctggaaaggaggaaaacgtgaagaaagcacatgatgctctccttgttaggtgcaaggctaactcggaggccaccttgtgtacatacatgggtgacgcaaagatagtgagggtgctgc

SEQ ID NO: 21190 - DNA, 456 bp, Gossypium hirsutum
  Clone ID: uC-gsflnu33B085g09b1
tacggttgaaaaatattgggtctccaccagaatcagagcgtaaacgagctgaacttgatgcattagcccgacggttacaaggtattactaaatcagtgtcgaggtatccaactttcaggcgacactttgaggaatttgttaacaaactatccgaggatctctcaaaggacagtggcagcagcaacagcagcagatctagtaataggtctcatcaatcgaagaacaccgttctgcggttttttagcagcagatctttcaagcggagttcaagccaaaacatgtctgatcaagaatcacaatcagttcttgccagagatgcagaaatcgaatgatgtaggaataggatgtcgatcaagaatcacaatcagttcttgccagagatatagaaatcgaatggtgtaggactaggatgttgatatttgtccatagttgtcagattttggacataaatgcaac

SEQ ID NO: 21191 - DNA, 555 bp, Gossypium hirsutum
  Clone ID: uC-gsflnu33B085g11b1
ttcaactgtgaataagtgaattgacatccaagcgttccattccatttccgtatagttcaaaaacacttgagtaccttcgatcatattttagtgtcaaaaatggccgaggagcataccagtaaggcccctgagttggagagcaacgttagcggtgaaggagcagtggagagcaaggaccgagggttgttcgatttcatggggaagaaagaagaggagaagcctcaagaggaggtgatcgtaaccgagtttgaaaaggttactatcgaagagacaaaggcagaggaagaaggtgaggagaagaagaagcatggtctcctggagaagcttcaccgatcagatagcagcagctccagctcttcaagcgacgaggaagaaggtgaaggagaagagaagaagaagaagaaaaagaaggagaagaaggggctgaaagaaaagattgaagagaagttagaaggagaaaagaaagacgaggacacctcagttccagtagaagagtgcgatgagccagtagtccagccagagacgccagagaagaaaggtttcctcgagaagatc

SEQ ID NO: 21192 - DNA, 510 bp, Gossypium hirsutum
  unsure (1)..(510): unsure at all n locations
  Clone ID: uC-gsflnu33B085h04b1
gtttctttgatttgtttctaaggatttaatctgtaaaccttcttcccatttcttcattacattgttcaagaacaaacaaaaaaaaaaagaagcaaaaaaacatggccaaagttctgttgttcattgctctatgtgtgcttccagctttggttagtgctacacgcattctgaataaccaattggtggttgaaggctatgtgtactgtgatacttgccgtgctggttttgaaacccctaagactagaaggctagctgatgccatggttaagctggtatgctccgacaggaagaaccgcggagttgttttcgagaaggagggatataccgacaaaaccggaaaataccagattcgtgtatccgaggatcacttggatcagatctgtgatcagttcttgtgaagagcccccagcttggatgtgccacaatgtccccnggtcgtgaacgtgcccgtgttatcttgaccaactccaatggcatttcatccaccacccgttatgccaatagcatggg

SEQ ID NO: 21193 - DNA, 561 bp, Gossypium hirsutum
  unsure (1)..(561): unsure at all n locations
  Clone ID: uC-gsflnu33B085h05b1
tcctctcgtccggaagatttttggatctgttgaccaacatcatttccctactggatttgggtctggcataaatgcaactttccatcgaattcttgaacttcaggtcccaagtgaattcatgttaacatctgaatctagcgttgagataaattcaatcaggaccgtcaatgaagcacacagcttagattgcaatctaaatcagttccgctgcagagttgttgctgttcatgtcctggttctagagaagagcaaccggaaatgtgataacataaaatcaaatacttacaccagacctcatagtgttgacattccacttgcttgctttatattggatgatgggtcatcttcttggtgttgctgggctaatgctgaaagagcggcaacattgctgaggctgcagaacactgccaggacctctaccatgtatcatcttcaaagaattgtagaggagcatgacaggattactgtgaaaagcgctagatcaacttctgatccttttgatcaagatttcactgttactgtcggttcangaagggcactaactggcttggatgaagattt

SEQ ID NO: 21194 - DNA, 514 bp, Gossypium hirsutum
  unsure (1)..(514): unsure at all n locations
  Clone ID: uC-gsflnu33B085h06b1
ttctcgcgtccggcagcagtggcttgacgttcccctttgctcccttcttccagaagccaaaagtttgagttaagaacaatggcttttgctgcaatgaagccgacaaaacctggtttggaggagtcccaggagcagattcacaagatcaggatcactctctcctccaagaatgtgaaaaaccttgagaaagtttgtgctgatttggttcgtggtgccaaggataagagactgagggttaaggggccagtgagaatgcccaccaaggttcttcacatcacaacaggaagtctccctgtggtgaaggaacaaacacatgggatagatttgagctccgtgttcacaagcgagttattgatcttttcagctcccctgatgtggtcaagcagatcacatctatcaccattgagcctgggttgagggggaggttactattgcagattcttaaatatgcctcacttatatgctntttggcaacctctagttttagtcaattagaagacttncatctgatata

SEQ ID NO: 21195 - DNA, 456 bp, Gossypium hirsutum
  Clone ID: uC-gsflnu33B085h08b1
ctgtggtgcaaagttcaaatctatctgtgttgggaactgcttggggatcaaggacctaaatgtaggattgcctcctctaccaccttgtgagtcccttcgatcgctgtctatccgtaactggcggaggctttggtgatgctagcttggctgctttggggaagttgtgccctcaactgcagaatgtggagctgagtgggcttcatggaataacacatgttgggttttttcccattgctcgagagttgtgaggccggcttggtgaaggttaatctcagcgcccgtcccaagttggataacatagttgtttgtaagatggctgttcaccatggtctgactctagagatgctgaatcttgatggatgcaagatcagtgatgctggcttggttgcaattgcagagaactgtcagttgctcagtgatctcgatgtcttcagtgcacaataaccgactctggaa

SEQ ID NO: 21196 - DNA, 381 bp, Gossypium hirsutum
  Clone ID: uC-gsflnu33B088a03b1
tttataggctcggtttcttccaaaattggtgggagaaatcaactaacagatgcagagcctgtggctttaatcgggaatgatgatgcccctctggtccaagaggatgttccggtggaaaaacaatctaggaggaagagaccccgtttaagatcaagccgtggcggtcgataacctagaccatctcagtatgaataataggttacaggcacacccttttctcctatcaatatgaataacaatttggtgcatcatttaggtttgttcatttataaatgattaaataatttaccgatttaggatttaaggtttaagtcgaatgtgaagacatttcgttaatactagtctttgcaagaacttatgacatttaatgtgtcaatttat

SEQ ID NO: 21197 - DNA, 479 bp, Gossypium hirsutum
  Clone ID: uC-gsflnu33B088c06b1
cgtagaaggaggttgcggctgaaacgcccgtggctccgactccggcagtggaagctccaacgccggtagcggaggatctcaaagctgatttcaagaaaacaaccgtagcttcaccgtcagttgaggaaaaatccgatgaatctatggctcttgccgtcgttgagaaagcccctgagctattaccaaagttcatttcatctggatcatatgttatagtatgattttctattttttcttgattttttatttctagttatcttctatttatttttttcttattttttcttttcaactatttctttatacttctctttcttatttcttatctcttttccattattctatttttcttttcacttctattttttatattatctattttttttttttttttcaaatattatttattttatttttttacttctactttaatatacttttttcattttttatcattcttttcttctcatttttttttt

SEQ ID NO: 21198 - DNA, 209 bp, Gossypium hirsutum
  Clone ID: uC-gsflnu33B088e03b1
aaataaaaataatttaagatataagccatcaatttctagtgccaaatacataaaaagccataaagccatccatttttttattgttctaaactcagtaataatatgataaaataacaatgtgtccattctcctccaacctgcaaaataagcactcccagcaatggagctttggcaagtgtcggtgatcccaaaacaagcctagggctgct

SEQ ID NO: 21199 - DNA, 298 bp, Gossypium hirsutum
  unsure (1)..(298): unsure at all n locations
  Clone ID: uC-gsflnu33B088g06b1
natcatccaaaaacgctcacactctttccctgtttttcttttcttttctgtaaaatcgatttagttttgcttttgccaaaatctggaatatttgcttttgttctcctaattctgattcgttttgacagtatctatacccagtatattcctttaagtgcaatagccatcagctcttgagtcgatctcccacccatgtagctgatatccacgaaaacaagatgttagctttgtcgaatatccctgaccttattgccagccattccagcattcgatttagtcgctacaagatccttatttc

SEQ ID NO: 21200 - DNA, 267 bp, Gossypium hirsutum
  Clone ID: uC-gsflnu33B089c03b1
ccctcgcgtccgccttttgtttgtcttagtcctttgtgatctgtttttgatacttttggagttatttattcattaaaaaacctatggaatgacaaatgattaggaatccaggttccatcgttgccaatgacttccttattcagttgctcagaaatttggctttgcatattgaggtctctctctctcttataagcctaaattttttatttttgaacttttttgaattatttatatatcttttactgtttttaatcaataataaataat

SEQ ID NO: 21201 - DNA, 449 bp, Gossypium hirsutum
  Clone ID: uC-gsflnu33B089c12b1
ttgtttatctccagatagcaaactcaacctcgatgatattcttcaagttcgtgaagaatcagacatatatgtgttaggttttcaggaaatcgttccgttgaatgctggaaatgtgcttgtgatcgaagacaacgagcctgcggtgaaatggctcaccttaataaaccggtcactaaacaaggcgaattatgttcctttaagaggacccagatccgttggttcacccgagggttcactggttttccctaaaattaaacttagaaaggccagcaaagctttgaggacagagaataaatggaagctgaagagctgcaactgtcctataggtttggaaaggaagaatagcaaagaattctgtttccggtgccctcaatcgcaaacgaatgaaaatgatatttcatccgaagatgatgaagaccgaccttatgggccttctagggcaaactcga

SEQ ID NO: 21202 - DNA, 155 bp, Gossypium hirsutum
  Clone ID: uC-gsflnu33B089f12b1
ttgataaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaagaaaacatgggggcgg

SEQ ID NO: 21203 - DNA, 213 bp, Gossypium hirsutum
  Clone ID: uC-gsflnu33B089h06b1
tattaattatttttaatgacaaggagctggagttactgataagtggtctaccagaaatagatatggatgatatgagggcaaataccgagtactctggttttagtgctgcatcacctggtatacagtggcacatgggggttgggatggcttacactcaagcatatggttttaaccatcacaacagtcctggaaaacaccattggttctgggtat

SEQ ID NO: 21204 - DNA, 461 bp, Gossypium hirsutum
  unsure (1)..(461): unsure at all n locations
  Clone ID: uC-gsflnu33B090a03b1
cctactcgtccgcccacgcgtccggttgaaatggcgtccaagttgtgtgactcatgcaaatcagcgacggccactctgttctgccgtcctgactcggctttcctttgccccaactgcgactccaaaatccatgccgccaacaagctagcctcccgtcacgctcgggtcttggtctgtgaagtttgcgaacaagcaccggctcacgtcacctgcaaggctgacgcagccgctctttgcgtcacttgtgaccgagacatccactccgctaaccctctcgcttgccggcacgagcgggttcctttggctcccttttacgattcccgcaagcccaacacagcgtttaacttcctggacgaccgttacttctccgacgtcgatggagacgctgacagcagcagggaagaagcggaggcagcgncctggttgcttttctaacctaaccacaaagcacatgaaagccc

SEQ ID NO: 21205 - DNA, 102 bp, Gossypium hirsutum
  Clone ID: uC-gsflnu33B090b09b1
ataattggggattagggttttctctgaaagagtcttttataaaaaactgaagatgatctaggcggtgatgaatctatcaactagttgacaaggctcattcac

SEQ ID NO: 21206 - DNA, 475 bp, Gossypium hirsutum
  Clone ID: uC-gsflnu33B090h05b1
ggtagttatcccgccagaccagcaacgtctcatcttcgccggaaagcaactcgaggacgggcggactttagccgattacaatatccagaaggaatcgactcttcatctggtcctgcgtcttcgaggtgggatgcagatcttcgtcaagactttgaccggtaagacgattactttagaagtggagagctcggatacgattgataacgtgaaagcgaagattcaggacaaagaaggaattccaccagatcagcaaaggttgatttttgctgggaaacaactggaagacggaaggactttggctgattacaatattcaaaaggagtccactcttcaccttgttcttcgtcttcgtggtgggttctaagccttaaggtctcccttaatgtgggttttctggttttacgtgaaggactgtgcccctgtaatggccctttaaataatttctagtctttgtttaccggttgcatctatgtat

SEQ ID NO: 21207 - DNA, 146 bp, Gossypium hirsutum
  Clone ID: uC-gsflnu33B092a02b1
gtttgtttctcagttaaaacattgctgtctgctcttaaacatgtttgttgagaaaacaccagacaaacttgatgttgttttaatgtttcctgatatgaaaagcaaatatttttagtttcaaaaaaaaaaaaacctaaaaaaaataa

SEQ ID NO: 21208 - DNA, 341 bp, Gossypium hirsutum
  Clone ID: uC-gsflnu33B092a11b1
ctcatttttccgcccacgcgtccgtaccaacgagatacctgacgtgaatgaaaacgagaatctgacaaatgatgttcatatttcaagtgatgttcacatttctaatgatgttcacatcgatgggaacggtcaaaaaagaaaaaaccctgagaaaaatacacaaagtaatgcatatgcactctgacagtatgagtcaagccacatctagtttgactcttgttatggatccatatggtattccacaagcagtcaatgtgcttgacagcatgtctaacgaagatccagaagctagtctgctatactttttcgcacttaaattattgctcaataaggacatgaga

SEQ ID NO: 21209 - DNA, 294 bp, Gossypium hirsutum
  Clone ID: uC-gsflnu33B092b08b1
atttttcattcaataaccttctcccttgactctcatcaatctactcttttgattctcaggaatggcgagtggttttggtgaatcaacaagcatgcctccaccaagtccatcttgctcgagcagtaataatgctaacgatgctggtgattttgaatgcaatatttgctttgaattggctcaagatccaatcgtcacactttgtggtcatctcttctgctggccatgtctctatagatggttgcaccatcactcgcattctcaagaatgtccggtttgcacggccccgattcaaga

SEQ ID NO: 21210 - DNA, 398 bp, Gossypium hirsutum
  Clone ID: uC-gsflnu33B092c05b1
cccactcgatcgcccacgcgtacgcccacgcgtccgagcgaattcgtatttggtcatggacgcaaaccggagttcggacgacccggatccgaatttgaatctgattttggccgaagacctgaattggagcagcctcctgaggagagtggatctgggcatggccggaggccggcatatgagcattcacatcaaccggatttcggatccggccgtagatcagaatttgagcagcctccgccgcctgagtttggaactgggtatcgacggagacccgaatttgagcagcctccgtctcctgaatttgaatctgggtatggccggagacccgaatttggcgaacaagagtccgagttcggatctgagtatggcattcttatcatagcacggtataatttgga

SEQ ID NO: 21211 - DNA, 168 bp, Gossypium hirsutum
  unsure (1)..(168): unsure at all n locations
  Clone ID: uC-gsflnu33B092d02b1
gtttgttgttangaataaagatgaaaaaatcatggagatatcaaagagaatcaagtgctcaattggatgtgcttcaaaggcaatttttttcttttattttctatggttttattacttattgatttttttttggttggtttaaatctttgaaacaattgtcccaaaaat

SEQ ID NO: 21212 - DNA, 362 bp, Gossypium hirsutum
  Clone ID: uC-gsflnu33B092d11b1
gtaatgttcaaaccgaccctttgcaattccaagacacaagaaccaagacacataccacgatggcaacaacgacggagaagcaagccatggttgttggaatcgacgacagcgagcacagtacgtacgcgctgcagtggatcctcgatcacttctttgctcctttcgcttccaatcctcctttcaagctcgtcatcgttcatgccaagccttatgattcttctgctgttggtctcgccggacctggagctgctgatgtattgccctatgtggatgcggatttgaggaagatcgctgccagggttgttgagaaagccaagggaactatgccttagcaaattggacatgatgccgttttgaagcgt

SEQ ID NO: 21213 - DNA, 532 bp, Gossypium hirsutum
  unsure (1)..(532): unsure at all n locations
  Clone ID: uC-gsflnu33B092e08b1
gtgggtactgaagcaaaatctgaaatgacagcatctatggcaaacaaatattcaaatactatagtttcaaataggttcagtgagcaaaaaaggatttaggttacttgttcgttttgtgacggttaggttgttagagcttgtggttttgcatggcttccactctgcanagtgttagggttccttggacccccttctgcggtagcttgcttactgtccttagcgtataaaactcggaggtcctgtttcttactttatatgtgtatctacttattttattgtttactttttatgcttaatcccctatctattttttttatttctcactaacttcttatctatttatctacttttcttttatttcttttctttcatttacttcttttattttttttttttgctgtttctttttttattttctttttttctctctgtttcctttttttctatcctttctttttcttccttttcccttctcttctctttctttcttttcttctttcttttcaattttaccttttttccttttcctttt

SEQ ID NO: 21214 - DNA, 346 bp, Gossypium hirsutum
  Clone ID: uC-gsflnu33B093a03b1
tcggttctttccaagtatgaagccactgctcgtagctggacccagaagtatgccatgggatgacagtggttggtgtgtaatacctatcagctttcttatgtgttttggggaaggaaggaggtgttttttcttaaagtaacttgccattgtgctttggatatgggaaagatatggaacattctttttatttatttcgtgctttataacttgtgtgaaacccttgtttcgttcaatttcaaagtcgctgtgaaaccctttgtttcggtcaatgtaacaaaaaagtctttagttctaaaccaactgaagtcaaaaccgcaaaggctgctgaatcagctaaataatcagc

SEQ ID NO: 21215 - DNA, 417 bp, Gossypium hirsutum
  Clone ID: uC-gsflnu33B093a04b1
ccctttcgcccggggagctaattggtgccgagcaggaatgctgtaacgggaatggcaatgaccatgtctaatattacgcaaagccacaggactgagagctgatttggctgaatcacaagagaaagatcacgctgaggagctggtgtttagcacgactcacgtactatgaccatggaggagatctgatatgtgtagactacaggtcgaagtagccactcaccgactcataacgtgtgtttacctattgaatgaatactatgcggatcacggtctttatttacggaccgcctgccggcttcggccggccgatccgggcggaagacattgtcaggtggggagtttggctggggcggcacatctgttaaaagataacgcaggggcgctacgatgagcggaaccagaacagcaatctcgtgt

SEQ ID NO: 21216 - DNA, 412 bp, Gossypium hirsutum
  Clone ID: uC-gsflnu33B093a09b1
gcgcttattcatgcttctaaacactgctagctgggggacactttagtgagaactaggaagacatgccactgggattgatattagggataggaaggacgtttcgaaggaagagtacctcatcgttcgattttctgtcgcctaaacgagcaccaagagattattacaaggggaaaaattgcaagtctactggtttccacactcacaaaggtggatatcttgtgatgcaggagaagttgccaaactatgtgcttcctgatttgactgactttacactcaatccaatgtgtcccaatgcccaactggagtctaaaccacataggttgctaaatcagcttaaaggacaggatatgagggctgatcacggggtctcatgtctttatcatctaatcgcagccatgtgaaactagagcat

SEQ ID NO: 21217 - DNA, 551 bp, Gossypium hirsutum
  unsure (1)..(551): unsure at all n locations
  Clone ID: uC-gsflnu33B093b07b1
ttttaggaaaaccctctctcaaatcttggctcgccagtcgcctctctttcttcttctgcttcttcttcttcattctgttggctgctgctgctgctttggtggcgtgatttagaagccacaactcaatttcatataaagaaaaaaaaaagagtgagatggatccagacgcagtagccaaggccttcgtcgagcactactactccacattcgatgccaaccgggccggtttagccaatctctaccaggaaggttccatgttgaccttcgaaggtcaaaagatccagggctctcagagcatcgtggctaagctcaccagccttcctttccagcagtgcaagcacaacatcaccaccgtcgattgccagccttccggctccggcggcatgctcgtattcgtcagcggtaacctccaactcgctggcgagcagcatgctctcatgtttagccagatgtttcatttgatgccaacgcccacagggaagcttttatgtgttgaatgacatactcangttgaactacgcgtgaagacgatgactaatcaagggatggga

SEQ ID NO: 21218 - DNA, 382 bp, Gossypium hirsutum
  Clone ID: uC-gsflnu33B093b10b1
ttcacgcgtccgcccacgcgtccgcggacgcgtgggccgaggaacccgcggtggaggagaaaccagctgaggaggaaaagggagatgaaaaagctgatgagattcctgttgagaaagttgaaaaatagagcgaccaataccatacgtaaggtggcaaatgcttaaaggagcttcttttttctatagttggcggagtcatactactattatttatgattactatgtaggatgtgggatggcgagggctttctttttctttaatggttgcttctctgctttggggtttgatatttagtattgaacttgcttttgggtccaggggtcaacatgccgatggaagaaactatgggttttccattttgaagtggttgggatgtatgta

SEQ ID NO: 21219 - DNA, 524 bp, Gossypium hirsutum
  unsure (1)..(524): unsure at all n locations
  Clone ID: uC-gsflnu33B093c01b1
attttacctacggcgctaatcgatacggcgtcgtggtactgttccgtaaccttattggccttaatattgatagggtcaatcagggcaaactccgtatcagatgaaccagtgagaggtagccagctccggaaccgaccctgcgatgaaatctatgtcgttggcgaaggtgaaactcttcactccatcagcgacaagtgtggcgacccgttaatcgtcgaacggaacccgcatatccatgaccctgacgatgttttccccggccttgttatcaagatcatcgcttcaactgataggaaattatagaggtagctgcttatacacatgatacacacagaaaatttaatactggatactggttttggtcttcttttgtttcttagtgagaagtcttcgtaataagctgaagcctgtatattgnggcctttgattaggatcatatcatatcatatatacatggagattggtttcttctccggagagattccagctcctctgtaaatagctcttttatcagtatatggcat

SEQ ID NO: 21220 - DNA, 524 bp, Gossypium hirsutum
  Clone ID: uC-gsflnu33B093c06b1
ccctcgcgtccgcgacaaatatgctgcggaagctggtttttcgacaggcttccagagcttaccgatccctgtctactcagtcaacgcttgctttactcagcaaatgctctgttttctcttattgttcatcatcacgacctgaaatccctcctagtaattccatcgaacaccttgaagatcaacccaccaacaccatttccattgatcgttctggactatgtagtccccctgagcattctcatgaaccttcctcagactctgaactggttaagcatctcaaaggcattattaagtttcgtggtgggccgatatctgtggcagaatatatggaagaagtcttaacaaatcccaaggctgggttctatattaaccgggatgtctttggagctgaaggtgatttcataacatctcctgacgtaagccagatgtttggagagatggttggtgtttgggctatgtgtttatgggaacagatgggacatccaaagagggagaactggttgagcttggccctgcagaggaac

SEQ ID NO: 21221 - DNA, 512 bp, Gossypium hirsutum
  Clone ID: uC-gsflnu33B093c12b1
ttttatcgcgtccgaaggaaggccgtgaaccctggcgtttggaatagtttagatttcaacatttgcgcaaagatgggagtgaaaaattgagcagtgaggcagcaaaacaagtttatgatgaagcatgcaagatggttaaagactctatgccaacacctgagagctctttcacacctcaagataatattgcattagaaaacaaggtctatacacaagtgttcggctctgaaaaggatggaaaaatgttgggatatggacgtgggatgaccaaatccaagttgtttggctatgggtcagtcacccgaggaagccaatctacatcggctattagtacattgattgaaaagatgagtgctaaacatgtcgagcaaatacaaacaattcaagccgaacaagcaattcgagagaaaactttactcgaggaagcataatctcgattttgtacggaggccgcggagtgagaagctcgtttgatagctaaggtagaagaaagatttatgaaattaactgga

SEQ ID NO: 21222 - DNA, 413 bp, Gossypium hirsutum
  Clone ID: uC-gsflnu33B093d01b1
tgcttatttacaccattgatggttatatgcggagagagacttggatacaagttcagttcatgaggttgcattctgaaaaggccgttcaaattttattaatatgaaatattcaatcaacctgtaggacttggttttatgttctatgaattcacattgggtttctgtttttcgtctgattgctagtgttactatggttccattttgtcaagctgttttccacaaatggttcctgacatttcttgttattatgtttacttctctcggggattgtttaacagctttttcaattagtttagcatattatgctatttcctggttaaaaaaaaaaaaaaaaaaacaaaaaaaaaaaaaaaaaaaaaaaaaaaaaaaaaataaaaaaaaaaaaaaaaaaacaaaaaaaaataaaaaaaata

SEQ ID NO: 21223 - DNA, 524 bp, Gossypium hirsutum
  Clone ID: uC-gsflnu33B093d05b1
atttccccatccaaacgacgccctaaaccaaaagtcatggccaccccttccgcacgtgaggaaaacgtttacctggcgaaactcgccgagcaagccgagcgctacgaggaaatggtcaagttcatggagaacgtcgtctccgccgtccctgcccccgacgaactcaccgtcgaggaacggaacctcctctctgtcgcctacaaaaacgtgatcggcgctcgccgtgcctcttggcggatcgtttcctccatcgagcagaaagaggaaggacgtggcaacgccgaccacgtctctgtcatccgtgagtacagggccaagatcgaggccgaattgtccgagatttgcgccggaattttgaagcttctcgacgagaagctcgttccggccgccgggaccggtgattccaaggtcttttacctgaagatgaagggagattaccataggtacttggctgagttcaagactggcgatgacaggaaagcggctgccgagaatacgctcactgcgtataaatctgctcagga

SEQ ID NO: 21224 - DNA, 543 bp, Gossypium hirsutum
  unsure (1)..(543): unsure at all n locations
  Clone ID: uC-gsflnu33B093e01b1
ctttattttaacaacgatgaggatgatgggttcgatcaagctatatgtccggttgattcccaagaagcagggatgatagtggataatgatcttaataccctcatcgttcggccactcacccctggcgttacgcttcatgccattgttgacgcttgccatagcggaaccattttagatcttcccaaagtttatatgagtgaagagaaaaactgggtaaacaacagtcctccgtcgggagcagagaaacgtacaagtggtggattagctatttctattagtgcttgtcttgatcaccaagccgccgccgattcctctgcctttacccccggcgagatgaacggtgcactgacctacatattggcggagattctgaagaaattaccaggcccgacgtatggagacttattcgatttaattaatgaaacccttaataacgttaaccaatctagttgccttgctaatacangattcttgaggagactcttcaactccaatttctcacagacaccacttctttcgtcttcggcaggcgtcgacgtttac

SEQ ID NO: 21225 - DNA, 493 bp, Gossypium hirsutum
  unsure (1)..(493): unsure at all n locations
  Clone ID: uC-gsflnu33B093e04b1
gtgtgaccatgttggtttaccaggatctcatctccggtgacgagcttctttctgactcattcccctacaaggaaatcgagaatgggatgctgtgggaagttgagggaaagtgggttgtgcaaggagctattgatgttgacattggtgccaatccttcagccgaagatgctgatgaggatgaaggtgttgatgaccaatctgtgaaggttgttgacattgttgacactttcaggcttcaggagcaaccccctttcgacaagaagcagtttgtcgtgttcatgaagaagttcatcaagaacttgacaccgaaactggatgcggaaaagcaagagtccttcaagaaaaacattgagggagcaaccaagtttttgctttcaaaattgaaggaccttcaatttttcatcggagagagcatgcacgatgatggactgttggtatttgcttactacaaggatggtgctgttgacccgacattnnntgtacttgcgtatgc

SEQ ID NO: 21226 - DNA, 500 bp, Gossypium hirsutum
  unsure (1)..(500): unsure at all n locations
  Clone ID: uC-gsflnu33B093e06b1
ttttcttgaagtagccagccgtttcacacactcaagaagagagagagctcgtaaatcatggcggaacagaccgaaaaagcttttttgaagcaacccaaagtgtttttgagctcgaagaaaggtgggaaagggaagagaccaggaatgggtgggaatcgcttctggaaaagcattggattgggcttcaagactccccgtgaagctattgaaggaacctacatcgataagaaatgcccgttcactggcatggtttcaatccggggtcgtatcttagccggtacttgccatagtgccaagatggtcaggacaatcattgttcgacggaactaccttcattatatcaagaaataccaaaggtacgagaagcgccattcaaacatccctgcacatatttcaccatgcttccgtgtgaaggaaggggatcatgtcattattgngcaatgcaggccgttgtcgaagactcggaggtttaatgctttgaaagtgattccagcaggatc

SEQ ID NO: 21227 - DNA, 514 bp, Gossypium hirsutum
  Clone ID: uC-gsflnu33B093e09b1
ttttcaaagaaaacctttgttaaaccaaaaatggctctcaccaactcctccattcttcccaccaactccatccttcaatctcagccatcaacgccgttctctaaggctaagccattgtctgtccttcggatctccgccgtccattcttctgactcgcctaagaaccccgtcgtctccgaaaaatccgtcaagcagcccgctactgctccactcgccgctaccaaatctgctaccgcgcccaccactgctccaccgaagaatgcggttcctgggaaatggaccgtggatagctggaagtcgaagaaggctttgcagttgccggagtatccggatcaggcggagctcgagctcggttctcaagactcttgatgctttccctccgattgtcttcgctggagaggctcggagtcttgaggagaagctcggggaagccgccatgggaaacgcttttctgttacaaggcggagattgtgccgagagtttcaagagttcaacgctaataacatccgtgaca

SEQ ID NO: 21228 - DNA, 517 bp, Gossypium hirsutum
  Clone ID: uC-gsflnu33B093e10b1
ttcatcgcgtccgcccacgcgtccgggttgataccggaaaccgacctgtgacaggaatacgtttatacttggaaggtaggaagaacgaccatctagcaatccatcttcagcatctttcaactcttcctacaatccttcagctctcggatgaccacaattacgagcctaacgacgagccacttggacgcgggtacttcgagccagtcaagtggagcatattctcgcatgtatacactgcacctatacaatacaatggaagccactttgatgataccgctgccatcgtaaccaagggtgggtttgaggtaaagtctgtcgggatgaggaaagttctattcctgaggctcggattctccatggtcagtttcactaagatccgtcgatccgaatgggacggaccctcgacattgtcacggaaatcaggagttttctcgatgttgatcagcactaggtttagttccggactgactcaaccggagaaaccaaccaaagtggatttaaattcggctgttttccc

SEQ ID NO: 21229 - DNA, 434 bp, Gossypium hirsutum
  Clone ID: uC-gsflnu33B093f02b1
cccactcgtccgcagtattgttgccgtgagtttgctaactctcaagctttaggaggtcaccagaacgctcataagaaggaaaggcaacagctcaagcgtgctcaacttcaagccactcgaagcgccgcggtttcgtttgctaggaaccctatcatctctgcttttgctcctccaccgcatctcttagcgtcggctacacccgtcgtggtgccagctgcggcgggaccgtcttgggtttacttgccacgaggagggccacctcctttccacgtctcacatggctgcgtgattccgagcgctggtggtggaggaggcggtgctgagggcacaagtgtaaccaccaagattaggactaagatgaggcccagcatgaaatctgccaccctttctatgccaccttctcccattcttcctacgaagcacaattttttcac

SEQ ID NO: 21230 - DNA, 455 bp, Gossypium hirsutum
  Clone ID: uC-gsflnu33B093f05b1
ggttaacaaaatttcaagcttgaaattttgattcaaacacttttccttttcattctctcataaaactcaaatcccaagttcttatcaatgggtctctcagtcgagaattcagtaacacaatcccacacacgaacccacaaaatcttcttaatcagcaattaccttctattgggagccgcctccagttgcatcttcctcaccctttccctccgcttattcccttccctgtgtggattcttccttatcctcctccatgtcatcaccatcgccgccgtcgtcttgggttgctccgtcgccatttcgggttccaacaaacgctacttggcttacatggtgtcgatggtgctgacatcaatattcgaaggctctgtttcggttcttatcatgacccgaacgtcggatttcttggggtacttgaggtcttatgtgagggaagatgatgggttttgatattg

SEQ ID NO: 21231 - DNA, 541 bp, Gossypium hirsutum
  Clone ID: uC-gsflnu33B093f07b1
atacggcccagttgcagagctagcgccttctttgcaggctgatccgacaaggagtactgatatgtcaataactggcacaatggatcctgaagatgacacaatttttctcaaagtacagattacagacaaggaaggtcaagctcggaatatctattttccttttgacatagtgaatgacactgcaattgatgttgccttggagatggtaaaagaattggatatcaatgactgggagccattggagattgctgatatgatagaagaggaaatatcttctcttgtcccaacttggaaagactggggctcctctcaagtctaccatcagcacagctttaagtacgaagatgaggacgaagatgatgcccaaaatgaaatctgccaccctttctatgccaccttctcccattcttcctacgaagcacaattttctcacgggaaaagtgtgacttccaagtgcaattggccacaggatttattcagcaatgatgatgcaagttccagttgctctatgaaactcttcagtactctacaatgaatatga

SEQ ID NO: 21232 - DNA, 439 bp, Gossypium hirsutum
  Clone ID: uC-gsflnu33B093f12b1
ttttacgcgttcgcccacgcgtccgcccacgcgtccggaaagttgaaaccgtagtgaaagaggcacttgagtggcttgatgacaaccagagtaccgagaaggaagactacgaggagaagctcaaggaggtagaggcagtatgcaacccaatcatcacagcagtgtaccaaagatctggtggagccccaggtggtggatcaactgaagaagatgatgattctcatgatgaactttaaaaaactggtaatgccattttgattgctgaaacaagcaaagaaaagcaaagggtgagaaggatgagagcataggtaggtgagatgaggatatactgtaattgttctccatggtagaagttaaaaaagggagaagtatatccccctttggtcggatgttatttttgggtgaatgaatacgttttaacggatattttttttgttat

SEQ ID NO: 21233 - DNA, 513 bp, Gossypium hirsutum
  Clone ID: uC-gsflnu33B093g01b1
ctttcgcgttcgcccaccgtccgcccacgcgtccgcaaaatcagtggagtccaatttatgatgtagctgcaatactgacatctattcagtcattgctttgtgatccaaatcctaattcccctgcaaattctgaagctgctcggatgtttagtgagaacaagcgcgaatacaataggagagtacgtgagatagtcgagcagagttggactgctgattgatctctcatgttggatttccatagtcagaacaaagcgtggatacattaggagagcatgtgagactgtcaagcatagttggactgctgattgatagctcaacgtttggtttggtttctatggaacgtcaaaaatagtccaatgtcgtgtctaaataacattgaacaccgcaaatgtgttgcaaactactttgtcttattatgttgtttgtgttaagaaaatgaacgctgttccttgggcagcatatttcatctagtactccaagcataaataaaccctaagtcccaagtaaatcaaa

SEQ ID NO: 21234 - DNA, 483 bp, Gossypium hirsutum
  Clone ID: uC-gsflnu33B093g02b1
acgggtcgaatcttctaaactatccaaatacctctaacggatactctttaatatttaagcttcatattccggctttggatcctagggttttcttttttgttttctttttctccagcttcgtctgtaatggctcaaccaacagggaggggaagagtggtaggggactatttagtgggccggcaaatcgggtcgggttccttctcgattgtctggcatgcgaggcatcgagttcatggaacggaagtggcgataaaggagatcgtaacgagtcgattgaatagaagttgcaggatagtttgatgtcagagatctttatcttgaagagaattaatcatcctaatattattcgactgcatgatattttggaggctcctggacagatacatcttgtattggagtactgcaagggggtggatctttctatgtatgttacacgcttggaaagtgtccctgaggcaactgcaaagcattttatgcaacagc

SEQ ID NO: 21235 - DNA, 471 bp, Gossypium hirsutum
  unsure (1)..(471): unsure at all n locations
  Clone ID: uC-gsflnu33B093g04b1
gctttgaccatgttccacacatgctccataaatgccctgatcaaatcccagaccccaaggccgtccagtatgtgagaaacgatcgtgggacacccatggttttggacaacaactactacaggaacatactggacaacaagggtttgttgattgtggatcaccaactggcttacgacaaaaggaccagaccttatgtgaagaaaatggccaagagccaagactatttgttcaaggagttctcaagggccattactctcctctctgagaacaatcctctcactggtagcaagggtgagatcaggaagcaatgcaagcttgcaaacaagcttcactaaaatgccttgccaaagagaaagccgagagtggccgaatacatggatgtttacttgtttcttttccaagagacaagtttgttaatgtgcagtgagcnatggtgcactggtactagtttgatacgatcgacccattgca

SEQ ID NO: 21236 - DNA, 488 bp, Gossypium hirsutum
  Clone ID: uC-gsflnu33B093g08b1
tttatgccttgatgaagattcttaccgagagaggttacatgttcaccaccactgctgaacgggaaattgtccgtgacatgaaggagaagcttgcttatgttgccctggactatgagcaggaactggagactgcgaagagcagctcatctgttgagaagaactatgagttgcctgacggacaagtcattactattggagctgagagattccgttgtccggaagtcctcttccagccatctttcatcgggatggaagctgctggaatccatgaaactacctacaactctatcatgaagtgtgatgtggatatcagaaggatctctacggtaacattgtgctcagggggggttcaaccatgttccctggtattgcagaccgcatgagcagggagatcactgcacttgctccaagcagcatgaagattaaggtcgttgcaccaccagagagaaagtacagtgtctggattgaggatctatcttggatcactc

SEQ ID NO: 21237 - DNA, 508 bp, Gossypium hirsutum
  unsure (1)..(508): unsure at all n locations
  Clone ID: uC-gsflnu33B093g09b1
tttcattttgctttgaatctttgataatggaagccaaatggctggttcttttttcagtggcggcaatgctgatggcactggccaactgccaggaatctgtgaagccattggtgaagatggtaaagggcaagaagctgtgtgacaaagggtgggaatgtaaagggtggtcaaagtattgttgcaaccataccatttctgattacttccaaacttaccagtttgaggacctttttgcgaagcgtaacacgccggtagctcatgcgattgggttctgggattaccattctttcattacggctgctgctcagtatcagcctcatggatttggtaccactggggaaaagctccagaatatgaaggaagtcgctgcttttcttgcacatgtcggcagcaaaacttcatgtggctaccgagtcgctaccggnggaccattggcttggngtctatgctacaacaaagacatgagccctagcaaagtatatggcgatgattactacanatacaccta

SEQ ID NO: 21238 - DNA, 517 bp, Gossypium hirsutum
  Clone ID: uC-gsflnu33B093g10b1
tttaaaactcagaatcaacagatcgaagtgaaaatggagtgtgtgttcggtttagtgggcaacgactttgccatagtggcgggggacacgtcggctgttcacagcatccttgttcacaaatctaacgaagacaagatcatgatcctcgattctcacaaactcatcgccgccagcggtgaatccggggacagagtgcagttcacggagtatatacagaaaaacgtggccttgtatcagtttcgaaacggtattcctttgacgactgccgccgccgctaatttcactcgcggtgagcttgccactgccttaaggaagaatccatactttgtgaacatccttcttgctggctatgacaaagagacaggcccatctctggtctatatcgactacattgctacacttcataaggttgataagggagcatttggttatggatcctactattctcttgctatgatggacaggcactaccacagtggcatgacagtggaagaagccattgatttagttgataaat

SEQ ID NO: 21239 - DNA, 575 bp, Gossypium hirsutum
  unsure (1)..(575): unsure at all n locations
  Clone ID: uC-gsflnu33B093g11b1
cagctgaaatggctactgcaacaatgagcttcaatttggtgggagcatttaggggtctttctctagcatcaagctcgacgtcgtcctttatgaaaggcgaagtgggttccattcacaaaacggcagtcgtttcgttcccgaggaagtctccgttccctttgacgatcgaatcggcgcacaaaaaaggagccggtagtactaaaaacggtcgcgattcaaagggtcaacgactcggcgtcaaaatctacggcgaccaggtcgccaagcccggcgctattatcgttaggcaacgtggaaccaagtttcatccagggaaaaatgtggggcttggcaaggatcacacaatcttttcattgattgacggacttgtgaaattcgagatgttcggagccgacaagaagaagattagtgtttacccacgagtacttcagcctgagaatcccaacagctatagagcanggcagagagagtacttcaggatgcgacgtgatcaaacgaaggcaaaaaaggaaggaatctagctcaacctgactnggctcgcttcgctgccgtgctacgatgataatctgttgtga

SEQ ID NO: 21240 - DNA, 536 bp, Gossypium hirsutum
  unsure (1)..(536): unsure at all n locations
  Clone ID: uC-gsflnu33B093g12b1
ttctccctggagctcaatactacggccgtggtgctttgccaatttactggaactacaactatggagctgctggctatggtataaaagttgatttgttgcaccaccctgagtatctcgagcagaacgcaactattgccttccaggctgccatctggaggtggatgaccccaatcaagaagaaccaaccttcagcacacgacattttcgtgggtaactggaaaccaaccaagaatgacacagaggaaaaacggggtcctacttttggctccaccatgaacgttctctacggagattacacttgcgggcaaggcgatatcgatcccatgaacatcatcatctcccattaccttcattaccttgacttactaggtgttgggcgagaggaagcagggccacacgaggagctaagctgtgccgagcagaaagcattcaacccaaccccagctccacctgctgccagtgcttcctgatctttggttcagccaatntcatntgtaaaatgcagttgtcaatgaagggtaatttaataagagagc

SEQ ID NO: 21241 - DNA, 336 bp, Gossypium hirsutum
  Clone ID: uC-gsflnu33B093h01b1
ccttctcgtccgaaaaaaaaaaaataaaaataaaaaagaaaataataaaaaactattaagcattaaaaaataaaaaaacaaatataccaaacatactttttgtaaattgagcaaggggtgttcgttttatagacacaaacatttcatacacctggcttcaagttgcatgttcttgtttttgcagcacctgttctacctgattgagagtggtttgttgactgagccattgggagatgctggtacggtcccatattcatatcctaacaatggaatgctttttcgtcaattcacgataaagctattgggtacatcattccccaacatgactgctgttga

SEQ ID NO: 21242 - DNA, 526 bp, Gossypium hirsutum
  Clone ID: uC-gsflnu33B093h05b1
agttaactgtgaataagtgaattgatatccaagcgttccattccatttccgtatagttcgaaaacacttaagtaccttcgatcatattttagtgtcaaaaaatggccgaggagcataccagcaaggcccctgagttggagagcaacgttagcggtgaaggagcagtggagagcaaggagcgagggttgttcgatttcatggggaagaaagaagaggagaagcctcaagaggaggtgatcgtaaccgagtttgaaaaggttaatatcgaagagacaaaggcagaggaagaaggtgaggagaagaagaagcatggtctcctggagaagcttcaccgatcagatagcagcagctccagctcttcaagcgacgaggtagaaggtgaaggagaagagaagaagatgatgaaacagatggagaagaagggactggcagataagattgatgagtaattagtaggggaaacgatagaagaggacacctcagttccagtagagaagtgcgatgagccagtagtccagccagagac

SEQ ID NO: 21243 - DNA, 518 bp, Gossypium hirsutum
  Clone ID: uC-gsflnu33B093h08b1
gataaaaacaccttttttctctttcaaaaggacagtttttttttcttacacacacaacaaaattccaataaattcccttaatttctcttagtttttgcttacgaaaatactttatacgtattcaccaatgcatgatctttcgatccaatgtaatttcgacccataaaacacgcttgatttgactcactgagttggagaaaaaattatgatagaagcaatggagagttccgtcgtcaatggcagtggtttcactcagttacaacagagctatggagatagtagtgaagaagagctatcggtgttgccacgtcacactaaagtggttgtcactgggaataaccgtaccaaatcggttcttgttggtcttcaaggtgtggttaagaaagctgttggacttggtggatggcattggctggttcttacatatggcattgaagtaaagctacaacgaaatgccctcagcgtaatcgaagctcccaccgtaacgaagagatgatgacctgagtttgggacatgca

SEQ ID NO: 21244 - DNA, 473 bp, Gossypium hirsutum
  unsure (1)..(473): unsure at all n locations
  Clone ID: uC-gsflnu33B093h11b1
tttaatcaccatcacaaacgacaagggccgactctccaaagaagaaattgaaaagatggttcaagaagcagagagatacaaatccgaagatgaagaacataaaaagaaggtcgaggcaaagaatgcattggaaaactatgcatacaatatgaggaacacagtgaaggacgagaagattggtgctaaactcccagcagctgataaaaagaagattgaagatgctattgaacaagccattcaatggctagacagcaaccaactcgccgaagccgatgaatttgaagacaagatgaaggagttggagagtatttgcaaccccatcattgctaagatgtaccaaggtgccggcggtgacatgggtggtggcatggatgaggatgttccggctggtggaagtggtgctggtcctaagattgaggaagttgactaaatcattgattntcttcacctgggttctctatagctctcttatg

SEQ ID NO: 21245 - DNA, 541 bp, Gossypium hirsutum
  unsure (1)..(541): unsure at all n locations
  Clone ID: uC-gsflnu33B093h12b1
ttttcttcccatctatgcatggttttaaataaccattagctccttttcatttgttttccacctttgtttttatggtccttggcttctaaacctgcaacacttaaaaacatatattttcagattattgctaattgttggtcttcaaagtagttgaagaaaggtgatcatattggtgtggttggagatcatatctggtgtgtgaaggagatggagagtggttgctctaagaatgttgaatcatgtcctaaacttcttgatttaatacctcaagaaagagagtggcatttgaagggagaagaggagagaagggatggatcctcacaggagaagaagctggaactgaggcttggtcccccaggtgagaacaactggtccaacaaaaacaatactgagagagatgagtctttactctcactagggtacttctcttccatgaagagcaatggaaaacagacacacaagtttccatgtccngaggaccactctgctggtcagttttgtccactccatgggccaaaagccaccatcagcagcagacaat

SEQ ID NO: 21246 - DNA, 158 bp, Gossypium hirsutum
  Clone ID: uC-gsflnu33B094a01b1
ggtgggtttttttaaaatactagcggttgcaaacaaaacagaaacaggatggcgaaattgcttatgcactggaaattgtagaaccgaattttttaactcggacttttaatttgaagaaacacgcagacccaatagatttgagaaaaagaaaactttaa

SEQ ID NO: 21247 - DNA, 207 bp, Gossypium hirsutum
  Clone ID: uC-gsflnu33B094a05b1
caacatatgagtgatggaaaatattccgagactgtcgggagtgatcttgctcccccattggctcgggtggtttcaacttctgttcctactaataagccgaagttggttatgtcacaaaccggtcttcaagctcctaacactcacactatgcggaaacaagaagcttccacccaagaaccttatcaagccaagttggtaaccgatagt

SEQ ID NO: 21248 - DNA, 210 bp, Gossypium hirsutum
  Clone ID: uC-gsflnu33B094b11b1
cctcacaagcctcgactggatcagatccgggggcgggtttttataacaccgttctgtggtcctcccttacgcggcttacgctcggaaattgaagcttgaaaactcgaagctcgttagggatatcgccgaactatccgggaaatactcggatttgataaacaaaccatattatcgggcctctgtttgacaagaaactactattgatggatt

SEQ ID NO: 21249 - DNA, 299 bp, Gossypium hirsutum
  Clone ID: uC-gsflnu33B094d05b1
gctagacattcgttgaagtggaacgaatttggaaagaaagggcttggggaagcagttataacactgaaagccttctcgagcatggaaacgagtccaactagtcgctatcaaaatcaacccggcatgcgtttctacaaagtcggtatcctgtcccggaggcagttgaaggtgtgagcctcatctttctacacataaatgttgaaaggtgaggcatcttaaaacatttagattgtttactgcattttggtgttgcatatttcaaagttgagaaggaacttggcgggtgatgatagataatc

SEQ ID NO: 21250 - DNA, 462 bp, Gossypium hirsutum
  Clone ID: uC-gsflnu33B094e02b1
tgtctgttcaaagcgtcatggcatcgaagcggattttgaaggaactcaaggatttgcaaaaggatccacccacttcttgcagtgcaggtcctgtagctgaagacatgtttcattggcaagcaacactcatgggcccttccgatagcccttatgcgggaggtgtatttttagttagtattcattttcctccagattatcctttcaagccccctaaggttgcatttaggaccaaggttttccatccaaacatcaatagcaatgggagcatttgtcttgatatcctaaaagaacagtggagtccagccctaaccatttccaaggttctgctctcgatctgctcgttgttgactgatccaaaccctgatgacccacttgttccggagattgcacacatgtataagactgatccggcaaagtacgaagcgacagcatgtggctggaccccagaatattgcatgggat

SEQ ID NO: 21251 - DNA, 421 bp, Gossypium hirsutum
  Clone ID: uC-gsflnu33B094e11b1
tcccacgcgtccgcccacgcgtccgctccttccttctctctctctctctctctctctcaaacaaaaccagttctcttcgaaataatcagtctgggttatggacggcggtgcttcctataacccacgtacagtcgaagaagtctttcgagatttcaagggtcgtcgagctgccatgattaaagccctcactactgatgtggaagagttctacaagcagtgcgatccagaaaaggagaatctttgcctttatggatatcccagtgagcagtgggaggtgaatttacctgctgaagaggtgcctccagaagctttcggagcctgcactgggtatcaaactttgccagagatggggatgcaagaaaaggacttggttgtctttggtggctgtccacagtgacgcgtggttacttggctggggctt

SEQ ID NO: 21252 - DNA, 264 bp, Gossypium hirsutum
  Clone ID: uC-gsflnu33B094h11b1
tgaaatttcttctcttttttccccattttatgggggcccataccatttccccgctaccccgattccctttattttttcccccaatttccccaaatcggcagccctctgcatctctgtcagtagcccgcttctgtatctccgtcgagatatgctgtcaagtatactgaaagaggacccaaggatcttcaaaatctgagagaagaaattcaatcccaaaaaaagaaaaagaaccctaaaagatgaggattaatgggagtcgggagt

SEQ ID NO: 21253 - DNA, 74 bp, Gossypium hirsutum
  Clone ID: uC-gsflnu33B095e10b1
cttaagtatatgtgcttaagcacgtgtgttttaggtgaaaggttcgagggttggtattccaaagaaaaaaagag

SEQ ID NO: 21254 - DNA, 94 bp, Gossypium hirsutum
  Clone ID: uC-gsflnu33B095f07b1
accttttatatcatacgaaacacctttcctctctatttggggcctaattatgtcaatgacacgttaagcaaacaaacccctgcccgaagatcat

SEQ ID NO: 21255 - DNA, 257 bp, Gossypium hirsutum
  Clone ID: uC-gsflnu33B095h01b1
gtcgatgtttgctatgttggaaactgttactcccattccatacgatgttgttaatgatctcaagggtggctactagttctactctgttttttttgtcttgctgtttttggtttaccctttgcataacttaagtaagcctcgatagttattttggatgtgttgttttctatttgtagttcatttgaagaattactgcttttgaaaagattttaatcttatcaatcattttaatttagtgataaaaggaattccattcc

SEQ ID NO: 21256 - DNA, 238 bp, Gossypium hirsutum
  Clone ID: uC-gsflnu33B097b07b1
tcctccacgcgtccgatttatttcactacccaacaacccaatagataaaggaatcgtttacttgttcgtagcaatttatcgtcatttcaagctcaattctctgaaaatttttgtgctgaactccttttttctgtttgtactaccatgtgtggaggttctactctttatcttcactcttcctctctttctttcttttccttctcttctcattactcttttctttttcttcttcttccct

SEQ ID NO: 21257 - DNA, 214 bp, Gossypium hirsutum
  Clone ID: uC-gsflnu33B097e07b1
tcgtcaaaaaaaaaaaaaaaaaaaaaaaaaaaaagggctaacttaaaaaagagcccccgcacacacccaaaaaaaaaacacaaatacattacttctcttacccccaaccccccattacccccctccactgtacccacatacttctcaccctaccacctccctcacataccctcccttcaccccacaccctcacactctacccacaccctctcac

SEQ ID NO: 21258 - DNA, 187 bp, Gossypium hirsutum
  Clone ID: uC-gsflnu33B098a02b1
aataaatgaagaacaaagagaaaaaacgaaaggggggaattattaagaaaaaaccacccataactcctgcccacaaaacaacaagatgtggcccccctctccgcgggcacaggtttcactacggtagccgcagcggtcaatcctcctctctctcggggggggccctcgcggggggccccgggtttca

SEQ ID NO: 21259 - DNA, 191 bp, Gossypium hirsutum
  Clone ID: uC-gsflnu33B098b08b1
tactcttcttcttaatcatcctgaagccatgcataaagcttggactgaaataactgctgaagtgggacatgacaagtttttagatgaaacagacctgccaaagttgaattatctacaatccataatttcagaaactatgaggttattttcaccagcaccattgctattaccacatgaattatcagatgatt

SEQ ID NO: 21260 - DNA, 98 bp, Gossypium hirsutum
  Clone ID: uC-gsflnu33B098c05b1
tgataatctcatgaactaggacggtctgaggctggctttataaacaaaataaattccatattatcccattaaaggggggttactccagccctgtcacg

SEQ ID NO: 21261 - DNA, 296 bp, Gossypium hirsutum
  Clone ID: uC-gsflnu33B098d11b1
gcctcattttcacacttgtcattctgtttgcttggctaatattagctgatggaatcagatttaccgaggaaggtaggctttccaagttagacaaagatgagtactactcgggagaactggttacaaagaccctgattggcagccgtaataagatcaaagatagccggggcacacatggagcagatgctgctgctgttaccaccattttcgcatccaataccaaggatttgcacgccacaacccctggccacagtcccggcaccggtcattaaatttcacctaatggccataattag

SEQ ID NO: 21262 - DNA, 100 bp, Gossypium hirsutum
  Clone ID: uC-gsflnu33B099f04b1
cctcgacgccgccgtcaaagatctaccgccactaggccgtcccttggcctccgacgacgctccggcgacaccaggtgtgtaaagatgcgcgcgcaagcca

SEQ ID NO: 21263 - DNA, 264 bp, Gossypium hirsutum
  Clone ID: uC-gsflnu33B099g10b1
tcgcccacgcgtccggaaaatatctcaaatctcctcctcctcctcagtcgtgctttacctccgtcgccgtcggccattccccctgcctcgccatctctctccggcggccttcgcttcgcctcctcatctctggctctgtccgtccgtcggccttgccttgcctcctcatctctgcctcgttctttgtcagtttgttggtttgtcttttcccgtctaccttccgttcttagctttatactatggctccctccctttagggcccct

SEQ ID NO: 21264 - DNA, 249 bp, Gossypium hirsutum
  Clone ID: uC-gsflnu33B099h07b1
tcgtgacattatagctcggctgtcttcctttacaccattgattttttttggacaccctgcacatcccaaggagccagggaaaaaaggcatgcttgcttcacaaggcaattcatttttactcacaaatgattaatgtaagaaggatgttatgtcccatatcccaaaaatcatataagcttcaaaacccccatcacttgaatcttgtaaggctttcatggatctggacttgcagaacttagtctcatgtat

SEQ ID NO: 21265 - DNA, 413 bp, Gossypium hirsutum
  Clone ID: uC-gsflnu33B100a02b1
tcctgatttgcatgttagtagatagtaggaaatgttgctgctcggaggaattatattacgtgatgtgatgtctcatccccagcccagttttgtgccttgtaatccagaaaaccttaggacctagacaaccatggcagtgtggtgaccgcggaaacagtgatagaagaaagcaagaaagttgaaacttttattattatataaactaagtagagatggatatatatgaattgtgagtttgattggagcaatatttcctttgcgtgaactggattgggctggagtgagatgtaaggttatggatggttttaagtggtgtcggtgggtaagacttattttgctggtgcaaatatgagttcactgaaatatgctatggattgaaggtcatcaacatacatatgaatggatggatgcta

SEQ ID NO: 21266 - DNA, 474 bp, Gossypium hirsutum
  Clone ID: uC-gsflnu33B100a05b1
ggtatattttgccgaattacgtggtggtggagcagcgttacttcgacgtgaaggagtttccggcgaacgacgaccacccgtcgcatgacgtggcgcgtgggcagaggttcgtgaaggaggtgtacgagatactgagaagtagcccgcagtggaaagagatggcgcttctgatcacgtacgatgagcacggagggttttatgatcacgttccgacacctgtctcgggtgttcctaacccggacggaataattggacccgacccgttttatttcaagttcaataggcttggtgttagggtccccactctcttggtctctcgctggatcgataaggcaactgtgatccacgagccaactgggccaacaccgtcttcccaatttgaacatttttccatccctgcaactgtgaagaagctcttcaacctgaattcaaatttcctgacaaagagggatgcctgggctgctacatttgaaa

SEQ ID NO: 21267 - DNA, 353 bp, Gossypium hirsutum
  unsure (1)..(353): unsure at all n locations
  Clone ID: uC-gsflnu33B100a12b1
cttatttttatctttcccgnctctgcatttacgttctatttttttttagatttattttttttcaaacaaaactaaagggatttgagttcgtgtggatttgaagtactttcttgagcatatatggaccgtgctgtactatcccctgggcaggacctgaagagggccctccaatgggaaacatacgctgccactaggcgtggtacatgagccagcctgcgagatgccagggcgccgtcatgctttccaacacggctaaaaggcctgggatcaagccggaaatggctctcactatgccaaagcgctggaacattgctgaccggcctgctggttaccagagacgggggaacactttg

SEQ ID NO: 21268 - DNA, 464 bp, Gossypium hirsutum
  Clone ID: uC-gsflnu33B100b01b1
tttacgcgtccgctgcaatccatgaggagaaacctgtagaagtggtcaaggttggagaaattgcaacagaagaggtaccggctgttgctcctgcagcagaacctgttgctgaagaaccaaaggaagcagtgcctgaagcagcatccggagaaccccaggctccagaaactgaagccacagttgaaactgaatcaaaggaggtggttaaagagcccaaggctgtgactgaggagccagaagttgagaaaaaagaagaagagactcctaaggaaacggtagcagagccagttgccgaggagtcccaggagtccaaggagacttctgagccaacagttgaagaaaccaaagaaagcacagagtctacagaagcagcagcagcagcagcagcagcagcagcagaagtaaaagcagaagccgaagccgccccagtggaagcacccaaagaggaagctgcaaggaagaaa

SEQ ID NO: 21269 - DNA, 469 bp, Gossypium hirsutum
  Clone ID: uC-gsflnu33B100b04b1
ttcatatcccatatttccctttgaagaagatgcagatctttgtgaaaacccttaccggcaagaccataacactcgaggtcgaaagctccgacaccatcgacaacgtcaaggccaagatccaagacaaggaagggatcccacccgaccagcagcgtctcattttcgctggcaaacagctcgaagacggtcggacccttgccgattataacatccagaaagaatccaccctccacctcgtcttacgccttcgtgggggcatgcaaatctttgtcaaaaccttaaccggcaagaccatcaccttcgaagtcgagagttccgacaccatcgacaacgttaaggccaagattcaagacaaggaaggcatcccacctgaccacagcgtttgatcttcgctggcaaacaattggaagatgggaggaccttggctgattataatatccaaaaggaatccacccttacctttgtttga

SEQ ID NO: 21270 - DNA, 340 bp, Gossypium hirsutum
  Clone ID: uC-gsflnu33B100b07b1
tgcaatccatgaggagaaaccttattaagaggtcaaggttggagaaatcgcaacagaagaggtaccgtctgctgctcctgcagcagaacctgttgctgaagaaccaaaggaagcagagcctgaagcagcatccggagaaccccaggctccagacactgaagccacagttgaaactgaatcaaaggaggtggttaaagagcccaaggctgtgactgaggagccagaagttgagaaaaacgaagaagagactcctaaggaaacggtagcagagccagtcgccgaggagctcaaggagaccaaggagacttctgagccaacagccgaagcaaccaaagaaagc

SEQ ID NO: 21271 - DNA, 477 bp, Gossypium hirsutum
  Clone ID: uC-gsflnu33B100b09b1
tttccaccaacatagtccaacattttcataacaatggctgcagtcacaaacgccgctgctacatcctccttcatggggacacgcttccccgacgtctacacaagttcagggagattcgtcgccaggtttggttttggcggcaaaaaagcagctcccaagaaagcctcgaaacaaacctccgaccgccctctatggtacccaggagcggtggctcctgattggctcgatggaagcttggtgggtgattacgggttcgacccgttcgggttagggaaaccagcggagtacttgcaatatgatttggattctttggaccagaacctggctaagaatatggctggtgagatcattggaactaggaccgaagttgccgacgtgaaggcgacgccgtttcagccttacagcgaggtttttggtcacagaggttagggagtgtgaattgatccatgacggtgggccatgttggctacgcttggt

SEQ ID NO: 21272 - DNA, 485 bp, Gossypium hirsutum
  unsure (1)..(485): unsure at all n locations
  Clone ID: uC-gsflnu33B100b10b1
atctcggccatggaaacgaaaccaagctctaaaattcccctctttttcccaattcttttccttctattatcaactctaacccaaccctcattatcatcatcaatcgacaccatcatcatcaatggcaaagacccatcaatctctttacggcgccgtattctattagcttctcaaaggaacaacaagatgaaccagatccctaattgtggcgaaagggtgtcgagatctcagtgtttacaaaacccaaagtgtcgatggtgtcgtagtgaagctcttgatgatatgtgctttaaaaaagctgaagcttggcgattgcctcaacaggtttttctttgtaattgatattcgattttagtttatttgtgaatgaatttgatctgatttatgatatgtttttttgaaatttttgtactgtttgatttggtgattntatgtggatgcttttgaattgatttaaaatttttgcgggttttagtggaaatttg

SEQ ID NO: 21273 - DNA, 410 bp, Gossypium hirsutum
  Clone ID: uC-gsflnu33B100b12b1
gcacggaccgggactggacttgccggaccgacccacgccgttggtttgattcagctgctgataaacggacaaggtggctttacgatgggaatattatggtcactacgacctacaatatggagactaagggcatagtctgacggccaatacagagtgatatctatgtgccagggggctacatggagagctcgctgaaaatgaggaattggcagccaaggatgtaagcagggctgttgatgacggaaaagctcctaatagttgcgaactcattaagtcgagaactattagatcttgcattgtgcacacgaaaagacagacgaatgaattaactatatgccaagaatcaaatacggaaggagcaataaaaaatcaatacatattctagaccgccaataatgagctttagtgca

SEQ ID NO: 21274 - DNA, 479 bp, Gossypium hirsutum
  Clone ID: uC-gsflnu33B100c03b1
ttgataacccttaagctgccgccatttttgctttcagcagcttgcatttgaaaagatggtgagggtcagtgttttaaacgatgcacttaagagcatgtacaatgcggagaagaggggcaaacgacaggtcatgattaggccttcctcgaaagtgatcatcaagttccttttggttatgcagaagcacggttacatcggagaatttgagtatgttgatgaccacaggtctggcaaaattgtggttgaacttaacgggaggctcaacaagtgtggggtgattagtcctcgttttgatgtcggagtaaagagattgagggttggactgctaggctacttccttctagacaatttggatatattgtgctaaccacatctgctggcatcatggaccatgaagaagctagaagaaagaatgttggttggaaagtacttggttttttctactgagtcaaatttttgatatttttctttttttaatt

SEQ ID NO: 21275 - DNA, 484 bp, Gossypium hirsutum
  Clone ID: uC-gsflnu33B100c06b1
tgttttattgcgcatacacgtaacgctatctccttcgaccgttttgcttacaagcatggtatgaagtaccagactgtggaggaaatgaagcttacagattttcaaagagattgtggatttgatccgatccactaacacgaaaggtttatcttacactgttgctgataatcatgttgctgattggagctgggacgagttccaaatacacaggcttggagctgctcaaaactgctcaggcaccacaaagggcaatcaccaactaactgatgtagtcctacctgaatcgaaagattggagggaagcaggcattgtcagccctgtcaaagaacaaggctcctgtgggtcctgctggacattcagtaccactggggcactagaggcagcttatcatcaggcatttggaaagggatctctctatcatagcaacagctagtgtactgtgctggagcctttaaaactttggttgacacggagggttgccgtc

SEQ ID NO: 21276 - DNA, 511 bp, Gossypium hirsutum
  Clone ID: uC-gsflnu33B100c09b1
ccgggacggacttgctggacccacgcacgcgtttatttttgccacagctggctagaatggagacctttctattcacatctgaatcagtgaacgagggtcacccggacaagctctgcgagcagatctctgacgctgcgctggacgcttgccttgcccaggaccccgacagcaaggttgcctgtgaaacatgcaccaagaccaacatggtcatggtctttggagagattaccaccaaagccaatgtagactatgagaagattggccgtgacacatgccgctctatcggatttgtttctgatgatgggggtcttgatgctgacaactgcaaggtcctggtcaatattgagcaacagagccctgatattgcccagggtgtccatggccacttcaccaagcgcccagaagaaattggagctggtgaccagggccatatgtttgggtatgccactgatgagaccccagaactcatgccccttagccatgtccttgcaactaagcttggggctcgtct

SEQ ID NO: 21277 - DNA, 414 bp, Gossypium hirsutum
  Clone ID: uC-gsflnu33B100d01b1
cgtttgctctatgaccatcttgggcgttctcgacaggtttgccgccatgggtatagacacccctgaagacgttgccctactaggagctcacagtgtgaggagaactcactgcgtgaagctggtgcatcggttgtacccagaggctgaccctgccttcaggcccgaccatgttccacacatgctacataaatgccctgatcaaatcccagaccccaaggccgcccagtatgtgagaaactatcgtgggacacccatggttttcgacatcaactactacaggaacatactggacatcaagggttagttgattggggatcaccaactgtgttacgacaaaaggaccagaccttatgtgacgaaaatggccaagagccacgactatttcttcacggagttgtcaagggccattactct

SEQ ID NO: 21278 - DNA, 481 bp, Gossypium hirsutum
  unsure (1)..(481): unsure at all n locations
  Clone ID: uC-gsflnu33B100d03b1
atcatatcttgctacacccttttggctctgctatttctattcattaaagcaaagctatggctaaattactggccacccttttcatcctaaccctctttgtttccactttatcctttgcagctcgcactgctccacctttccctgcaaatacccaacaacaacaagctcagggtgttgttgaagttgaagatagctgtgaaggagttgcggaagaagagtgtttgatgagaagaactcttgctgctcatactgactatatctatactcaaaaccacaatccatgagcttcaaatttcttgtttttctttagccatcaacccactacatatatatatgtactgtatgtatatgcttgnttgntgntgattatgatataatttaataacataatcaatcagaggctttttttttcccctacttttgtgttggtgttttgtttcttccatttgtgattntaagttttggattgttttgaaaattt

SEQ ID NO: 21279 - DNA, 440 bp, Gossypium hirsutum
  Clone ID: uC-gsflnu33B100d04b1
atatttttatagaacaaaaaagaaaaaaaagagcgaaattaaacaacgatatacgcaatgtactggcttgaggacgattatacatagttcgtactcatagagtggtacataaagaacgcagggtggtacgtggctgccaatctgatgagttgtaggttgcgataggcgaatggcctctaacgagtttgtatatacgggtccagccaaatcattttatgagcttgtcgataagaacacctgggacgagcaaccactgtggatatgaggatagagcatctgaagccaacatggtttatttgacggtggcatcttccaaagggaatgcgccaatgtacagcctgcatagagtgaagacttccctttgactgatggggccgctttgacttgcgattttccagcattcgcaagatgcgacaactctccaggctaaatttattgtc

SEQ ID NO: 21280 - DNA, 201 bp, Gossypium hirsutum
  Clone ID: uC-gsflnu33B100d06b1
atcatttttcctttctcttttgcttatttcctcaagtggcacctaacttctctgactgtacagaaaagtaacaaattgagcaatgaagtaattctttgtaattatataactgtgatgccagtccttggaaatgatatatataatataggtggtttttgggttgaaatataaagaacaaaaaaaaaaaaaaacaaccaaact

SEQ ID NO: 21281 - DNA, 476 bp, Gossypium hirsutum
  unsure (1)..(476): unsure at all n locations
  Clone ID: uC-gsflnu33B100d09b1
tttgtgtcggttgatcggatgaagaccccttttgttgtagttcaagggcatagacctatgtacactacaagtttcgaaagtagggacgccgcattgagagagaaaatgcttgagcatttggaacctttatttgtgaataacaatgtgaaccttgcattatggggccatgttcatcggtacgagaggttttgatcattgaagaatttcacatgtggaagcatggggcagaaggggaaggattgggaggcattaccagttcatgttgtgattgggatggcaggacaagactggcaaccaacatgggaacctcgaccagaccatccacacgatcccgtctacccacaacccaagaggtctttgtaccgcacaggcgagtttgggtacactagattaattgctacaaaagagaaacttacactatcggtcgtaggaaaccatgacggngaggtgcatgacatggntgagattttggcatc

SEQ ID NO: 21282 - DNA, 387 bp, Gossypium hirsutum
  Clone ID: uC-gsflnu33B100d10b1
tttttgaactctcccggacctggaaaaagggagctcaggcaagctaccaaccaagcccttcacttgcttcaggacaattatccagaggtcgtggtcaaacaggtgtttatcaatgttccatggaggtacttggctttcaatatgatgattagtcctttgctaactcagagaaccaagagcatgtttgtgtgtcgcaagtccagccaaatcatctgatatgcttttcagatatatggcgcctgaacatggaccacttcagaatgcaggattgagcatggacggcgaacaagaatttacggatgctgatgctgcaacagaggttacagtcaaaccagcaaccaaacacagatgatgaattccctgttactgagaagagtactgtggtgt

SEQ ID NO: 21283 - DNA, 461 bp, Gossypium hirsutum
  Clone ID: uC-gsflnu33B100d11b1
tcgtccacgcgtccgcccgcccctaaaaaactctcactcatataatttaaattcgaagaatctgctacatcaaagggaaatcacaaatcccatttctcttccttacatcttttctttccttttcaacaattgcatcttttgcttttgatcccaaattctgggtttcctcttctgtccatcaatcaattcatactagttactcgaaatcgttaattttaagttgaagaaaaatgggcggtggtagggaaggtgaatcaagtgacaaagggctgttttctcatcttgctggctatgccgccggacattatcctccgcctggatcctaccctccacaaggatatcctcctcaaggatatcccccacaaggatacccaccggctggatatcctccaccagcgggatatcctcctcatggcggatacccacctgcaggatatcctgctcatggaggataccctcat

SEQ ID NO: 21284 - DNA, 376 bp, Gossypium hirsutum
  unsure (1)..(376): unsure at all n locations
  Clone ID: uC-gsflnu33B100d12b1
tttctgctcatacaataccaagctgacacgtggacgcattgctacaggttcatcagagattatgaaaacagtttgatgatggctttctcgatgtttatttcgcacttctcagtttcctgttttagttcaatcgttaactcttatggaatgggtaaatttcacttgggggcagcagagggtagctggaataacagatttctttattctttgttactgatctctgtaagctaatccgctgcaacatgccagctcggtctggagccgtggattgtattagtagaacaagtgaaacttgtgagaatgcagatgctatgtacttggatcattgctggggctaaatatattccaaatttcctactngggcaaccaacaccta

SEQ ID NO: 21285 - DNA, 414 bp, Gossypium hirsutum
  Clone ID: uC-gsflnu33B100e01b1
tcgttcacgcgtccgctcctatgtttcagaatcaaaatctctctttctcggcaatatggcagcaaatggcgatggttctgacaagagctcgatcgtcagcttcggtgagacgctgcccgattttgtgcccactgtctccagcgttactgtagccgaagctcccgtcttcctcaaagcccctggcgccgctccagctcacgtgctcatagctggagatagactctgcagcagatcgtcatttgacggaaaacttgcatacaacctgattggtcacatgctggccgatcttctcaagcatatccgtgagttcggtgacggataccttgtgtgaccaatgcgctagaactgctcttgccttagctacgctacgcgccgaccgaaagcgtgagatcatgttctatatgaatcctagca

SEQ ID NO: 21286 - DNA, 450 bp, Gossypium hirsutum
  Clone ID: uC-gsflnu33B100e03b1
ttgcctctacgcgtgcgctcaatctgggatgaagcttccaagatgcttgattaatacagagacgaaacgctcgactatgaaacaattcagagattcggttctccggtgacggcacacatcgaacccgacggtgattatgaagattatataagaactgagcttctttatcaaacggggttatctcaagaccccactaactccctcctcctcgccaattacgctcagattctctaccttgttgcacatgattatgagagagcggaagagtacttcaagaaagcggtaacagtggaggcggtggatgcggaagcgtacagtaaatacgcaagctttttgtggaaagcgaggaacgatttgtgggcagctgaggaaaccttcttggaagccattgaagcagatccgagcaactcttattacgccgcgaattatgctcattttctatggaacact

SEQ ID NO: 21287 - DNA, 98 bp, Gossypium hirsutum
  unsure (1)..(98): unsure at all n locations
  Clone ID: uC-gsflnu33B100e04b1
nttttaagtctttgtgtctgcttgttgttgctggttagatatgatcgtcgatgcattgtaatgtaatttttgacaatttgaactagtttatcaattna

SEQ ID NO: 21288 - DNA, 436 bp, Gossypium hirsutum
  Clone ID: uC-gsflnu33B100e05b1
cggcacgcgccgcggcggacttgctgggccgacccacgcctttgttcatctctattctggaagtagaacactgcgggtatattttaagtgacgactgcggcgaacgcagagcatacaaaaccggagtcgtgccaagtggctacaagcacgggtctcgaccggagggctatagagcccatcaccatctgcctgatcgaggccgggggctgaatcgactaccacctttgccagaaaacgatgacttagacgcacgacaaggagctcgccttggacgccaacaacgacacggctaagaccattctgaccccggactttgtgactggggctgtgcttgtgaatgagcacctgcttaacatcacacgcgagaataggctcgaaggcctactcaaggaggaacttcaccagatctatcctggagccatgtcaactacagcag

SEQ ID NO: 21289 - DNA, 472 bp, Gossypium hirsutum
  Clone ID: uC-gsflnu33B100e07b1
ccgggacggaccggctggacccacccacgcgtttattctactcgccgacgcgtgggcggacacgtgggcggtctcttggttgggagcaaagcctaaatggccgccactgtgacaggagcatgcacgaccacctaatacagacactaagccactgtgaaaacactctagacggggtatatctatcctgaggtaccaaagacctgcacgagcttgggggcccacaaattcacagggtcgctggtgttattggccatggctgcatggagcaaaccatctgatctccatggggcatcgaggggagctacctggaggcccgagaagtcatgcactgcgaataagcttgcgacgatactatacaccgccggggcattagctctggaaccgaaatgctactagaaacttacattccactgtgtgagtttgttgtcgatctgaatgcgttaccactacttacgagttccctagctgattg

SEQ ID NO: 21290 - DNA, 481 bp, Gossypium hirsutum
  Clone ID: uC-gsflnu33B100e09b1
gttccttagagggttatgcagctggaaatgcaattccgagtccacttaagaatgtcgaaagaggattcttgaagaagtattgggcaaagtggaaggccagccataccgggcgctgtcgtgcaatgccgcatatcaagacatatacacgctacaagggacaaaatctggcttggttcttactaacttcagcaaaccttagcaaagctgcctggggcacccttcagaagaacaattctcagttgatgatccgttcttacgagctgggtgtgctatttttaccatctcgtatcaaagtagatggtcccagtcgtgaattttcctgcactgataaggcaggttcatcaaagggtaccggtaaatcaaagtcatccggaaatcccataccagcaatgacgaagctagttacacttgcttggcaaggaagcaagacatccgaagtaattcaatgcctgtaccatacgaactccctcctgaaccatat

SEQ ID NO: 21291 - DNA, 463 bp, Gossypium hirsutum
  Clone ID: uC-gsflnu33B100f01b1
tcgtttagatcgcaaatcggctcgcctttctgtttaaatgcttacccttttctagcctacatgtctaataaagaccaaattgatattaattatgctctcttcctaccaacgaaaggagcagatgatccaaaaactaagttgcattatgataacttgcttgatgctcagattgatgcagcctatgctgcattagaagatgccggatatggaaagatggaagtcattgtcacagagaccgggtgggcttcacatggtgatgagaatgaagctgcggcaaccgcaaacaatgcaaggacttataattacaatttgcggaaaaggcttgcaaagatgaaaggaactccactcaggcaaaaagtgtgcttaaggtttatgtttttgcaatctttaatgaaaatttgaagcctgggccaacgtctgagaggaattttggattggttaaacctgatggaagcatcttata

SEQ ID NO: 21292 - DNA, 442 bp, Gossypium hirsutum
  Clone ID: uC-gsflnu33B100f02b1
ttgttgttgcgctagggactattattttagctgaaaaaatccaccttggaagcatactgggagccattatcatagtctcaggcctttacactgtggtttggggcaaaagcaaagatgtgaaaactccagaacttgaagagaaaagcaacggcctgcaggaattgccaatcacagacaatggtagatcaatgaatgttgttgatggagctgcgaaagctgttaacattccggattcaaagaacactttcagcacacgaggaacataaaacaatatagatatttccttcaaaatgctgatatatttcaagcagagtttgttctttccaaggcgataaaaactactatgtaacccacccctaccagaaactattttctacctttaataatcatcttttgattgaacttttgaggcttatttggtgagtaaaaaccatgaatcatc

SEQ ID NO: 21293 - DNA, 475 bp, Gossypium hirsutum
  unsure (1)..(475): unsure at all n locations
  Clone ID: uC-gsflnu33B100f09b1
gtttgtctcagatttttgaagatggcccgtaccaagcagacagcccgtaagtcgactggtgggaaggctccaaggaagcaacttgctaccaaggctgcccgtaaatctgccccaaccaccggtggtgtgaagaagcctcatcgctaccgtcctggaactgttgctcttcgtgaaattcgaaagtaccaaaagagtactgagcttcttatcaggaaattgcctttccagaggcttgttcgtgaaattgcccaggacttcaagactgatttgcgtttccagagccatgctgttctagctctccaggaagctgcagaggcataccttgtgggtctttttgaagacaccaacctttgtgcgatccacgccaagcgtgtcacaattatgcccaaggacatccagttggctcgtaggatcagaggagagcgtgcttaattncatgtgtgtggatcagtcgttagaaagaagaaactattgt

SEQ ID NO: 21294 - DNA, 130 bp, Gossypium hirsutum
  Clone ID: uC-gsflnu33B100f11b1
ttgttattgttgaaagaagttggtttttaatttttaagacaatttatgtgttggcttttgggttgtttcacagatttggattacaatggcatgaaagctttttatctatataatttaaacaagttcctct

SEQ ID NO: 21295 - DNA, 426 bp, Gossypium hirsutum
  Clone ID: uC-gsflnu33B100f12b1
aagcctaagagcttgccagatgccgatgcctggatatagacgcttgattatatcaaggccaaatctacaaagcttgtgcttcaccctaggtcccaaaatttgaactcttctataggcctcaactagtttcgcgaatccaatcgtctgctaaaatcttcacagcatacctcaggacagagctcctcagctgccccaaaagaaggcgagggcctccgctgcaaaagccgagccaacattctcgtgtatagttgatctagaggaaaccaaccttcctcttccatttctggcaacaaaccctgaccctgattaaatagagccctgtcaaatgccgcgtcaaagttgatcttgacccactccctagaaggaggcttccatcttgtaacgtcgaccaccttatccacagagcccaaagggtacaagaaaata

SEQ ID NO: 21296 - DNA, 268 bp, Gossypium hirsutum
  Clone ID: uC-gsflnu33B100g03b1
atcgttctgtgttaaatcttcgtaaaaaaaaaagggggagatatatgctaaatataagcctaaaaagccacgaccgtggacgggggtccggtttggcggttccgtgctctgcggcgcgctgcttgtggtttgccggtgcttctttcgagtttcctggcctcgacttcttggcctttgtgttgcctcgccgtgtctggggccttgcctggctgcgccttgcttactcggcttttggccggttggcctttcgaccggtggggttctggcg

SEQ ID NO: 21297 - DNA, 379 bp, Gossypium hirsutum
  Clone ID: uC-gsflnu33B100g06b1
ctttgagtccgagattatagattcatcactatgggacaaggagctagaaaagcagctgttggacatgctcgaaatcgcctgcagatgtttagaccaggatccaaggcgaagacccttaatcgatgaagttgtttcatggctgaatagtatcggaaacgaggttgtttgtcaatgaacatccatcgatttgaaaaatcttagctgggagggtatacctgtaaagcagacaccgtcaaagtttcgataagttccgaaggattactgaccgaatcacttagaacaaagcattgcccatggtgtactaacgtttgagagtttgtatgcttaggctctttaagccattttcttctgtctgaaataagcaaattatagaatatct

SEQ ID NO: 21298 - DNA, 332 bp, Gossypium hirsutum
  Clone ID: uC-gsflnu33B100g12b1
ctatatgtgatagctggtgcgcctgctggcaccgccgcggcagtaactggcgggaccgcacgacgccttttgtgaaatataccatctacccttgagtatgggggagatcaacaggaaaaggtttttgttgtctttctgaacaacaaatgtggaggggactactgagggagtggattcatactgcctgcaacaacaagatgaaccgtgtccaagtatgctatacccagaaaccccttttcttttacgataacctggccaagaggtatatgcagcaatacaacgaggtggaacgctctgctcttggaatggttattgctactgatgttaccatt

SEQ ID NO: 21299 - DNA, 478 bp, Gossypium hirsutum
  unsure (1)..(478): unsure at all n locations
  Clone ID: uC-gsflnu33B100h02b1
tcgttcacgcgtccgtaactctattttcatgttatcttgtttaggccagagcattatgcgacaaggcataaaatatgcatctcaaagactagatacatttgcatgtgttaggtatagaaaaaggtgtttccattttggtgttaagattttatgcagtgtagttgcttactgccttacactatgttgtccttttaggcaaaatggttgaacaagcaattgaccaaattatggccttttattgtagaggtgcatactttggctttatgttccggtgttttggattctctggcggttgaattgaaagcatcaaaggacttctctaagttatatgcaggcattgcaatactttggcttcacataagcttgaaccagccctccgntggatattggttcttcttttttttttttttatctttaccctttgattaatgagaaggggggatgaattggcattctttttttactaggatgaattttg

SEQ ID NO: 21300 - DNA, 337 bp, Gossypium hirsutum
  Clone ID: uC-gsflnu33B100h11b1
aagatcttattggagaacgtgattagagatgcagtaacctacacccaacatgcgaggaggaagactgtgactgctatggatgaggtttatgcactgaagaggcagggcaggacattgaatgggtgtggggggtagaagatctagggattagataaatctgtgatgttgccgagatctggactacttgctcaagatatcaataatgtcagaggattaagaatagggctggccattaaagggtgctattgcgattattggaaattataaaatggtcaaggggacttgttctgtgatggggaattaaggccatgaattgcagatgttaacgaaagtggga

SEQ ID NO: 21301 - DNA, 528 bp, Gossypium hirsutum
  Clone ID: uC-gsflnu33B101a01b1
ttctattgaggcattttataacgcaaatctgggaatcaccaaaaagccagtgccagatttcagcttctatgaccgttcgtctccaatctacacacagcctcggtatttgccaccatccaaaatgcttgatgctgatgttacagatagtgttatcggtgagggttgcgttattaagaactgtaaaattcaccattctgtggttggtcttcgatcttgcatctccgagggtgcaatcatagaagataccttactgatgggagcagattattatgagactgatgcagacaggaggtttttgtctgcaaagggcagtgttccaattggtatggaaagaattcacatatcaagagagccattattgacaagaatgctcgaattggagacaatgtgaagatcataaacagtgaaaacgtgcaagaagcggcaagggaaaccgatggatatttcatacagagtgggattgtgacagtagtcaaggatgccttgattcctagtggaactgtaatctgagaagattgcatcatgatc

SEQ ID NO: 21302 - DNA, 60 bp, Gossypium hirsutum
  unsure (1)..(60): unsure at all n locations
  Clone ID: uC-gsflnu33B101a06b1
ccttcgttttcgaaaaaaaaaaaannnaaaacaaaaaaaaaaaaaaaaaaaacaaattac

SEQ ID NO: 21303 - DNA, 392 bp, Gossypium hirsutum
  Clone ID: uC-gsflnu33B101a08b1
ccctcgcgtccgcccacgcgtacgtggacgcgaggactgatacgtagaactttcacgttcttcggaccaaaacaacacttagcgctctagccaaatctacaacttatggaactagtgcccctggaattgtcgcatgtgacatcatcctcatttcatttaatttattatactatgggaactaccctatatcaactagaaggaccattgacacataaacttgtgaaccttattactctatcatgttgaactgtatatcgtttgaaggaccagagctaggtaaactcttatcaaatattgtgccgcactagagtgcggaaattgccacagatcctacgacctctccttgatactgcaacatccataatgatatctcccacttgagtgtatacgcg

SEQ ID NO: 21304 - DNA, 479 bp, Gossypium hirsutum
  Clone ID: uC-gsflnu33B101a09b1
cctaatcgaagctagggttttgcagggagctttaaaacgacaatgacgaccgtcgttcccacctccgaagaagatcccgtcctccccgtcgtccgattcacggccgacctctcttgggctgatgccggtcctgaggttgcggaaccgctagtgacgaggctttgtatggaagcgcaagagtgtatggtgatgggaagatggtggatttggcttctttaatgcttacttctgctgagttggtctttcccaaggtctctgataaagatctcgagtgtatcttcactgttatctgcaatctagcctcaaagctcgaaaatccagatgatgaacttgagatggcaaagctcatatctacaaaaatcagtcaacaaccaaatgataagcctgcaatgcgtttaaagatcttgttcaatctctacaatttgttggaaggcccagatagccggatctttgtgtacatgcaagccttagatttagca

SEQ ID NO: 21305 - DNA, 283 bp, Gossypium hirsutum
  unsure (1)..(283): unsure at all n locations
  Clone ID: uC-gsflnu33B101a11b1
tttattccaaacaccatataaataagctcaggaaggggcaacttaagagcattctccaactcaggccaaacgaaaagggggggcccagaacgggggggccaacaacgaccagaccaggaaatcacccaaccgggctagaagacacgccaaacaggcccgggaagaggccagaggggggcaaaacgctggtgaagagcagacaaacaatgacacccctgggggaacgcaacgaggtggcgaaaaacacacaagggccgcatcaaaaatccaanacaacacaacc

SEQ ID NO: 21306 - DNA, 496 bp, Gossypium hirsutum
  Clone ID: uC-gsflnu33B101b07b1
cttaacttgctcatgccttttggtcctctagcaatcctggttcataaaatgactgatagtaatgggtgggtcttctttctaagcttactcggtataacacctttggctgagcgtttgggttatgctaccgagcagttggcttttttcactggacctacagttggtggtcttctaaatgctacatttgggaatgcaactgaactgattatttcaatttatgcactgaaaagtggaatgaaacgagttgttcagttgtcattgttgggctcgattttgtcaaacatgctgcttgttcttggatgtgcgttcttttgtggtgggcttgtatatcatggaaaggagcaggtctttagcaaggcgacagctgttgtcaattccggactccgctgatggcagtcatgggcctactctttccagcagtcctccattacacacacacttgacggcatgttgggaaatcagagttggctctttcagatttagtagttggggtatg

SEQ ID NO: 21307 - DNA, 341 bp, Gossypium hirsutum
  Clone ID: uC-gsflnu33B101b11b1
tattgttgagtaccgaacatataatgatattcgaattctacctttggtattggggagggactcgattcatcgttttcgtatattctgggatacctcaccgggatggattgtcggagcaccgccgggaacctaaccggtggtggggggcactgacgcccgggcatgcgatgggcgtgggcattgccctggataacccctgctcgctcaatgtctcctcccccctaaagagctaaaaaaacttggtccatgcgctaccaggagacgtacatgtgtctgaaatagggacacttttttttttagtttccatatgtccgaaacagggacactttttttagcccaat

SEQ ID NO: 21308 - DNA, 322 bp, Gossypium hirsutum
  Clone ID: uC-gsflnu33B101c01b1
tctacttttgcgtggacgcgtgggcggacgcggggggatttaaagaagattttctgtaatatttttgaaaattgaggttcgagctatgaaatgaatactgagaataacagataaagggctggatctgaaaatataactcatactgtaaatggtgaggaagattaagactggtaagatagtggtgatcattggcatgatgggtaaggatggatcttatttgagcattatggatattaaaaaaggctatgaagttgatggcatgatgcgtcttttaaaaagttgaatatgcatagtataaaccacatagttaaagattcacata

SEQ ID NO: 21309 - DNA, 546 bp, Gossypium hirsutum
  unsure (1)..(546): unsure at all n locations
  Clone ID: uC-gsflnu33B101c06b1
tcctgccatttgatgagcaaaagaagagcatttacttgggggagacatattcggtcctagtatacggcgaccaccatcacagatgcaattattggataacatccaatattgttggtcgatcagcacccaatactcctcctggtctcggcgttttcgtttactatccaaatcatccaaggagatctcctcccacaactcctccacctcctcctctatggaataacactgaccctcgattagctcagagtcacgccattaaagctcgccaaggttacattcacactccaccttcacgttcagacagggtcattgtgttcctcaacacacaaaacacgatcaatgggaatgttcggtggtcggtcaacaatgtctctttcgcacttcctcatacaccttacttgatcgcactcaaggaaaatctaacccatgtgttcgatcaaaccccacctcccgatgggtacgatttccagaattatgatatccgtatagtacaagagaacagaaatgctacctcgagcaatggngtttacaggttgaacttcaact

SEQ ID NO: 21310 - DNA, 382 bp, Gossypium hirsutum
  Clone ID: uC-gsflnu33B101c09b1
cccacgcgtccgaggggagaaagagaaagatgctgatgatacgttatcaggggggaactagaatgaaaaatttgcataaatgcattgctgttctgcttgaggatgtgctgtaagtatagagatcgtagttgatgctcaaagaaaatgctgggttttgatggaagatcacaggtacaggaaggaaactgatgcgaactcatctctcaaaaggtattggcctagtgggactgtcatatgtaagaacaatgggattgtagatgatgcatgaataggcaaagggtcacatgaagcatctatggagaatagctggttgaggagggaattctgagggcactgatggcgtataacgagctgaacggagcttgatcgaggctatacacaa

SEQ ID NO: 21311 - DNA, 385 bp, Gossypium hirsutum
  Clone ID: uC-gsflnu33B101c10b1
acttgtaacacccttatggccaatggaatggggcaccgttccgctagagaaccatacacatatccggattaccctccgtgacggaatcaagacctctctatgccgcggtgagcacgttaccgaaccctgcacggatcaacttacatatttgctggcagggatcaaggagacactcaggctccgtatgggcatgcctgtactagtgccacacatgaacctacatgatgcagagctaggagtgtatgacatccctgcagagagtaagatgcttgagcatgcatggtgcatagccaccagcccatgtgactggacgaacccagacctgtaccgggcctaaagggaacacgcggaggcatcgcaggcacaagctaatgggattgactct

SEQ ID NO: 21312 - DNA, 505 bp, Gossypium hirsutum
  unsure (1)..(505): unsure at all n locations
  Clone ID: uC-gsflnu33B101d07b1
agctgtcccaaagctgagaaaattatctcagattatgttaaagaacacatccctaatgctccgtcactggctgcctctttcattcgcatgcacttccatgattgcttcgtcaggggctgtgatggatcagtgcttttaaacttcaccaatggccaatcaccagaaaagaatgctgtcccgaatcaaactctaagaggctttgatttcattgacagattgaaaagcatggttgaagctgaatgcccaggcattgtctcttgtgctgatatccttactttaattgcaagggactcaatcgtcaccgttggaggtccattttggcaagttccaacaggtcgaagggatggagctgatctcaaatgttactgaagctaacaacaatattccaagcccattcagcaattttacaactctccttacacttttcaacaaccaaggactcgatacaaatgacttggtcctcctatccggngctcacanccatcgcatagctcactgcccggca

SEQ ID NO: 21313 - DNA, 385 bp, Gossypium hirsutum
  Clone ID: uC-gsflnu33B101d09b1
ttttctacgcgtgcgcacgtccatcttctttacgaagtgatcgaggcgactcttgctatagatcaagtgctgagacgttctggtgactttgcgaatcatatgactattgcctaatgtactggtgctgtgagtatgaaaatgctgattgttgtaccgaaactgaatactgatggcctagaggatgcccccagttgggatggccaaggatgactctgcctgaagaacgcttgagactatctgggagtagcagctaggaatgcaacggagggtaaacacatagtaccatggactagaactgaggtgacagatataacatataactctgtgcagggagaaagaacccgtttgctgctatgcgttgaaaagagtgagaaatgacatgtca

SEQ ID NO: 21314 - DNA, 301 bp, Gossypium hirsutum
  Clone ID: uC-gsflnu33B101d10b1
tcactataggtgaaggctggctcgcccgcagggacgcgtcccggaccgcccgtgccgacccacgcgaccggtttgtctcacctctcctattactatattaatagggggggtttaggaaaagtgagcaaaaatcccacagaacttaccttatcatgacagaaaccgatagaagagcccaacgatctgcaccacgtccatggttatagcaaagagtggattctcgaacggcctaatacccctacgaagattgtccaaaggaagcttggtccccaggggattcaccacattcattaggcggggg

SEQ ID NO: 21315 - DNA, 222 bp, Gossypium hirsutum
  Clone ID: uC-gsflnu33B101d12b1
gacggcatagctattcttttgtgatagctaaacctaattcaatggccgtggccgtacaacgacaagactgggaaaggcatgacgttacccaactcaatctgattggagtagatccacatttcgctagctggagttatagcaaaaaggaccaggccgatcgccattgccatcagttgcacatgctgaatggtaatggggacgggcactgcagctgtgcattaa

SEQ ID NO: 21316 - DNA, 529 bp, Gossypium hirsutum
  Clone ID: uC-gsflnu33B101e02b1
aataatcttgttacccctgatcagcccaaagacaatgcagtagttaacagtggctttgaatttggcccttggatgttccaaaatgtatctcttggtgtcttgcttccgaccaaccttgacgaagagacatccccattaccaggatggatggtcgaatcaaccagggcggttcgatacattgattccaaccattatgctgtcccagaaggcaaacgtgccgtggagttggtttccggcaaggaaggcatcatttctcaaatggtggaaaccaaaccagataagctatatagcttgaccttctctttggggcacgctggggacaaatgcaaggaaccactggctgcaatggcgtttgcaggggaccaggcacaaaattttcactacacgcctgactctaactccaccttccaagttgctagtgtgaacttcacagccaaggcggagaggacacgtatcgcgttctacagtgtgtattacaatacaagaaccgatgacatgagctcactatgtggtccggtggtggacgatg

SEQ ID NO: 21317 - DNA, 522 bp, Gossypium hirsutum
  Clone ID: uC-gsflnu33B101e03b1
gttcaataagctgatataccaagacaaaccaagactgaaaacagcattggaagtgctcagaaccagcatgagcattgaaaatggtttgaatgaggtgagactccccttctttgtgttgcatggggaagcagatacagtgacagacccagaagtaagcaaggcactgtacgagaaagcgagaagcactgacaaaaccataaaattatatccggggatgtggcacggcttgacagccggagagcccgatgagaacgtggaaatggtgttcgcggatatcataggttggcttgacaagcgctgcaatgctgtaactttagaccaaagtctggatcctttcgatcaaggtttggaagaatgcagtgataatatagtgatttcgatggcaaaagccactggcggaacacacgcaaacgggagatatttgtgtggtttggagggaccatgcgcacgggctcactcggcaatgtaggctgatcgtatcaagctaactaaacgttgtctttgaaagggggattaaaggat

SEQ ID NO: 21318 - DNA, 392 bp, Gossypium hirsutum
  Clone ID: uC-gsflnu33B101e06b1
ctttctcgtgggtagctgcactcaatcgagaatccatcattgatgcaatcggtatggtatctgtccctggcaatcccatcaagggaaccacccagcaggtcgagattcatgttagaaaattgaattgcgtgaataaagctatgcctaccttacccattaacgttgaggatgctgctcgaagtgatgctgaaattgcagctgctttgcaagctggagataagcttcctcgtgtcaatcaagatacacgcttgaactttagggttcttgatattaggaccccagctaatcaaggaattttccgcatgcagtgccaagttggaactatatttaggcaattcttgctgactgagggtttttgttgaaatccacacccctgagctgatagctggctc

SEQ ID NO: 21319 - DNA, 516 bp, Gossypium hirsutum
  Clone ID: uC-gsflnu33B101e10b1
ctttatttctttcgatgaaaatttgatttgctgcaagaacgagagagagatggtaagctcgaggcaggggtttccttcatggataagtgctgcctccgccaccagagttgattttgaaggaaacgctgataacatgttgaaaactgcccacgacgattctacaacccaaaagcctaaagctgtagccgacgtcaatttgagcttcgaagagagggctttctctgccgcaggtgccgcttttatttccgccatcatcgttaatcctctcgatgtcgccaagacaaggttgcaagcacaggctgctggagttccttacaagacctgctttgaaacaaatacgatgttcccagatatgagaagctctcaatcatgttcgcgtgtggttggtggctctgaaccactatgtcccctgagtgtcataggtacactggaacacttgatgttttctacaaagtcattcgtcagtaaagttttgccagactgtggagaggaacaaatgcaagtttagcattggct

SEQ ID NO: 21320 - DNA, 512 bp, Gossypium hirsutum
  Clone ID: uC-gsflnu33B101f02b1
aatacctttaagctgccgccagttttgctttcagcagcttgcatttgaaaagatggtgagggtcagtgttttaaacgatgcactcaagagcatgtacaatgcggagaagaggggcaaacgacaggtcatgattaggccttcctcgaaagtgatcatcaagttccttttggttatgcagaagcacggttacatcggagaatttgagtatgttgatgaccacaggtctggcaaaattgtggttgaacttaacgggaggctaaacaagtgtggggtgattagtcctcgttttgatgtcggagtcaaagagattgagggttggactgctaggctacttccttctagacaatttggatatattgtgctaaccacatctgctggcatcatggaccatgaagaagctagaaggaagaatgttggtgggaaagtacttggctttttctactgagtcaaatttttgatattttcctttgatcttttttaatttcactccatgtagaacttgatactttact

SEQ ID NO: 21321 - DNA, 513 bp, Gossypium hirsutum
  Clone ID: uC-gsflnu33B101f04b1
cccactcgtccgcccacgcgtccgctctcctcctcctacttcatcaccaccaccagtttccactcctcctccagcgactcccccgcccgttagctccccaccaccagcttctcctcccccggctactccacctcccgcaactcccccaccggcttctccacctccggctaccccaccacctgcttctccccctcctgctactcctcctccagctaccccaccaccagctcctttggcttctcctcctgccacggttccagctccggcccctagcaagaccaaagctaagtctccagcactatcaccttcggcctccagcccaccgtctccatcaaatgaggcccctactcccagcctcggcgcttcttcaccaggccctgctggaaccgatacgagtggagtagagaaaacatggcccataagaaagatggtgtggagcttggtgattggatggggtatcctcagtttaatgcttaaccaagagtcttttcttaccatttgggcttagctatg

SEQ ID NO: 21322 - DNA, 496 bp, Gossypium hirsutum
  Clone ID: uC-gsflnu33B101f08b1
tctgttaaaataatggcggatcgtttctttcccaacgtattgccggacttggtacccgaaacaacacaaaacgaacagcaagaaattggagatactctgatcaaacttctatccatgccttactcttctgtatctcaacatttcaaacgcaccgatttggacctcaaagaaaccgtaacgctggaaacgtgggggataactttgcaaaaagtctccgactttactctctattgtggcagtctcggtactgctttcttgctcttcaaatcctatcaacttaccaacaacaccaacgacctctccctatgcttagccattgatgatgcttgcaactccgcttacttatcttctggggatgcaacctttctatgtggtcgagcggatgtttgcgctcttggcgctgaggccgcaaagtattctggacagtaagagtcgcttaatcactacttaaccccgtgtagagagactaagctctcaagggatctccctgatgaat

SEQ ID NO: 21323 - DNA, 525 bp, Gossypium hirsutum
  Clone ID: uC-gsflnu33B101f09b1
tttacttaatcagcttgatggatttgatcagcttgggaaggctaaaatgatcatggctacaaaccgccctgatgttcttgaccctgcactgcttcgtcctggacggctggacagaaagatagagatcccattgccaaatgagcagtcaagaatggaaatcctcaagattcatgctgctggcatagccaagcatggtgaaattgactacgaggctgttgtcaaacttgctgagggctttaatggtgctgatctacgaaatgtttgcacggaagctggaatgtcagcaattcgcgcagaacgtgattatgtcatccacgaagatttcatgaaggcagtgagaaaattgaatgaagccaagaaattggaatccagtgcacactacagtgccgattatgggaaagaatagagcttatctgttcttcccgaagctatcgctaattttctcatgtcgagcactcagatcgtttatcaacatcgtagagaagtcactatgcatttaaactttacatagctttcataccaaag

SEQ ID NO: 21324 - DNA, 218 bp, Gossypium hirsutum
  Clone ID: uC-gsflnu33B101g04b1
aataggatgaatttgcagcattgtaaatttaggtttccgtccccacgaagaaactatgttgttgatttataattggaaatttcgttttttttgtaagtttaggtttccgtctccgtaaagaaactatgtcgttgatctataatcagagatttcgattttaaaagtggcaacgggaacttgcattcatgcaaaaaaaaaaaaaaaaaaataaaaaacaa

SEQ ID NO: 21325 - DNA, 381 bp, Gossypium hirsutum
  Clone ID: uC-gsflnu33B101g09b1
cccacgcgtccgctagatcgcgagcgccgcccttattttaaaaattatttttactgcttttaccaccacttagactagtgccagaacaagagcgcaccttacaggcaccagtggaactagatggacacacacatgcgcgcactttgactagagacttaacgcattgacctactgaaccataccttccaaaagtcatacaagcttggagcacagcgatggagacaggactcccacaagcccattcacgacagttaacacttatcatgatatatcagccaaaatccaagccacatgcaagatggacagacagaaacacaggcatgaaaataggatcgagaatcacctttacaataattttgtactagatgatgatgaaatcaa

SEQ ID NO: 21326 - DNA, 431 bp, Gossypium hirsutum
  Clone ID: uC-gsflnu33B101g10b1
tctttgcagggtatggaggtgccagggaatggtgcttgcagaggcgtggggtggcaaatggcatgggggtgaccagggtttttccttttttgctgtttttttattattgacccgagctagagttagtggcctgagctgatgtaatttgtgttcgggtatttgggttaagggccggtcataattaggcctgttcatggcttttatccatgttaccagagggaaaaaaatgactttttccagcttatttgagctttgcattggataatttaactcatcatatagggcccacttctccacatgatctatactccagcccgcactagtagctcctaatctacagaccaagttgccactctaatgctatgctggtcccaggttctggattggagcaaccgtatcattctcatgcaaagccatataaaaaagttgac

SEQ ID NO: 21327 - DNA, 367 bp, Gossypium hirsutum
  Clone ID: uC-gsflnu33B101h02b1
ggacatgctgttcagcttcttctatctcgtcttttttgggcatgatagatgcttgtttttcttactttcgccatgaaaataaactcgcttatgcgaacattttacgtgagaaagtgacagttcagttgtatagtgattttccttagttttcaattggctcgtggactgtaccccttgagaattgatacaaatagggttgttcattttgttagttctgttaaatttttaaccgatattattgagcttgtagtgcgcaaaggttcggtaataccggtcattttcagttcaaaatatagtcgatattccggacaaaaaaaacactacaaattacaaaaaacaaaaaccaaataattaaaaatatggacgg

SEQ ID NO: 21328 - DNA, 393 bp, Gossypium hirsutum
  Clone ID: uC-gsflnu33B101h10b1
ttgaacaccgatgtagagaaaagattggcggttgccaacaattcactgaagcatttcgagcttgaaaatggtaatcgctccaaatcttttgaagttaaagatgaaaacggaagcacatggacttttcgctgctatgttcgtaacgacggtgcctacaagaagcctgtcttatccagtggttggcgtcaatttgccctcaataaaggagctcaccagggagatttgatcacactctataaggatgttgaagcagacgcttcgataagatcgaagttcagagaaaaatcaagtgattaggcagggagtgctggtctagtgtggaaccagaccaacctacaggcgcaacagcacaagttcagagaaaaatcctgttatctggcaaggagtgctggt

SEQ ID NO: 21329 - DNA, 133 bp, Gossypium hirsutum
  Clone ID: uC-gsflnu33B107b03b1
tttagagctgatagatagtgtgatagatctccgacgactttccaaccagaacgagcttccaacaactacaaacacaaaaaaataacacgaagtaagcatgtcatgcttagtaagttcataaccaatatattct

SEQ ID NO: 21330 - DNA, 594 bp, Gossypium hirsutum
  Clone ID: uC-gsflnu33B107c09b1
tcttgctgctgacctcaaagagcatgttatcaagcctgtcatccctgaaaagtacctagatgagaaaacaatcttccaccttaacccatctggccgctttgtcattggtggtcctcacggtgatgcaggtctcactggtcgtaagatcattattgacacctatggtggctggggagcccatggtggtggtgctttctctggaaaggaccctaccaaggtggacaggagtggtgcttacattgttaggcaggctgccaagagcattgtggctaatgggcttgcccgaaggtgcatcgtgcaggtctcttatgctattggtgtgcctgagcccttgtctgtctttgtagacagctatggaactggaaagattcctgacaaagaaatcctccaaattgtgaaggagaacttcgacttcaggcccggtatgatcaccatcaacctggatctcaagaggggtggcaatggccggtttttgaagacagctgcctacggacactttggaagggacgacccggacttcacctgtgaagtgtgaagccctcaaggggagaagcctatctaaaatcagcttgggctgtctgagtgctctatcta

SEQ ID NO: 21331 - DNA, 501 bp, Gossypium hirsutum
  unsure (1)..(501): unsure at all n locations
  Clone ID: uC-gsflnu33B107e12b1
tttatctgtatgccaacgtcaggccttgttacagtctcccgggttataagactcggtatgatgatgtgaatcttattactattcgtgaaaacactgaaggggagtacagtggacttgagcatcaagtggtgagaggtgtagttgaaagtctcaagattattactcgtcaggcaagcttaagggtggctgaatatgcttttcattatgctaagacccatggaagagagagagtttctgcaattcataaggccaatattatgcagaaaacagatggtctttttcttaagtgctgtcgtgaagttgcagagaaatatcctgagataacttacgaggaagtagtcattgacaattgctgtatgatgcttgtgaagaatccggcactttttgatgtattggtgatgcctaacctctatggtgacattatcagtgatctttgcgctggattgattggnggcttgggcttaacacctagttgcaattattgtgagggaggaatagcac

SEQ ID NO: 21332 - DNA, 460 bp, Gossypium hirsutum
  Clone ID: uC-gsflnu33B108a09b1
tgtttctagtgcacaatccactgcaaagcagatattagatgatgatgagtcgtgcaggacaacattgactaatttcagtaactcagtgcaattcagttctccaacctttggccgggttaatattttcaatcaagtggaaagggagttacatggcggccttcctaagtcgtcgtttaaagggggaactccttcatccggttcttttcgatctggctgtagcaaggatgatgctgggacttgttctcaaactacttctctttatgggtctcaaatcagttcattggttgagctgggtcatactacaaggcacaatagcagtctctcgaccgcatattcaaagaggaatgatgaaacaagcaaaccgaatcgcaaaaggctaaaacctggagaaaaccctagaccgaggcctaaagatcggcagatgatacaagatcgagtgaaagagttgagagaaattgta

SEQ ID NO: 21333 - DNA, 305 bp, Gossypium hirsutum
  Clone ID: uC-gsflnu33B108b06b1
ttttcacgtaagcagactgagcatcattctgatggcctacataacacttgtagcgagcgaacccatggagatgagggaggaccaaggagtcggttggaccctaaaccaatggaaagataagaccaggatctggcagttctggtctgacttgatgatgccttagcttctatgattgcataaagctgatgactatgatatcaattactttacagaatactgcatgacagttaacatttcctacaattagccaactagaacctttgtatggaactttcaacgagacttgcaagaaattgaataaaata

SEQ ID NO: 21334 - DNA, 515 bp, Gossypium hirsutum
  unsure (1)..(515): unsure at all n locations
  Clone ID: uC-gsflnu33B108c03b1
ttttacgcgtccggaaaatcagttgtctcttttaacaaaatcaaaataatgggtcaaattcaatactctgagaaatacttcgatgatacttacgaatacaggcatgttgttcttcctcctgaagtggcaaaacttctccccaagagtcgcctcctctctgaaaatgagtggcgtgcgatcggagtacagcagagtcgtggttgggtccattatgctattcatcgtcctgaaccacacatcatgttattcaggaggcctcttaactatcagcagcagcaggagaatcaggctcagcaagctatgcttgccaagtaattaaaatagcttttggtattttgaaagaaaaaagggaggaaaacccgnatatggttatatctgcataaacagtttggatgtaatggaattctggattggtttctattatatagntctctattgtggagaattaccatgtntaggctggntgctgntactgtcttttctgatgacctatatacgtcattggtactctctgc

SEQ ID NO: 21335 - DNA, 290 bp, Gossypium hirsutum
  Clone ID: uC-gsflnu33B108h02b1
tttatgcttccgaggcatcctggacataaggggagctgttatgtgctcataagcgactgacagacaacatgaaatggttctttagctcgctgacattatatccaaaagggccagaagagctggcacggctatgaggaagcaaccgaaagctattgaagaaatttgattctggtattactaaaatgaggtctgctatgcagagagccatggcctccttctctgagtacccaccaatgagatggttatcaatgcagatcaaccgacagcgcaagggtgaacttgatcgaaac

SEQ ID NO: 21336 - DNA, 381 bp, Gossypium hirsutum
  Clone ID: uC-gsflnu33B108h11b1
taattctcctaggtgcttgttcgggtcagctagtcttggagagattgcgattttagctggtggttgtgattctcagggtaacatcctgagcactgcagaaatgtacaattccgagactcagaagtgggagactctcccaagcatgaataccccaaggaagatgtgcagtggggtatttatggataagaaattctatgtaattgggggaactggtggagtgggaaatgatgcaagggttctcacttgtggggaggagtatgatttagagttaaaaaaatggactaaaattcctaacatgtctgtggaagctggtgaggctgagaaacctgtggcacctggggcacccctactggttgcagtagtaaacaatgaactgtatgc

SEQ ID NO: 21337 - DNA, 255 bp, Gossypium hirsutum
  Clone ID: uC-gsflnu33B109b05b1
tctttttcgcgtccggattgctcttaacaattgtggagttttacagcagtttgtgttggttgtataaattttgagactctctttttcttctttttactatcaaattgcagctaatagtatgtgattgagtggtctatatgtctattcccaaaacatgaaatataaaattggggtttttttttccgaaaaataaatttatttcggtttttaaaaaaaatatcacttaaataattattaccaaaaaaaaattcatat

SEQ ID NO: 21338 - DNA, 388 bp, Gossypium hirsutum
  Clone ID: uC-gsflnu33B109c02b1
ttatttttgtaatgtcaagttaatttcctagcggttttatgggttacctatatcatcctgtaaaaatgatatttgctgggaaaaatatattccattcctttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaggggggggcctttttaaaggtccaaagtttacgaccccgggcatgaaacgtaaaagtttttttaaggggcacccaaaataaaattcagggcccgcggttaaaaaacgggggaacgggaaaaaccctgggtaacccaaattaaaaccctttgaaccaaattccctttttccc

SEQ ID NO: 21339 - DNA, 426 bp, Gossypium hirsutum
  Clone ID: uC-gsflnu33B109e05b1
ttttacgcgtccgaccacgaattcggtaagatgagagatgactatgtcaaggggtccacaaaaaagtgtgtagggggcttgtatggactaggggtgcggaagggacggattactaatgagaagagaataattggaaaaaactgcagatggatgtagactatttagagcgtgagcctgaataatgtttgtatacgtagctaaaaaaaaaaggtattgctgatgttagctgtgactattctccttttgcttgcattggaactgaaaccttaactggtttttccggttgaagtccagtgtaaattatgcagttagtgattatatcttttgaataatagtcataatcatttgcatcttaataaaaaaaaataactctttgtatgccctgatatgttgatttataattgtaataaacattatggcgggcgg

SEQ ID NO: 21340 - DNA, 508 bp, Gossypium hirsutum
  Clone ID: uC-gsflnu33B110a11b1
cctgactcacgcgtccgtgtttgtctattgaagtgtttccttcactttctcgagaaaaaaaaaatgtcttcaggttgcaattgcggatctagctgcagctgcggatctggctgcaattgcggtgagaactgctcaatgaaccttaaccttggatactcggagaagacaaccagcactcagaccatcatctccggagttgcgccagtgaagatgacctttgagggaccagagatgggcactactgaatcaggacatggatgcagctgtggatcaagctgcaaatgtaatccatgcacctgttgaaaagcttgatgaaagccatagattatgaaaaaagaaagcagcaaaataacaggcctctgtaatgatttattttcaaggatggatgcctgcaaggtctataattatgtctctctttgtcttgtgtaatagaagctttgtttgtggtgaaaataatgtatatgccatttggttgggagctaatttttcttctgtcaaaggaattttg

SEQ ID NO: 21341 - DNA, 289 bp, Gossypium hirsutum
  Clone ID: uC-gsflnu33B111c04b1
tttgtcttaggcgatcctcagggccaaggcctggtgtccacagaagcttgagtgacacaggttgggttggctccaccaacatttaaggatctcagttagatctgtgagccttagaggggatgaatttatttaggctatatattttatggtataggtgatgttttttactacccattttgaacctctttcacatatcagaaatgcaatggaactatccgattggtgagagatcaaatcaatattgctgtagggactgctaccaacatgttcagagttaactcgttatgtg

SEQ ID NO: 21342 - DNA, 356 bp, Gossypium hirsutum
  Clone ID: uC-gsflnu33B111e07b1
tttggtgatttgatcaaagaagccaatccaattcctcactcgaacggccttctttcagaagatggttcaggatacccaaaacagtgaagaactttttgtcaaacggttgctgacattttctatgaatccccttggggatgtgtttgtggtcttgtaaaatataatgaatgcttggtggttttttactggctttagaattttattatagattttacggtaccatgggaccatcttcaaggggatataaagtgaataatccaaggcggggttgggggggggggctgcaggctagaggtgatcggatttataagtgttcatgctcccttctttacccggtattggttacgcttattttc

SEQ ID NO: 21343 - DNA, 379 bp, Gossypium hirsutum
  Clone ID: uC-gsflnu33B111f04b1
tacattgtcgcatttcgacaccaaagttcgtgcccttgcaagaaaatatctatagactctccatagttgaagatttcatatgtctgtttcatgttctctcatgtatgctgaagagttaacccttttttatgatatcggcttgagtgttctttacattattagcggctctgtcggaatttcatgggtccagttgcctgtaggaacgacagagacaaagaacatctgagattatgttttctttattggatgtttttaaatagaatttgggaaggaagagttttattgtttagatctgatttataaataagggatgtctaatgtggttatcatatcccaaggtaaaatccggctaaaagaccgatgctgaacaagtacccat

SEQ ID NO: 21344 - DNA, 451 bp, Gossypium hirsutum
  unsure (1)..(451): unsure at all n locations
  Clone ID: uC-gsflnu33B111h07b1
ttgttccatctcactgggataagatctcccaaggaggcttgaaacgtatcgaggagaagtatacatggaagatttactcggagagactattgaccctgaccggagtgtatggattctggaagcatgtttccaaccttgaacgccgtgagagtcgtcgttaccttgagatgttttatgctcttaagtaccgcaagctggctgaatcagttccattggcagaggagtaaatttaagctgttaaataacattgggccggtttttcttggagaataatattctgttttgtaatttcaattggagaagctcttttgtatttcatcttgtcttttccttttccttttttcgccggcattgtttgaacatggggttgtgcgcccgtcaattccagttaaatatggtgacttttgtttttcacattaaaaanattttttataaatattatatatttaag

SEQ ID NO: 21345 - DNA, 371 bp, Gossypium hirsutum
  Clone ID: uC-gsflnu33B112e01b1
gtgaattcctatcctcctatcccaatttacgcccaaggaatactctgaatgatgacttggtcagtttctgtcattgaacaacggaaacgattcaggacagccgacgccaagggcgaggattaaagcgacacttaaccgagctggggacaggtactaagggggcgctctatctgcatggctctccaggagcttggtatgcattggaggcaccagatgaaagctgcggctaaagcccgattgccagccatcgcgttacattccagcggctgcagactctactaccgcccaccggagcccggaaccgcagacaaaaaggaccttgtacacgaagtacgcgcccttctagagttgtagggaatcaataagggcat

SEQ ID NO: 21346 - DNA, 338 bp, Gossypium hirsutum
  Clone ID: uC-gsflnu33B113a07b1
tctagatcaggaaggtcttattataccaacaactgtttcaaggcacatggatcagtccacccttactctagaggatgctccaggattacccgctgcaggagatgagtttttcttttttctttttctttttagtggatgctttgggtttgtaatattttaatgtgtattttgtgagaactatggaggaattgagtgttgaggtttcgggttttgccatttttgtgagtttttgtttcttggtttaatgtgtggattagcaatgtaattatgaacctatgatgtgtgatttggttaagatacttttaaggttatggttatggtaaaaaaaaacaaacttt

SEQ ID NO: 21347 - DNA, 410 bp, Gossypium hirsutum
  Clone ID: uC-gsflnu33B113e04b1
tccacgcgtccgagttgacacacatactattaccggtatgctctgtgtgcaggtaaaaaaagcaaatcatggatgctaccacagctctagtcgcctctaggcaggtatctcctagagaagccgctatccacatgatgttgtctgctgcggatcattttgtcaccatgaactgggattgccatatggatcgttacgttgtcaagcgtgtcaatgacggtatttacatcaacaaccttggcacgacctgagagaagcttcaactagcatctcgcgttaacgacgctatcgagaaccgtcaagagatcagagttcaatctgcaagaccctatggacagagggcgtgtcttgtaatctgctcatgacacttgatggcatgccattgctggaaagcacactggctggtcattctg

SEQ ID NO: 21348 - DNA, 468 bp, Gossypium hirsutum
  Clone ID: uC-gsflnu33B113g03b1
gggaaattaagttgaattagaaagtttgaaacattgacacttatgcttgagaaaatgaggaaatgaatttaacttttagattgaaacaagaaagaatctttcgaagtgttaaaaaaaggccatacacattgcttcgcggtttgcactgaaaacttctttgatgaatataaccttcatgaattagattttagacataagtatgctttttcttttaccctatttgatctaagtaagcaatgggtttcaaagagggattgatttacatgctctaggtcaagaaagcagtcaatggctgaagatgatgtgtaagctgatccttggacaccaatttcgaggaatctaatgtttaccgtatgggtggtttcctgcatttccattagggatataatcatatgctagaacctgcaagcattgcactcagacaaacataatcttgacatctgccattgaaaatagtttcttagatgc

SEQ ID NO: 21349 - DNA, 502 bp, Gossypium hirsutum
  Clone ID: uC-gsflnu33B114a06b1
gcttcatctacatatctcgtaagtgatagaccctttattgattggttatcagagtctgatcctactgtctcagcattcgttccttctcagccttcaaaacctaagctgcatgtaagctccgacaacaacaacaattctcctgctttaaagtcttcttcatccgctcggtctcgcgaccaggtggtggttttgagggtggcaatccattgcaaaggatgtgaaggaaaattaagaaaacatatctccaaaatggaaggagtgaaatcatttagtatagatttaccgacaaagaatgtgacagtcattggtgacgtgactccctcaagcgtgttagcaagcgtgtcgagggtgaagagtgctcaactatggccatctgcagcaccatctcaatcttctccaatggtcaaaatgaattactgatggaaaaaaaaaaactccagggttttcttcttttttgaatgaagggtttcaccttgcttagatagtaatcaacatttgaact

SEQ ID NO: 21350 - DNA, 530 bp, Gossypium hirsutum
  Clone ID: uC-gsflnu33B114d06b1
cgcccggcgttcgttttgctagacccagtaaaccacatatttcacagccggctgtgatccaatcagtaacaccagcggtacataggagtgatgctaaccagagtttgagagccgaaactccggttccagttccagttgcggcaaagtctaatgagctagaaagtccgaaacaagtggatggtactgttgttcatgaagtcaagctgccatccaggagacttgtgattgttgttacaccaaccagcacaaaagatcagtttcaaggtgtgttcttgaggaggctagcgaatactattcggctggttcctcaaccattgttgtggatcgtcgtggaagggcaatcggattcgaacgagctatccgaaatacttatgaaaacaggcattatgtataggcatttggtgttcaaggagaatttcacagatcctgaagcagagctaaatcatcaacgaaatgttgcattgaagcacattgagcaacacaagctgagtgggatagttcatttcgcttgacttaccaatgttacgatc

SEQ ID NO: 21351 - DNA, 453 bp, Gossypium hirsutum
  Clone ID: uC-gsflnu33B114e12b1
cccacgcgtccgttcggctttgttttcatttagacaaattgtttttaggtgcatcttcttagctcaccaagtgttcgacgatattcctcaactagcaaaagtagaagctgatcatcttttttctcttgtttaaagcaaacccgtcgtcactctctttcaaattagagccttggactgtgtacaatattccatctatttactttcagcaagtgttggaacaatatttctccataagcgaaagtagagataatcttttctcttgtttaaagtagccgtcaatctctctcaagataaatgatgcctagatggaaaggaaaaggcttacaagccaaagctaatgctgatcccatgtctaaaattgtctcacaactccaatcctctttgatccaatttgagactcggggtttgctctcgagctgcagtgtacttgttgaagtggatgctgaattagct

SEQ ID NO: 21352 - DNA, 521 bp, Gossypium hirsutum
  unsure (1)..(521): unsure at all n locations
  Clone ID: uC-gsflnu33B114g06b1
acttggtttcagcattagcttttcagaatgtggagggattgaaattgaagagaactgggataaggtcaagaccatatctgtcccaaccgggtcgcttttgacatcagaaacttgtgctccacttgttgcaacccttcccttggagatcaaaggagaaatcgaggagttcatcaaagtgatctttaatctgtttcaagatctcgatttcacattcctcgaaatgaaccctttcacgctggtcgacggaaagccttatcctttagacatgagaggcgagctggatgacactgctgctttcaagaacttcaagaagtggggtaatgtcgaattcccattgccttttggaagaacaatgagtgcaaccgaaagctatattcacgggctagacgagaagaccagtgcatcgttgaaatttactgtgttgaaccctaaaggacgcatttggacaatggtagctggaggaggtgcaagtgtcatctacgctgacacggttggagatctggnttttgcttctgagctcg

SEQ ID NO: 21353 - DNA, 502 bp, Gossypium hirsutum
  Clone ID: uC-gsflnu33B114h12b1
gctcttccttgacatatgggcaaacgggtagtgcaccggctccggtggcaatgaccccaactccgacacctgcaccggctccggcaccagaatacgtaaacctaacctatttactctctgtggctggtccatttcacactttccttaactaccttgaatcaactaaagtgattgacaccttccaaagccaagccaacaacactgaacaaggcattacaattttcgtaccgaaagacgattcgttcaagggtcttaagaagccgtcattgtccaatctcagtgatgatcagcttaaatcgctcatccttttccatgccttgcccaaatactatgcccttgccgacttcaattacctcagtacaaaaggccctatcactacacttgctggtggccaatacactatgaatttcaccgatgactccggcaccgtgcacctcgattcaggatggagcaaaacataagtatccagcgctgtacattcgaccgatcccgacgcgatata

SEQ ID NO: 21354 - DNA, 442 bp, Gossypium hirsutum
  Clone ID: uC-gsflnu33B115a09b1
tgtggacgcgtgggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggctttttaggggaccaatttttttttccgggtgttgggaagttaaaattttttttttgtgggaccaaaattaaatttaaggggcggctttttaaaaccttttgatttgaaaaaacctggggttaccaaaattaaatgtgtttaaaaaaattccctttttccaaagttggtttaaaacaaaaagggccccaccattacccctttccaaaaattggcgccccttaattgttaaagggaccccccctttaatgggcaaataaaagggggggtttggg

SEQ ID NO: 21355 - DNA, 485 bp, Gossypium hirsutum
  Clone ID: uC-gsflnu33B115g09b1
tttcgttccacgcgtccgcccacgcgtccgcagaaaccaatgtggagctacctgttcttgaagcaagatcggttgaagatattgatttggcttttaagcaacttcatgaaggagtggatgttgaggaagtaattcttccaagtatgattgagaatctgccagatcatacagataccacttcagaatttcctgttgtcgaggcaagatctctggatgatatacataatgctttcataaaaggaccggaacctaatccagctgagctgccgcattcagcagacttgaggcatggatcatcagaagtagagctgcatgatgtggtttcttctaatgaggttgaagttgggcaagcagtctctggctttgaagaacatcttgagaatgttgctgctggtgaaccgaaaaaagaatatgaaaaaaaggaagaaaagaaagaggaaaagaaagaggagaagaaagaagagaagaaggacgagaaaaataaa

SEQ ID NO: 21356 - DNA, 323 bp, Gossypium hirsutum
  Clone ID: uC-gsflnu33B126a03b1
ttttcgtatttcatatatcaactcgttcgcgctgccgagggggggttttaatttcaatagtaaccggtggggaattatacgctcgtatgatgtaagtggatggtccgcggtggcctggaaactacattattccgaccccatttaaacgacgaagaagaagaaggttgtgattcaagaccctgccgatgaatctgttgacaagttggcagagaaaacggaggcatcatcattttctgaagggcttgactttagcaatctgaaaaaaaatactaaaaaatccagctgaggcccatacatttcactgaccgaaagtggggatgcag

SEQ ID NO: 21357 - DNA, 517 bp, Gossypium hirsutum
  Clone ID: uC-gsflnu33B126a12b1
tattttgtgaagaagttattggtgaaggatccccatgccagactgacagctgctcaggccctatcacacccgtgggttagagaaggaggaaatgcgtctgatatccctgtggatatttctgtccttaacaacctgcgacaatttgtgaagtatagtcgattgaagcaatttgctctgagggcattagctagcacacttaatgaagaagagatagctgatcttcgggatcagtttgatgcaattgatgtggataagaatggttctattagtcttgaagagatgagacaggccctcgctaaagatcttgcttggaaaagaaggaaccacgtgtccttgagattcttcaagcgattgatagcaacacagatgggcttgttgaattcaaggagtttgttgcagcagctctacatgtgaatcaaatgggagaacatgattctgataaatggcagatgctttcgcaagctgcttttgagaaattcgatgtaaatagagatgggtttataactccagaggaact

SEQ ID NO: 21358 - DNA, 521 bp, Gossypium hirsutum
  Clone ID: uC-gsflnu33B127b08b1
tttgaagatcaagcacaagaagaagaaggtcaagctcgctgtgctacagttctacaaggtggatgaatcgggtaaggttcagaggctgaggaaagagtgccctaatgctgagtgtggtgctggaactttcatggctaaccatttcgataggcactattgcggtaagtgtggactcacttatgtttaccagaaggctggtggagattaagtagggctcgtgcaaaagatggatcttttagggtttttccaatatgggttttaggttttaaattttcagtaatcgtcggattttgtttaatcgaatgatttttgttgtgtttgaatatgttataatacttgggctatatgatttggagttttgattatcaattcagctgtttgaatcaacttaagttaattcttctttatgttgtttgattgatgattatatttatatgccttgtattttttgctattttggtctctgggtattgggtatgcttaatgtttgtaaaatgattttactatttttgctgatcact

SEQ ID NO: 21359 - DNA, 332 bp, Gossypium hirsutum
  Clone ID: uC-gsflnu33B128b02b1
ttctacgcgtccgcccacgcgtccgcccacgcgtccgggaaaaaaaaataaaaataccatggcaattacatctcatctgccaaacctcatcaatgttcctctagaccgtcctgcctctttctcacaccttccttgcaacgaatttcttcgtattcaaagcaacagagcttcaacatcgaccagcttcagtttgggcatcaatgtctccaggaagcaatgtaaacccatgttggtgcgaagcatgggttcttcatttgggtcaaggcttgaggagagtgttaagaagacccgggctaggaacccaagtggtggatactctaagtcttggtgct

SEQ ID NO: 21360 - DNA, 83 bp, Gossypium hirsutum
  Clone ID: uC-gsflnu33B128b11b1
ggccatgaatatgagggtcatctctttctttggctcctgaaaaaccacaccgagcatcccacttgggtcggccgttctatagg

SEQ ID NO: 21361 - DNA, 493 bp, Gossypium hirsutum
  Clone ID: uC-gsflnu33B128h07b1
taaaaaacccagttcacttttcagttcttggtaccttggctgaccatttttgtgtaagtttattagtttctttccataaacaaagctcaaatctttctgctgttttggagggtttttaaagggggaaaagatggtctttttttttttttccttttttccaataatgaaagttattaactttacggggtttatttttttatgttatggatgatgaatatgtttagatctcattcaccatgttctagatcttggttgtttagcattttgattagacagttttgaatgttgttcaatttcatccctatttgggttcttttttgcttgcttttgtaaatgtttcatctttctagtccttttgagctttttttactttatggaatataagtggtgtataacttttttttctttttttaagaagcctatcttatttttttggccataaactattaacaagatgccatttaaaaaagaaaaaaaaaccatctttatcaat

SEQ ID NO: 21362 - DNA, 541 bp, Gossypium hirsutum
  Clone ID: uC-gsflnu33B129d04b1
tagttgaggggtagtcgtgagatggggttgaattcaagggtttttgagccctgaaagatcaaatcccccctccccttgtgtttcgtggtgatcaacagtttagggtttttgttctctttctgaacaacaaaaatggtggggactactgagggagtggattcatctgcctccaacaacaagaagaaccgtatccaagtctccaatacccagaaaccccttttcttctacgttaacctcgccaagaggtatatgcagcaatacaacgaggtggaactctctgctcttggaatggctattgctactgctgctaccattgctgagatattgaagaacaacgggctggctgtcgagaaaaaaatcatgacttctaccattgacatgagagaggaatcagggggacgaccagtacaaaaagcaaaaattgaaatactgctggggaagtcagagaagtttgatgagttgatggcagctgctgcagaggaagccttagatgatgagtaaagctattagttaaagaataagactgttcgtcagctttagc

SEQ ID NO: 21363 - DNA, 445 bp, Gossypium hirsutum
  Clone ID: uC-gsflnu33B129g04b1
ttcttgcgtgcggtaccatgcctccctgcagggcgaaagcaacagtgaagccctggtcccccggcagatacctggcgctttcggacgacctgtggctcaactacatggtgacgacatgacggtgacacgagcctgacagccgacgactgatcatgaaagcgcaacttgccactgggactttttgatgccgaccagcactccgacggcatgctccaccaccggacgctagatcgagctgggaatggccggcgagacctgtacagacttcgtggggtggagaacggccttgtgcttgtccggcaacttgagaaaggaattcgccgcacgcttgaagaccttgttctaggccgatagccccacccacttctccagctttcccgcgtcggcgccttccttcttggaaatcgaggaaggagtaatcaagccccacgcccttccaggcaga

SEQ ID NO: 21364 - DNA, 478 bp, Gossypium hirsutum
  Clone ID: uC-gsflnu33B130a07b1
tattcctataaataacacaagaaatcatggcaaaaacagaatatcaaagacaaaaaaaaaaaccattgcagagtactgagaaaggtatgatattaaaagggatattgtgataataaaagaatatacaacctggagttgtcgaagaactgagttttgaaactcaggcacgctggtgagaggaccccttgatgtatcgttcgctgaaggagaccggaatattgcaagtattctctgggttggataccctggggaagctggtggaaaggcacttgcggaggtcatctttggtgattttaatccaggtggaagacttccaatgacttggtatcctgaatcatttacaaagattgcaatgaatgatatgaacatgcgtgccaacccttttcgtggttatcctgggagaacttaccgtttttacaccggaaatagagtgtatggctttggccaaggcttaagctataccaaattcacctacaaa

SEQ ID NO: 21365 - DNA, 321 bp, Gossypium hirsutum
  Clone ID: uC-gsflnu33B130c01b1
cagtcaggcaaccatctatagaatgaacaacggattaagtgcataccatccaatcagctttgttgcaaaagggggaagtaggaattaccttatggtaccatcgcagagcgtcagatatgaatcttacagcgtatatttcaatatgcaaccataggtgtaatcaggttcaggagcagatgcggcaatgttgattataattataggcttttaacctggtactggtcttaccagacagagtatgctgttggctgggattgtatctgtattgatttacgaggcgattgtcttacaaataaattcaaacataaaaaattaaaaaca

SEQ ID NO: 21366 - DNA, 471 bp, Gossypium hirsutum
  Clone ID: uC-gsflnu33B131a01b1
taaaaaaattagagagtcttccttcgatggttgccggagtttggtccagtaacggctcagcgcagctagaagcgactactcagttccggaaattgctttcaattgagcgaagccccccgatcgacgaagtgatacaatctggcgtcgttcctcgctttgttgagtttcttatgagggaagattacccacagcttcagtttgaggctgcttgggcgcttacaaatattgcttctggaacctctgagcatactaaggtagttattgatcatggggccgttcctatatttgtaaagcttcttggttccccaagtgatgatgttcgcgagcaggctgtgtgggcactggggaatgttgctggcgattctcctagatgtcgtgatcttggtctcagtcatggagctttgatgccactcttagcacagttgaatgaacacttcaaagctgtcaatgctgagaaatgcaacctggaca

SEQ ID NO: 21367 - DNA, 165 bp, Gossypium hirsutum
  Clone ID: uC-gsflnu33B131d06b1
ttcctttcgtccgcgaaaacgaacgcacaggggggggcaactttgcgttcgggcgcatgcgacaactcacaaacggaaatggcaggggctaatggcaccacataaacatactcttaccactcccaaacttggaaatatcgggggggacaggacttactgtcaagc

SEQ ID NO: 21368 - DNA, 362 bp, Gossypium hirsutum
  unsure (1)..(362): unsure at all n locations
  Clone ID: uC-gsflnu33B131e03b1
ttcctctcgtccgcaaatctgcaatgactgaaaaatgaagacgatagactaattaggtcaacactttcctgctggattgctgcatagtttttctgtcggtttgtatgcactgctcggtgagtataccgatcttgtgttagaacacaaaatatgtttgcgcatccagttgtatcttaatgccttcaatgactaatatctatttttgttttctatcagatgtattatataaggataaatagtatatatcagacatgggaatgcatatatttggggcttatgttttaatctgttgaaaacccagaaataaaagaatgttgagctttccattggtgcncnttataaaattnctcatcatcataaat

SEQ ID NO: 21369 - DNA, 455 bp, Gossypium hirsutum
  Clone ID: uC-gsflnu33B131g06b1
tttcttatctcaaaagaaaatttcaggcaatttcagaacgccaaccctagatcttttcttcgcacttcaaaaggttcagtgtttgcttccaatttgtttactgtatctctgatttgattatatttccctcactggctactcatttttatgcttcatttaatttgtttgatgtttacgttttgcaaagtggagagtccaaagcttgtcatgcgacgtcattaatttgttttacattgcattcgagaaatggaagaggcggggcgaggggatttgaagtataggaataacattgctgactatagtcttcatcaaggattgtgatggaagctcgggcgatatgcttgtttttcttcccttttttctgcaattcatccataattttatgttcattccacctccctttgcttcaatcccttttggattattgctttttttgctatacttatagattctta

SEQ ID NO: 21370 - DNA, 141 bp, Gossypium hirsutum
  Clone ID: uC-gsflnu33B132b06b1
ctcacgcgtccgtcttaacgtacatttctacgggggtttttaaaataaaactaggatacacacacacacaatacacagtttatcaccactctggggggggaccaattcacggcgagagtcggggaacctccaccaaacatg

SEQ ID NO: 21371 - DNA, 122 bp, Gossypium hirsutum
  Clone ID: uC-gsflnu33B132f03b1
ttcttatcggatgacaggctaagggatgataaacttaaagggctatggggtcaatacggtgccatcacctattacaatgttatgccatttccaagcgggggaagtagaggaccatgtcctgt

SEQ ID NO: 21372 - DNA, 461 bp, Gossypium hirsutum
  Clone ID: uC-gsflnu33B133a12b1
tgctatctctagctttgtcaaaaactgaagaggatgcagaacatgaaatagaggaaaatggaggaattcaagaagctatttcatggtataatcgggttcttagttttcagattgaaggtggtcatggggtgaagtttactttcaatgatattaacataaaaaatccaaaggaagaatattcttttaccattcgtcatgcaaatgatgcctactccttattggattgcaacccaaacttgaatggcattaaagacttgattaatgagttgaacagaacaaatgacttatttggctttgctagaaccatcagagaaaagtttcaagaagcagcagcacttggattgcagccccagtccacaacttttcatcaggactgttccacaatctttttgtcgggtccagctttatctgtttcgagcaatagcagtcgtattttttgcccagaaaaatgagcatcacat

SEQ ID NO: 21373 - DNA, 127 bp, Gossypium hirsutum
  Clone ID: uC-gsflnu33B133c06b1
cccactcgtacggaaaagcacgccaacctaagatagcggggactttaacgagtaacctgctgttttaagaccaggaccggaggtaccaggaccagagaaccacgacaaggacgggatgccccaaaaa

SEQ ID NO: 21374 - DNA, 90 bp, Gossypium hirsutum
  Clone ID: uC-gsflnu33B133e09b1
actacgcgtacgagaaggcgcgccaaataatgggggcgattttaaaaacgaatggcgttataattacagacagagaccgcagatgtatcg

SEQ ID NO: 21375 - DNA, 270 bp, Gossypium hirsutum
  Clone ID: uC-gsflnu33B133f11b1
ttctcgcgtacgaaaatacttgctaaaaaatgggggctgtttttgacaaatatgatggtttaataacaaaaaaagacagcagttttcgggagatgacattacccgtgtctttctcgccgcccacaagatgagctggggcgacaacatttaacctctactgagtagtatgatcttgtgcggtcaaatgatcaattgtgggggagacaattctggtccatagtgcactagcgtggggtcacggaataggatatgttaccacttagctgcttt

SEQ ID NO: 21376 - DNA, 87 bp, Gossypium hirsutum
  Clone ID: uC-gsflnu33B133h05b1
cctactcgtacgcacacacgtgcgacaaaaagaagggggagattttaaagcataacgtgtatttaacaaagaacaaccgcatgagga

SEQ ID NO: 21377 - DNA, 378 bp, Gossypium hirsutum
  Clone ID: uC-gsflnu33B134c10b1
tccttcgcgtccgctcgcgaagaatgccgaagcaattgtatcactcaaccatgttcctgatatgctgcggcacaagcttagtcgatcggtgtccaattctaggaaaatggatgcccattttttacaacttcttgctagcggatcaccaacagagattcgagtcaatgactgctcccgagtcactgaagacgaattcaccaagatatttggctgctgtgatactagaaacttgattggaattgactgatgtatctctcaaatttgtggggaaaaattgttccaaattatgcgccattgacctatcttacttgcggaagttgacggatttatcaatgagatatcttgctatgggtgtcgatcaattaacaggcttaaact

SEQ ID NO: 21378 - DNA, 117 bp, Gossypium hirsutum
  Clone ID: uC-gsflnu33B134d07b1
ttctatgcgtccgtgcacgcatgcgttattatgggcggaattgaaaggtaagattgcaaatgataaggcaagttaaatatgtagggcgaggaagtagatatgtgactaacatgtgtt

SEQ ID NO: 21379 - DNA, 82 bp, Gossypium hirsutum
  Clone ID: uC-gsflnu33B134g07b1
ctcactcgtccgcccacgcatgcggtactacgtggcgtatttaaagataatagtggaaaccctctgccaagatcatttttca

SEQ ID NO: 21380 - DNA, 62 bp, Gossypium hirsutum
  Clone ID: uC-gsflnu33B135d01b1
aaaaaacatccagtacgatcatgtattacgaattaagttgtcatagtatatttcattatggg

SEQ ID NO: 21381 - DNA, 159 bp, Gossypium hirsutum
  Clone ID: uC-gsflnu33B135g01b1
cctttgctttcgattgggaccctagactagtctccgcgtttgaagtgaagaacaataatgatgtagacaaattgcatttcaatgctgtattattcagtggtttcgcccgtatttatttatttccaattctgcttaataataaaaatgattagttttttt

SEQ ID NO: 21382 - DNA, 102 bp, Gossypium hirsutum
  Clone ID: uC-gsflnu33B135h03b1
cttttgttttcggccacgcgtcctgtttatttggggtcgcctaaagctgggccggttgatggtccaagcggctgcacgataaggtggctctggagtctgatg

SEQ ID NO: 21383 - DNA, 495 bp, Gossypium hirsutum
  Clone ID: uC-gsflnu33B136c03b1
tctgcggcatacatctaattcttccggccttccctttgaatattgttatgacctaagtgcaaatcaaaccagctttgagtaccccattgtgaatctgacaatgaaaggtggagactatttttttgttaatgatccaataatagtgatttccttgcagggtggagatgtatactgtttaggtattgtgaaaagtgacaatgtgaatattattggacaaaatttcatgaccggttatcggatagtttttgatcgtgagaggatggtgctgggctggaaagcatcctactgttatgatttagaggcctcgaacactttaccagtgaacccaccaactgcagtccctccagccattgctgtgaatcctgaagccacatcagggaatgctaataatacaaacatttcaggggcgtcaccatccattacatgttcatcacgccacctcaaaacattgttttacgcacttacatttgctctcattccattttttgctttgat

SEQ ID NO: 21384 - DNA, 510 bp, Gossypium hirsutum
  Clone ID: uC-gsflnu33B136e06b1
tttgaaaatcaagacaatgatgccagagaaaatcaagacaatatgaagctgtcacatgagaacatctctactgtccaagggcatgcagattttcagaccatccttacaagctctctagctgaagctgaccataaaatagaaagtaacccagagatgctcgagctagaaaacatcataaatatggaggtaatggtggaaaacatgaggaataacttggcgaaggctcgtgaactgaagaaattagaagaagagataaagaagaacaaaactaatattaggaaagacgaactgaaggtggagaagggagaagctgatttaaaagaaaacaaactgaaggtggagaagggcgaagctgagttaaaagaaaaccaagtgaagctggagaaggacaaagctgagttagaagaaaacctactgaagctgaaaacgatgcagaagaaaccacggcttgcctaatttgcttttctgaaatacattctcaatggtttattgaggatgctgctgaactga

SEQ ID NO: 21385 - DNA, 514 bp, Gossypium hirsutum
  unsure (1)..(514): unsure at all n locations
  Clone ID: uC-gsflnu33B136f12b1
ttcccttcgtacgaancaggccnggacaacaaggacggttcaacctcaccaagaaaattttcgaaattactgcttcctctatcaactggttctgaaatccaaaccctaattttcctaatccgaaaccctaatcgaactaattttcaaatcagttaagaatttccggccgaatcaggaaccctagattccatggcgtcgaggaaaaaggaatccgaagggattgccttgctatccatgtacaacgatgaagatgacgaagaaatgggagacatcgaagaaggtgaccaccggcaaaaccaacaaactggggaagaagaagaacaacaacaagaagggcagccgctagaagaagaaaacgattacagagaatctaataacaatatggaagaagattcgagaaccaacgataatacgcctccttttcctcaccaaaacaccattctttcacaacaacagcaggagccctctgtttctttcgccgagcaacctcaactttggtttcgtcgaagagaag

SEQ ID NO: 21386 - DNA, 412 bp, Gossypium hirsutum
  Clone ID: uC-gsflnu33B137d12b1
ccacgcgtacggagagaatgaagctatgggtgatgatggattgccttggcacatgttcaatactcatatacggagacacaatggcaaaaccagcgacgatctgcattcacattatgaacaaaaagtgggcctcaatggggactataagagaccataggatctgactatttttttttaatatatctttagctatgaaattttgctttgcggcttgacctaattttttttgggggttaatctgtgttattcctaataactcacagaagctccagagattcactttaattagattgtgatatcatgaaagcaaatttcgagcaaatatgatgactagtttgcttatactaatgcaaaatgaccttaattactttcattagcagaaagaaaaacaaaactgagttctattattgta

SEQ ID NO: 21387 - DNA, 419 bp, Gossypium hirsutum
  unsure (1)..(419): unsure at all n locations
  Clone ID: uC-gsflnu33B138g02b1
gtatattcatcatgatgccaagcaccccaaggttccctttgaagagtcaaagcttgtgaatctacatgctgttcatgtggttgagacttccaagcctcgtcctggtgttaggggcagccttaaaaagtgataaaaaaccccaaaaaatgtgtttttcgtcaagctttggtgttttgtgatgtttcgaaatatgggtttggttcctttttcatcttttaattgtttgtcacgcttgcagtagagatgggaatgagaaaggggttggggtgaaaaaagttggattattcttgtaagggtcccccttgatttgatgtcgatgatgaatggtgttgttatagcttcctcatttaatgctaatgaagtgtttgtgccnnaaaaaaaaataactnaaatcttattactattattaacaaatcata

SEQ ID NO: 21388 - DNA, 476 bp, Gossypium hirsutum
  Clone ID: uC-gsflnu33B138g11b1
atcgcgtgggcggacgcgtgggcaaaatcgtaaaaggaaattacattcggatccagtatggacaagaacatgttagcaggtctcgagggtctccctgaagaagataaggcccgaatgtccgccatgatcgaccatcttcagcttcgtgatagtctaagaatgtataattctcttgtggatagatgcttcaatgactgcgtggacaacttcactcgcaagactctgcagaagcaagaggagacctgcgtcatgcgatgcgcggagaagttcttgaagcactcaatgcgtgtaggactgaggtttgcagagcttaactcgcaggccgcaacacaggattaaagctaataaacgaccatgagttggagctcaaaatgtttttgcatatcatgtagaattttcttcttttgggataaattggggtcttccgcagatgaaaagcattacgttgctggggttgagaattgctgctaaatcat

SEQ ID NO: 21389 - DNA, 375 bp, Gossypium hirsutum
  Clone ID: uC-gsflnu33B139a05b1
ctttattaaaccttctgcttagcttaaaaaatgttgaatctgcactctcctacttccctcgttatcgtcaatggcttcggacaagaagattaagatcgggattaacggatttggaagaatcggacgtttagttgccagagttgctcttcagaggaacgatgttgaactcgtcgccgttaacgatcccttcatttccaccgattacatgacatacatgttcaaatacgacagcgttcacggtcaatggaagcaccatgatcttaaggtcaaagactctaaaaccctcctcttcggcgaaaaacccgtcactgttttcggaatcaggaaccctgaggatattccatgggctgaagccgggcttgagtccgtgtgagt

SEQ ID NO: 21390 - DNA, 152 bp, Gossypium hirsutum
  Clone ID: uC-gsflnu33B139c08b1
ttgttacccgcacggaaaacccaaggaaagggggggctttgaacaaacaaggggttgaatcaacccaaagggacaacatcggcaacaagaaggacccaaaaagagcaaggagaagcacgcacaaaagccaacaagaaacccacccgcaaagg

SEQ ID NO: 21391 - DNA, 209 bp, Gossypium hirsutum
  Clone ID: uC-gsflnu33B139d05b1
gctatttttccggtgaacctgaggttggtgggggaggggtttttttaaccgggggattgagcccaagggtacgatatcgccgacaagcaggacctatacagagctgggtggatatggaccataatcttgcattgtacccacagtagaggaagagtgaacttctccagagcggatgcgagaatgaaccagacgagggggatgtcatctcc

SEQ ID NO: 21392 - DNA, 384 bp, Gossypium hirsutum
  unsure (1)..(384): unsure at all n locations
  Clone ID: uC-gsflnu33B139e02b1
cttcgtttccgagagaagctcaaggctgactataaatcttatctattgctatggctactgaacaatgtgtgcgccctgttgaaaaaaccctacacgaagggaaacatgaacaccatccgagcagtggccaaactcaggttcataaggagagtaagggtgtgaatcaatcacatgggcacaaccaactgagtcatgacacacccaaaacacatgccgagtccaagaccgtgagccatggtgtccatgctcagcaacatgtggctcaaagcacggccatgcctacaacttgccatggaaagaaggaaaagacgatgaaagacacgaaggagaaagacacggacanggcggaaaagaaagaaaagaaggaaaagaagaccgagagca

SEQ ID NO: 21393 - DNA, 136 bp, Gossypium hirsutum
  Clone ID: uC-gsflnu33B139e11b1
tggttacgcgtacggaaaacaaagggaaaggggggggtttaaataactaagtggttgattcaacccaaagggggaaaatcggaagcagtaatgacgtaaacagagctggctggacttggagaatattggaagaata

SEQ ID NO: 21394 - DNA, 247 bp, Gossypium hirsutum
  Clone ID: uC-gsflnu33B139f08b1
tcggctatgcgtccggagaaccgaaggttgggggggggttttttgatataagtggggtgttcagtccaaaaggggcatatcggcaacaagtagtgacatataaagagcgggctggggatggacaatatggttgaattattcgcatagcaaaggaggaataaacttcacgggtgaaatctggaaaggaaaaatacgcgagtgctataatttctacgatgaacataaagttgcacaagggtaaggggct

SEQ ID NO: 21395 - DNA, 510 bp, Gossypium hirsutum
  Clone ID: uC-gsflnu33B140c11b1
tcccacgcgtccgcccacgcgtccgcccacgcgtccgctagctctccttttgaatcaatctccatttttagttttcgtaaagtgaaaggatgttaggcattttcaagaaagaattaatgaatccaccaaaggagctgcatagcccagcttcactcacttcatcaaacaagaccaagcttcccaatcaaatcatcaaccatttcctttcttcaaatcccaacaatgctttctcaatggggttcggatcctcagcttgctttgcttatgctcccacagagaatcgtttccccaatcaaaggttgttctgtggagtggatgaaatatactgcatattcttgggggatttgaataatttgagcagcctgctaaagcagtatgggctgtcaaagggcaccaatgaagccatgtttatcatcgaagcatatcggacccttcgcgaccgtggtccgtacccggctgaccaggtccttaaggatcttgaaggcagctatggatttgtggtgtatgata

SEQ ID NO: 21396 - DNA, 495 bp, Gossypium hirsutum
  Clone ID: uC-gsflnu33B140f11b1
taattcccaatccctaattccctttaccgattacaacccctaattccccttccaaatccctaatcactcattcacagagacgacacctcccccaccaatctaggttttatttttgtttcttcgattcttcatttgttttttttcctcaaaaagaagatttgtttcggtttcttatcaacattcatacgaagacggagaagacgaagaagaaaaagaacattcccattctgttttttggtcaagcttcaatcaggactcaagaatggctgggaaggcagcacaatctgtggtgaaggcagtgggagaataccaatatccatggcgtgaaaagttggcgaagtacaaagtagagttatcaaagggagtatggggctattgggaacttggagcctggaagcctctaggcatcagtgccagacgtcgagccagacttccgaaagaaatgcttctagcgggccaagattggccatacgatccagagaagaaagagatgag

SEQ ID NO: 21397 - DNA, 58 bp, Gossypium hirsutum
  Clone ID: uC-gsflnu33B141a11b1
tcctcacgcgtccgaaaaaaaaaaaaaaagggggattttaaaaaaaaaaacctttaat

SEQ ID NO: 21398 - DNA, 488 bp, Gossypium hirsutum
  unsure (1)..(488): unsure at all n locations
  Clone ID: uC-gsflnu33B141b08b1
tgnagagctgcttccttcaatatcattcctagcagttttggagctgccaaggctgtcggcaaagttttgccagcactgaatggcaagctgactggaatggctttccgtgttcccactgttgatgtctctgtggttgacctcactgtgagacttgagaagaaggctacatatgatgaaattaaggctgctatcaaggcggaatctgaaggcaacttgaagggaattcttggttatgtagacgaagatttagtctcaactgacttcatcggagacaacaggtcaagcatttttgatgccaaggctggaattgctttgaatgacaactttgttaagcttgtgacttggtatgacaacgaatggggttacagttcccgtgttatcgacttgatccgacacatgtctaaagcttaagtgagtgagtgaatgtgctttgtgtatccaagctttagcaattttaatttagaagagatgttatgagagaataaacg

SEQ ID NO: 21399 - DNA, 378 bp, Gossypium hirsutum
  Clone ID: uC-gsflnu33B141d02b1
gtgattaggaggagaatagagggaagcaccgggatctttttgctactagttctgtctaattctacgggacacccgatgagtgattacatgcggagaatcctttggttaatgtacaagttttcggtattgtctatgaatcacgagcacgtgcaaaattatatgacaacttgccgagctggagaacattgccaaaactgaaacaagggctttattgagacaaaattaaagttcactagaaggtgggcagcacaaaaggtacggagctagtgaacgtgtacatgaatcatcaatctttttgtttgataccaactctacacttactactggcgtacccttgctgagggcataaatgaaaaacactatggccttcccacctta

SEQ ID NO: 21400 - DNA, 322 bp, Gossypium hirsutum
  Clone ID: uC-gsflnu33B141g02b1
ttcacgcgtccggttgatttcatcaagtttgatgttgttaatgttgtcatggtcactggagggaggaacagagggcgagttggagtaattaagaatagggagaagcataagggcagctttgagacaatccatgttcaagatgctgctgggcatgagtttgcaactcgtttcggcaatgtcttcaccatcggaaaaggaacaaagccatgggtgtccctatctaagggtaagggtatcaagatatccatcattgaggaagctaggaagaggcttgtttgccaaaatgttgcctatattttagcataagatatccagatatgta

SEQ ID NO: 21401 - DNA, 337 bp, Gossypium hirsutum
  Clone ID: uC-gsflnu33B141h08b1
tctcacgcgtccgcggatgagctgaacctagcgtatatgtatatgatcagcagagcttaccatgactcactgtttatggcaaggatagctccaatgggcatgatatttattccatgttacaaaggatatagtcataagccagaagaatatgcgtcacctcaggatttagaaaatggggtgaaggtattagcgctaaccttggccaagttgtctttgcgttgatgtgttgttgtatattggaaggttttattaggctggttaatgccactctttgtcaatattttcaataataacaactttggcatttatgaaaactttgtattatgtttgagaattc

SEQ ID NO: 21402 - DNA, 411 bp, Gossypium hirsutum
  Clone ID: uC-gsflnu33B142b11b1
tgcttgggttgagtgtagagatgaggaaaatcatgggtgccaaagttcttttcttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatcc

SEQ ID NO: 21403 - DNA, 166 bp, Gossypium hirsutum
  Clone ID: uC-gsflnu33B142e02b1
tggcaccgctgtgtctggggagaataaatggaagattcttccgttaggtaatttagaagctgtcaggaagtatagggagaaggttaaggcacgagctgcctctttggaggacgaggttgtgagactgtcgtcattcaaccatcattttgtgaaaagtttcctgggt

SEQ ID NO: 21404 - DNA, 497 bp, Gossypium hirsutum
  Clone ID: uC-gsflnu33B143b04b1
tttatcgcgtgggtggaactattcaaatgaaaagttatttgtcaggaaatccagaaattcgactagctcttaatgaagatctgagcataggaagagggggaacagtctatgactataggagttcatctggttcaggcgctgtgatactcgatgacttgaattttcatgaatcagagcgtcttgatagttttgacatggacaggactctatctctggtaccaccagatggtgaatttcctgtcatgaactaccgaatgacgcaggaatttaagcctcctttgcgtattaattgtttaattgaagaagctggacagcttaaagctgaagtgattattaaagtacgcgcggagctgccttcagacattactgccaacacaattgctgtacaaatgccacttcctaaatatactactagagctagtttcgagttggaacctggagctgttggacaaaagactgatctcaaagaagctaacaagaaacttgaatggggattg

SEQ ID NO: 21405 - DNA, 354 bp, Gossypium hirsutum
  Clone ID: uC-gsflnu33B143f01b1
tttaataacacattttctggtccatctaagaaagcttagtgttatcactatggactgcaaattccagggcatgctgtgacatgacgacacggaggtcaggccgctggtcggatagggaaggaactatgaacagagagcactgctcacactgaggagaacttccggaccctctgtactggctagaaaggtgtaaggcgtatgagtatgcctctctactacaagagctattcttgccatggtgggagcgataactatatgtgccaaggaggtgacttaaccgacggtaacaggacccgaagggaatccactgaccgatcatagtgagttgacgagaacttcattatgaagcacact

SEQ ID NO: 21406 - DNA, 328 bp, Gossypium hirsutum
  Clone ID: uC-gsflnu33B143g07b1
ttcacgcgtccgatagaattggaatagccaaggaagaatttcatgccattttagaggtattcttatgtctatactggctagtcgtgtttgcatacagagattgagcagggggtgacacaagcaattattcgctctgctattggctttaagagggacccatggcctaaggtttcggacaatgcaaaggaccttgtaaagaaaatgcttaatcctgatccagagcagcatcttacagtacagaaagtgcttgaacatccatggctacaaaatgccaagaaagcacccaacgttttgttgggtgagactgtgaaagctatgctcaaacaat

SEQ ID NO: 21407 - DNA, 422 bp, Gossypium hirsutum
  Clone ID: uC-gsflnu33B144h07b1
tggttctttgtctatgccaagaaaatgactgggtggatgtattttgtctccaagacattggctgagcaagctgcctggaagtttgcaaaggagaataacttggatctcatcactataatttcaactcttggcattgggccatttcttatgccttcaatgccacctagtctaattactggcctttcaccccttactgggaatgaagctcattatggtatcattaggcaagggcagttcgtgcacttggatgatctctgcatgtctcacatattcttgtttgaaaaccctaaagctgaaggcagatacatttgctcctcccatgaggctaccattgtagagcttgccaaaatgctaagagaaaaatacccagactacaatattcctactgagttcaaagaagcagatgaaaaccttggaaaatg

SEQ ID NO: 21408 - DNA, 173 bp, Gossypium hirsutum
  Clone ID: uC-gsflnu33B145a07b1
gaagctgctgcgcctgccggtaccgaaccggaagttccggccacacccacgctttcgttctcgcgtcagggcaggcattaaagcgaggggtccaaccaagggtcggccaggttttaatggcatcagagctcaaaggaacttagaccccagaaaaggcttcactgctaccccca

SEQ ID NO: 21409 - DNA, 344 bp, Gossypium hirsutum
  Clone ID: uC-gsflnu33B145g07b1
gttaggtgtgcgtcaacctaagggagctaaacctggtgggacacgtattggatgttaaaaactacttttcttcaaaaaatggaggggaaagagaaaactaattgtggtgactggatgatgagtgcctgtattttcttattgtcattctttataacttgttttagggtgtgaggatgtagtgtttttctttataattgattgtgtcatttgaagaacataaccttctgtttctgccccatctctcggctccttcatgtcaggaagcctaagttctgactgcttgcaagactagttcatttgttggtagggaaggaaatggaaaatggaagtggtttctttatatt

SEQ ID NO: 21410 - DNA, 404 bp, Gossypium hirsutum
  Clone ID: uC-gsflnu33B145h04b1
ctcacgcttccggcgagctgtgctgaggtttatgtgatgcagaatcggcagaaggagaagatgaagagaatggaagaggagaaagcaagcagaggcattgaagagtcgacaaagcctcaacctcatacggttgttgttgggaggagtaaggttcagcctggccaggctgcgcccgactctgctagtgttagcgtcagtgaaaaacagggatcgggagatgtcaatgcaccttaatttacagcttctattgattatgtccatcactttatgtatattctagagattatgatcggtctgctaaatcggtgagaatcttttatatataaatagacaagtctcgtaaaaagaattatatatatatgttgattcttcctgtcggcaaaagaaagaaaaaaacaaacaaa

SEQ ID NO: 21411 - DNA, 429 bp, Gossypium hirsutum
  Clone ID: uC-gsflnu33B146a01b1
ccctctcgtccgcccacgcgtccggcgaagaacagtgtgagttgcggtagcggctgctttatcccaattgaatgtggagaaggctgtgaatgctctgctcaaatggagagattctcagtcccaagcccaaaaaccccaacttcttgaacaggatgaattcctatatctcatcgtcagcctgaagaaaatccctcaaaaggctcgcgttaaccccatcaaagtccctctccctcaccccatcatcgatgatcccgccgagctttgcttgttcatcgatgaccgctcgaagtctggtatcaccaaagacgctgcgtctaagaaaatcaagtcggaaaacatacccatcaacaaggtcattaagctgtccaagctcaagactgattataagcccttcgaggcctaaaggaagctttgggattcatatgatat

SEQ ID NO: 21412 - DNA, 353 bp, Gossypium hirsutum
  Clone ID: uC-gsflnu33B146a10b1
ccctcgcgtccggtatctggacgactcaacatggttttttggtgtctatgatggtcatggaggtaaagcagtggctaagttttgtgccaagcatcttcatcagcaggtgctcaagcatgaggcgtattcagctggagatattgggacttcagtacagaaagcttttctcagaatggatgagatgatgtgtggacaaagaggatggagagaattagcactcctgggagataaaatggacaaagtttctggtttttttgaagggtttgtatggtcttctaagggtgatgaagccaatgaccattttgatgattggcctcctgaggagggatataatttgtctaaagatcacaagc

SEQ ID NO: 21413 - DNA, 424 bp, Gossypium hirsutum
  Clone ID: uC-gsflnu33B146c04b1
tgttattgttgtagcttaatctagttaatctaggtactaatttgtgattctgtaaaagctttgaaaattttccattgttatttttgaatctttttagttgttaatggtttggcttgaagcttgataatgagtttgaattaatttataaagtgattttaagtaatttcaaattaaaggactaaattgatagaatagtaaatttagtatagaattcttatgaaattttagtagttatggactgaaaatgaataggaataaatttagtacaagggtttcggggctaaattgtgataattttgaaagttttgggtttaaggactaaattaaataaaaggttaaaagtttagtgttaaagtgtaaaattttttattaagggtcaaatatgtgaatttaagtgttttaagatatttgaattggttaattg

SEQ ID NO: 21414 - DNA, 536 bp, Gossypium hirsutum
  Clone ID: uC-gsflnu33B146d01b1
attttaccttctgcttagcttaaaaaatcttgagtttgcactctcctacttccctcgttatcgtcaatggcttcggacaagaagattaagatcgggattaacggatttggaagaatcggacgtttagttgccagagttgctcttcagaggaacgatgttgaactcgtcgccgttaacgatcccttcatttccaccgattacatgacatacatgttcaaatacgacagcgttcacggtcaatggaagcaccatgatcttaaggtcaaagactctaaaaccctcctcttcggcgaaaaacccgtcactgttttcggaatcaggaaccctgaggagatttcatgggctgaagccggggctgagttcgttgttgagtcaacctggagtgttcactgacaaagacatggctgctgctcacttgaagggtggtgcttagaaagttgtgatctttgcccctagccaagttgcacccatgtttgttatgggtgttaaccagaaagactactagcccgagcttgcatttgtttcaatgttagctg

SEQ ID NO: 21415 - DNA, 481 bp, Gossypium hirsutum
  Clone ID: uC-gsflnu33B146d10b1
gttcaagtcctctattgttcaaactaatccctgcgttacttcatctcggggtgctcttacgatggttctcccctgagagagaaagttccattgaggttggaattaaaggagataacctccgttcagacagcggaaagcatcgcattactttgatggtgcaagaaccccatgattcctgattaataccatgtaagtaaactaatcgagaagaaaaatctccattacatgtttgatcggccatgtttttgtgatgctgcagatgaagttaatgatgtcgtgaaacacactttgcttcctgtttttgttttggtttactaaccctactatatttgattaacaaattgcattgttcctcttaaaaagatgccaacagcatgaggtaacctctagctgttgaagcaatgccttgtaatctttcatttctaactggttttacaccgttggtttggctgttctagcggttctcatactttcattttta

SEQ ID NO: 21416 - DNA, 298 bp, Gossypium hirsutum
  Clone ID: uC-gsflnu33B077c12b1
aaaaaatgtcttcaggttgcaattgcggatctagctgcagctgcggatctggctgcaattgcggtgagaactgctcaatgaaccttaaccttggatactcggagaagacaaccagcactcagaccatcatctccggagttgcgccagtgaagatgacctttgagggaccagagatgggcactactgaatcaggacatggatgcagctgtggatcaagctgcaaatgtaatccatgcacctgttgaaaagcttgatgaaagccatagattatgaaaaaagaaagcagcaaaataacagg

SEQ ID NO: 21417 - DNA, 295 bp, Gossypium hirsutum
  Clone ID: uC-gsflnu33B077d04b1
tctatgaccaagatgtccttgcggaagacacaattctttactggttccgcaaaggatcaaatccaaagggcaggcaaaccttcgtgaaggccctggagcccttcgtgaattggctggaggaagccgaagaagaggaataagcgcgtcgataataatagtgttatcaacaatcaagaagttatgataattaaccttgttatcttttccttgtctttattaagctatatgtttgccggattcttttaacatttggtgtgtgcctgctaaaatatttgctgcgctcgtatgctaagct

SEQ ID NO: 21418 - DNA, 295 bp, Gossypium hirsutum
  Clone ID: uC-gsflnu33B077e01b1
gtgattggtatccccagattgttcacgtctgtacactattcgattttgtctactgttgtgaaaacatatatcaactgtcataagaggattaagttatgttgtcaatgcatgtgaatgggacttgtatgtggctcctttaatgtcattctagaactttgtttctttgttctgttaaagcatttgcatatttttttgtcagctaaaatatgcagttagtccttgtactttacaatgattaatggcatattttaaccttttttgcctcttgattctttcttttctggttccattattg

SEQ ID NO: 21419 - DNA, 295 bp, Gossypium hirsutum
  Clone ID: uC-gsflnu33B077e07b1
cttccgtcacaactccaaaaccgtacacaaaatgggcaaggatctaagcgacgagcaagtctcatcaatgaaggaggctttcactctcttcgacaccgacggtgacggcaagatcgctccatcggagctagggatcctaatgaggtctctcggcggtaaccccacccaagcccaactcaaagctattatcgctgaagagaagctcacggcgccctttgacttccctcgctttttagatctcatgtccaagcatatgaaacctgagcccttcgataggcagctacgcgatgctttc

SEQ ID NO: 21420 - DNA, 139 bp, Gossypium hirsutum
  Clone ID: uC-gsflnu33B002b08b1
tatacagatcgagagtggacgccaaaggatggtattctttaacagaaggctagtactacggcagaggctgagatatatatacacatgaggaagcgaagagaatccaagaggcgcaaactgagtccatgttatggttaaa

SEQ ID NO: 21421 - DNA, 224 bp, Gossypium hirsutum
  Clone ID: uC-gsflnu33B002d09b1
tacacccctatccttctcaatctttctcaaagaaatgtttacatttcagctcacagcgtcctcagtgacagcatcagctaggaacttggcttcattacaagggctcaggctgtccaccgtcaaattctcttccttcggaacattaaagcctggggctgcgaccagcaggtccttcagaggcttggttgtcaaagcagctacggtcgatgccccctaagcccact

SEQ ID NO: 21422 - DNA, 388 bp, Gossypium hirsutum
  Clone ID: uC-gsflnu33B003a02b1
ttctttgatttttattgtctttgatgctatagccctcttcatatcattggctgttgtggtagtgcaaacctcgattgtagttatacacagaaaagcaaagaagcagatgatggcagttattaataagctcatgtggttggcttgtgtactgattacagttgcatttctagccctttcatatattgtagttggagatgagtggtggttagctaatctagttactggtatagggactgttatcattgcatcaacattggggacattgtgtcattgggtgattgtgaaccgtattgaggctttaaaactacgcagcatccggagatcttcaatgaatagtggatctcgatcattttcaatgtcatatgtgtctgacacggagattctgaac

SEQ ID NO: 21423 - DNA, 363 bp, Gossypium hirsutum
  Clone ID: uC-gsflnu33B004c08b1
taagaatacaaggtgatccagatagtgtttcgaagaaaattgagaagagtcgactccagtactacatcaaccacttcgagtgaatcggaggttcagattttgactatcggcagcccttcttggagggatctaggaacgataccataccgttttattcattcgaaaaccaaggctttggtcaatgggagactccattggctttccaagcctaacaggtacaccactgctagcttgctcgtatccttcgatctcgaaacagagcaattccaggaggtgccgaaacctgattgttgcggctcatagaggtgtttgcggcatcttatggttgtacgaggttgtctctcggttgggtgcgttcatgag

SEQ ID NO: 21424 - DNA, 78 bp, Gossypium hirsutum
  Clone ID: uC-gsflnu33B004d04b1
tatttctttggacttttggtttaataatttggtatttattttgagtttcaaaggggccgggcaaattggcctatctac

SEQ ID NO: 21425 - DNA, 507 bp, Gossypium hirsutum
  Clone ID: uC-gsflnu33B008b06b1
tttgagtgtttccaatatgtcttcctcattacaaattgaattggtgtcatgtcttggagacaactatgcatatcttttacatgatgtggacacaggcacagttggagttgttgatccttcagaagctgtgccaattattgatgctttgagtcgaagaaactggaacttgacttatatattgaatacccaccaccatcacgaccacactggtgggaacgcagagttaaaagcaaggtatggtgcaaaggtgattggttctggaatagacaaggataggattcctggaattgacattgttctaaatgatggggaaaagtggatgtttgcaggtcatcaagtgcatgtcatggagacccctggttatacccgaggccatattagcttctattttcttggttctcgagcaattttaccggagacataaacggccatgtgagccgacttttcgtttacattttaatgccgttgggcggtggtaattgggtgaaaatttatgattttttgcgg

SEQ ID NO: 21426 - DNA, 536 bp, Gossypium hirsutum
  unsure (1)..(536): unsure at all n locations
  Clone ID: uC-gsflnu33B013d12b1
ttttgaaaatgtcgaagcgagggcgtggaggttcagctggtaacaagtttaggatgtcactgggtctgccagtggcagctacagtgaactgtgctgataacactggcgctaagaacttatacatcatttcggtgaagggaatcaagggccgtcttaaccgattgccatcagcttgtgttggagatatggtaatggctactgtcaagaaagggaagcctgatcttaggaagaaggtcttgcctgctgtcattgtgagacagcgcaagccctggcgcagaaaggatggtgtttacatgtactttgaagataatgctggtgtcattgtgaacccaaagggagaaatgaaaggttctgctataactggtccaattggaaaagagtgtgctgatctatggccaagaattgcaagtgcggctaatgccattgtttaggaactcacattttagtcattgtgtttctctgcatgggactaatatagtttgctggatcaagatttntgttatttttatttttccttcagaacatcatttggatgg

SEQ ID NO: 21427 - DNA, 457 bp, Gossypium hirsutum
  Clone ID: uC-gsflnu33B013f04b1
ttcttcgcgtacgagttttgggttttttattgctttttaggctttgcttggtatggatgattgatagagttcaaggatcaaaaaccttgtcaacctaattgttagggttcatattagttttttacgttgtagcttaacaagtttcccaatccttgctaccaaaccaaatcttatagaacaagttgttagagacttggtagagtgttaggtgaaatcaaatgagtttagcttgtaatgttgcatttcaaaatacacgcttcacttagttgattaagcaaaaattctggtaataaacatagtatgtgagtgagataactatgcgtatatgtatatagacagtgaaagcagccttgaaacactgactgcataatgttcatatttagcctacaaattcacttcattgggtgtcacaacagcgacaaaactaagcctttcttggaccttaccacgctgatcg

SEQ ID NO: 21428 - DNA, 498 bp, Gossypium hirsutum
  Clone ID: uC-gsflnu33B013h08b1
ttaaaaaaaaaaaaaaaagaagttcaaattgaagaatgcctgtattttcttcaagagctatgttcaggaactacgacaagcatagaaagcaaaaaagtgaccctaaaggcaaattgtccgacgtgttcaggagctatgctgattctaatggggagctaaacaaggaaaagctgaaagacgcttttctacatctggatgctgccatgccgtaccggcaagccgaagaagccctccgtgtcgtcggcaaaagctattacattaacatcaaggatgaaaccgaccttaacacccttgtcgactatgcttacaataagggttacgggtattcaatttgattagctaatttataagcttattttctttttctttttcacttttaatcatctaatatgttttttttaaatatatgtaagtttcgtcccaaaagacattattatagaataaaggttttggggctcatgaatgtgatgtagtttttgcatgtactttgcaaagact

SEQ ID NO: 21429 - DNA, 552 bp, Gossypium hirsutum
  Clone ID: uC-gsflnu33B015a11b1
gctggtacccctgctggtgccgctgccccgtaattgccgggacgccacacgccttttattactgcactgacatccatgcccctgggggtggagactttatcaagaacatgattactggtaccttccaggccaattgtgctgcccttatcattgactctaccactggcggttttgaggcatgtatttgcaaggatggacagacccgtgagcatgctctgcttgctttcactctcggtgtcaagcaaatgatttgctgctgcaacaagatggatgccacaacccccaaatactcaaaggctaggtatgatgaaattgtgaaggaagtgtcttcctacttgaagaaggttggatacaaccctgagaagattccttttgtacccatctctagttttgagggtgacaacatgattgaaaggtccaccaaccttaattggtacaagggtccaactatattcgaggctcttgaccagatcaatgagcccaagagaccctgtgacatgccactccgtctttcacttcatgatgtgtacaagattggatgtattggaactg

SEQ ID NO: 21430 - DNA, 528 bp, Gossypium hirsutum
  Clone ID: uC-gsflnu33B019g07b1
tcccttggtggtggtgcaaacaccgtggcttctggctacaacaagggaactgccttgggagctgagattattggaactttcgtacttgtctacactgttttctcagccaccgaccccaagagaagtgcccgtgactcccacgtccctgtattggctccccttccaatagggttcgcagtgttcatggttcacttggctaccatccccatcaccggtactggtattaaccctgcaaggagtttcggtgctgctgtaatctacaataacgacaaagcctgggatgaacactggattttctgtgttggtccatttgttggagcacttgcagcagctatatatcatcagtacatccttagagcagcagctatcaaagctgtgggatccttcccgagcaaccccaccaactaataaaaatcaacccaaatagctttgtctcccttcaatctttttcttttttcacaattgatcgttgtgtgtatgagaagattttatgaaatgagatgcttatgtccctctctttttaataac

SEQ ID NO: 21431 - DNA, 184 bp, Gossypium hirsutum
  Clone ID: uC-gsflnu33B024a04b1
gtcggaggctcatggagcttgcataagatctgggaaatctgctccaagtgagcaagttcagagggaactgtctgattacttggaagataacatgatggccttgataatatcttccggataaaagtaaccaattgggtagctgaggagacttcggtacctatgtattacatatttggtagccaca

SEQ ID NO: 21432 - DNA, 468 bp, Gossypium hirsutum
  Clone ID: uC-gsflnu33B024a11b1
ggggcaatggtgatgactttgtacaaaggtccaattgttgatttcatcaaatcaggaggcgtggcacaccatggcaccaccactgaatctgcagacaaacactgggttactggcaccataatgcttctagcaagtatcttaagctggtcaagttactttattttgcaatccttcacgttgaagatgtacccagccgagctctctcttacagcttggatatgcttgatgggaacgatcgaaaatgcagtagcgtcccttatcatggtccggggtataagtgcttggaaactaggttgggattcaaggctccttgctgcgtcttactctggaatagtttgctctgggattgcgtattacgtgcaaggagtggtgatccgggaacgaggaccggtgttccttacgtcattcagccctctatgcatgatcatcactgctgctctcggtacctttgttttatcagaacaagtg

SEQ ID NO: 21433 - DNA, 447 bp, Gossypium hirsutum
  Clone ID: uC-gsflnu33B035c06b1
ttcttgcttccgaccacgcgtccgtacacctgcaacactatctaacgcaccaaggcatggagttccagtagatgctgaaagaagctcaagtggaacccacagaagcagttctacaactgctttagggccactcccgatccctagccaatttaaggcgctcgaaacgcatataaacagtatggagtgggaactgcccgtgagaggtcctgagagataaagagtaggagacttcggaccaagtgcttcacttcttttacaaaaagatggggaaccattgatacgagctccaatcatgtctcatgtgacaagagacccacttttatggtgccattccaaattaagcaggaattatcccagataaaagggagactactactgaaccgtccttttggcttcaccaggtaatatttatgaaattaataccgcatgtatatctattcctctcgc

SEQ ID NO: 21434 - DNA, 392 bp, Gossypium hirsutum
  unsure (1)..(392): unsure at all n locations
  Clone ID: uC-gsflnu33B036a04b1
ctgtaatatactaaccttctttttttacattttgttcgattagtcttcttctcggtatcgctgtcatggctgggttcgagcagcgaataaaggagagagccaaggagctcaaggttttcttcaagaagggtgtgaagatcgtgggagaatcatgcaagaaaggttggtacaaagtcaagcacatcagaggctgattcttttgccttccatcatcttgttttcttttcgttttccatgtagagatctttgtcagtcatcttgaattggaggggttttctttaattattgaaggattntatcctgttttctgcttattttttgtgcttttttttagcatcttatgagttgatttgattttgagattatagttaacngacaaaacatnaaattcc

SEQ ID NO: 21435 - DNA, 436 bp, Gossypium hirsutum
  Clone ID: uC-gsflnu33B046a10b1
ttcacgcgtccgaatatgaacgtcgcagagaaaactttttcaaggagctggagatcgtttttgctgatgtggtaatggccataattgcagatttcatgcttgtgtatcttcctgctcctactgtttctctccggcctcctcttgcagtcagtgctggagctatttccaagttcttctatagctgccctgataatgctttccaggttgctcttcctggtacttcatattcacttatgcagagattaggagcagtaatgcgtaacggcgcaaagctttttgcagtgggcaccacttcttcgctggttgggacagccatcacaaatgctttgattaatgctaggaaggccgttgataagacatcggcagctgaagttgaaaatgttcctatactagccaccagtgttgcctatggtgtatatatggcagtttcgagcaa

SEQ ID NO: 21436 - DNA, 279 bp, Gossypium hirsutum
  Clone ID: uC-gsflnu33B049f08b1
tttatgagacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctttgtctgtgtcttgcgttatacaagctttgtttgaggtgaaaataatgtataagccatttggtcgggagc

SEQ ID NO: 21437 - DNA, 128 bp, Gossypium hirsutum
  Clone ID: uC-gsflnu33B049g04b1
gtaaaatattgcgcttacaatacatttcaagactcgcctaatatctatagattcttaaataaatgggcacttcgttgtgccttgaatgatgatttgaaaacaaaaaaaataaaaaaaaaaaaaaacaa

SEQ ID NO: 21438 - DNA, 434 bp, Gossypium hirsutum
  Clone ID: uC-gsflnu33B051b03b1
cccacgcgtccgcccacgcgtccgcttatctcttttcgtctctgaatctgatcaatcaacacctgaaaaggaaaacttacaaacaactactactagtctactacccagcactagaagcagctcgtagccagccatggatgaagagtacgatgtcatagttctaggaactggtctcaaggaatgcatcctcagcggtcttctttctgttgacggactcaaggttctgcatatggataggaatgattactatggaggagagtctacatcactcaaccttattcagctctggaagaagtttagaggaaatgataagccttctgctcatttgggctctagcagagaatataatgtggccatggtccctaagtttatgatggcaaatgggacttttgggcgtgttcttatttataccggttgttccaagaattctttac

SEQ ID NO: 21439 - DNA, 484 bp, Gossypium hirsutum
  Clone ID: uC-gsflnu33B051b11b1
tataaccccagaagacaagagtttcacctcaacaaaacacctacagagcaaatatgccaattgagagctcttccactaatgccccaaccgtctgtgtcaccggtgccggtggcttcatcgcctcctggattgtcaagcttcttcttgaaaaaggttacactgtcaagggcactgtaaggaacccagacgatcccaagaattgtcatttgagagagcttgaaggagcaaaggagaggctatctcttcacaaagctgaccttcttgattaccagtctcttaaggaagccattagcggttgcgatggagttttccatactgcttcacctgtgactgatgatcctgaacaaatggtggagccggccgtgattgggactaagaatgtgataatggcagcggcagaggccaaagttcgacgtgtggtgttcacatcttccataggtgccgtgtacatggaccccacaggagccctgatgggtggtcgatg

SEQ ID NO: 21440 - DNA, 190 bp, Gossypium hirsutum
  Clone ID: uC-gsflnu33B055e01b1
agttctttcaaatctatccttcagtgttttttcggtggtattggaatttggttatttggtaataactgttctttatgagccctttttcatagttttatattggtatattttatattgcagtaatgttttatatgaatctcatgtcataagtagaaatgtttaatgaaaatagtatggtgatatttttatt

SEQ ID NO: 21441 - DNA, 374 bp, Gossypium hirsutum
  Clone ID: uC-gsflnu33B056h07b1
tttctttgacgcgtgggcggacgcgtgggcgccgttgtgttgacagctacttctcagatctgcaggggcggcgccagggggccaaaaaagatgtgtttgctcctttgtgtccaacacggagcctgaacatgatggatcaagtgaaggggaatcgatttttgtccacatcccgtgacattccaaggcttgggagcgaggccaaagaatcaaaccttcgcccgttatctcctccatcttcctatttataagccacaactttctgcgactgtgtcaattaccaacaggatctacggggctttcctaactactgcacttttgttctcttatcttatttctctgaaaatgggtttagtttgcttgacctatttcaattt

SEQ ID NO: 21442 - DNA, 493 bp, Gossypium hirsutum
  Clone ID: uC-gsflnu33B057a03b1
cccacgcgtccgcccacgcgtccgggcaggggatatctcggctctcgcatggatgaagaacgtagcgaaatgcgatacttggtgtgaattgcagaatcccgtgaaccatcgagtctttgaacgcaagttgcgccccaagccattaggccgagggcacgtctgcctgggtgtcacgcatcgtcgcccccatccaaccatgagccctcgagcctcggttggaccgcgggcggaaattggcctcccgtgcgctcacagccagcggttggcctaaattcgagtcctcgacgacatcatcgtcgcgacgatcggtggtaatgctgcaagcaacctcgttcggagtcgtgcgcgtccgtcgatcgagacccttgaaccctttcggcatcgcagggacggtgctcgcatcgcgaccccaggtcaggcgggattacccgctgagtttaagcatatcaataagcggaggaaaagaaacttaccaggattcctctagtaacgg

SEQ ID NO: 21443 - DNA, 313 bp, Gossypium hirsutum
  Clone ID: uC-gsflnu33B057c07b1
tttgtttttttttttttttttttttttttgaaattgaaccaagatttattcaaataataaatgccactacaaatatgatcatcataatggttataacgtagaatcagtatcagcacaacaaaactaaggcaatggacaagtacaagatagggtagagagtaccaacaaggagagaagctgagttggcctttgcttttttaactaaataaattttattactttagtatgtatcagcaaattttcatgaggatttggttcttaattatgagtaatgggggcttttctgttatttcagaatgtattatgatattta

SEQ ID NO: 21444 - DNA, 551 bp, Gossypium hirsutum
  Clone ID: uC-gsflnu33B058d09b1
tgtgtgatcgaagcgtgaccggaatggccggctaaaaaagaacagccaaaaatcgaccggagttgaaacagttaaagagaaaacgacgggcaaaagaagcggtttattttcaagttttcgtgctattttcaggtccagtgggaaagcaagtgaatcagacgcgcttccagtagcccagtggccgccagggaatagggacattaggtctcgtttgccaccagatgatcgtgacgcaatatcgatggagcctgaaattatggagagtgaaccggtcagtctaggtggaatgaagcggttcgcatccggtaggagatcggagccgttaatctgaggtgcgtgatggcagttgtggggcacagcttaagcgcgggttggtctgcggtcgtagttgggtaacttgcgggtcccgcctatttttaaaattttttttcgtggtgacgtcacacgatgattgactgttttgacaaggttagaaaaattgaaagcacattgttttttcttatccccccccctttataaattttgatttggtttacttggtacaggttctt

SEQ ID NO: 21445 - DNA, 424 bp, Gossypium hirsutum
  Clone ID: uC-gsflnu33B059b02b1
gttcatattaatggcctttaacaagttgactgacagcggagcatccaccccggctggtctcgtagccgccgctctagctcatggcttcggacttttcgttcgctgtctccgtgggcgccaacatctcaggtggccacgtcaaccctgccgtcaccttcggtgcttttgttggcgggaacatcactctcttgcgcggcattctttactggatcgcccaactcctaggctcaaccgtcgcttgcctgttgcttaagttcgctaccggcgacctggctgaacccgcttttgggttgtcatcaggtgtgggcgtgtctaacgcattggctttcgaaatcgtgatgacctttggattggtgtacacagtgtacgccacagcccgtgatcccaaaaagggaagctttgggaacaaactcaccattggcaa

SEQ ID NO: 21446 - DNA, 209 bp, Gossypium hirsutum
  Clone ID: uC-gsflnu33B060h02b1
ccacccttccttgcgcccgacaaagagaaggccggagggagggacattacacagagagagagacagagagagagacgtcgggaggaatagcgcgcgcaccactcgccgaggaacgtcaggcatggaggaagaaccatccccatggcctcgttgcgaaaccagagacgttgcctgatggaacgcgcaacttgaaggggaggcattgcacg

SEQ ID NO: 21447 - DNA, 353 bp, Gossypium hirsutum
  unsure (1)..(353): unsure at all n locations
  Clone ID: uC-gsflnu33B060h10b1
tnctcgcccacgcgtccgccaaaactcaagctatgggttttactgaggtggagactgaggttgagcggtcgactgaagctgttgaagatagctgccaaggagttggagaagaagaatgtttgatgagaagaactcttgctgctcatgttgattatatctatactcagaatcacaagccatgagagctttttatgaatttatggacatggtcttttaaattttaaataacataatcactcaagttaatttgtgtttgtttcttcttcattatatatttcttcaatcttctggttttttttttttttttgaaatatatggttggagtttctcaactcaaaaatctctctcaacat

SEQ ID NO: 21448 - DNA, 466 bp, Gossypium hirsutum
  Clone ID: uC-gsflnu33B062c09b1
atgcgtccgcgcgcacttaacaaatggaacatggacagggttgagctgagttcatcttgggcgggccttaactctggtgggatgttataccctgtcgctcatggagtacatgcggagaagctgggaaacgaggccaccatttctcaaaccatacctgtaaaaccaggggtactgtatgcgctgacatttggggcgtccaggacttgtgcgcaagacgaggtgttgagagtgtcggtgggtactcagtcaggggacctccccttgcagaccttgtacagtagtatgggtgatgacgtttatgcttggggtttcattcccaaaaccaagtatgttactggtaaattccataacccaggtgttcaagaggatcccacctgtggtccattgttggatgcggttgctattaaggagcttggccgtcccagagctaccagatataatctggtgagaacagtggctttgaaga

SEQ ID NO: 21449 - DNA, 537 bp, Gossypium hirsutum
  Clone ID: uC-gsflnu33B063f07b1
tctttataaacaattatctccgtttatctgaagtagaataaggataagaagatgggaacattggggaaagcaatctacacggttggattctggatccgagaaaccggccaagccctcgatcgccttggatgtcgcctccaaggcaattactacttccaagaacagctgtcgaggcatcggacgttgatgaacgtattcgacaaagctccaattgttgatagagatgcctttgttgcacctagcgcttctgtcatcggcgatgttcaggttggacggagttcttctatctggtatggctgtgttttgagaggtgatgtcaatagcatcagtattgggtctggaacaaatatccaagataactcccttgttcatgttgcaaaatctaacttaagcgggaaggttttaccaacgattattggaagtaatgttactgtcggtcatagtgctgtttacacggatgtactgttgaggatgaagcatccgttggtattggggctaccctattagatggtagttatgttgagaagcatgccattg

SEQ ID NO: 21450 - DNA, 425 bp, Gossypium hirsutum
  Clone ID: uC-gsflnu33B063g02b1
tttttagcgcagaagtgaataacataaaatatgtgattttatttaaggttttgtttgggggaaattgagagaccattttgaaaaaaaaaaatccaagatgaagatcacatcgtttgtcttgctgaagtgcaccccggatggctccgatccgataatactagctaacgctaccgatttgagccattttggctacttccataggtcaagcgtcacggagttcatcgttttctttcttggaactgtcgctaaacgcactccttctggtgagctcctatccggtcatcacgaatagtataaggtacatgcttacaacagatatggaccttgtgccttggtatttatggatgatcatcatccagctcgaagtgctttttcgcttctcaaccagattctagatgaatatcagaaaaatcctggggagtctt

SEQ ID NO: 21451 - DNA, 451 bp, Gossypium hirsutum
  Clone ID: uC-gsflnu33B064f12b1
tagcgacacaaaaacactgctttttcttgggtgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgttctgtctgctagggaaggcatcgtttcgttgggaggcccttatattcctctcaaaactggaagaagagacggtagaaggagcagagcagatgttgtggaggagtatcttccggaccacaatgagaccatctttggcgttcttgacaggtttgtcgccatgggtattgacacccctggagtcgttgccctctaggagcttacagtgtcggcagaactcactgtgtgaa

SEQ ID NO: 21452 - DNA, 469 bp, Gossypium hirsutum
  Clone ID: uC-gsflnu33B064h07b1
ttatcgacccgtccatctttttctcttcttccgagcagaaataataatagcaataatcatggagtccaaacatgggagttggagactctcattaatgttgcttctggttatgcttgggttggcaaaagctgatatcaatcaagacaaaacagaatgtagtaatgagctagtagggctggctccatgtctcccctacgttggtggagacgcaaaaacccccaccatagattgttgcagtgggctgaaacaggtgctggataagagccggaaatgcctgtgtgtattgcttaaagatagagatgaccccagccttggcctcaacatcaacgctactctcgcggcaacacttcctatcacttgtcgtgcccctgtcaacatgaccgactgcatctctcttctgcacttaactcccgattcccaggaagctaagttatttcaaggatatcagaagctgacacacactggcaac

SEQ ID NO: 21453 - DNA, 197 bp, Gossypium hirsutum
  Clone ID: uC-gsflnu33B068f07b1
gtgccacaaccatattattttggaccactggcgcacatttgatgaccttttcagtggagcatgcctccaccatggaaagatcagttggaggtttccaaattcctgcaggttccctgactgttttctttgtggcagctatattgatcactctttctgttaatgaccgtctagttatgccattttgtaacacctggact

SEQ ID NO: 21454 - DNA, 605 bp, Gossypium hirsutum
  unsure (1)..(605): unsure at all n locations
  Clone ID: uC-gsflnu33B071a05b1
tttcggaaccaagttaaaaccaacggatcccaagcaccagccgtacagattcgagtcagtcttaacggtgctgaataacggcgacgagaagcttaaatcgtggagggttttcgtggggtttaaaaacgacgagtatttagtttcagcgtcgaatgcggttttggctgatgggacgagcttgcctgccaatgttgggaacggtaccgtttttgctgggtaccccatgactgatctgaaaacagcgattgagactgccggagatttgaatcagattcaagttcaagttaagcttcttgggactcagtttggagtggcggctcctagtgttcccttgcctgaaactattcatcttgctaatgatggcttcctttgtcctaagccttctttgcaaggtaaaagtgagatgcaagtttgttgcaccaaagacccgaaattcaagacgaatgttacggtagaggatgagttcctaccttcgcaagtggtgatcttacattatgtatgatgtgacgagaacgtacgactcgaactattgngcacaggttactatctcaaccataacccccttggcgactgataatggaaatgagtttgatggatgagggatg

SEQ ID NO: 21455 - DNA, 445 bp, Gossypium hirsutum
  Clone ID: uC-gsflnu33B071e11b1
tcggtttaccctaggtgttgttgtcttttgtttattcttgcaacttgcagtacatagagttggatggaacttcgaggctttgaaagatattatgcattattactcactaatgtggacagggtttgtcccaaattgaactttttgcacattctgggctatgtaattgatggagtggttctctagtacttttgtgtcactggtactgtgccaagctttggcttgatgccactggagatgagatgcccgctctatcaattcttttacctcctctcctatttagtcttaaatttgtgttatttcatttgatcaaaaaaaaaaaaaaaaaaaaaaaaaaaaaaaaaaaaaaaaaaaaaaaaaataaaaaaaaaaaaaaaaaaaaaaaaaataaaaaaaaaaaaaaataataaataaaataacctaaaggggggggcccgttttagaggtt

SEQ ID NO: 21456 - DNA, 638 bp, Gossypium hirsutum
  Clone ID: uC-gsflnu33B071f07b1
tttattatgattacagtgtaatgatgccgggaaaggagagcccggttgacgcttcaagaggggaccaaggcaagggtttctatacacgtagcgggaggcgttacgatacggcgaatgatgaggtggcaacagctcaccgctcagagacgcgggagaagaagggattgatggattggatcaaagacaaactcccatgacagcataggatagatgaggaggacaccacacaaccaccagatgatgttgtcctaattgagaacgaccaccatgaaggagagacaagacagaagaagggattgttggtgagaatcaaggagaagattcctggttaccactccaatacagaggacgagacgggaaaggagaccactgctctgaattaatgaatcgatataatgcattgcatgtcaaggatgtgaagagtatgggtggtgtatcaattagatggaacggaacggtctgtgctttgtttttggggtggcgtacattacataaatttctggggtgggtatgctgcttggagggtagaaagaaaagaaagaaagagaaaggagggttttaatgtattgaaggcacgttattaaataaaaaggaaggactgttttcctttaaataaaaaaaaaaaaataaaaaggagg

SEQ ID NO: 21457 - DNA, 551 bp, Gossypium hirsutum
  unsure (1)..(551): unsure at all n locations
  Clone ID: uC-gsflnu33B071g03b1
ggagagccttttttttgtgtagcgattctcagttagtcttttctttaagcttacagcttctctccagagttttataatgggtaaggagaaggttcacatcaaccttgttgtcattggccatgtcgactctggcaagtcgaccactactggtcatttgatctacaagctaggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactttatcaagaacatgattaccggtacctcacaggctgactgtgctgttctcattattgactcaaccactggtgggtctgaagctggtatctctaaagatggtcagactcgtgagcatgctttgcttgctttaccctcngtgttaggcagatgattngctgctgcaacaagatggatnngcacac

SEQ ID NO: 21458 - DNA, 588 bp, Gossypium hirsutum
  unsure (1)..(588): unsure at all n locations
  Clone ID: uC-gsflnu33B071h02b1
ttcacgcgtccggccacgcgtccgcccacgcgtccgatcgagttctttgtttaagaataaggatcttttaagatacgccggatccgctaaaatacgccgatccccgtccgtcttccgatcatatggggctgcttgaccagttgtgggatgataccgttgctggtccccgacccgataatggccttggcaagctccgaaagcactccactttcactttccggcctaactctgccaaggaatctgatggcgggagtgtaagatcgtacggtgatgaagcgccggaggaagcgacgagagtgacacgtagtattatgatcgttaagccgcctggttaccagagcggatcgtctccggtttcgccggccggatcgacccctccggtatctcctttttccggaggcagagaatcatatcggtttcggagaaggtccacatcggatgcatacgagaaggctaacgaggttggaccaaggagcccttgtcctcctccttacgacgtgtgagatatgagtcctctccatatttggcgacanatcaaatgggtttcgtactggttgcatgctaggtctttcaatgtgtaacttatag

SEQ ID NO: 21459 - DNA, 431 bp, Gossypium hirsutum
  Clone ID: uC-gsflnu33B071h10b1
tttcccacgcgtccggacaaatctggtgaatttgtagctgttgatcccttgcctggcagcctccttgtcaatcttggggatatggccacggtatggagcaatggaaggttacacacggtgaagcatagagtgcaatgcaaggaggcgaaaactagagtgtcgatcgccacgttcctcttgggaccgaaagaggaagcggtggatccgccaccggagctggtggattcggaccatccgcggctttacaactcgttcacgtacgaggagtacaggaagctgcggctgtcgacggaattgcaagctggtgaggctcttgcacttgtacatacctgatcttaaagaaagattgtgtaaagcatattgcaatgtaatgaaagtcctccacttctgccctttgtttgatgaataaagcatgaatttaaatttcctag

SEQ ID NO: 21460 - DNA, 327 bp, Gossypium hirsutum
  Clone ID: uC-gsflnu33B072g01b1
gttttggatgacaaaactggttatagctactcatttgaagcattcgaagcattcaatgccctaaatgatccccgtgctgtatatagcctcaagtatatgctggtgggcaagataatggagagccaggccgatgatgatgctagtataatatcatccacggcagggctacagaatgtgaggaccgatcttgatgctatgaaagctgatgctgatgcccatgccaaacgttacctgaagcttatagagattgctcttcgtgattgcaaggctcaactagaggaagacccaattgtttacaggcgccgtttttccctatatgacacttta

SEQ ID NO: 21461 - DNA, 351 bp, Gossypium hirsutum
  Clone ID: uC-gsflnu33B074c02b1
tgaagaaaatggccaagagccaagactatttctttaaggagttctcaagggccattactctcctctctgagaacaatcctctcactggtagcaagggtgagatcaggaagcaatgcaatcttgcaaacaagcttcactaaaatgcctcgccaaagagaaagccgagtgtggccgaataaaatgtttgtttactcagtttcttttccaagagacgagtttgttaatgtgcaggtgagtaatggtgcaatggtactggtttgtaacgatcgatccattgcatttttcttttagcataagccaggttgccttctcttgatgttggtcatgggcttggtggatgtagggatggat

SEQ ID NO: 21462 - DNA, 499 bp, Gossypium hirsutum
  Clone ID: uC-gsflnu33B075d09b1
tcgttcagaaatggggtcccaaactcctctaaagctcccagtcattgatttcagtaagccagacctaaaagcaggcagcaatgagtgggatttggtgaaagggcaagtccagcaagcacttcaagagtacggttgcttcgaggctttgttcgacaagatccctctccaccttcgagaggcaatattcggatccttgcaagagcttttcgatctccctttacaagccaaaattcggaatgtttccaataagccttatcatggttacgtcggccaataccctcaagtcccattatatgaaagcatgggcgttgatgatgcaaacattactgaaaaagttgaagccctgactactaccttatggcctcaagggaattcaagtttcagcaacactatacaatctttctcagaacaattatcggagttagatcaaattgttagaagaatgatattggagagttttgatcttgaaaaaaatatggatgaacacatgggttcaacc

SEQ ID NO: 21463 - DNA, 520 bp, Gossypium hirsutum
  Clone ID: uC-gsflnu33B078e04b1
tttccttttccaatctccagctcccaaggtaaatatgccgatcagaaacatagcagttggccggcccgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaggtggccacgtcaaccccgccgtcaccttcggtgctttcgttggcgggaacatcactctcttgcgcggcattctttactggatcgcccaactcctaggctcaaccgtcgcttgcctgttgcttaagttcgctaccggcgacctggctgtaccagcttttggattgtcatcaggtgtgggcgtgtctaacgcattggttttcgaaatcgtgatgaccttcggattggtgtacacagtgtacgccaca

SEQ ID NO: 21464 - DNA, 545 bp, Gossypium hirsutum
  unsure (1)..(545): unsure at all n locations
  Clone ID: uC-gsflnu33B078e12b1
tgtcacgcgtccgcccacgcgtccgtgagttttgaatctagggatttgcgggtggagaagacgagagctcatctctctgcttcaaagctcctgtccaggtagaattctcttcttcctttgcgttgtgttctttgttgttcagtcgccatggcttcaaagcggattttgaaggaactcaaggatttgcagaaagatccacccacttcttgcagtgctggtccagtagctgaagacatgtttcattggcaagcaacaatcatgggaccctcagatagcccttatgctggaggtgtgtttttagttaccatccatttccctccagattatcctttcaagcctcctaaggtcacgtttaggaccaagggtcttcatcctaacatcaacagcaatggaagcatttgtcttgatatcctcaaagaacaatggagccctgcactaaccatttccaaggttctgctctcaatctgctcgttgctgaccgatccataccctgatgaccctcttgtccngagatngctcacatgtataaaactgatcggccaagt

SEQ ID NO: 21465 - DNA, 433 bp, Gossypium hirsutum
  Clone ID: uC-gsflnu33B079a04b1
ctccccttcaaaaaaaaaaaaactaaaaatccagcagtgtggtgcagggaaacagaacacaaaatggcgacagttccaggacagttgatttgggaggtagtgaagaagaacaattgttttttggtgaaacaatttggaagaggaactgctggcgttcgattcagcaaagagcccaacaatctctacaatgtcaactcttacaaacactctggtttggcaaacaagaaaactgtcaccattcaacctgcaggcaaagaccagtctgtactcttagccacaaccaagtctaagaaacagaacaagccttcgagcttgctccataagtctgtcatgaaaaaggagttccctaggatggccaaggcagtcaaaaaccaggtgacagacaactactacaggccggatttaacaaaagctgccttagcaaggttgagtg

SEQ ID NO: 21466 - DNA, 366 bp, Gossypium hirsutum
  Clone ID: uC-gsflnu33B079h09b1
taggcctgcctggcagggatagacctttggaggatactgttgcgaatttatcgagagctgaccgttacgatgaatgttattaatgatgtggtccgctcattcgtagctaatcatctaactgggcgagtcaggaatgccactatgggtaaatacccggtaaatggaaaaaggcaaggaggctgttgaaatcattgagcgcatgaccatagtaccctaagagcattggttggatatccaatcattactatggtgtagatgttcaacctcctaccttgatccagaaaatagagatgatgtattatcctacaccaacatggagcccttgccaagaaagcggtttgacatactaaaattggaaggatgcaa

SEQ ID NO: 21467 - DNA, 374 bp, Gossypium hirsutum
  unsure (1)..(374): unsure at all n locations
  Clone ID: uC-gsflnu33B080h02b1
ttaccggttcgacccacgcgcccgactanacttccgcacacgcgaccgcgcggagggagggccttttgaaggcttttttccattggccaaaccttccgcgcgctggcttctccttgccctcattgccggttgtgctctcggccaagctcccagctgcgctccaaccatgtcaccgccgtcttcttctccgaaaccagctcccaagatctctccgaccaccgatcccaccgttactccaacagctactccgactttaaccgccactcctccatgttcagcccctgaatcttctccaactttcctctcctgctgctcctcccaacctgtccactggttctcccggcgctacttctcctaccaacctccttaagtca

SEQ ID NO: 21468 - DNA, 371 bp, Gossypium hirsutum
  Clone ID: uC-gsflnu33B084c02b1
ttttatgcgtacgtggagaatgcaagagagttagcagctaaacttctcaatcaatgcctgttggacaataatgacaatcaatatctttggatgcttgtggaacatgccttggagcttcctctacattggaggatcccaaggtttgaagctggatggttcatagatgtgtatgagaaaaacaaggaaaaaaattccattcttttagagcttgctatattggattacaacatattgcaatctatacaccaggatgatcttagatatgtttttgcatggcggaaggaacatggctttgacaagaggatgagctttgcctagagataggctaatggaaaactttttatggagtgtgggaatgataattagtcctc

SEQ ID NO: 21469 - DNA, 486 bp, Gossypium hirsutum
  Clone ID: uC-gsflnu33B084c10b1
ttcacgcgtccggcggcgactacaacagtatcaaaaccctaagctttcaacaatggcggatgtggaggcagaggtggcggcggccggagtgcctaagaagagaacattcaagaaatttagcttcagaggcgttgatttggatgctcttcttgatatgtccaccgatgagcttgtcaagctcttccccgcgcgtgctcgtagaaggttccaaaggggtctcaagagaaagcccatggcattaattaagaaactccgcaaggcgaaaagggaggccccaccgggtgagaaaccagaaccagtcagaacccacctgcggaatatgatcattgtacccgaaatgattggaagcattatcggtgtgtacaatggcaaggcattcaaccaggttgaaatcaagcctgaaatgatcagccattaccttgccgagttctccatttcgtacaagccagttaagcatggtagaccctgtattggtgctacccattc

SEQ ID NO: 21470 - DNA, 242 bp, Gossypium hirsutum
  Clone ID: uC-gsflnu33B084d06b1
cccacgcgtccgcggacgcgtgggtttgtgcctgatataaatggtgttggattgtttatcatgtttggtacggataccaaaaaaaaaaaaaaccaccagaaatagttgtttgttgtgctatgttaaaactgttcctcttcgggttaagaaaccgtcacgttattatattgatatttataaaaataaaatataaataaactcgacacacttggctctttgttttcaaaaaaaaaaaacaaaaa

SEQ ID NO: 21471 - DNA, 579 bp, Gossypium hirsutum
  unsure (1)..(579): unsure at all n locations
  Clone ID: uC-gsflnu33B085f09b1
tgtgaaagcacaaccatagaagtattgtacctgttgacacactcccaagaaccttttccggctgagatagcccaatcagaatctcaattagtatattatcgtgatagtgcattgatattgtcaccatatcatattaagcaacaagcgacttttattaagacaccaagtactaaagtggaatcattcacaagggtggaacccagtaatcgtgcaggcactgaaataaagtatgggccatatgaggatcatcctccatactctttttctccaattcttatacattttgagaacaatagcccatttgctgttgttgaggagcttgttcgtgaagttgagatatctcattggggcaaccttcaggtcacagagcagtacacattggttcatgccggtgcccggcacaaaggtgtattttcaagggttgattaccaatccaggccaactttgaatggtgcatcctcactgaggtaccttctggcaagactacctcctagggttcattctgtctactaccgtgatgaaataggaaacatctcgtcctcacacctgcgtacttgattccgtangtctgaactggaa

SEQ ID NO: 21472 - DNA, 551 bp, Gossypium hirsutum
  unsure (1)..(551): unsure at all n locations
  Clone ID: uC-gsflnu33B085g05b1
ttttactttacaacatgacacacatgaaggtgcactagatatatttatgaggacattctgtgcataaatataaaaatgctctgtgtgctttgcatttctgctgtttataataggtaataaagcagttgagctgctgtaggtagcatgggagcatgaacagttctcaaggctgagagtcactgctgccactctttctgaactttctgtcacaccagaactcctagaaagcactggtggtctgtttgataccagacaatacgtaaatgaaactgctattgttagaggtgtgaagctagttgctgaaagtcttgcgaggcatatctatggccatcagggaaaaaatatccaaatttttgcagatgagagcagtttggctgtcaatcctgcctatatacgatcttggctggatgttttatcacanacacctcgagtagctccatttctttcaaaggatgacccttctgtcatggcattgaaaaaggagttagctggtcatgttgatgaagtgaatgtgcaacatgagactcttgaagggtttttacttttatgat

SEQ ID NO: 21473 - DNA, 528 bp, Gossypium hirsutum
  unsure (1)..(528): unsure at all n locations
  Clone ID: uC-gsflnu33B085g12b1
ctaaaaaccactcgttttagcagttaaagatgataaacatgtggatcaagaaccccagtctgaaactccccttcttgctttacaagtaaccaacaacaacagtaagggttgtcaagtgaacaagggtaataagattcacgagtgttcaatctgtgggtcggaattctcgtcgggtcaagcccttggaggtcacatgagacggcacagggcagcagctgccaccaccgcaagcaatcaagttgtggtgagcgttggcaatggcgatggcattaaacccagaaatattctatctttggatcttaatcttcctgcaccagaagatgatctaagggattccaagttccaattcggagcaccccaacaagctattgttttctccacaccagctttggtagattgccattactaaccccccccccccaaaaaaaaaaccagtatatggatcaatcaatgtgaattataattgatattgtttcaacccaatattatttacagttttattattctttgaatnggtggttccttttt

SEQ ID NO: 21474 - DNA, 380 bp, Gossypium hirsutum
  Clone ID: uC-gsflnu33B088d12b1
tggtttctaggtactatacatttccctccagattatcctttcaagcctactaagggtgcctttaggaccaaggtcttacatcccaacatcaacagcactggaagcatttgtcaagatatcctcaaagaacaatggagccctgcactaaccatttccacgggtctgctttaaatctgctcgtggctgacccatccaaaccctgatgaccttattgctacggagattgctcacatgtataagaccgatcgggccatgtttgaagccactgctgcgatctggaccgagaattattccaagggacgacagtggtatggtgtgctatacactatcaaattttgtatgacttgcgttaaggaaggaggtgtcgtaacttgaaagca

SEQ ID NO: 21475 - DNA, 373 bp, Gossypium hirsutum
  Clone ID: uC-gsflnu33B088f04b1
actcgtgtccataaaccctgaagaaatttctcgcaaatccgaggtcaaaatttagagattgcgaccatgatcagcattcttgctgaggcaagcgatcggtttaacatcaattgccagatcgagcatctcctagccaaacactgtggaactggacatgctgagcttaacagattagaatgggcgggtaacattgaacgctatagatacgcatcatatatagggccttacccgacggtggcttactccgctggggcaaagaaagaatccatgggaagagagagttacatctgcatgcagaaaaggctcacgccttgaggcctgcctacagaaagagaacatgattacgaactgctggtcgggctgccaagtgtaa

SEQ ID NO: 21476 - DNA, 138 bp, Gossypium hirsutum
  Clone ID: uC-gsflnu33B090a12b1
tctgcatttttatcggttcacgttttcatgaaattgactgcatctataaactgggtttctcttttccttttttgggattaaattggcttagtttctttattttccttaatgtcaatcttgggttgctagaagcctgga

SEQ ID NO: 21477 - DNA, 440 bp, Gossypium hirsutum
  Clone ID: uC-gsflnu33B092c12b1
ctcactcgtgcgcccacgcgtccgcaattatctcacacccttcatggttgaacgtctggagaaacttattcaagagaaattggaaaactctggattaacatttaaattgtactctaaaacttcaaaagagattagcttctacatgaaccaagatggcctcatctttgccggcaagcaggatcgaggacagccgcaccttagccgactacaacattcagaaggaatccaccctccatctcgtgctccgtcttaggggaggtgctaagaagagaaagaagaagacctacaccaagcccaagaagatcaagcacaagaagaagaaggtcaagctcgctgtgctacagttctacaaggtggatgaatcgggtaaggttcataggctttcgaaagaatgccctaatgctgattgtggcgctggaacttttcatggttaccttttt

SEQ ID NO: 21478 - DNA, 337 bp, Gossypium hirsutum
  Clone ID: uC-gsflnu33B092d08b1
ttcactcgtccgccaggaggtcatcctcggatatcgaaaagctcgacaatcaaccccttgctcctcttgcttctaatgaagtgcaagaaataaaatcagtcaagtcctcctcttcatttgatagccaggcacttgatacacccatttcaataagccttcgaccccctcctattgaccgtcacaaatcattcgatgatgaagagttttctaaaaagcctgttgttgttaagaaagctgtaccggctcctacaaatgctacatcatattcgatagcagacctccagatagctactggcagttttcagtgttgaaaatcttcttggcgaagggtcatttg

SEQ ID NO: 21479 - DNA, 96 bp, Gossypium hirsutum
  Clone ID: uC-gsflnu33B092e04b1
gggcgatacagcaaaactccaacaaaccccgacttgaggctgacatgcaaatattaccagtcaaacgaccacacaggggcgaacgactaatcaaac

SEQ ID NO: 21480 - DNA, 276 bp, Gossypium hirsutum
  Clone ID: uC-gsflnu33B094g07b1
tccacgcgtccgatagtgttcacttttaaggggaatcttgtgctaactttttgttctactactaaacctttgtatcaggttttggaattaagcaagaaataataatacttaacctcttaaacaaaactactttcattttgcaccaatcacaatgtatttggaactataaacattgcttttggaaattaattattttactctctgaccatatcattacacaaaataaaagaatttaacaaaataaatctttttttcagttggtttattattaaaaag

SEQ ID NO: 21481 - DNA, 182 bp, Gossypium hirsutum
  Clone ID: uC-gsflnu33B094h03b1
cacgcctgcggtaaaatactaaagacaaactaggccgactagggggttaattagtgccacggcacagtggacaagacttccagcaatgggagctgactgaaagctgagaactcaacacctaaagcaaaggatgggctgcaagtcatataagatgtcaaaatctcggaaatgaatggaagaaa

SEQ ID NO: 21482 - DNA, 162 bp, Gossypium hirsutum
  Clone ID: uC-gsflnu33B095c11b1
tctacgcttccgaaaaaatattacgtttgggaagcgagaaagtgcaagaaaatgagcggagcaggaaagaaagtagtatatgtggctttcaaagcaggaaagagctttgattgggaaggtattgagactatcgtttagtctgtttttgcctgtattgttttt

SEQ ID NO: 21483 - DNA, 118 bp, Gossypium hirsutum
  Clone ID: uC-gsflnu33B098a08b1
tgagagagttaaaacccgagatccgatactaattccctaccaaagttgattagaaagagtgagggaagaatagcgtaacagatacttagtaaaaacctatgttagaacaaacacatta

SEQ ID NO: 21484 - DNA, 265 bp, Gossypium hirsutum
  Clone ID: uC-gsflnu33B098b04b1
actacgcgtccgagtttgtgggagcaaaagagaggagatttataaaaaaatactccgcaataccccacaaggatgagggaacggaaacaacttagtgcaagtgttgagagaattggaagtgatggacttacaatacatgaagaacttatcgtacagtataaaataatagatgacttgggctcaaataaaataatctcaacaaactcgactggacttaatacccaaaacagtggctacggcactcaataaataaacttataagggc

SEQ ID NO: 21485 - DNA, 86 bp, Gossypium hirsutum
  Clone ID: uC-gsflnu33B099e10b1
ttcgttccttgcatcttccgaagaaatgaatgcgtctctgagaggaagacacgcaaactgcaagagcactgtcgccgattatgcag

SEQ ID NO: 21486 - DNA, 461 bp, Gossypium hirsutum
  Clone ID: uC-gsflnu33B100g10b1
tcgttcaactctacaacgccaaattcaagtttaccaaccttattgtttatttgttcgagacttggcgagtttttttgaatccccatggcttcaaagcggattaataaggagtcgaaagatctgcagaaggaccctcctgcatcttgcagtgctggccctgttggtgacgatatgttccactggcaagcaacaattatgggcccagcagacagtccttttgctggaggactatttcttgtttccattcacttccccccagactatccattcaagcctcccaaggtttctttccgaacaaaggctgtccatccaaacatcaacagcaatggaagcatttggcttgacattctcaaggagcagtggagccctggccttaccatattcgaggtgctgctttcaatatgctcacttctcacagatccaaatcctgatgacctttggtgcctgagattgctcacatg

SEQ ID NO: 21487 - DNA, 434 bp, Gossypium hirsutum
  Clone ID: uC-gsflnu33B107b12b1
tctttctaacccttttctcctgcactctcactgttgaatttcccggtggtggcttgttgtaacttgacttgctttttgttgtttttatggagttttagcaactctctgtcaaataacattgttaatttatatattctttcaaagcaaagatgggagaaatgtcaagcttccaattgggagttataggggccctgtttctttctgttgcatcatctgtctctattgtcatatgcaacaaagctttgatgagcaatcttggcttcccctttgctaccacactcactagttggcatctcatggtaacattttgcaccctttatgctgcccaaagattcaatctgtttgagaataaatcaattgacatcaagactgtgatgctttttggcattctcaatggtgtttctattggatttcttaacttgagccttggattt

SEQ ID NO: 21488 - DNA, 501 bp, Gossypium hirsutum
  unsure (1)..(501): unsure at all n locations
  Clone ID: uC-gsflnu33B108b09b1
tttccacgcgtccgatcggaatcaatggatttggaaggatcgggcgtttggttgcgagagttgctctccaaagcgatgatattgagctcgttgctgttaacgatcctttcatcaccactgaatacatgacctacatgtttaagtacgacagtgttcacggtcaatggaagcatcatgagcttaaggtgaaggactcaaagacccttctctttggtgaaaagcctgtcacagttttcggtatcagaaaccctgaggaaatcccatgggctgaggctggagctgagtatgttgttgagtctactggtgtttttactgacaaggacaaggctgctgctcacttgaagggtggcgcgaagaaggttatcatttctgctcccagtaaggatgctcccatgtttgtgnnggggtgtcaatgagaaggaatataagcctgaccttaacattgtctccaatgctagttgcaccaccaactgtcttgccccattggctaaggtgatcaac

SEQ ID NO: 21489 - DNA, 447 bp, Gossypium hirsutum
  Clone ID: uC-gsflnu33B109e07b1
tttcccacgctttcggtcagtgaagatgacctttgagggaccagagatgagcactactgaatcaggacatggatgcaagtgaggatcaaactgctcttgtgatccatgcaactgttgaaaagcttgatgaaagccctagattatgaaaaaagaaagcagcaaaataacaggcctctgtaatgatttattttcaaggatgaatgcctgcaaggtctatgactataattatgtctctgtctgagtcttgtgtaatagaagctttgtttgtggtgaaaataatgtataagccagttggttgggagcaaatttttcttttgtccaaaggattttttgctgctcattcatggtgacttggtttatggctttatctgttgttaaaatcttataaaaatatatatcgattgctgcttataaataaaaaatttgaaagccactctttacttatat

SEQ ID NO: 21490 - DNA, 351 bp, Gossypium hirsutum
  Clone ID: uC-gsflnu33B112e03b1
tgattttgcacgactctataaaggggcaattggacacatgggttacgaagtaaagagatccacatccaatgtggaggatcataaggagctggttacagctgatgaggtattgtaggactatgtctactacatggagatcgcgaatggagtgtagtggaaaggtgctggactgcgaggcaggtgataggaagcgaggcatatgacagatgcttaggggaatcaacccatttgctgagggggcagctgcggagtaggtgatgacgataatgtgaagacaggaggggagatttggagcgcttttgcactccaagagttgcttgcatgtgccaaggtgccggctgtgacatggat

SEQ ID NO: 21491 - DNA, 54 bp, Gossypium hirsutum
  Clone ID: uC-gsflnu33B114a04b1
ctctaaaatttaaaaactaaaaaaaaaaaaaaaaaaaacatgaaaaaaaataaa

SEQ ID NO: 21492 - DNA, 476 bp, Gossypium hirsutum
  Clone ID: uC-gsflnu33B126g01b1
tttcattcgtccgcttgggtattgcatgggctttcggtggcatgatctttatccttgtttactgcactgccggtatctcaggtggacacattaaccctgcggtgacttttgggttgcttttggcccgtaaagtatctctcatcagggctgtggcttacatggtgtcacagtgcttgggtgctatatgtggagttgggttggttaaagctttcatgaagcatccatacaactcccttggcggtggtgcaaacacggtggcttctggctacaacaacggaactgctttgggagctgagattattggaactttcgtacttgtctacactgttttctcagccaccgacctcaagagaagtgctcgtgactcccacgtccctgtattggctccccttccaatagggttcgcagtgttcatggttcacttggctaccatccccattaccggtactggaataaccctgcaggagtttcgtgct

SEQ ID NO: 21493 - DNA, 472 bp, Gossypium hirsutum
  Clone ID: uC-gsflnu33B126h04b1
gcgttctttttacgtatagctctggttccacgcttggagtgagccgacaattctggttcccaagtgggtaacgcagattggcgaataccaatcgagtctcttctttgcggatcgttcaggacagcattatcagcgatgtctatcactgggtgtcgataatcttgctgttcttgatggatagactcctattcaagtataccagggcttctgctagagctttaagaccacattctcacctttcatgggttctaccatcaccggcatttcaatgggtctcggaccagatggtgagctccggtctgcctcacaccacaagcctgacgagagtggaccgattactggtggctgggagtgccaatgtgatgacacatacatgcttaaccttcttaagcaatatgctgaatcgaatggaaacccattatggggtctaggtggtccacatgatgcccctacttatgagcaggtaccgtac

SEQ ID NO: 21494 - DNA, 262 bp, Gossypium hirsutum
  Clone ID: uC-gsflnu33B129a04b1
ttctgttcctgctgctacgcgactctctatggtatattggagaatgggatacgtttcgtgcctttcctttatgctaatgttataatttccactctcatgatcacttgctcttgttcacggggaattagatcaccccatcttaattattgccaaataatgcaagtgttatccaccaataacttatgcagtttaggttgctgctaaaatttctttagcaagggtcgcttggatcacgtgcctctccatctactcaaagattgcg

SEQ ID NO: 21495 - DNA, 539 bp, Gossypium hirsutum
  Clone ID: uC-gsflnu33B129f01b1
tttatctatctacaggcagattgaaattagagtaattgagaaaaacgcaatggctcaaaagatgttgatgatggcggcccttgtgatattggggacgaagatagcgacatttacggctgcggatccgacttgtttgcagagcttgatgtcttgtgctccttacttcaacaacgccactctccaactgaaaggcgattgctgtaaccctctcagacaagccgtcgctactgaacttacttgcctttgcagcctcattaataactctactttgcttagttctttcaacatcaacatccccatccctgcagctcttaggatcactcgtggctgcggtgtcactgataagatgaacggctgcatccccgctactctcacccctgctccttccccatcagctacttctcccaaggctgctccactcatcaccaggaggtgaaagtggaggtgtccacaagataacttcgaccagaatcatcacttttgttgtttttttttttaagcatctatagctctgtactatggcgacatgtttcctacat

SEQ ID NO: 21496 - DNA, 540 bp, Gossypium hirsutum
  Clone ID: uC-gsflnu33B129f07b1
tctttttaaaatgatgtcatcccttgatgaagttaataccatcgtgaagggggctcgatcagatgtgtcaaaagttgccaacgctgatgagttcgaatacaaggatcctgttgatggttcagtttcaaagcatcaaggtattcggtttttgttcgaggacggatcacgattggtcttccgtctctctggaactggttcagaaggtgcaactatccgtctgtacatcgagcaatatgaaaaggatccatcaaaaataggaagagattcccaagaagctcttgcccctcttgtggaagctgctctaaaacttttgaagatgcaggagttcaccggccgatccgcaccaactgttatcacatagattcattctgctacacgttaaggtgtgttttgatttaattttgaggcaaagaaaacatacattaaagtcctcataagatacgctatatatatatctatgtcagtgtgcatccttgccatgagtacttgagaatgcaaaaggccataatgctaactcattaaaattttggcaattttatt

SEQ ID NO: 21497 - DNA, 441 bp, Gossypium hirsutum
  Clone ID: uC-gsflnu33B129f09b1
tcgtttagcccttcgctggggacggctaatactctgacgaacataactaataaaaggtggatgcacacactgtctccctggctatagtaggtcactactacttcacattcgatgctaaccactgctgtatagccaagctagagcagaaacgaatcatgaagagcttagtgggtaaaaagatcctagggtgtcaaagtaatgtcggtaatataacgagcctgcatttacagcagtgcaagcgcagtattaccaccgttgattgccagccagcggtcgctggcggcgatctagtattcgtatctagacactacaactctgtgtggaacaacatgctctcaagtttagccagatgattgatttgatgccaacaacacaaggaagctactatgtgttgaatgacatattcaggctaatctactcgtgaagaaacagaaatcacta

SEQ ID NO: 21498 - DNA, 437 bp, Gossypium hirsutum
  Clone ID: uC-gsflnu33B130c10b1
ttccacgcgtccggaagtcatcatgtgtttatcgtactgtatgcatagatgttaaaattttttaagaggaaggaaaccttctgattttgggttgtgctttaccaattcttgcatgcatgataggttttgagagattgatgatttgatatgtatagttatctttcttttagctcaagaagctaacgagggtcccaacgataaaggcaaatgatttgctatgtagatttgtactagagtttctagtgagtttattattacttccatgtgttgtaaagtccatttttatataaattatgtaaggtaagtaatcttcctcagtaatgtatgaatggtgtatgtgtgggtaatggtcgtccagtgtaatcagcctgagttctgtctttttgtgttcaatctgtccgtgtgggtaatggtgtatgtgtaagatatgatctata

SEQ ID NO: 21499 - DNA, 113 bp, Gossypium hirsutum
  Clone ID: uC-gsflnu33B132e09b1
tccacacgtgcgatcaggcgaactatggagcggcctcttaaaggggattatcataattatcccccctattcaaaaaaattaataatgttgcgggggggttactataaattcat

SEQ ID NO: 21500 - DNA, 241 bp, Gossypium hirsutum
  Clone ID: uC-gsflnu33B133h07b1
taaatggagttaaaaatggcttgtcctccaactcacaaagtggtaaaaggtgagcttaagaatggttctgatgactgccttgcgagcttgatgtattcgaattaccaaggtgctccagaaacgattaaaaaagattcattacccactccatttgcgcagaatatgctagtcgacggtctgtacggaggcctggtgtatgatgttgttagggttaagaggattattctttggaccactgatt

SEQ ID NO: 21501 - DNA, 99 bp, Gossypium hirsutum
  Clone ID: uC-gsflnu33B135f07b1
tcgccttctcgtccggccacacgtccacttgggctggcctcacttacagggcggtcgagagcagcaccaagccacacacgcagactgtcgctgaccacg

SEQ ID NO: 21502 - DNA, 445 bp, Gossypium hirsutum
  Clone ID: uC-gsflnu33B137b08b1
ttccacgcgtccgcccacgcgtccgctctcagacaagccgtcgctactgaacttacttgcctttgcagcctcattaataactctactttgcttagttctttcaacatcaacatccccatccctgcagctcttaggatcactcgtggctgcggtgtcactgataagatgaacggctgcatccccgctactctcacccctgctccttccccatcagctacttctcccaaggctgctccactcatcaccaggaggtgaaagtggaggtgtccacaagataacttcgaccagaatcatcactttgttgttttttttttttaagcatctatagctctgtactatggtgacatgtttcctacatgagttgaggggtgatttcatctcataataaataataaataataaagagagcatttcgagtttaaaaaaatcacccaccaattaccgg

SEQ ID NO: 21503 - DNA, 426 bp, Gossypium hirsutum
  Clone ID: uC-gsflnu33B140b04b1
tttaaaattttctcccgtgaaacccctaattttcccccctaaaatcatttttttcccttcatcttaacccatttcaactttccttccttcgttgatttttatgtgttttttattttaaatctctctgcaacatatatcagttaaagcttcaacctttatacccaaatacaagattttgagtttaaaaaagcatcagtctttgttcttttgtgtataaatcacgagatttgtttagtttctaagaaaatattttattcgtgtttggaagattttcttcaccattttagagggtgactttgtttttcttttctttgacgctctataaagtcttaattccacctcttcgtttcattttcccgagaaaatgctggacttgaaggataatcccaagttggatttggcatcttccaatgagatgtccacaca

SEQ ID NO: 21504 - DNA, 214 bp, Gossypium hirsutum
  unsure (1)..(214): unsure at all n locations
  Clone ID: uC-gsflnu33B141a10b1
ccacgcgnncttcacgcgtccgcccaaaaccccataccgcgtngtgttttatagcaaagttgtgtttctctcccagnnacctnctctaggatcgttcaagcttcgatcccgaaccgattcacgagtgccattgtcaaggccccgacttctcttggatcttttaagatcattttcaaacctttttggcttgaagtgttcatgtcatcacaatatc

SEQ ID NO: 21505 - DNA, 465 bp, Gossypium hirsutum
  Clone ID: uC-gsflnu33B142d09b1
tcccacgcgtccgcccacgcgtccgctgggctgttttaggagcagagggattaaggataaaagcatcgtcgtgttctcgcttcttcaactctgtctctacgtctctgaacctcctcctttcgttcttttcttattcagtattgtaaaagatggccgatgctgaggatattcaacccctcgtctgtgacaatggaactggaatggtgaaggctggttttgctggtgatgatgctcccagggctgtttttcccagtattgttggtcgaccccgacacactggtgtcatggttgggatgggtcagaaggatgcctatgtaggagatgaagcacaatccaaaagaggtattcttactttgaaatattccattgagcatgggatccgcagcaactgggatgatatggaaaagatcttgccatatacattctacaatgagctccgtgttgctcctgaggagcaccctgttc

SEQ ID NO: 21506 - DNA, 380 bp, Gossypium hirsutum
  unsure (1)..(380): unsure at all n locations
  Clone ID: uC-gsflnu33B143g09b1
tgtcacgcgtccgctcccaagaaagcatttggatatcagcaacagtattactcacaaggtagacaagcatcgaatggtgctgtggaacaaggtcttcattctcataatgactcgaacaatgctactatttttgttggaggacttgactcggatgttagtgatgatgatcttagacaacccttttcccagtttggtgagatcatctctgtgaaaataccgcctggaaaagggatgtgggtttgtgctatttgcaaacaggaaggacgctgaggaagcaatccagagcttgaacggaacaaccataggcaagcagaccgtccgactttcttgggtncgaagtattggaaacaaacagcggagagctgattctggaaaccagt

SEQ ID NO: 21507 - DNA, 393 bp, Gossypium hirsutum
  Clone ID: uC-gsflnu33B145e10b1
ttatcggttcaggaaaatgtggctgcggcgctgattgcaagtgtggcagtggctgtaacggatgcagtatgttccctgacataatagagaagactacaactgagactattgttcttggtgtggcaactcagaaaatgcactttgagggatctgagatgggagttggggttgagggtggatgcccgtgtggagacaactgcaaatgcaacccttgcacttgcgggaagtgaacaacaaagagaagcagagtggcctttgtcattttaactaaataaattctattactttagtatgtatcagcaaatcttcatgaggatatggttcttaattatgtgtaatgtggcttttctgctatgtcagaatgtattatgatatttaagaaagtttgttttc

SEQ ID NO: 21508 - DNA, 388 bp, Gossypium hirsutum
  Clone ID: LIB3272-033-P1-K1-A5
cgcgtccggttttgaatctagggatttgcgggtggagaagacgagagctcatctctctgcttcaaagctcctgtccaggtagaattctcttcttcctttgcgttgtgttctttgttgttcagtcgccatggcttcaaagcggattttgaaggaactcaaggatttgcagaaagatccacccacttcttgcagtgctggtccagtagctgaagacatgtttcattggcaagcaacaatcatgggaccctcagatagcccttatgctggaggtgtgtttttagttaccatccatttccctccagattatcctttcaagcctcctaaagtcacgtttaggaccaaggtcttccatcctaacatcaacagcaatggaagcatttgtcttgat

SEQ ID NO: 21509 - DNA, 385 bp, Gossypium hirsutum
  Clone ID: LIB3272-033-P1-K1-B4
cgcgtccgctccaatctctaatcgggtttctacaagcttctaattttctttttcttcactatttcggcgcatcagaatctcaagcttcgaagttccggagtttatgtttgaagatccatccatcattggattatttcctgaagatttatttttggtcgcgttttttcaagatctgaatcgggcggattgattgattcagagcgattctttagtacaataatcggtgatcgaagagttcgtgtgaatttgatgatctaagagcaaaggggctttttcattattccctacgatttgccctaaacttctggttttgctgaaagattcgatttattggaacacttcgtggagttaccgtcagagttgatatcttgaagacaaagcgcgg

SEQ ID NO: 21510 - DNA, 388 bp, Gossypium hirsutum
  Clone ID: LIB3272-033-P1-K1-C5
acgcgtccggaaattttattattaatattatcatttctttttgtgtggaaaattaagggagaaagggaaagatgaagatcacgtcgttattggtgttgaagtgcaacccagaaggatctgatccgatcatattagcgaacgcaactgatgtgagccatttcggttacttccaaaggtcaagcgtgagggagtttatcgtctttgttgctcgaaccgtcgccaaacgtacacctcccggccagcgccagtccgtccagcacgaagagtacaaggtacacgcttacaacagaaatggacttgttgccttgggatttatggatgaccactatcctgttcgaagtgctttttcgcttctcaaccaggtgctagatgaatatctgaaaaattt

SEQ ID NO: 21511 - DNA, 386 bp, Gossypium hirsutum
  Clone ID: LIB3272-033-P1-K1-D5
cgcgtccgaattttggatcaaaggctttgattggtgcgggttcttatggaagagtttattatgccagcttgaacaatggaaaagctgtggctgtgaaaaagcttgatgtttccactgagtccgagtcgaatgtggagtttttgacccaggtttccatggtttcaagattgaagcatgacaattttgtcgagttgcaaggttactgtgttgaaggaaatctccgtgtgcttgcttacgagtttgcaacaatgggttcacttcatgacatattgcatggaaggaagggagttcaaggggcacaacctggtccggttcttgactggatgcagagggtaagaattgcagttgatgcagcaaggggcttggaatatttgcacgagaaggtt

SEQ ID NO: 21512 - DNA, 388 bp, Gossypium hirsutum
  Clone ID: LIB3272-033-P1-K1-E4
cgcgtccgcttcttatgctttctttttgttaacactgaaaaaaagagaagttcccttcccagtatttctctacaatgcaacttctccacgctccatcttggccacatctctcctttcaaacttcagaccgaaattcaaaaggaggattgctttcacttgagaaatgtcttcaactgtcaactgccaattgttcctttcagcctcaaaagctggaaaggtcgatatgggtatcgcataaaagaaacttttttagcttctgtgcaacaaaagctacctcagttgaagctggttcttcagcagcatcaagtggaacagctgaaggtgatgtattaaaagccttgtctcaaatcattgatccagactttggaacagatattgtcacctgtgg

SEQ ID NO: 21513 - DNA, 385 bp, Gossypium hirsutum
  Clone ID: LIB3272-033-P1-K1-E6
cgcgtccgcttaattctatcaaatacatttttggagacaagcagtttttcagcggcaatgcgttgggcacctattgttggttgggccccatcttttttgttgaaacgatacatcttaacaggaatacatgatggacctcaagaacctttcattgctgattctgtagatttcgttgtttcacaggtcgaaactctctcaagagatgacttagcatccaggttggctttcacagttgataatgcttcagttgggcctcttctactttcagattcattcattactataatggatacaaatgactactcttcaattcctcaagaactcaaagatcagcttggtgagaggtatcccgctgctaggcgagcttatctgaaaacaggcgcgg

SEQ ID NO: 21514 - DNA, 384 bp, Gossypium hirsutum
  Clone ID: LIB3272-033-P1-K1-F4
cgcgtccgttcttctctcttttactcattcattctttcgtttcaatatcaaagcaaaaatggcttcttcttgtaatgttgtttcaatggctttactggcttgtttggtgttgaactccttggtttttgttgcccatggtggtgacttttaccaggatttcgacctaacatggggtgacaaaagaggcaagattttcaatggtggcaagctcttgtctttgtctttagacagggtttcagggtctggttttaaatccaagaaagagtatttgtttggaaggattgatatgcaactcaagcttgttgctggcaactcagctggcactgtcactgcttattatctgtcatctcaagggccaacccatgatgagatagactttgaatt

SEQ ID NO: 21515 - DNA, 385 bp, Gossypium hirsutum
  Clone ID: LIB3272-033-P1-K1-F6
cgcgtccggaaatttgttgcaattttcagttttctgggaaaagtagaggcaaattttccactttttcgttctgggttgtaaggcaaagaacaagaagagcttcaactgaaacaatggtgaccaaaacagtagatcttcgatcggatacggtaacgaaaccaactgaggcaatgagggctgcaatggcaactgctgaagttgatgatgatgtcttgggtgctgatccgaccgcggcccggttggaatccgaagtcgctaagatcatgggcaaggaagccggtttatttgttgcatcaggcaccatgggtaacctcattagtgttcttgttcattgtgatattaggggaagtgaagtcattcttggtgacaattgtcatatccatat

SEQ ID NO: 21516 - DNA, 386 bp, Gossypium hirsutum
  Clone ID: LIB3272-033-P1-K1-H6
cggtccggtctaccacacacttgctaatattgctacttggagtggtggctctcgccactccctcttttggtacctatgagtctcccaactatgggaagccccctactcctgtttataaacctcctaaggtgaaacccccaccttatgaacatcctgtttataaacctcctaaggtgaaacccccaccttatgaacataagccccctgtctatgaaccaccaaagaaggaaaagcctgagcctaagccaccagtttatacacctccaaagaaagagaagcctgaacccaaaccaccagtatatgaacctccaaagaaggaaaagcctgagcctaagccaccagtttatacaccaccaaagaaagagaagcctgagcccaaaccacca

SEQ ID NO: 21517 - DNA, 307 bp, Gossypium hirsutum
  Clone ID: LIB3272-001-P1-K1-A1
cgtcgtgagaatggggaattgttctttaaaggggtcactgctgagtgtagaaactccatcagggttttaacagatggtggtgaaatcattgatgttaaaggccctaaacttgcccgagatattgtaaacgattttccggggtacgttatttgtaaaagagatcaagctcaagcttcaatgtttccattgaatgaaggtgagtggttggttagtgggggattttattatcttcttccattagccaaagttggggcaccaaagatgtcgatggcagcagctgattttgttgagaatttgtcaagtgggt

SEQ ID NO: 21518 - DNA, 411 bp, Gossypium hirsutum
  Clone ID: LIB3272-001-P1-K1-A10
attactacgacatatacaatttagccaactcttgtgtatttcatccacgatgaatcccttcaaaaccttgccaaccctttctttcctcttcttaacccttttcagcttagcccatgcagccacatttgatataagaaacaactgcccttacaccgtttgggctgccgcatctccgggtggtggcaagagacttgaccaaggtcaagcatggcaaatcactgcagcctctggaaccacacaagcccgaatttgggctcgaaccaaatgcaatttcgatgcctccgggaaaggctcatgcgagacaggcgactgcggtggagtcctcgaatgcaagggatacggtaaagctcccaacacactagccgaatacgcaatcgaccaatttgagcaccaagacttcattgacatctt

SEQ ID NO: 21519 - DNA, 405 bp, Gossypium hirsutum
  Clone ID: LIB3272-001-P1-K1-A11
cacagttcttaaacctaagatacgctttttctcaggaggttgaggtaaagactggaaatcatagagatgctgagagaaattagaatttggctcttccagaaatttgaggaataactctctattggaactcaaaacttctagtgcatcttgaaattctttggtttggcgaagcttttcctctgtcaccaggtgttttgcttccataaacttctgacgaactagagccatttttttctcattcagattatccttatacctccctttttgtggagagctatctcttgaataagttgccctcggggactgttgccagatttcataaacatctttgtatttgtccagctcttgacaggggtttacttcggatagcatttccttgcccgcaaagccctgatcttgctccca

SEQ ID NO: 21520 - DNA, 378 bp, Gossypium hirsutum
  Clone ID: LIB3272-001-P1-K1-A12
atcgcaaccacctgctggtccaccaaagctgacatcaatggtcaaatattctgaacatttcttgagaaaatatgtccgcaacaagacgccagaaatcatgcccagtatcaacagcttcttcactgacccaaagtgaggcttcactcttgccttatgctgaaactaaaataaaaaaatagaagaactaagtcttattcaatcaataccaagttttgccctttctttctgctgactgtgatgcaaatttgtgttggttttgcacttggatgaggtgtgttttttaagagaataaaaggtgttgtggatttttcgaagaagtgttgttttagcttaaatgaatgacccttatttgcaataatatgattttggtaagtgggc

SEQ ID NO: 21521 - DNA, 412 bp, Gossypium hirsutum
  unsure (1)..(412): unsure at all n locations
  Clone ID: LIB3272-001-P1-K1-A3
cttgggaacatttctggtgtttagggtttggttacagggagagatgggaggaggccatggagggagtacaacttacaaaggtctaactttgcatcatccaaagcgatggcatgttgtcaccggaaaaggcttgtgtgctgttatgtggttttgggtcttgtacagggctaagcaagatggtcctgttgtattgggttggcgacacccttgggagggccatgatggtcattctcacggtcatggagataagcattagtgactcccggattgtgtttaggcgcaggaagattatctgattacaggtttgctgttgcagatgttattccacaaatgtcttttgttaatntcttcggtttcaataaagtgattgtgaagggaagattgtaagcataatgaggtgaaatatgaaact

SEQ ID NO: 21522 - DNA, 410 bp, Gossypium hirsutum
  unsure (1)..(410): unsure at all n locations
  Clone ID: LIB3272-001-P1-K1-A4
gagcaaaccaaaaaaaggctgcaaattcagcttttcaatatttgcttttgatcaatcgaaatggcttcacaagtttctcaaatgccttcttcatcacccctttcttccaataaggatgaaatgcgtcccaaagccgattttcagcctagcatttggggagatctcttcctcaattgtcccgacaagaatattgatgctgaaactgaaaagcgccaccaacaattgaaagaagaagtgaggaagatgattgtggcaccaatggctaattcaacccaaaagttagccttcattgattcagtccaaagactgggtgtgagttaccatttcaccaaggagatcgaagatgaactagagaatatctaccataacaacaatgatgccgagaacgacctctacaccacatncattcg

SEQ ID NO: 21523 - DNA, 403 bp, Gossypium hirsutum
  Clone ID: LIB3272-001-P1-K1-A5
catacttatagtttacattgatttcctacctatggaattcagacgcatgcatacatttgctgtctttcttctaattgcctgttatttagttctctcagtcgagggaagatttctaaaatcactgagcaaaaataattcaaagcaagtattgccaccccctacaccaactaaagcctcggattttggtgactcaattgaaggttacaaagaggattttcgacccactacaccagggaacagccctggtgttggacattcttttgcagacgttgttgaagatattgttgaacaaaacccagcaagcattagcgtgcaaggaaatggcaagcgttcaattgcggtgcacagccctggtgttggacattcttttgcagacgttgttgaagatattgttgaacaaaac

SEQ ID NO: 21524 - DNA, 415 bp, Gossypium hirsutum
  Clone ID: LIB3272-001-P1-K1-A6
gttcttccttgcatggaagtcagctaaacaacaaacgacaaagaggagatggttatactacaagtttgaatggcaatggcttgaatgctgttcacattggtaaagatgatctccgatttaaactcatgcaaaagaatgtgtttagacgggctcagagtgatgaaaacaggaaggacatggaccttcgtgaaaagttgtcaagaatgggacagccttacgagacacatcaaacatctgagtcaagggagcgaatacctgaaccaagggagcgagtgctggagtctagggaaactagcatcttgggcagatttccttccacaagaagtgtggatgatttgcctcgtgttaccacttcaagaagttcttattctccttggactttagatcatttaaggcaacgatctccagacagagt

SEQ ID NO: 21525 - DNA, 404 bp, Gossypium hirsutum
  Clone ID: LIB3272-001-P1-K1-A7
aaaacagtccactcactccataaatctgttctttattgccactttctcgaacaagagaggaatctgtgaaatttttataggttatgggtaagatatggcgatgatgttacagagaaaattgatgaggagaacctttggagaaggcaaagcaatactcaacttcaattctaaccctgtactttctccctgcacttccttctctaccgttacttccgctgccgctacaccattccacaatgcgccacgtcagcttccaccgttcgattaccagccgacaccgtacaacggaccgtgcgccgatcaaatgcttgagaagcggaagaagttcttgggcccctctctcttctactactaccaaaagcctatgaatattgttgaaggaaaaatgcaatatttgtatgatg

SEQ ID NO: 21526 - DNA, 168 bp, Gossypium hirsutum
  Clone ID: LIB3272-001-P1-K1-A8
aaaaagggaacaaaaaatggcaattcagattcctagagtgaaacttggaactcaaggatttgaggtttcaaagctgggatttgggtgtatgggtctttcaggtcacaataattcaatgtcaaatgaagctggcatagccatcattaacccccccttcgaaagaggaat

SEQ ID NO: 21527 - DNA, 401 bp, Gossypium hirsutum
  Clone ID: LIB3272-001-P1-K1-A9
ctctctctctctctcttcaacaagccggcgagggaaggaaaaccagagagggtgaaaaatgccagctggtcacggtctccgatctcggaccagggatctgttttccagacccttcagaaagaagggttacatcccattgtccacttatctcaggacctacaagattggtgactatgtggacgtcaaggtaaatggcgccgttcacaagggcatgccccacaaattctaccatggccgcactggtcgtgtctggaacgtcaccaagcgcgccatcggcgttgaggtcaacaagcaggtgggtaaccggattatcaggaagaggattcatgtcagagtggagcatgttcagccttcaaggtgcactgaggaattcaaactgaggaagataaagaatgatcagc

SEQ ID NO: 21528 - DNA, 412 bp, Gossypium hirsutum
  Clone ID: LIB3272-001-P1-K1-B1
cgaaatttgaaacacaaaagaccaaagagatggatagatcaaggttgcggtctctcaccttgctttgcactttggttcttcttggatctctagcttctactcaggcaaagaagtccaaggaagatctgaaagaagttactcacaaagtttactttgatgttgaaattgctggaaaacctgctggtcgaattgtcatgggactcttcgggaaggcggttccaaaaacagcagaaaacttccgagcactatgcacaggtgaaaaaggtgttggaaagagtgggaaacctctccacttcaaaggaagtgctttccaccggattattccaaacttcatgattcaaggtggtgattttacacttggtgatggaagaggtggagaatcaatctatggtgagaaatttgctgatgagaa

SEQ ID NO: 21529 - DNA, 405 bp, Gossypium hirsutum
  Clone ID: LIB3272-001-P1-K1-B10
agttgacccactttctaatcttcacatcaacaacaacatgcctagtcgctgcgaaattctgtgtgaacttttgatcgcgattttgatccctcctttgggagtttgcttcaggcacggttgttgcagcgttgagttctggatttgtgtgctgttaactattctgggttacgttcctgggattatttatgctctctacgctattgtttttgtggatcgtgatgagtacttcgacgagtacaggcgtccactttattactctgcttagttctcttttatgatctctctctttttctgtaaagtggtgatcctgaaactgtttgcatttgtttttaattgaactcgatattgatgtgcttctactctttaattgatcttgacattgtgcgattgtaaatttgtaatgtt

SEQ ID NO: 21530 - DNA, 381 bp, Gossypium hirsutum
  Clone ID: LIB3272-001-P1-K1-B2
atctagggttagggttttgctccttctgagtttctctcagtaccaaaaatatccccaaattgaagatgatgcaacaaccagcacaagctatggtaccaccaccaatggctccacagacccaacagtaccaatatcagcaaccacctccggctccggttcctcaggcacaacaaccttacatgatgatgaacatgatgcagccgcctcagagtcatcctccacctatgtggcccccacaacaaggttcggctggggtacctgctcaacaacagccagctggtcaaccggctaacgcagatgaggttcggactttgtggatcggagatttgcagtattatatggatgagaattatctcttgagctgttttgcccaaactggag

SEQ ID NO: 21531 - DNA, 409 bp, Gossypium hirsutum
  Clone ID: LIB3272-001-P1-K1-B3
ctcgctaaaagacttttcagatgtctaacccaaggttggaaggtaaggtggctcttatcactggtggagccagcggtatcggtgaggagacggcgaggttctttgtacaacatggggctttggttgttattgttgatgtccaggatgatctggggaatcaagtcgctgcatcgatcggccttgacaaggttagttaccggcactgcgatgtacgagaggagaagcaggttgaggaagcagtaagtttcacagtggagaaatatgggaagctggatatcttattcagcaatgcgggtaccctaggctcgttaaccggaatcttagaaattgacctggatgactttgacaacaccatagccacgaacgttcgaggggtggccgccacgatcaagcatgccgctcgagctat

SEQ ID NO: 21532 - DNA, 411 bp, Gossypium hirsutum
  Clone ID: LIB3272-001-P1-K1-B4
ctgaaacagataaacatcaaaatgggttcccaaaaacacgtctttcttttgttatcagtgcttttgattctcaattcccttctcttttccggtgccgatgaagatcactattacgaatttattttgcaagaaacagagattacgaagctatgcagcacaaaaaccatattgacagtgaacggcagttttccagggcctcaaattcgggttcgaagaggcgacactgtttatgtcaatgtgcacaatcaaggaagatctgctgtttcctttgattggcaaggggttgaggatccggttgatggttcaaacgagttgatccagcctggtaaaaacttcacttacgagatcgaattagacgatgaaatcggaactttatggtggcatgcaaggagtgcttgggctaaagctacc

SEQ ID NO: 21533 - DNA, 412 bp, Gossypium hirsutum
  Clone ID: LIB3272-001-P1-K1-B5
ctcgaaaattattctggatagatccccaagtcttatcctttgatacaacctcttttgaaatacagcaataattgagatatttttcaagctctttttggagtctagcatggctaccgttttcaaaattcaatataactgaagttgctctactgaaactccttcactttggttttgcaatttcgaggtcccctgttactaaatttcaaaaaatggtgtcccaaaccattgatgtgttgaagaacgagctgcctcttgagcaggagcttgttgttttgcctgaagatgttgtcactggccttgttcttgtcgatatcatcaatggcttctgcactgtcggtgctggaaacctggccccaagagaacccaacagacaaatatcaagaacgatcagcgaatcagtgaggctggcaag

SEQ ID NO: 21534 - DNA, 411 bp, Gossypium hirsutum
  Clone ID: LIB3272-001-P1-K1-B6
ggaaaaaagagaaggatctgatgtacctgccggttgatcttaattatacacaagatcatgatggcccttgaaaataaagaaactatgcagaactgcgaggcaaccttaaaatgcctccagacgaaggggttcccgtacaacctgcgatgtactgggaactcaattgaaggccgtccagagcttaaagatgaaatttgtactcacccaggtggggatgttgtagaacctgtttgctctttaaatgggcagtttatggaataccacaaacctacccttcggcatgagtctggctcttggtcgaccttctatcctgacacccacaagttgcagccatacccaccaaatgcttttggggggcagttttaccactttcccatggataaccgatttcattatgccccattcaatatg

SEQ ID NO: 21535 - DNA, 402 bp, Gossypium hirsutum
  Clone ID: LIB3272-001-P1-K1-B7
gggtggaaaggaattctgggttttgagtatggaattgttcaaggacctttgggaccggatattgctggtccggagctagttgctgctgttgcaaacgctggtggactaggccttcttagagctcctgattgggaatcaccagattatgtgaaggagttgataaggaagactcggaagttaaccgacaaaccctttggggttggtgttattctgccatttcctcacaaagaaaatgtaaaggctatactagaagagaaggtagcagtgttgcaactgtattggggagaatgctcaaaggagcttgtaatagaagctcataatgctggggtcaaggttgttccccaagttgggagtttggaggaagcaaaaaaagcaattaatgtgggcgtagatgcaatcatt

SEQ ID NO: 21536 - DNA, 383 bp, Gossypium hirsutum
  Clone ID: LIB3272-001-P1-K1-B8
cccacgcgtctcgggtttttgttacctcgatttcaagtgaatcagaatgggtaaggaaaagactcacattaacattgtggttatcggccacgtcgattctgggaaatcaaccaccactggccacctgatttacaagcttggtggtattgacacgcgtgtgattgaaaggtacgcgcaagaacctgctgagatgaacaagaggtcattcaagtatgcttgggtgcttgacaagctcaaggctgagcgtgagcgtggtatcaccattgatattgccttgtggaaatttgagaccacgaaatactactgcactgtgattgatgcacctggacaccgtgactttatcaagaatatgattactggtacgtcacaggctgactgtgctg

SEQ ID NO: 21537 - DNA, 412 bp, Gossypium hirsutum
  Clone ID: LIB3272-001-P1-K1-B9
cgtaaattcagttatctactccccaaaatgagttgaagaatactactattgtgggagtggagatggcgtggagatctcccaactttttcctaaggaagcaccgaaaatggccgcttatttcctctcacaaaactaaatggcgccaagctttcacccaaaatcaacccatggtatccttcaaacaactcgttgcccggcataaccctcttcaacctgactttgtcccctctctcttacagtctcttagcctctacaaccttcaccaatcccctcaagcctatcattttctcatcaaaaccttgctccataatagacaattccaccacattccttccctgctccatcacctccaactccaacactttcaaacacccgagtacatttttacccacctcgtcaaattctatggcaa

SEQ ID NO: 21538 - DNA, 415 bp, Gossypium hirsutum
  Clone ID: LIB3272-001-P1-K1-C1
cgaaaaggttaagagcaaaagacagggcagagtaagctaagctttgatcatcaatggcggagaagagtttcaagtacgtgatccttggcggtggtgtagctgctggatatgcagcgagagagtttgccaagcagggagtgcagcctggtgagctagcaattatttccaaggaggcggtggctccatatgaacgacctgccctgagcaaagcatatctcttccctgagggagctgctagacttcctggtttccatgtctgtgttggaagtggcggagagagattgcttcctgagtggtacaaggaaaaaggaattgaattgatccttagcacagaaatagtgaaagcagatcttcctgccaatactctagtaagtgccgctggagaaacattcaagtatcaaatcttgatcattgc

SEQ ID NO: 21539 - DNA, 410 bp, Gossypium hirsutum
  Clone ID: LIB3272-001-P1-K1-C10
ggactgggtacccagtctggagggcgtgcctcaccagtagtcaataagtcgacttcaatgaatcaaaggctattacctcaaggtagtggtggcctaatgagtggtaggacaagtgccctgttgcagggtagttcaacccctcctgctaagccacccaactcaattttaggtgctgagtctgttgcacaagcttctctttcccctaaacctgctccggtggagaaaccaccaactcaggctgccaggcttaatacagatgatcttcagagaaaaacacgggcattgttagaggaatatttcagcgttaggctactagatgaagcattacagtgcgtggaggaactaaaatctccagcataccacccttgggttgttaaagaagcaatctccgttgctttggagaaaagccc

SEQ ID NO: 21540 - DNA, 402 bp, Gossypium hirsutum
  Clone ID: LIB3272-001-P1-K1-C12
cggacgcgtgggaatattccactttattcgacgccatagcttccgtcaacccaaaggctcctttaaactccggtaagaaccatacgccgccgtccggttcacgtggttcctcaaccagctgcgaggtatgggacgtggcctgctctgaagcggttttgagcctggcccggaaacccgagaacgtggagtggattaaagggttgaggaggaagatacatgagaaccctgagcttgcttttgaagaatacgaaaccagtaagctggttcgaactgagttggatcgtatggaaattgaatatagataccctttggccaaaacgggtattcgggcttggattggaaccggtagcccgccctttgtagccatccgagctgacatggatgctctgcccatacaggaag

SEQ ID NO: 21541 - DNA, 411 bp, Gossypium hirsutum
  unsure (1)..(411): unsure at all n locations
  Clone ID: LIB3272-001-P1-K1-C2
gggctttccaagttcctgtttgagtgcaattatttgcctttacctgattctggtctggatgatggtttggtgacgcccgactcggtccttgagccgtcttgttccaccaaaacgtcttctgggtctggtggatacgatgaagtgtggtgccgggcacttgcttgcaccgctgcaacgtcggagattgtgaggaagaaaaggacaagcttgacagcatgtcgtccgacatgtcctccggtatccgaagtttcaggaaatttaatgaaccggagaaagaaagctccacaacgagctccactgtattgaaacttgatttcatctatggaagtgagagaggtaaggggagattgtgacattgntggtatttatatatatttcattttcaggcaatttacggatgaaatctcccag

SEQ ID NO: 21542 - DNA, 383 bp, Gossypium hirsutum
  Clone ID: LIB3272-001-P1-K1-C4
ctctcttcctgtcttcgtctacttcgcctctttctctatggatccctacaagcaccgtccatcaagtgctttcaattcaccattctggactaccaattctggcgctccagtttggaataacaattcatcacttactgttggacccagaggtccgattctccttgaggactatcatctggtggaaaagcttgccaactttgacagggagcggattccagaacgtgttgtccatgctaggggagcaagcgcaaagggtttcttcgaggttacccatgacatttctcacgttacatgtgctgattttctgcgagcacctggagttcaaacccctgttatcttgagattttcaactgtcatccatgagcgtggaagccctgaaaccc

SEQ ID NO: 21543 - DNA, 405 bp, Gossypium hirsutum
  Clone ID: LIB3272-001-P1-K1-C5
aaaacaagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaagatatgcgatgaaagagtcgtcgtcgtcggagacaagggcttattcttcagcttgggcgcctgaccctgttacggggtattacc

SEQ ID NO: 21544 - DNA, 409 bp, Gossypium hirsutum
  Clone ID: LIB3272-001-P1-K1-C6
cagatttaaaaaaaaaaaaaccagtggaggagattttctccttagtctttgggctttctacactcagatttattcttggaaatataaggttagaccaatggattcccagaccaaaacagagaattgccttggatgggctgctacagatccaactggtgttctatcaccatacaaattcagtcgcaggcctctaggaagtgatgatgtttccataaaaattactcattgtggagtttgttatgctgatgttatttggtcgaggaatatgttaggagattcaatatatcctttggtgcctggtcatgagattgctggtattgtgaaggaggtcggttccaatgttcaaggcatcaaggtcggcgatcatgtcggagtgggaacttatgtcaactcatgtagaaattgcgag

SEQ ID NO: 21545 - DNA, 410 bp, Gossypium hirsutum
  Clone ID: LIB3272-001-P1-K1-C7
caagaactccaccaccggcaccgtccaggttcatacctatgacatcagctcctacagttcaattgttgccaaggatctgtccttcgaggtctgggataagacggctgagagtagaagggacgggagtttggcgattttcgctaaaattaaggttccggcggatttagcggcgagtgggaagattaatcaggtttggcaagtgggtcccagcgtcggaactgatggcaggttggacaaacatgccttcgccgtctctaatttgcaatctaaaggaaccttggatttgaaaagtggacagagtagcactagttctggaggagacgacaggctcaagaagaaaaatattcatgggattttgaatgctgtgagttggggaatattgtttccacttggagccatgattgcacgct

SEQ ID NO: 21546 - DNA, 410 bp, Gossypium hirsutum
  Clone ID: LIB3272-001-P1-K1-C8
tcgctttgaggggaagaatcttgctatcccttgcttttctctcgcaaaaaattctcaaacttgtttttaacgttcgctgaatactatcgctcatttcttccctcagaaccctaatcgataactgaagccatttaatcatgtttgggcgtgttccaaaaaaatctgataacactaagttttacgaagtacttggggttcccaaaagtgcaagtcaggatgaattaaagaaggcttataagaaagctgcaattaagaatcatccggataaaggtggagaccccgagaagtttaaggaactggctcatgcttatgaagtacttagtgacccagagaagagagaaatatatgatcaatatggtgaagatgctcttaaagagggaatgggaggaggcggttcttctcacaaccca

SEQ ID NO: 21547 - DNA, 405 bp, Gossypium hirsutum
  Clone ID: LIB3272-001-P1-K1-C9
ctgcaacaccaacttgattcagtctcgatctttccgccgttaatcagctaccctgtccctccaacgttctatatttgatctctttactctaaacaaatcacgccctccaccttctgttttacttcaataccccctccccatttttctactgcttttggggtaatgctgattgcttgaactgcatccctttgcttccatacatatttcagcttggagatttgaaggagaactgaaagagatacattcttctggggggacaaaatcctataaatatgactggttatatcgttggtgcgcttgttcctattgtttttacccttctccttcggagttcaaagaaggtaaagaagcgaggggtgccagtcgatgttggtggggaaccggggtatacaatccgaaacagtc

SEQ ID NO: 21548 - DNA, 414 bp, Gossypium hirsutum
  Clone ID: LIB3272-001-P1-K1-D1
ggaagtcctccgtgccacacaattaactttcctcgatataaggttcaaccgaatcaaaggcgtcgttccggcgacagttttcaaattagacctcgacgttctcttcatcaacaacaacaatttcaggcaacgtctaccggaaaatttaggtgatacaccggcgttatacataacatttgcaaacaacaagttcaccggtcggatcccgccaagtattggcaaagctaaaaacctcctcgaagtactattcctcaacaacgaactcactggttgtttaccgtacgagatcggctacttacaaaacgccaccgtttttgacgtcggaatgaataaactaaccgggccgataccacattcgttcggttgtttgaaaaagatggagcaactcaatttagccggcaatgaaatttacgg

SEQ ID NO: 21549 - DNA, 409 bp, Gossypium hirsutum
  Clone ID: LIB3272-001-P1-K1-D10
ccgctgagtttaagcatatcaataagcggaggaaaagaaacttaccaggattcccctagtaacggcgagcgaaccgggaaaagcccagcttgagaatcggtcgccatcggcgtccgaattgtagtctggagaagcgtcctcagcgacggaccgggcccaagtcccctggaaaggggcgccggagagggtgagagccccgtcgtgcccggaccctgtcgcaccaagaggcgctgtctacgagtcgggttgtttgggaatgcagccctaatcgggcggtaaattccgtccaaggctaaatacgggcgagagaccgatagcgaacaagtaccgcgagggaaagatgaaaaggactttgaaaagagagtcaaagagtgcttgaaattgtcgggagggaagcggatgggggccg

SEQ ID NO: 21550 - DNA, 406 bp, Gossypium hirsutum
  Clone ID: LIB3272-001-P1-K1-D11
aacgctctctcatcctgcttctggtcaagccaatctcaaaagactccccttttagctcacagctctctcgagttctgtaatgggtaaggagaaggttcacatcaacattgtggtcatcggccatgtcgactctgggaagtctacaaccactggtcatttgatctacaagcttggtggtattgacaagcgtgtgattgagaggtttgagaaggaggctgctgagatgaacaaaaggtcatttaagtatgcatgggtgcttgacaagcttaaggccgaacgtgaacgtggtattaccatcgatattgccctctggaagtttgaaactaccaaatactactgcactgtcattgatgcccctggacaccgtgacttcatcaagaacatgattactggtacctcacaggct

SEQ ID NO: 21551 - DNA, 407 bp, Gossypium hirsutum
  Clone ID: LIB3272-001-P1-K1-D12
aatttatttctttcatcgctcggcggcgatgcaccacccacagcctcacatttcttcgtcaacctccacttcctttcctgccgccgcggagtttgacttcaaaccggccaagcgccgcggcagttacaattgtggcagatgtggtcttcccaagaaaggccacgtttgccatctcaacagtaccacctaccctacttcgatttccactcctacctcatctccatccgccattactgtcgaaaattcatcatccgcgtcccgtcctccgcccctacgtcagtcttacacgcatctccgacgtgcgctttcctttgacgacatagacactcgcgctgactcgccggcacgcgatttagatgagtctaattctccctacccgggtacagatcttgatccggataataaga

SEQ ID NO: 21552 - DNA, 413 bp, Gossypium hirsutum
  unsure (1)..(413): unsure at all n locations
  Clone ID: LIB3272-001-P1-K1-D3
ctctctggaacatcaccaaagccgactttcagatcttggaacaactaggaacaagtttgggcagtcatggctaagcaccatcctgatttgatcatgtgccggaaacagccggggattgcaataggacgattatgtgagaagtgtgatggcaagtgtgtaatctgtgactcttatgtccgcccttgcacgcttgtgcgagtttgcgatgaatgcaactatgggtcgtttcaaggtaggtgtgttatctgtggaggggtggggatatccgatgcatattactgtaaggagtgtactcagcaagagaaagatcgcgatggttgtccaaaaattgttaatctcgggagtgctaaaacagacttattctatgaacgtaaaanatatggttttaaagaaaagatgattgatgtttacct

SEQ ID NO: 21553 - DNA, 412 bp, Gossypium hirsutum
  Clone ID: LIB3272-001-P1-K1-D4
ctttgtcatctcaaaccctagatcagggtttaaagaattttttccttttttttttcaactaaaattcccctcttgatcttcttcgattattatctttttattgtggctgaaaattacggaaaaatggcagcccaagcagcagcaaccactttcaatgggaacttaaagaaagcacttgctggtctgaggcgaattaatctggaaggtctgagatggagagttttcgatgctaaaggccaggttctcggaagattagcatctcaaatttctactgttattcaaggaaaggacaagcctacttacgctccaaatcgtgatgatggggatatgtgcattgtgatcaatgccaaggatgtatgtgttacagggagaaaacttacagacaaggtttattactggcatacaggctatg

SEQ ID NO: 21554 - DNA, 408 bp, Gossypium hirsutum
  Clone ID: LIB3272-001-P1-K1-D5
ttcatctgccatcaatttgctctgaagatcatgttggctatttttcacaaggcatttgctaatccaccagaggagctgaatagtccagcttctcataaatctaccaagaagcctaaacagcctgaagaaaccctaaatgatttcctatctcatcaccctcacaacactttctccatgagctttggcaacgctgctgttttggcttatgtccgccatgaacgtgctgcttcagttcatcagaggttgttttgtgggtttgatgacatatactgcctcttcttagggagcttgaacaatctatttatgctgaatagacaatatggtctttccaaagggagcaatgaggcgatgtttgtgattgaagcatataggacgctgagggataggggtccataccctgctgatcag

SEQ ID NO: 21555 - DNA, 409 bp, Gossypium hirsutum
  Clone ID: LIB3272-001-P1-K1-D6
cggccaccggcggcaaccagcacccaatgctggtttctgttttattagccctttttctcccatgcgctggcatgagtgctgttttcattgtttatatctgtcttttatggtacgccacgaatcaccgggctgataattcagggtcgttatcggttaagcaggctggtgagaaagggttgtccgtttcggagcttgagaagctgcccaaagttaccgggaaggatcttgtgttggggactgagtgtgcggtttgtctcgatgagatagaggcagagcaatcggctagaatggttcccggttgtaatcacggctttcatttacaatgtgctgatacttggctttcaaagaactcggtctgtcctgtttgtagggccaagcttgagcctaagttgttcgatccacctggtga

SEQ ID NO: 21556 - DNA, 408 bp, Gossypium hirsutum
  Clone ID: LIB3272-001-P1-K1-D7
gatgagtcttccccttatgcggccatgcttgcggcacaagatgtttctcaacgctgcaaggagttgggtattactgcccttcatataaagctccgagctactggaggaaacaagacgaagacccctggtcctggtgctcagtcagcacttagagcccttgctcgttcaggcatgaaaattggtcgaatagaggatgttactcccattcccactgatagtacccgtagaaagggtggcagacgtggaagaaggctctgattctttgctttatatcaattactcactcagctactactgctgtggtgcttggagttttctttgttaaacagttttctttatattcaagtgtgttttgctcggttctcttgctgcacatttagttttttggaaatggatttagatctttta

SEQ ID NO: 21557 - DNA, 412 bp, Gossypium hirsutum
  Clone ID: LIB3272-001-P1-K1-D9
aatggatctcaagatttgaagtctggccatacttggaaacctacacagaggatgttgctcatgaaatctccaaagagttgcaaggcaagccagatctgatcatcggaaactacagtgatggcaatatcgtcgcctccttgctcgcacataaattgggtgtcacacagtgcaccatcgcccatgctttggagaagacaaaatatcctgattcagatatctactggaagaagcttgaagacaaataccatttctcttgccaatttacagctgatctttttgcaatgaaccatacagatttcatcatcaccagtactttccaggaaattgcaggaagcaaggacactgttggtcaatacgagagccacactgctttcactcttcctggtctctaccgtgttgtacatggtatcgg

SEQ ID NO: 21558 - DNA, 410 bp, Gossypium hirsutum
  Clone ID: LIB3272-001-P1-K1-E1
aaaatatctcaaatctcctcctcctcctcggaaatcttagtatcatcaccatggcctcaaatcccaaggtcttctttgacatgactatcggtggtcagcccgctggtcggattgtgatggagcttttcgcagattgcactcctcgcactgctgagaacttccgtgccctctgtaccggcgagaaaggcgtcggccgcagcggtaagcccctccactacaaaggctcctctttccatcgtgtgatccctaactttatgtgccaaggaggtgacttcaccgccggaaacggtaccggaggtgaatccatctacggatccaagttcgctgacgagaacttcatcaagaagcacactggtcccggtattctctcaatggctaacgctggtccccgaactaacggatctcagttc

SEQ ID NO: 21559 - DNA, 391 bp, Gossypium hirsutum
  Clone ID: LIB3272-001-P1-K1-E10
cgaggatggccgaactcttgccgactacaacatccaaaaggagtccaccctccacctagtccttcgtctaaggggtggcatgcagatatttgtgaaaacccttacgggcaagaccatcaccctcgaggtggaaagttctgatacgattgataatgtcaaggccaagatccaagacaaggaagggatccctccagaccaacagaggcttatctttgcaggtaaacaacttgaagatggccgaaccctcgctgattacaacatccagaaagagtctaccctccaccttgtccttcgtcttcggggtgggatgcagatatttgtaaaaaccctcaccggaaaaaccatcactttggaggtggagagttctgataccattgataatgttaaggcg

SEQ ID NO: 21560 - DNA, 409 bp, Gossypium hirsutum
  Clone ID: LIB3272-001-P1-K1-E11
gaaggttgttgacattgttgacactttcaggcttcaggagcaaccccctttcgacaagaagcagtttgtcgtgttcatcaagaagttcatcaagaacttgacaccaaaactggatgcggaaaagcaagagtccttcaagaaaaacattgagggagcaaccaagtttttgctttcaaaattgaaggaccttcaatttttcgtaggagagagcatgcatgatgatggatgcttggtgtttgcttactacaaggatggtgctgttgacccaacatttttgtactttgcatatgcattgaaggaggtcaagtgctgaggtttgaagcaaagaaaaaaaaaagtggttgctgaagaatttagtcctttttattattgcttttgtctcttgttttcagtactctgctaaagacat

SEQ ID NO: 21561 - DNA, 409 bp, Gossypium hirsutum
  Clone ID: LIB3272-001-P1-K1-E2
ctgaaacctaaggaaaaatcataaaagaaaaaaatgcacccattgtcttcaattcgacagcttcgccattcttctacttcagtattgcttcaacgctttagcatcttcaattgggtgtttcgagcttcttccaaccgccctgcttttctcggaggttcaaagagtttcagtgctggtgcacattcttctgagaatgttggaactccggagaagaattttgatcaacagacaatgaaggataatgtctctgctacacgtgcttcaactttccagaaattttttggtcctttaggtgcacaatctactggtcaaacagatttcaggtcaggcgggaattacaggtctatggatgttttgagggaagcaatagatgcagatagaatggcaaactttaggggttctcaatttc

SEQ ID NO: 21562 - DNA, 410 bp, Gossypium hirsutum
  Clone ID: LIB3272-001-P1-K1-E3
ggaaaatctccactgtcccctaaagggatactgtctcaactacaaaatatttgtggccaacttgttcaagggaaggaggaggatgcacatgaatttttaaggtatgttattgatgtgatgcaatttgattgtcttaaagaagctggggtgcgttcatcaaggtgttcagaagaagaaacgactttaataggcctaacatttggaggttttctccggtcaaagataatgtgtgtgaaatgtcaaggcaagtctgaacgtcatgaaagaatgatggatcttacggttgagattgaaggagacatagagaccctggaagaggctcttcatcgctttacgaggactgagattttagatggagaaaataagtaccaatgtggcagatgcaactcttacgagaaggccaaaaagaa

SEQ ID NO: 21563 - DNA, 407 bp, Gossypium hirsutum
  Clone ID: LIB3272-001-P1-K1-E4
gaccgagggatctctttgtcttctcagattttctctttccatctctcaattctcaaaaccctaatttctctgcttttccttttgcttaatcaatcgatcctcgtcaatggccaacagtaatctccctcgaagaatcatcaaggaaactcaacgtctcctcagtgaacctgcacctggaattagtgcttcaccatcagaggataacatgcggtatttcaatgtgatgatccttggtccaacacagtcaccatatgaaggtggggttttcaagttggaactatttttgcctgaagaatatcccatggctgctcccaaggttcgatttcttacaaagatatatcatcctaacattgacaagcttggaagaatatgccttgatattctcaaagacaaatggagtccagctc

SEQ ID NO: 21564 - DNA, 384 bp, Gossypium hirsutum
  Clone ID: LIB3272-001-P1-K1-E5
cacaaacccaaatctccaattgatctgtttcatttttcagcaaagctagaaaaacaatgactaaggatatcgagactgcagagcaacatggaggggagttctcggccaaggactaccatgatccaccacctgctccattgattgatgctgaagagttaaccaaatggtcgttttacagggcagtgattgccgagttcattgctacacttctcttcctgtatgtcactgtgttgaccgtgattggttacaaggtccaaaccgaccctgctaagaacactgttgaccccgattgcggtggcgttggtattcttggtattgcttgggctttcggtggcatgatctttattcttgtttactgcaccgctggtatctttggagggcata

SEQ ID NO: 21565 - DNA, 410 bp, Gossypium hirsutum
  Clone ID: LIB3272-001-P1-K1-E6
ataatatattcttcaacggactcgttggttggcaccggccgcctctttgtctcgcttcacgacaagtcccagtttcatttttaattattgttttcacatccattttcactaagctatatatatcgttagttttctggaaatttgagctattgatctttgcgttgaatatggattgtgaaatggagaaaaattcccacgatggggttgtcgttaacggcggaaacgagggcgttttgggcctacatgccaagaggaagaagctcattatcgataccgatccaggaattgatgatagcatggcaatcttaatggcattccaaaatccggaggtggatatcttaggtttgacgactgtatttggaaatgttaggacggaagatgccactcgtaatgccttacttttgtgtgag

SEQ ID NO: 21566 - DNA, 402 bp, Gossypium hirsutum
  Clone ID: LIB3272-001-P1-K1-E7
ctctcccgctccttctcgctgcgatttcgtcttcaagatctcagttctcaaatcgtagcgctcttttctatcaagccatggctctgatcttgcatgcaggaaaaacaaacaaaaatgcctttaaggcactcattgctgcagaatatagtggtgtgcaggtcaaaatggttgagaattttgagatgggtgtgtcaaataagactcctgagttcatcaagatgaaccctttggggaaggttcctgtgttggaaacacctgagggtccggtatttgagagcaatgccattgctcgttatgttgctcgctcaaaggttaacaaccctatatgtggttctacattgattgattatggtcatatcgagcaatggattgattttgcagccttggaaattgatgctaata

SEQ ID NO: 21567 - DNA, 410 bp, Gossypium hirsutum
  Clone ID: LIB3272-001-P1-K1-E8
gatcagtgaaactgaagatctagggttttttattcagaaaattaaaaatttacaccgaaattgaactggtttgagtcgactcgtattgatagataggtgcaactcgaccatgtatagtgggtccagtgatggcgagagccacgaagccgccgctcaacggaagatcccaccggtttcgtcgatgctttgggttcgaaatcttcgccggtacatcggatccggtgctggactcggatccgaagccttaatggagcttgaaacaaagaggatcttgcttgatatatttaaagaaaagcaacagaaaagcgccgaagctggtacaataccaagtttctataagaagaaacctgaggaaggatccatcagtcatagggttcagaagctagcaaaatatcgttttctaaagaagc

SEQ ID NO: 21568 - DNA, 407 bp, Gossypium hirsutum
  Clone ID: LIB3272-001-P1-K1-E9
gtatatggcttgctgtttgatgtaccgtggtgatgttgtgcccaaggatgtcaatgctgctgttgccaccatcaagaccaagagaactattcaattcgttgactggtgcccaactggattcaagtgtggtatcaactaccagccaccgactgtcgttcctggtggtgatcttgctaaggtccagagagccgtttgcatgatttccaactcaaccagcgttgctgaggtgttctcccgcattgaccacaagtttgatctcatgtatgccaagcgtgcctttgttcactggtacgtgggtgagggtatggaagaaggagaattctcggaagctcgtgaggaccttgctgcacttgagaaggattatgaagaagtcggtgctgagtcaggcgagggtgatgaggaaggtg

SEQ ID NO: 21569 - DNA, 399 bp, Gossypium hirsutum
  Clone ID: LIB3272-001-P1-K1-F1
tttacttttaatttctctctttagtcaccggagctgttaaaggatggagtccaacggcggtggcgcgtcacctatccgtcgagaaatcgaaactttgaaggaggaaagagcccggattgagcaaaggatttcgttccttgaagctcagctccaagaagaagcttcattagcacctcagcagcagcaaaacgacggcgtctgcaatggtttttgtccttcggaaacatccaccgtcgatgccaatctggctcacgggttatctgcggatagtatttaccgttacagccgtcatcttttgcttccttcttttggagtcaaagcacaatcaaatctcttgaagtcttcaatattggttgttggagctggaggtttgggttcgccggctatattatatcttgc

SEQ ID NO: 21570 - DNA, 304 bp, Gossypium hirsutum
  Clone ID: LIB3272-001-P1-K1-F10
gaatgccttaatttttatcatgtagggagatgagttgcggctgattacaccgcagagtccttgtgaatctagggagtgccttaaaacttaaagccccccttccccttccccttccccttccccttccctttccctatctctttctatttttatttattttgcttttaagtggtagtgttcttttgtattcgaaagcgttttggttctggttttgtttagtagtgttttgagtagcagtctcatatcatcataacgtctcattcgtgactttaactctttattttgatgaacaaattgtcttttt

SEQ ID NO: 21571 - DNA, 393 bp, Gossypium hirsutum
  Clone ID: LIB3272-001-P1-K1-F11
gatgcataagtacctgttatctttcacttctaacacattgcatttacgcctccagcagctgcaccacggagaagagagaaaaactgaaaaaggggaaaaaaagcgtcgtcgtttttgcttcttcttcttctttttcttcttccctctctctctttctcagaagctcctctttcgttcttttgttcactaagtattgtaaaagatggccgacggtgaggatattcaacccctcgtctgtgataatggaactggaatggtgaaggccggttttgctggtgatgatgctccaagggcagtttttcccagtatcgttggtcgtccccgacacactggtgttatggttgggatgggtcagaaggatgcctatgtaggagatgaagcacaatctaaaag

SEQ ID NO: 21572 - DNA, 407 bp, Gossypium hirsutum
  Clone ID: LIB3272-001-P1-K1-F12
gaaggtcgtgaagttgcctggacttggttcaaggaaaactgggatctcattttaaaaacctacggtagtggattcctgataacacgttttgtcagtgcagttgtctcaccgtttgcatcatttgagaaactgaaagaagtggaggagttctttgccaaccggtcaataccttcgattgcaaggacattgaagcagagcctggagcgcgttaacattaatgccaactgggttaagagcattcaggcagaggaaaatctgggtgaggccatacaggagttagcttacaggaaatactaagggatttgtctttgttttttactagagatctagtatggaaagtagttgcggtggctttttactgttgttatacttttttactaaactgaatactctctagtaatatcatg

SEQ ID NO: 21573 - DNA, 411 bp, Gossypium hirsutum
  Clone ID: LIB3272-001-P1-K1-F2
catatctctcctttgtttccccttttctctctcttttttcaaccctaaccctacctcaccaaccaggattcaacatgaagggaggaaaatctaagtcagatactaagagtgccaagctatccgtgaaatccaaagctggaaagaaatcggggaaggctgccaaggatccaaacaagccaaagaggcctgctagtgccttcttcgttttcatggaggagttccgtgagcaatacaagaaggatcaccctaaaaacaaatccgttgccgctgtcggcaaagctggtggagataaatggaagagcttgtctgaagctgaaaaagcaccttatgtagccaaggcagaaaagcgaaaggtcgagtatgaaaagaacatgaaggcctacaataagagacaggctgagggtcctaaag

SEQ ID NO: 21574 - DNA, 417 bp, Gossypium hirsutum
  Clone ID: LIB3272-001-P1-K1-F3
gtcaaatatcacaggtgatggaggagggagtttctcttcagaaactcatcaccaagaacaacaagtaggaaactttcatggaggctcaaactctttgctttcaactaacagtaatggcggctccactgctcctccaccagctaagaagaaaagaaaccttccaggaactcctgatcccaatgcagaagtgattgctttatcaccaaagacccttttggcgacaaaccgattcgtgtgtgaaatatgcaacaaagggttccaaagagaccaaaaccttcaactccatcgacgaggccataacctaccatggaagctaaagcaaagaaccagcaccgagatccgtaaaagggtttacgtctgccctgaaccatcatgcgttcaccataacccagctcgagccctaggtgatctcaccgg

SEQ ID NO: 21575 - DNA, 210 bp, Gossypium hirsutum
  Clone ID: LIB3272-001-P1-K1-F4
aaaagccatggctttgtcttgctggttgccagagaatgtggagactgaaattaagcttacaacatgtctttaatgtgttatgaaatcacattttgttctgataattgtagcagttttgtattacttactactatacaataaggattttggtgttgaagagcttcttggttactggttaaattttttaaagaggaattgccatttgaattc

SEQ ID NO: 21576 - DNA, 410 bp, Gossypium hirsutum
  Clone ID: LIB3272-001-P1-K1-F5
ctcggctctcgcatcgatgaagaacgtagcgaaatgcgatacttggtgtgaattgcagaatcccgtgaaccatcgagtctttgaacgcaagttgcgccccaagccattaggccgagggcacgtctgcctgggtgtcacgcatcgtcgcccccatccaaccatgagccctcgagcctcggttggaccgcgggcggaaattggcctcccgtgcgctcacagccagcggttggcctaaattcgagtcctcgacgacatcatcgtcgcgacgatcggtggtaatgctgcaagcaacctcgttcggagtcgtgcgcgtccgtcgatcgagacccttgaaccctttcggcatcgcaaggacggtgctcgcatcgcgaccccaggtcaggcgggattacccgctgagtttaagcata

SEQ ID NO: 21577 - DNA, 411 bp, Gossypium hirsutum
  Clone ID: LIB3272-001-P1-K1-F6
cgtcacttgaaggctgaagctatggagggtaaaaatgcgaatctggaagcggcgatcgaccagttgcttaatgttgagaagcagatgcggtttgccggcgatgtgattggcaccaagaaagcggtctctgacattttgcagctctgctttgaagctaaggattggaagtctctcaatgaacagatcgttaatttgtctaagaaacgtggtcaacttaagcaggcagtgactgcaatggttcagcaagcaatgcaatacattgatgaggcaccagatcttgaaactcgtatagagcttatcaagaccctgaacactgtgtctgctggaaagatttatgttgaaattgagagagcaagattgatcagaagacttgcaaagattaaagaagaacagggccttattgctgaagct

SEQ ID NO: 21578 - DNA, 412 bp, Gossypium hirsutum
  Clone ID: LIB3272-001-P1-K1-F7
agtgggtgcaccattagctccttctaagccagagccaaagcagcagagaagaggagaggaagatagaaaaatgggcgcaacagccaccggcaaatctctccattttttgctcttcacaggaccccctttcatttctctccctaacaaagacaaaatcaaaagcagaaaccctaaacctcaacttcagattctccaaacccccaattctcgtcgccttcgtctttccattagagcttcttcaccctcctccaccgccctcaatgacccgcctcttccctctctcaccaattccgatcttcaacttcgagttcgaatcctctctgaatcactcccctacattcagaaatttaggggaaaaaccattgtcgtcaaatacggaggcgccgccatgaaatctgcggagctcaaggcc

SEQ ID NO: 21579 - DNA, 412 bp, Gossypium hirsutum
  Clone ID: LIB3272-001-P1-K1-F8
gtttgtacccagaggttgaccctgccctcaaccccgaccatgttccacacatactccataaatgccctgatcagatcccagaccccaaggccgtccagtatgtgagaaacgaccgtgggacacccatggttttggataacaactactacaggaacatactggacaacaagggtttgttgattgtggatcaccaactggcgtacgacaaaaggaccagaccttatgtgaagaaaatggccaagagccaagactatttcttcaaggagttctcaagggccattactctcctctctgagaacaatcctctcactggtagcaagggtgagatcaggaagcaatgcaatcttgcaaacaagcttcactaaaatgcctcgccaaagagaaagccgagtgtggccgaataaaatgtttg

SEQ ID NO: 21580 - DNA, 410 bp, Gossypium hirsutum
  Clone ID: LIB3272-001-P1-K1-F9
ggatgatgcatggttgaatggagaattcataaccactgtccaacaacgtggtgctgcaatcatcaaagctaggaaactctcaagtgcactatctgctgctagtgctgcttgtgatcacattcgtgattgggtccttggaactcccgagggcacatgggtttccatgggggtttactctgatggttcatacaatgcaccagctggggtcatctattccttccctgtaacttgtaagaatggagaatggacaattgtccaagggctggcaattgatgaattctcgaggaagaagttggacttgaccggagtggagctgaccgaggagaaggaattggcatactcgtgcctctcatgaatgcattcatcatttccataatctgtttggaagaggagtggtttgccttaatagg

SEQ ID NO: 21581 - DNA, 414 bp, Gossypium hirsutum
  Clone ID: LIB3272-001-P1-K1-G1
ggggaaacaaaaaggaagcatcattttcttaatccaagaaaaaatatcccttttcgttttaatctttgttgtagctaatccatcatcgttcgcgtgagagaaaaatggctaagaatgtgggaattattgctatggatatttacttccctcctacctttgttcaacaggaagccttggaggctcatgatggcgtgagcaaaggaaaatacaccattggacttggacaagattgtttggccttctgtactgaggtcgaagatgttatctcaatgagtttgacagttgttacttcactccttgagaagtataagattgaccctaaacaaattggccgtcttgaagttggcagcgagactgtgatagacaagagcaagtccattaagactttcctaatgcaaatttttgagaaatgtg

SEQ ID NO: 21582 - DNA, 408 bp, Gossypium hirsutum
  Clone ID: LIB3272-001-P1-K1-G10
ctttctctgaaacttacaacttcaccatgaacaaaagcaagctccagctgcaactttgtgcagggatatttactttaagcatcctctccaatggtgcttatggtagtgacaaaatctttgacataactcacaaaatcacttctcagttgccaacttttggatcacagaagggtcttggtcaattcatttggcttctttccagcatcaaaaatgggtccacagtgaatgtgtcggagttcaaattgggaacccacactggcactcacgttgatgctcctagtcacttctttcagaagtactatgaacaaggatttgatgtttcaacccttagccttcaaactcttaatggtcctgttctagtagttgatgttcaaagaaataagaacattactgctgaagttatgaagt

SEQ ID NO: 21583 - DNA, 305 bp, Gossypium hirsutum
  Clone ID: LIB3272-001-P1-K1-G11
ggggcggccaaaaaccattggaatttttttttatactaaaccccatttgttttttatgacaacttttgccggtttacaggaaaaaagaaaaaaattttcccttaaaggatctaacccatgttttataaccccaaaaattttttcctccccaaaaacccatttttgaaaagaaaatttggcttaaataaaaaagagatacccctttccttgggtggattttaaaacagtttggatagcaccagttttgcccttgcctaaggggggggccccaaccggggcatttgcataaaatgcaaattggtttg

SEQ ID NO: 21584 - DNA, 403 bp, Gossypium hirsutum
  Clone ID: LIB3272-001-P1-K1-G12
tgcccttttcttctcttcaactccacctgctaaaatgcaccaatttccggtgcttctcagcctcatcgcagtgtctgtactgctgatggtaactccagtcattggataccgtccatggcctcacttaaaacccaacagctccgatttaacgtttggaagctccaagaaattcgagggctcatcagagttcgtccaaatgagataccatatgggaccagttctcaccgccaacatcaccgtacacatagtttggtacggccgatggcaaaaatctcagaagaagatcatccgtgagttcatcaactcaatctccgccgttgatgccaagcgcccttctgttgccggctggtggaagaccgtacaactttatacggaccaaacgggcgccaacatttcccatact

SEQ ID NO: 21585 - DNA, 189 bp, Gossypium hirsutum
  Clone ID: LIB3272-001-P1-K1-G2
gaactaagacggttgcttttcctcttgagatactgaaagactatgtgtaatgacaaatggagactttatgcacagcgcaaatgattatgctgaacgtttgagttcgagcgctacattgttaattccattcgcatattgaatggttaaggctgattgtgcaaagtgatggtattgtgttacacagcataa

SEQ ID NO: 21586 - DNA, 414 bp, Gossypium hirsutum
  Clone ID: LIB3272-001-P1-K1-G3
gccaaatctttccctttttccgtttccttcccttctcttagtaacagtcgtttctctgccggatcacaaaaacaaatatatatagcaaaagaccattgatatatatatatacggataatcatttgttttgattgttaaacggctttttaacgggtgttacgtttatagagaagaacagtttgtcaatcacatagatcatgggttttctagacaaactttgggacgaaacgcttgccgggcctatgccagaaaccggcctcggaaaactacgaaagtatggttcattttcagccgcatcatcatcgcctgctaccgctgatactagtcaggttatgataactaggagcattacgattcttaagagcaactctggtttgaaaaacctatctatggacccgggttcagctccgggtt

SEQ ID NO: 21587 - DNA, 411 bp, Gossypium hirsutum
  Clone ID: LIB3272-001-P1-K1-G4
ctaaatcctcctttgttctaacgcaaatttgaatcatgacagacacctcctccgatctccaaaaatacggcgtgccgttttacggagccggatgggttccttacaaccacatcaaatccaagctcgcctcacaagaaaagattgaagaggataagaaagaagaaaaagatccaactccatccaacgatgacgagatcactacacccctaaactacgttgttctcgctggcggtggcggtgaaggccgtagtggcattcccaatgcaatcgttgtttcccacgttaatttcacctccaattctctctccgatcaacctgtggttaagcatgaaactggttctgatttgccttatcgaatgactgttcatccgcatggagatggcattatctgtgcatttcaacagagctgca

SEQ ID NO: 21588 - DNA, 410 bp, Gossypium hirsutum
  Clone ID: LIB3272-001-P1-K1-G5
caattatcttaaagcctgccatataatcatataaccaggctccgtcgtggtactcttcggccaccacaatgccgaaaatcgccttgggaacaagccaagaggctgctcagcctgactgcatcaaagcccttgtggtcgagtttatcaccactttcctcttcgtattcgttggagtaggagctgccatggccgccgatgagtcgggggcaaatgcgctggtgggattgtttgctgtggcggtggctcatgcccttgtcgtcggcgttatgatatcggccggacacatatcaggcggccatcttaacccagccgtcacgcttgggttgctattcggtggtcacatcacggtggtccgtgcgatcctctactggatcgatcagttgttggcatcttcagctgcttgtatactt

SEQ ID NO: 21589 - DNA, 408 bp, Gossypium hirsutum
  Clone ID: LIB3272-001-P1-K1-G6
gaaaattcattttctttggactttactctccgaaatccgagtcctaggaaagatgcgtgagattcttcatattcagggagggcagtgcggcaaccagatcggtgccaagttttgggaggtggtttgcgccgagcacggcatagattcaacgggacgctatcaaggagacaatgatttgcagctggagcgcgttaacgtttactacaatgaagcgagttgcgggaggctcgttccacgagccgtccttatggacttggagcctggcactatggatagtgttagatccgggccgtacgggcagattttcaggcctgacaacttcgttttcggccagtccggtgcagggaataactgggccaagggtcattacacggaaggggctgagttgatcgactcagtgctagatgt

SEQ ID NO: 21590 - DNA, 409 bp, Gossypium hirsutum
  Clone ID: LIB3272-001-P1-K1-G7
aaaaatgacaacggattggaaaactgttcgattgttccccattccctctgtcatttacttaatccataataatgtccagtttgctactcttatgtatctcgatacttcgacgtatcagattatgggcaatttgaagattgtcactactggaattctattcagatgagtttgttgcttgatttaggttatttcttaagaagaagctatctaatctgcagtggatggcgatcattctattggcggttggaacaaccatgagccaggtcaaaggttgtggagaggcttcatgtgattccctcttctcagcaccaattcaaggatacatgttaggaattttatctgcttgtctttccgcattggctggcgtgtatacggagttcttgatgaagcaaaacaatgatagcttata

SEQ ID NO: 21591 - DNA, 410 bp, Gossypium hirsutum
  Clone ID: LIB3272-001-P1-K1-G8
ggtcaatcgatctgttcacatcaactttactatatcttctcatttttggatcaatttctcctttcgcgctttgaagttgatttcttgaagatgggagcggaaaagaacttcattgacatggaggagggaactctggagatcgggatggagtatagaactgtatctggtgttgcgggaccattggtcattcttgacaaagttaagggtccaaagtatcaggagattgtcaatattcggttgggggatggaacaactcgacgtggtcaagtcctggaagttgatggggagaaagcagttgtgcaggtctttgaaggaacatctggaattgacaacaaatacacaactgtgcaatttacaggggaggtattgaaaactcctgtgtcgttggatatgctagggcgcatatttaa

SEQ ID NO: 21592 - DNA, 412 bp, Gossypium hirsutum
  Clone ID: LIB3272-001-P1-K1-G9
tttgtatttcatactcatttagcccctttcattagcatcgaaatcactccagttttctttatcactgaaaaatgtcttgctgtggtggaaactgtggctgcggttctggctgcaagtgcggcagtggctgtggaggatgcaagatgtacccagacctgaacgttgccgagatgaccacaactgagactctggttcttggtgtagcaccccagaaagcacactttgagggagctgagatggaattcggggctgagaacggctgcaagtgtggagacaactgcacctgcaacccttgcaattgtaaatgattagagaccaaagccaaagctccctggaagcagagacgcctttgtctttaagaaataatatgttttggtggttatgtggttttagaataaagtagccatggctt

SEQ ID NO: 21593 - DNA, 413 bp, Gossypium hirsutum
  Clone ID: LIB3272-001-P1-K1-H1
cccacgcgtccgcccacgcgtccgatttggtagaaatgtggggcaatcatgatgtttttgttggtataatatcaactagtgatgaatcttcacaaattagtagcaatgttaatgttcattcatggagattcagggtaaagtttgttccaagttggatgcattcattgcctgctgatccaagaagttatatggataacaaggatagtaaggaaactagggaagaaaaggggaggttttgtgctttgccaattctagctaggttgattttcgctactggatgtggtgccttgttcgcgttcatgatgctgtttatgtgggcgattttcgttagtaggcacacggtattccccgtcaagtatcaacccagtcatgaagatttcaggtatgagaaagtcaatgtggtggtggagaag

SEQ ID NO: 21594 - DNA, 383 bp, Gossypium hirsutum
  Clone ID: LIB3272-001-P1-K1-H10
cctaaaccctgcctttcccttcctcaatcatccaatgacggagctgaaactctccgagagccgagacctgacccgaatcgaacgcattggggctcattcccacatacggggcctaggcctcgactcctctctggagccccgtgacgtctcggaaggaatggtgggccaagcacaagctcgtaaagccgccggtgtcatcctccaaatgatcaaagacggtaaaattgctggccgtgctatcttattagcgggacaacctggaactggcaaaactgccattgccatgggcatggccaaatctcttggccttgaaacccctttctctatgctctctggcagcgaaatcttctcccttgagatgtcgaaaaccgaagctttaatgc

SEQ ID NO: 21595 - DNA, 431 bp, Gossypium hirsutum
  Clone ID: LIB3272-001-P1-K1-H12
gaatcgcagtttcggcctcgacctacgcgtgcgctcaaactccaacacccccactcctactccatctgcacgaggcacgtgccctacggatgccctcaaattaggtgtatgtgccaatgtgcttaacctagtcaatgtcaccgttggttcacccccagtgatgccatgctgttcccttcatcaatggtcttggcgacctcgaagctgctgcatgcctttgcaccgctatcagagcaaacattttaggcatcaacctcaacatcccaatttaccttagcttgctcctcaacgtttgttcaaggaacgttcctactggcttccaatgctaaatcatcactgttccctacattttttatcgtctttcttatggtgtttgtgtttgattttagaaagttatgatttctattatttactgtgtgttttcatttgta

SEQ ID NO: 21596 - DNA, 412 bp, Gossypium hirsutum
  Clone ID: LIB3272-001-P1-K1-H3
cggttgtggtgcgccctcgttcgttgttccttccgctcccctaccattcggttgggtgggctgttgggcggtgtgcgtgggcgctactactagtacgcaataggcatatgagtggtgttttggttgtgtgtattggcaggctccatgctactcgcatcgaactgtcgagccgcactcctcttcattaactccccttgttgtaatcgaactcaaggggtgcgatcgggatcctgtgctgcgtacctaagccagatggaattatggatgtgttgccgtcccttctccatcccgtgcccttcggggtgcgtggtggacctcaatcgtgccttgtgtcccgagtgcgcccccttaaatcggtgtggcctcgtcggtgcactggtgctcgatcgtgctttcggatgcggaaaatgtt

SEQ ID NO: 21597 - DNA, 393 bp, Gossypium hirsutum
  Clone ID: LIB3272-001-P1-K1-H4
ataccagatctgttacactctgaattatttaagcagcacgtcacaagggatctagagcaaggttagtgaccttgggttgagtgtagagatgaggaaaatcatgggtgccaaagttcttttcttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctt

SEQ ID NO: 21598 - DNA, 414 bp, Gossypium hirsutum
  Clone ID: LIB3272-001-P1-K1-H5
acgctccccgctgcttttctttatgcattcgtgatggtgaaagcatatgcgcaagagcacatttacaaacattcgtgggagcgagtaacttctgcatcttggcgtaagttcgctgaccctgaaaacaagcgtaccttgtctcatattctagaagttgacacattgaatcgcaaactcgatcctctctccggtaagctttacactactcgggctcttaccatccatgctccagggccatggtttgttcgcaaaatcattggccaggacatctgccactgtgttgaatcaacagtggttgatgcccaatcaaagtcaatgcaacttgcaacccgtaatgtcagtcttcagaagtttatagaggtagaggagaagataaggtatgatcctcacccagataatccaacaggatggacc

SEQ ID NO: 21599 - DNA, 445 bp, Gossypium hirsutum
  Clone ID: LIB3272-001-P1-K1-H6
gtaccgaatcggtgggtcggcccaggcgtacgtttgccttatctactccaacaccctacggacaccaccattgtcgttcacgagtcaggcagtcaccaacggtccaccatcatcgttcaccagtcaggtagtcaccatcggtccaccagtcaatcgctttcaatgaaggataccggcaaccagtaccctttctgcttggttttgggcgactagcatctgcatagtgtaagaatggagtcaggggctaaggaggaagggaaagtgctgggatacaacagcaaaaaggtgaagaaagtggcgatactttcaacactggccgcactccttgatgatccaattctcgccgatgtccctaagaaacccagcttgtccgatgttgataccctaatcaaccttgaactgtggagtgccatgtgtatctctatcttcaaattagatggaacct

SEQ ID NO: 21600 - DNA, 410 bp, Gossypium hirsutum
  Clone ID: LIB3272-001-P1-K1-H7
gcggtggtcgccgtgtttggcgccggagaaaattggcgaagaaggatgaaatgttgcagtacaagttggagaggatgccgttcttagaggagcaagttcggaagataagggaaggagggaaactgttgacgatggacattgagagactgttgctatctgaggacaatcgttttgattttgtgaatgatgtagcggctgaggccaaagaatatgttgagaataaccgggatgaatatggaggttcgaagaaagctatacttcatgtgcttagtaaccgtgtcaatgattcggggttttaccggccggatgcttatgccgaatctgaccctttcaagcctggacctacttttttgaaggaagaatttacataaaaggttttaaaggtaacatatgtgttttaagactgtaat

SEQ ID NO: 21601 - DNA, 326 bp, Gossypium hirsutum
  Clone ID: LIB3272-001-P1-K1-H8
ccgcgtccgtccgattccggtcgcccacctcgagaagcagccatagtttggagagacaaatggttctaagacagttcatgcctctttggactacattcttttttcctagcctgctgggtttgctcttacccccctaccaatgccacccacccacaccccctctactcattcacaggagggccctaggatccctcacatagcgttggccgagtcttaacctatccatgcaccgtgttcaccccatgtgccatgctgtccctctaacggccttggcacctcgactggtgatcctttgcaccgatatcagagcaaacatttagcataac

SEQ ID NO: 21602 - DNA, 409 bp, Gossypium hirsutum
  Clone ID: LIB3272-001-P1-K1-H9
caaagcctgtgtctagccgttggataaaacacggtgcggtgacttgaggctcttgtaatcggcggtgagacttcaaacttcagccttcaacgacaagtcatcgtgttaagatgaagggactcttcaaatctaagccgcgaactcctgttgatatcgtgcggcaaacgcgcgatctcctcatgtatgttggccgttcctccgacagtcgtgaagccaagcgggaagagaagatggcggagttatttaaaaatataagggagttgaagtgtattctttacggtaatagtgaatctgagccggtttcagaagcttgtgcacaactgactcacgagttcttcagagagaacacgctacgactcttgatcacttgtcttcctaaattgaacttagaggcgaggaaagatgcaac

SEQ ID NO: 21603 - DNA, 405 bp, Gossypium hirsutum
  Clone ID: LIB3272-002-P1-K1-A1
cgacgttctcgataaagggatgtatttttatactccattgtagaaaatgcttgattgtggttataaagctcagtatatgagtgggcggagggagaaatttgtcaggttggatgacttggactctagattatcatcatcctctgatacaggattgaaaaaatgtgggtttaacattgatggattaggtcgctctggccatgcaaacaatacaacatcaagatcttttaagagagggatcagaaagggatctgaaggacttaagtcaattggtcgctcccttggatttggggtttcacgagttgtatttccagaggatcttaaagtttcagagaagaagatttctgatcctcaggataaattcctcttgctatgcaataaattatttttcatatcttgtattctggc

SEQ ID NO: 21604 - DNA, 180 bp, Gossypium hirsutum
  Clone ID: LIB3272-002-P1-K1-A10
gattccaaatttttcccaaaagatgcaatttttggggaaaccctttattggtaaaaccttaaccttgggggtgaaaggtcttgttcttttggttatggtaagggttaaattcaagaccaaagaagggttccttctgaccaaacaaaggttttttttggccgaaaacaactctggggttgg

SEQ ID NO: 21605 - DNA, 411 bp, Gossypium hirsutum
  Clone ID: LIB3272-002-P1-K1-A11
atgctttgaggtagtaagaaggcctaaaaatggatcatagagacaggcagtctattgaacatcaaaagaaagatcctcaacaacacccccacccatgttttactaatttcacaacacaccatcagcagcagaaatgggaagatccttccctattagattacagcaccaggattgaacctcctttccagggattcaacccaaactgtcaaaccaaatcttcatttccatgtaaccccaataaccaaatcaaggtccctgaccctatcatgaatgagttgcttcaagccagcaaagtccaagattgggatccaagtgcaatgctaaacaatctgtcattcctggagcagaagatccatcagcttcaaggtctggtgcattccatcattgggagaaggggtcaagttttggggc

SEQ ID NO: 21606 - DNA, 402 bp, Gossypium hirsutum
  Clone ID: LIB3272-002-P1-K1-A12
gatgaatataggcaatgcaaatggggaggatgctattgaggcactccaagcacaagctcacatttggagacatgctttcaacttcgtaagcttcatgtctctaaaatgtgcacttgatttaggcatccttgatatcattcatgatcatggcaagcccatgactattaccgagctggttgctgcgctacagatgctcaaccctgctaaagcatgcgacatttataggctcatgcgcattctagttcactcggacttctttgcacgccaaaagctagacactgatgctcaagaagaaggatatgttcttaccaactcttctcgtattttgctcaagaataatcccttctgcgtaacgcctacattgaaggctacaatggatcctattataacaaagccttggag

SEQ ID NO: 21607 - DNA, 314 bp, Gossypium hirsutum
  Clone ID: LIB3272-002-P1-K1-A2
gggcggaattcggtgaccacgcgtcgacttcacccgccgtgatttgatcagacgatatgccgatcagaaacatagcgggcggcgaaactctatcaatgcttagcagtagtggttatatcaacgtatttgtttgtggatctggtagctggttaatagctgccgcggtcacactcggtggttgtgcgctttactacggattgcctttgcgtgctatcgggtacattcggggcatgtgaatcgcgtacatcggttcgtggcggaacattactttacgggatcttatggatgtaactctggtaacgcgttgctgtact

SEQ ID NO: 21608 - DNA, 420 bp, Gossypium hirsutum
  unsure (1)..(420): unsure at all n locations
  Clone ID: LIB3272-002-P1-K1-A3
attntttctctgattaccttctcttttcttctatcattctagagtttaaacaatggaatagaattgtctaaccatgtgtattgctgctttcatttggcaagctcatccactctaccctcttctgcttttacaaaacagagatgaataccacaacaggcctacgaaggcacttgcatggtgggatgttgatggttgtgagatattaggaggaagagatgaagtagcaggagggacatggttggcttgttcaagacaaggcagagttgcttttctcaccaatgtcttggagcttcatccccgtcccgacgccaagacccgcggtgatcttccacttcttttcctggagagcacaaagagccccatggaatttgcggagcaactggccaccgatgctcatcagtacaatggatttaacctcat

SEQ ID NO: 21609 - DNA, 413 bp, Gossypium hirsutum
  Clone ID: LIB3272-002-P1-K1-A4
ctttacgataccgacgcgacggttttgacagcgttagcggattccggtataacgcgtggtcgtcgcacttcctaatgaactactttcatccaccgccgctgatcagtcgtttgccgacaactgggttgaagcaaacataacaaagttttacccaaagacaaaaatcgaagccatagctgtcggtaacgaactgtttgtcgatccggccaacacgaccaaataccttgtaccggcgatgaagaacatccacgcttcgttagttaaatccaagcttgattccgccattaaaatcttttctccaatagctttcaatgctttgaaaacctcgtacccttcatcggccggttcgtttaagccggaattgattgaaccggtgattaaacccatgttggatttttttgaaacaaaccggg

SEQ ID NO: 21610 - DNA, 413 bp, Gossypium hirsutum
  Clone ID: LIB3272-002-P1-K1-A5
aaaagagttcaaatcattttgaatttgttttgagattgaaaaaatgggtgatgaagatgtagtattgttggatttctggccaagtccttttgggatgagagtgaggattgctctggcggagaaagagataaaatacgagtacaaggaagaagatttgaggaacaagagtgatttgcttctgaagatgaaccctgttcataagaaaatccctgttctaatctataatggaaaacctgtttgtgagtccctcattcaggttcaatacattgatgagatttggccgcataaatctcccctactccctactgatccttaccaaagagccatcgctaggttttggggtgattttgttgacaacaagatatatgatctaggaaggaaattatggaccacaaaggggagaagacaagaag

SEQ ID NO: 21611 - DNA, 403 bp, Gossypium hirsutum
  Clone ID: LIB3272-002-P1-K1-A6
gtgtttttttgcctattgaaaaattttccagtgttgatttcagtagccatcgaaaccctaattcctctttcaccatgaactgttcaatctccggtgaggtgccggaggagcccgttgtctccacgaaatccggcttgctctacgagaaacgcttaatcgagcgtcatatttcggattatgggaagtgtccagttactggggaggcacttactatggacgacattgtcccggtcaaaaccggcaagattgtgaagcccagatctttaacagcagctagcattcctgggatgcttggaatgtttcagaatgaatgggatgctttaatgctatccaattttgcattggagcagcagcttcataccgccaggcaagagttaagtcatgcactctaccagcatgatgc

SEQ ID NO: 21612 - DNA, 178 bp, Gossypium hirsutum
  unsure (1)..(178): unsure at all n locations
  Clone ID: LIB3272-002-P1-K1-A7
aaaaaaaccggaaggaacccaaagagnnaanacccgcaaagagcaccangagganccanccgnngccgaagaaaaggaacancaccanccaanacgagaagaacccaaggaccacaaggncncaagcggagacccnngggancggcgggnccaacaagaagcnccggaggggacccca

SEQ ID NO: 21613 - DNA, 253 bp, Gossypium hirsutum
  unsure (1)..(253): unsure at all n locations
  Clone ID: LIB3272-002-P1-K1-A8
caaaggggnagnagggnnccaangggggccnganggnaacanggnnggacacgaggccaanggcaagnncannnggcaaagnnnngaccanccaacnganacacncgnggggggncaggcgcnnagaaacggaggggcgacaaagcnngngagccgggcnncngcncaaaacaangnngacggagccnanagcgnggnganggagccnaaacagnnggnnnngcagnacaagggaangaacncnccnaaacca

SEQ ID NO: 21614 - DNA, 421 bp, Gossypium hirsutum
  Clone ID: LIB3272-002-P1-K1-A9
catatctctcctttgtttccccttttctctctcttttttcaaccctaaccctacctcaccaaccaggattcaacatgaagggaggaaaatctaagtcagatactaagagtgccaagctatccgtgaaatccaaagctggaaagaaatcggggaaggctgccaaggatccaaacaagccaaagaggcctgctagtgccttcttcgttttcatggaggagttccgtgagcaatacaagaaggatcaccctaaaaacaaatccgttgccgctgtcggcaaagctggtggagataaatggaagagcttgtctgaagctgaaaaagcaccttatgtagccaaggcagaaaagcgaaaggtcgagtatgaaaagaacatgaaggcctacaataagagacaggctgagggtcctaaagacgaagatgt

SEQ ID NO: 21615 - DNA, 378 bp, Gossypium hirsutum
  Clone ID: LIB3272-002-P1-K1-B1
ccgccgtcgacgcaaccgtcttaaatggcctccgtcgcactcacctcctcctgccccctcggttactcacgtatcaaatcacttgctttctcttccagatcatgtccaaacccggtcttttcccctccgtttctcccaaagtccacttcacataattccagcttcattaaacagttaagtctcactccagtcataacgaacaatagaatccagaaaagacacagcaaattaactgtcaaagcggcggcatcaactccagccgccgtaactccgccgtcccagcaaccatggcaaggtgcagcattaaagccattgatagcctcgattgctacaagtgtcattctctggttccttcccgtcccatccggtgtctctcgc

SEQ ID NO: 21616 - DNA, 410 bp, Gossypium hirsutum
  Clone ID: LIB3272-002-P1-K1-B10
cactcattcactccttcacagttgaaaaaccctttaattttaaaaaggatattttggttatatactgagaaatccaacttcttttgtatctttatccttttggtacttcaattatcaaaagaaagaaaagcatcaacaacaacaaaaaaaagcccatacacttaagtgaaaaaccagacaagagagaaaacaagaaaaatgggtgttctggatcatgtttcagatctgtttgactgttctcacagttccaagcacaagaaacgtaagcagttgcagacggtggaaatcaaggtgaaaatggactgcgaaggatgcgaacggaaagtgaaaaaatcagtggaagggatgaaaggggtgacacaagtggacgtggagcggaaggccaacaagttgacggtcgtcggatatgt

SEQ ID NO: 21617 - DNA, 408 bp, Gossypium hirsutum
  Clone ID: LIB3272-002-P1-K1-B11
ccgatttagtttaagaaaaaatttccttagagcataaaagaaaagttacgaacatgccgggtgtcaatcctgaaattgagttcccagccattgagttccgtccatcggatttgaagcgaggaaccgaaggatggaaccggttgtgcaagagggttcaagaggcttgtgagactttcggttgtttcgaggtggtatatgaaagggtatcgacgaaactccgagaggatgcgtttgggttgatgaaagaaatggttgagctcccagtggagacgaaacagaagaataatagtcccatgccttaccatggttgggttggaccatgcaagcaggtttctgtgttgtatgaaggctttggagttggagatgcctccaactatgactctgttaaaagttttgctcaacttatgt

SEQ ID NO: 21618 - DNA, 378 bp, Gossypium hirsutum
  Clone ID: LIB3272-002-P1-K1-B12
gttcttccttttggtttctatttggatctcaattttggtcctcaaacagggtaggggctgattaaactttgggcctgaacaaaggggaccaccacttctttgggcggggtgcaccctttccaaagcttccaaaacagagttgggctcgaaaacctaacacgctttggcgtcggcgagcacaacaagaaagaaaatgcgatggtggagtttgtgagggttgtgaaaacaagcgagcaagttgtggcggggacacttcaccatttgacggtggaagctgtcgacacccgcaaaaaaaagctttatgaagccaaagtttgggttaaaccttgtgtgaattttaaagaattgcaggagtgtaaacatgctggtgatgctgat

SEQ ID NO: 21619 - DNA, 365 bp, Gossypium hirsutum
  Clone ID: LIB3272-002-P1-K1-B2
tctctctctcccatttccctccatggccgtctcttttaaaatgtgcgcgagtttcggtctatttgtgggtcttatgatgctgggtctggtaagctcagctaagttcgatgagcttttccaacctggttgggctatggatcatttcatctatgaaggagagctccttaagctcaaactcgacaactattcgggtgctggctttgcatcaaaaagcaagtatctatttggaaaagtgaccatgcagattaagcttgtagaaggcgactctgctgggactgtaactgcttattatatgtcatcggacggtccaaatcacaacgagttcgatttcgagtttctaggcaataccacaagtgaaccttacc

SEQ ID NO: 21620 - DNA, 326 bp, Gossypium hirsutum
  Clone ID: LIB3272-002-P1-K1-B3
atatgacatgatcattgcatgttaggcatgctctcaattacaaccgaaagcgctgaattggaggactaaaactctattaatacacaacccaaaactggtgaacattaaacgaccggtctcacaaccttaatatacatactttaaatacattctctattgtacaaactcgggccaaaacacatgtgggttttaccttatttaaccattttacttcttaacgtcgcgtggtcgtatctgacacaaatgtatgctatagctaacatggcaaactcaactttgatgcatggaaaatactagctgatgcgtatgttaacacaaataaattt

SEQ ID NO: 21621 - DNA, 413 bp, Gossypium hirsutum
  unsure (1)..(413): unsure at all n locations
  Clone ID: LIB3272-002-P1-K1-B4
gcgaacatggcgataggagttaaggccttgcacttgtcctttgtgcctcatgccctcgcgattgccggcgctgttatggtattggtttggtgcattcacttcaggggtggattagcttgggaatcttctaacaaaaatctcatctttaatctccatcctgtattgatgttgattggcttcattatcttaggaggtgaagccattatgagctacaagtcattgccactgaagaaggaagttaagaaagtcatacatcttgtgctccatgccactgctctgattctaggcattattggaatctatacggcattcaagaatcataatgagagttcaatacctaatctctacagcgtgcattcttggcttgggattggaatcattaccctntatggcattcaatggatatatgggtt

SEQ ID NO: 21622 - DNA, 405 bp, Gossypium hirsutum
  Clone ID: LIB3272-002-P1-K1-B5
cggacgcgtgggtaccgctaccagtgaaagccgcactattcagtcttcggtcgccgctccccctttctatctattcaatctgaggtatgtcgacggccgtggcagccaccgagaccagcaaagacccaacccaacctacctccgaagtcaagcttttcaatcgctggtcttttgaggatgttcaggttactgatatctctttgagtgactacattggtgtccaagcttcgaagcatgcaacctatgtgccgcacactgctggaaggtactcagtgaagcgtttccggaaggctcaatgcccaattgttgagaggcttacgaactcactgatgatgcacggccgaaacaatgggaagaaacttatggcagttaggattgtgaagcatgccatggaaattatttatc

SEQ ID NO: 21623 - DNA, 413 bp, Gossypium hirsutum
  Clone ID: LIB3272-002-P1-K1-B6
ctttatttagggttttcttttgattactcctcttcccgatttcataaaattttaatattctcccactccgaatcgatctatgatttgggcaattcctctgtttttgctgtaaatattattcaaaatcaatttcatcaattatgtttttattgccttcttcgttgatgacttgcaacgtgatattccaaaacctgcgtgtgttcggtcctggcttgaatactttttcccctttctgcgtcgctcatcattcctctgcttctcgctaatctgtttccctcttctccttgttttcatctctatcatgtaatcatttttctcttcatcttaagctttcgaggggattgtttgttttccaagaataaaaagaaagggatctaactctttgtgaaaatatcacgtttttacaaaaatat

SEQ ID NO: 21624 - DNA, 419 bp, Gossypium hirsutum
  Clone ID: LIB3272-002-P1-K1-B7
attttcttaagaaagaacaactttcagcggaaacagccgcttcctccaacatgggtagagggttgaagaaacacttgaagaggctcaatgcccccaggcattggatgctcgacaagcttggtggtgcattcgcgcccaagccatcgtctggaccccacaagtcgagggaatgtttgccacttattcttattctgcgaaacagactgaagtatgctttgacatacagagaagtgattgctattcttatgcaaaggcatgttatggtagatgggaaggttaggactgataagacctaccctgcaggttttatggatgttgtgtcaattcccaagacaaatgaggacttccgtctcctttatgacactaaaggtcgtttccgccttcatgccatcactggtgatgagactaagtttaagctc

SEQ ID NO: 21625 - DNA, 419 bp, Gossypium hirsutum
  Clone ID: LIB3272-002-P1-K1-B8
gtttcaaagctctgccactcaccgtctctcatctgcttctagctgaagcctttaatgtctgccaacaaagcctgacggtgacgttcttctccttctcccctttttctaaaccaaaataaaacccccactaaactctttcaaattcagtcacccaaataaacaacaatggctacttcatcatcttcttcaaagctttcccttttcttcttgttttccttcttgtttgcttccactttagctcgtaattccccttcaccaacaacaaaaatcctcgatgtcttagcttctttgaaacaagctcagcatattctttcctttgatcctcaaatttctaatggtttttccaaaagccaaccccttttcgtcaactcttcttcttcatcgggttctggtttttcgattccacttcattcacgggg

SEQ ID NO: 21626 - DNA, 414 bp, Gossypium hirsutum
  Clone ID: LIB3272-002-P1-K1-B9
agattccaaaaaccaaccatggcatccactgataaaactgctgtcccactgtcatcaccaaagtctgaagctaccccaccatccgcagtggcggctgcggctaagtcccctttcaactattcttttgtcgatgttgttcttcgggtcttactatttgcggctactctaacttcagtggtggtcatggctaccagcaaggaaaccgagatggttccagtgccaggcttccctttaatcaggatccaactccaagcaaagttcaatcattcacctgccctcgtatattttatagcagcattatcagtaacaggcttctacagcattatcactgcgttggcatcactttcaatcgtgcttaaccctacctattccaaaaccttcttgctcttttttgctttcttcgatgtggtattt

SEQ ID NO: 21627 - DNA, 406 bp, Gossypium hirsutum
  Clone ID: LIB3272-002-P1-K1-C10
tagcaatgatgtggcttgggtcccatgctccggctgcaacgggtgctcagccaccactttctcacccaacacttcttccacctatggttcgttagattgcggtttgccccaatgcgcccaggtccgtgggctgtcgtgcccggctacggggtctgcggcttgctcttttaaccaatcctacggtggagattcattattttcggccaacttggttcgagattccttaggattagccaatgacattgtcccagattttgctttcggatgtataaacgtcatctctggtggatcagtaccaccgcaaggactgttgggtttgggtcggggacccatgtcacttatttcacaatccggggccctctactctggtgttttctcatattgtctacccagtttcaagtcctac

SEQ ID NO: 21628 - DNA, 394 bp, Gossypium hirsutum
  Clone ID: LIB3272-002-P1-K1-C11
tgcagttgctttgatttgctttgtggtaaccgctgtcggtggtcaatctgcggcggcctcacctactaaagctccgccggccgcggctactcctgctactgctcccgctactgcccctgttagcaaacctaaatcaccggctccaactgctgcccctaccacttccccaccaacttcttcaccaccggctgcggctccggagaagtctgcggcggttccagccccatctaaatctgctacggcttcttctcctccggctgctgctccggtgagttctccacctgctccagtacctgtgagctctcctccagccaaatcgcctcccgttgctgcaccgacgactccaccagagagctcggcctctcctacggctcctgttgctgcaccaactact

SEQ ID NO: 21629 - DNA, 404 bp, Gossypium hirsutum
  Clone ID: LIB3272-002-P1-K1-C12
gttgttttccccttattttcctaacagagccttctcaaaaacgacattcaacagtggcgaattcaatggcgaagtctttccttcaagttgcagctactgaagaggttgtttctcctctcagagttgtccagatcgaaggcctggtgatattgaaaataatcaagcactgcaaggaattttcacctgctctggttaccggccaacttcttggattagatgttggcattgttcttgaagttactaactgtttccctttcccgatccgcgaggaagatgaggagattgaagctgatggagctaattatcagcttgagatgatgagatgtctaaaggaggttaatgttgataacaacacttgtggatggtaccaatcaacgattttgggttcatatcaaacaagtgag

SEQ ID NO: 21630 - DNA, 272 bp, Gossypium hirsutum
  Clone ID: LIB3272-002-P1-K1-C2
ccggaatcggcgacccacgcgtcggaggaaaactgggcaattgttacctgtttcttcgcaggaatggaaacttgtttcgagctgtactatcgtatcttcgaaaccctatcgtactggccttaaatgttgggcgtgccaaaaattgtacaccatttatgatctgggtcaaaggcagtaggaaaaaaagtataaaagctgaattaaatatcaataaggggaccccgaagttaagacgctatctataagttaggccaaaaaagactttgacattg

SEQ ID NO: 21631 - DNA, 417 bp, Gossypium hirsutum
  Clone ID: LIB3272-002-P1-K1-C3
agcatcagttatatcactgtattgcatgtacctctgctacagtgggcttgcaagtgaaccaagagattatgaatgcaatggtctccacaagcattctaaagcaatttctactggcactgtgactgttggcctgcttaccactatcctttctgttgtctattctgctgttcgagctgggtcttctacaactctactatccccaccaagttcacctcgtgcaggtggtggaaagccattacttccattggacaaggctgatgaggagaagaagaataaggcagtgacgtactcgtacgccttcttccacatcattttttctctggcaagtatgtactcagcaatgcttttgacgggatggtctacctcagttggggagagcgggaagttggtagatgtaaggtggccatctgtgtggat

SEQ ID NO: 21632 - DNA, 294 bp, Gossypium hirsutum
  Clone ID: LIB3272-002-P1-K1-C4
gtctccactcgggggtgatgaaagtgtacaagctgggcaaagccttcaagtaccggagtgtgagtttgtggatgggaaattggatattcaaaatactggtgtacctcttggggatcattgccatggaaaatttgatataagcacattgcagatcattaaaaatgtaaatcttgaaaaactaaaggaggtgggttcgggtacctttgggactttcttaccacggaaaatggagaggaacagatgttcccttcaaccgattaaaaaaaatttgtttaactggtcgatcttttaagc

SEQ ID NO: 21633 - DNA, 345 bp, Gossypium hirsutum
  Clone ID: LIB3272-002-P1-K1-C5
tctaggtcttctctccccaattacaatcgaaatcagggtttttccctatccaaattctgatttaacccagtatgcctcaacgtcactcgaagaacaacaacgatttagccttcttcacgtacgatgagaagaggaagctaggttacggtactcaaaaggagagattaggaaaagattccattaagcctttcgatgcttgctgcctttgcttgaaacctttcatcgatcccatgtcttgccaaaaaggtcatgttttttgcaaagagtgcattctcgaatgccttttagcccagaaaaaggatatccaaaggaaacttgctgctcatgctgctcagcagaaacaag

SEQ ID NO: 21634 - DNA, 421 bp, Gossypium hirsutum
  unsure (1)..(421): unsure at all n locations
  Clone ID: LIB3272-002-P1-K1-C7
caggngagaaaaaacccggtcgacttacgcgtccgcttcattcatacgaaagctaaaacagcattgcctcccttctttatgcgggtcaggcgtgattcttgtttatttcgcaattaaaaattcattgtcaggctggtcttgtaaaggaatgttataagctttcaatataaacattcagaatgaagaataccaaagcgacaactctaagccaacccttgacaaaaaaatttcatgtcgatgattatttgtcatcatttggggaaaaatgtggaacatatgggattgacagtgctgctatcgctgctgtgattgtacccatattgctttcctctatcatgagaaagaaaaaggggaaaaaaagaggagttccagtcgaagtgggtggtgaaacaggttatgctgtgcgcaatgctcaaaccac

SEQ ID NO: 21635 - DNA, 406 bp, Gossypium hirsutum
  Clone ID: LIB3272-002-P1-K1-C8
cactaatcatgttccttctgaagacttggcgggcatctgcatttggagtttatggttacttgaatttcaccagaaatggcttcttgggacactccaagaaattcaaacccgaagatatggaaatacgaatagaggggaagaactgcgtggtcacaggagcaaatgctggcattggttttgctactgctgaggctcttgcatcatgtggagcaactgtctatatggtgtgtcgtaacaaggagaagggagaaaccgctctttctaaaattcagtcttcaactggcaatccaaatgttcatttggaagtttgtgatctttcgtccatcagcgagatcaagtcatttgcatccaggttctcttcaaaggatgttccggttcatgttcttgtcaacaatgctggactgat

SEQ ID NO: 21636 - DNA, 419 bp, Gossypium hirsutum
  Clone ID: LIB3272-002-P1-K1-C9
gaaccccaataacatgttctcaaagctccaccaccaccagcaccaccgtcatcaacatcaacatcaaccccaacaccaaactcaccctttctctcatcacttccaactctctcgtgattctcagactcccgactctgatgacactacccacacccctcccaaagatcttaccaccaaccacagcccttctctccccagtggtggtagcaaaggcggtgcttctcgtggtggtgccaacagtggcgacggtgctagcatcgaaatcgttcgtagacccagaggtcgtcctccgggctcgaagaataagccgaagccgcccgtcatcatcactcacgagcccgaccctgcgatgagtccttacattctcgaaatccccggagggaacgacatcgtcgaagctatctgccggttctctcgtc

SEQ ID NO: 21637 - DNA, 407 bp, Gossypium hirsutum
  Clone ID: LIB3272-002-P1-K1-D1
catcttcttcctccatctccgctctttccctgttttacaagcagcaaagctacacttcaacaatggaagatactaaaatggaggactcatcaaatcaaagggaaatgtctcacgaagaaatgcctgaaacacacagcaagggtggcctcattaccatgcctttcataatagcgaatgaatcatttgagaaggtggcgagctatgggctggttcccaacatgatactgtacctgattaaagattatcacatgggagttgctaaaggcaccaatattctctttttctggcaagctgctaccaattttacccccatattgggtgctttcgtcgctgattcatatctgggtcgattcctaaccatcggcttgggctccatttgcagtctcttggggatgatacttttatgg

SEQ ID NO: 21638 - DNA, 412 bp, Gossypium hirsutum
  Clone ID: LIB3272-002-P1-K1-D10
gagcaaagcttcctttatatgctttcaagaaggagagtgaaaaagatgcatttgaaactgaaaacaaagagcctccagttgcttttcttgattctctcgttcttggggagtgggaggatcgcatgcaaagagggctctttcgatatgatgtcactgcctgtgaaaccaaggtggttcctggtgaatatggctttattgcccagctgaacgagggccgccaccttaagaagaggccaactgagttccgtgtagataaggttctccagcccttcgatgggaacaaattcaacttcaccaaagtcggacaagaagaggtgctcttccagtttgaagcaagtgaagatggcgaagttcagttcttcccaaatgctcccattgatgttgagaatcacccaagtgttgttgccataaa

SEQ ID NO: 21639 - DNA, 387 bp, Gossypium hirsutum
  Clone ID: LIB3272-002-P1-K1-D11
ggaactcctgatcccaatgcagaagtgattgctttatcaccaaagacccttttggccacaaaccgattcgtgtgtgaaatatgcaacaaagggttccaaagagaccaaaaccttcaactccatcgacgaggccataacctaccatggaagctaaagcaaagaaccagcaccgagatccgtaaaagggtttacgtctgccctgaaccatcatgcgtccaccataacccagctcgagccctaggtgatctcaccgggatcaagaaacatttttgtcgtaaacatggtgagaagaaatggaaatgcgataaatgctccaagaaatacgctgttcaatctgattggaaagctcattcaaaaacctgtggcacaaaagaatataaatgtgac

SEQ ID NO: 21640 - DNA, 389 bp, Gossypium hirsutum
  Clone ID: LIB3272-002-P1-K1-D12
ctttattgtcagggatttttaccaccagatgaggtgcacatatttggctatgcaaggactaagatttcggatgatgatttaaggaaccgtattcgtgggtatcttgtcaatgatagaagtgcttcaccctcagaagacgtgtcaaagttcttacagctgattcaatatgtaagtgggtcatatgacggagctcagggctttcagctattagacaaggaaatcacaaagcatgaaatctcaaaaagtagccaagaagggtcatctcggagactcttttatcttgcacttccaccatcagtgtatccatctgtttgtaggatgatcaggaaatattgcatgaataaatctgatcttggcggctggactcggatagttgttgagaaaccatt

SEQ ID NO: 21641 - DNA, 411 bp, Gossypium hirsutum
  Clone ID: LIB3272-002-P1-K1-D2
attttcttctctatcttaaaccttgttgttttgttgcaaaagatgagtaacaacagcattgcagaaagctcaaacacccaaaacccaatcctcaaattgctagattgttcccttagggtttcagtgattccactaagtgttgcaaccatttggttaactgtaactaacaagcaagacaacagcatctacggagatgtcaaattcaacaatcttttgggtctcaaatacatggtttgcaccagcgccatatgtgctgcttatgctttatttgctgccattgcctcttggatcagatattttgtcactaaagcttggctcttctttgtctctgatcagattgtagcatatttaatggtgacatcaagggcagcagtgatggaaatattgtacttagcatataatggggacata

SEQ ID NO: 21642 - DNA, 408 bp, Gossypium hirsutum
  unsure (1)..(408): unsure at all n locations
  Clone ID: LIB3272-002-P1-K1-D4
aaaaaaaatggcttcttggaattcaattccactggaaatcacgtacgacacttttggttggctagcctttttttcgtggtccattagtttctaccctcaagtcatcttaaattttcgaagaaaaagcgttgttgggttgaactttgatttcgtgctgctgaatttgacaaaacactcctcttatatgatctacaacgtttgcctttacttcagccctgttattcagaggcaatactttgagaaatatggctctggagagatgatcccagtagctgctaatgatgtcgcgttctcaatacatgctgttntgttgacggctattactttgtttcaaattgtgatttttgatcgtgggacgcaaaaggtttataagatttctgtgggaatcatcattgctgtgtggttaat

SEQ ID NO: 21643 - DNA, 157 bp, Gossypium hirsutum
  Clone ID: LIB3272-002-P1-K1-D5
ctagattctataagcatttcccacttttttttttgtaggctatggatatatatatatcgagtgatttaagtattggagtattggcttctatgtaggaggtagttgcctttgtacaatgtaattctgccttttttaactttggtagaatttttgggtc

SEQ ID NO: 21644 - DNA, 410 bp, Gossypium hirsutum
  Clone ID: LIB3272-002-P1-K1-D6
ctcctagtgcaccggcatcgtttttctcctctaaaggtacgtgtaaacgcggcggcagcgtccgatctggtttctgcaaacgagatttctcacagaacaacgcaaatttcggatggagcgcggttccgttgcggttcatgtactttcgtaatgattcatgggttaatttctcggccgatgtagtagaaacgctccgagccggtttcttggagcggaaaccgattatcgagacgtcgattgacggttcgaagtatatatttgatttcaagaggatgctgcagatcgagtactcgacaggtaattgccggtcaatttcttggatagacgaaagtggcaagtgttttttccctagcgatttttttagcgaagaagaatttattgaatcagaatgtagtgagtgggatgattat

SEQ ID NO: 21645 - DNA, 408 bp, Gossypium hirsutum
  unsure (1)..(408): unsure at all n locations
  Clone ID: LIB3272-002-P1-K1-D7
aaattattgcacttcctctatccgggaaaaaatgtcgccggctgccggagtaaaagcgccactgcttccagggagcagcaaatcggcaccagcaaagcctccatcggtatctggcgcggtgtttaatgtgtccacaagcatcatcggagctggaataatgtcaatccctgcaacactcaaggtgttaggtgtagttccagcatttgtgatgattgtggttatagcttggttagcggatatatcagttgaatttttgatgagatacacacatgctggggacacaactacgtatgctggtgttatgagggaatcatttgggagggttggatccatccttgtccaaatatgtgtgatgatcactaatctnggctgcctcatcatttttttgattattataggtgatgttct

SEQ ID NO: 21646 - DNA, 412 bp, Gossypium hirsutum
  Clone ID: LIB3272-002-P1-K1-D8
cgtggctttcctatcttcatttcatcgcactctccgacgaaagaaacgagagaaaaatgaccaagtgttacccaaccgttagcgaggagtaccaaaacgccgttcaaaaggctaagaggaagctaagaggtctcatcgctgagaagaactgtgctccactcatgctccgtctagcgtggcactcagctggaacttttgatgtcaagaccaagaccggaggtccattcggaaccatgaagcaacctgctgagctcgctcatgctgctaacaacggtctcgatattgcagtcaggcttctcgagccgatcaaggagcagttccctatcctttcatacgctgacttctatcagcttgctggtgttgttgctgttgagatcaccggtgggcctgaagttcctttccatcctggaag

SEQ ID NO: 21647 - DNA, 416 bp, Gossypium hirsutum
  Clone ID: LIB3272-002-P1-K1-D9
tggcgatggattatttccattcagtcacagcaattccaactgttggggtgattggctttccactactggggcttttctcttttctatggatctcaagaagaaacaaaaactcgaagaaaacagcaccagaagctggtggagcatggcctattattggtcatctgcgcctcttaggagggccacaaccacctcacataagcttggctaacatggctgacaaatatggaagaatgttcgctatcaagttgggtgtgcatagagctttggtggtgagcgattgggagattgctaaagaatgtctcaccacaaatgataaagcgtttgcctctcgtccaaaacttgcaagctcggaacttttggcttacaacagagccatgtttggctttgcaccgtatggaccttattggcgtcatatg

SEQ ID NO: 21648 - DNA, 394 bp, Gossypium hirsutum
  Clone ID: LIB3272-002-P1-K1-E1
gcagaaagggaaaattagaaaccctaaatatctgcccctttattcagtccaccattcagccaccactccaccactgggatcgatggacgatggtctatggtggttcctttacttctatgttcaaggttcgtcaattttaacctcaaagtcccccccaaacttcgatgacaacgaaggagatggggatttcagtggctcattcacgaaggtatggagcgtgtgctggcactcggagtagggtgcacagaggtcgctcgtggtggtcgtacggtgctgggggttggggtttggctgcggcgcaaaggggagaaaccctagggtttctttttgtgctttaattttgggccatttgggccttgtattactaagctaggttttaggtttaaagtcgcat

SEQ ID NO: 21649 - DNA, 408 bp, Gossypium hirsutum
  Clone ID: LIB3272-002-P1-K1-E10
gcttgagcgtatggccttcaagagcacgacaaaccgcagccatttgcggattgttcgggaagtagaggcaattggtggcaatgtacaagctgcagtttctcgggagcagattggatatacctttgatgctttgaagacttatgttcctgaaatggtagagctgcttattgactgtgtgagaaacccagctttcttggattgggaggtgaatgaacagcttcaaaaaatgaaagaggaaattgctgaagctgcaaagaatcctcagggcttgctcttagaggccattcactcagctggttattttggtgctttggcgaattctcttttagcccctgagtctgctgtaaatacattgaatggtacagttttggaggattttatcctggaaaactttactgcttctcggat

SEQ ID NO: 21650 - DNA, 399 bp, Gossypium hirsutum
  Clone ID: LIB3272-002-P1-K1-E11
tcaacttttcaggtgttcttggtttctgagtattgaaggaattctctgtggttctttttaaagctaaagagttcagcttttggggttgatgccttgttggtttcttggcttatattgaagaatttttgtgttcaaagtccatttccttggtgctttatcatggattccccacagtcagttgtttcaccattcaagaactctgttgtagctgagcctgagaagcagaaaaccgagtttttcagtaggaactcgggtggtttgttgtcaaatgggtccgaggttaacaaaaaggaagagaattccattggtgttcttgaggtttatgttcatcaggcaagagatatccataacatctgcatttaccacaagcaggatgtgtatgctaagctttgtctcacc

SEQ ID NO: 21651 - DNA, 405 bp, Gossypium hirsutum
  Clone ID: LIB3272-002-P1-K1-E12
ggttaagagcaaaagacagggcagagtaagctaagctttgatcatcaatggcggagaagagtttcaagtacgtgatccttggcggtggtgtagctgctggatatgcagcgagagagtttgccaagcagggagtgcagcctggtgagctagcaattatttccaaggaggcggtggctccatatgaacgacctgccctgagcaaagcatatctcttccctgagggagctgctagacttcctggtttccatgtctgtgttggaagtggcggagagagattgcttcctgagtggtacaaggaaaaaggaattgaattgatccttagcacagaaatagtgaaagcagatcttcctgccaatactctagtaagtgccgctggagaaacattcaaatatcaaatcttgatca

SEQ ID NO: 21652 - DNA, 359 bp, Gossypium hirsutum
  Clone ID: LIB3272-002-P1-K1-E2
aaagggttcatggggaagacaaggtatggtgctttgggtggtggagctaactctgtgaatcatggctacaccaagggagatgggcttggtgctgaaattgttggtacctttgttcttgtttacactgtgttctcagccactgatgccaagcgcagtgccagagactctcacgtccctattttggcaccattgccaattgggttcgcagtgttcttggtacacttagccaccatcccaatcacaggaactggtattaacccagctcgtagccttggtgcggccatcattttcaacaaggacaagggatgggatgaccattggattttctgggtgggtccattcattggtgcaacactagc

SEQ ID NO: 21653 - DNA, 420 bp, Gossypium hirsutum
  Clone ID: LIB3272-002-P1-K1-E3
ggtggtggaaatccttcttcgcttctggttcagtcgccatctacatcttcttatgactccgtaaactacctcatattcgatctcaagagtttgagtggaccggtctctgcaactctctacttggggtattctctcttcatggtcctcgcaatcatgttggccactggcacgatcgggttcctttcatctttctggttcgtgcattacttgttctcttccgtaaagctggattgaagaggtaaatcggtaacccgagaggcaggggaggaaagaattggaccttttacattacttgatcatatattacatgtgttatattgagctcatttactctgttaggggaactttagtaaaatgcaataacaataatatggcgcagtttcatttaaattctttattaagtggtactatgatgcatgg

SEQ ID NO: 21654 - DNA, 408 bp, Gossypium hirsutum
  Clone ID: LIB3272-002-P1-K1-E4
acttcagctgccattttcttaccctttgtactgttcgaattcaagacataataccccatgaattttaaagaaacccaacaagcgacaacatggaccgatgaagaagacaaacaagcccagcaatatgccatgcaactggttagctcatcggtggtgcccatggtgttgaaagcagctattgagcttggtgtgtttgagattatacaaagagctggtcctagtgcgcttctgtcaccttcccagattgcatcccaacttccatctcagactaatccaaaagcccctttggtccttgatcgaatcctccgccttctagctacccactccatcctcacttactctcttgtaacaaaccaagcagatggccaggtttacaggctctatggtttggcaactgttgccaaatac

SEQ ID NO: 21655 - DNA, 409 bp, Gossypium hirsutum
  Clone ID: LIB3272-002-P1-K1-E5
cttctctccttccttctccactccctcggtcaattcttcctccagagcccacagggggggaaccaaccctaatctaggctttttggcctcagtttcgagatccttgaggtctctcaaagcaaccaggctgactactgataatgcttgtggctcagctatggcctctcgtatggtctccgttcctgccgtccagacacacatatctctcgattttgagacctttgtcttcaagaaggagaaagtctccctcgctggtcaggacgagtacattgtgagaggaggaagagatttgtttaagttgctgcctgacgctttcaaagggattaagcagattggtgttattggttggggttcgcagggacccgctcaagctcaaaatgtaagggattctcttgctgatgcaaaatct

SEQ ID NO: 21656 - DNA, 387 bp, Gossypium hirsutum
  unsure (1)..(387): unsure at all n locations
  Clone ID: LIB3272-002-P1-K1-E6
cggacgcgtgggttcagattctgggttatggccatagctctgccatctacagtgtggcacgcaacaaagtttcagccgcaacgtccgcttcttcagcgtcggcgccccttattagtccaatcctttaggcggagcgacttcgacaccttcactcgccgcatggcttctggtgaggccttgaaggaggcctggcgaaccgccaacgacggcttcgagcaattcgtcttcgaagctaaaaagaccgctgaacgcttagaccgccagtattccgtttcccgccggctctcctccgccgcccaatccgctgcggaccgtgctcgtgagattgaccgggagttcgagattggactccgttggcggactttntctatggattttagtagaaat

SEQ ID NO: 21657 - DNA, 239 bp, Gossypium hirsutum
  unsure (1)..(239): unsure at all n locations
  Clone ID: LIB3272-002-P1-K1-E7
gggannngcgggnggagaagacgagagcncancncncngcnncaaagcggcgggccgggnagaanncncgnacnacccccgcgnagnngnacnnngangaacaancgccanggcnncaaagcggannnngaaggaacccaaggannngcagaaagaaccacccacnncnnngagngcnggncccagagcngaagacangnngcannggcaagcaacaancangggacccncaganagcc

SEQ ID NO: 21658 - DNA, 413 bp, Gossypium hirsutum
  unsure (1)..(413): unsure at all n locations
  Clone ID: LIB3272-002-P1-K1-E8
caaaaatgatgatcggagaatcaatccaaccaaatcccaccatcaaaatgcccgtgaggggacccattcaacgatccgacggctagctttcactccgttaactttaactacaacaatgcagtcagtagtccttgccccgtcgattacctcgggtctctccaccgttacctaccgtcaaacgactacgagtccgattcgctgagtgatgattcggacttacctgttgatgcattctcatgcgaccatttccggatgtacgagttcaaggtgaggaggtgtgctcgtggaaggtcacatgactggactgagtgtccgtacgctcaccctggtgagaaggcccgaagaagggacccgagaaagttccattactctggaactgcttgccccgattntcgcaagggaagctgtaagaa

SEQ ID NO: 21659 - DNA, 402 bp, Gossypium hirsutum
  Clone ID: LIB3272-002-P1-K1-E9
gaaaaacgctgattaaggaaggatttctagggttttttttttccgtatgggtaagcgatggcaatggctgctctcagacgcgaagggaggcgtttcgcccctctgatctctccccgtccaatttctgctgtccgatcctctcctatcgttcccactcacgaatatgagggtccgattggtgttcgttatatttcaactcaagtcgttagaaaccggatgaagagtgttaagaatattcagaaaattacaaaggctatgaagatggttgctgcctcaaagttgagagcagttcaaactaaagctgagaattcccgaggcctctggcagccatttactgcacttcttggtgatcttcccagtgttgatgtcaagaagaacgttgttgtaaccatctcttctgac

SEQ ID NO: 21660 - DNA, 374 bp, Gossypium hirsutum
  Clone ID: LIB3272-002-P1-K1-F1
ggctgccttttgtccaattaactccatttctcctcccccaataatccctctctcatttcccgatctgctttagctttagggttctccacaatattcaattttcccttttttttaaagaaagaaagatatactttgttttctaattttcttacatttattcgtcgacgaacaagcgatttatctgtgctttgattctgatctctctagggtgttaattcatcgatcatgacgattccagattcgggatgcgtgatggagaacggcgcgagttgcttgccgtgcacgcccgaagaagagaaaaagatcgttactgatttaagaaacgaatccgaacgtaatttgaaagaaagcaacttgtatttcgttatttctag

SEQ ID NO: 21661 - DNA, 398 bp, Gossypium hirsutum
  Clone ID: LIB3272-002-P1-K1-F11
gtagccgccgcctgcgtctctctcttcatctctctgaaccaaaaagtctgtagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgaaggttgttgacattgttgacactttcaggcttcaggagcaaccccctttcgacaagaagcagtttgtcgtgttcatcaagaagttcatcaagaacttgacaccaaaactggatgcggaaaagcaagag

SEQ ID NO: 21662 - DNA, 409 bp, Gossypium hirsutum
  Clone ID: LIB3272-002-P1-K1-F12
cttcgctgcaaacttggatcctactgctgcacagattggtgtttgctatgggatgcttggcaataatctcccaaattcatgggaagtcattcaactttacaaatcaaacaacatccggcgattgaggctctacgatccaaatcaacaagcattacaagctcttagaggctccaacattgaagtaatgttaggtgttccaaatgatcaacttcaaaacctcgctgacccttccaaagcacgatcatgggttcaatcaaatgttgtagcttactggccgagtgttcggttccgatacattgctgtcgggaatgaagtccctcattcatcttggttagctcaattcgttttgcccgccttagtgaatgtattcaacgcggttcgatcggccggtttggagagtcaaatcaag

SEQ ID NO: 21663 - DNA, 388 bp, Gossypium hirsutum
  Clone ID: LIB3272-002-P1-K1-F2
caccgatccaatcaatcgcttcaactatctcaccaaacacatatccaatggctgcgatcgctgtcggcgacgtgttaccggacggtactctctcctacttcgacgccgatgataagctccagcaggtgtccgtacattccctggctgccggtaaaaaggttatcatctttggcgttcccggtgcctttacccctacttgcagcttgaagcatgttcctggattcatcgagaaagcaggggagctgaaatccaagggctttgatgaaattatttgcattagcgtgaatgatccctttgcgatgaaggcatggaccaaaacttaccctgagaacaaagatgtcaagtttctagctgatggttcagcaacatacacccatgcccttggtct

SEQ ID NO: 21664 - DNA, 397 bp, Gossypium hirsutum
  Clone ID: LIB3272-002-P1-K1-F3
gtacctcagtttcttcttttactgcttctctctttgtcccttcaaaaagttcatgttttgccaatcataagcgcagattcatccaatgttctcttggtggggctgtggtagaaccaaaagctttagcagaacccctgttgctcaatgctgttcgagggcaagatgttgaaagaccaccagtttggcttatgaggcaagcagggaggtacatgaagagctatcaaataatatgtgaaaaatatccttcctttcgtgaaagatcggaaaatgttggtcttgtcgttgagatttccctgcagccatggaatgttttcaagccagatggggtcattttattctccgatattctcactcctctctcagggatgaacatacctttcgacattatcaagggtaa

SEQ ID NO: 21665 - DNA, 403 bp, Gossypium hirsutum
  Clone ID: LIB3272-002-P1-K1-F4
gtggtcggacatattactgtgttacaaagggagtaccatatccctctattcctagaaaaaccaaacctaggcgtgttgatttatactattcaagttggtgcattcgtgcagctgaatcaaggaaaggggatggccagctgactgcgtgcgaggtattactttttcaccatgaaaatatgggtataccatgggaaattgcaaagcttggggtcaagctaggcatgtggggaactgtcaggaagattgaccctggcttacgtgcatatcaaaccgaaagagcatcgggagcgcccctttctcattcagcttccatggctcaaataaacaccaaagtaactcaagactatctgacatccttggaaagcaatagtaatgattcatcagagcttgaaacacacaattc

SEQ ID NO: 21666 - DNA, 407 bp, Gossypium hirsutum
  Clone ID: LIB3272-002-P1-K1-F5
cggacgcgtgggtctgaacctaaaagtctttagcttttcgcttcgagagagacgatgtgggtttaccaggatctcatctccggtgacgagcttctttctgactcattcccctacaaggaaatcgagaatgggatgctgtgggaagttgagggaaagtgggttgtgcaaggagctattgatgttgacattggtgccaatccttcagccgaagatgctgatgaggatgaaggtgttgatgaccaatctgtgaaggttgttgacattgttgacactttcaggcttcaggagcaaccccctttcgacaagaagcagtttgtcgtgttcatgaagaagttcatcaagaacttgacaccgaaactggatgcggaaaagcaagagtccttcaagaaaaacattgagggagcaac

SEQ ID NO: 21667 - DNA, 401 bp, Gossypium hirsutum
  Clone ID: LIB3272-002-P1-K1-F7
ctgccatcaatttgctttgaagatcatgttggctatttttcacaaggcatttgctaatccaccagaggagctgaatagtccagcttctcataaatctactaagaagcctaaacagcctgaagaaaccctaaatgatttcctatctcatcaccctcacaacactttctccatgagctttggcaacgctgctgttttggcttatgtccgccatgaacgtgctgcttcagttcatcagaggttgttttgtgggtttgatgacatatactgccttttcttagggagcttgaacaatctatttatgctgaatagacagtatggtctttccaaagggagcaatgaggcgatgtttgtgattgaagcatataggacactaagggataggggtccataccctgctgatc

SEQ ID NO: 21668 - DNA, 403 bp, Gossypium hirsutum
  Clone ID: LIB3272-002-P1-K1-F8
tgatttgagcagcagcagctaaagcagatcccaaaatgaagaaaaagggcgcatgtacaacttctggttgccagaagaagctcgagatcgatgacgaccagaagcttcgggcatttttcgacaagcggatctcgcaggaggttgctggagatgctttaggcgaggaattcaagggctatgttttcaagatcatgggaggttgcgacaagcaaggattcccgatgaagcagggtgttctgactcctggtcgtgttcggctcttgcttcatagaggtaccccatgcttccgtggatatggaagacgtaatggtgagcgtagaatgaagtctgttcgtggatgcattgatagccaagacctttctgttttgaacttggttattgagaaaaacggtgagaatgattt

SEQ ID NO: 21669 - DNA, 367 bp, Gossypium hirsutum
  Clone ID: LIB3272-002-P1-K1-F9
ggtaagtccagggtatgcgttacaggagccgctggtttcattgcctctgactggtcaagaagctactggagaaaggatataccgtccacgctaccctcagaaatttgggcgatgcttcaaaggttcaactccttaagagctttcctcatgcggacacagaattagttttgtttgaagctgatataaacaggccaaatgagtttgagcaagctattcatggctgtacgttcgttttccatgttgcgactcccttgcaaccctctgatgcttctcagtttaaaaacacgagtgaggctgcagtttctgcaataaaaagtattgcaaagtgttgtataaaatcaggtagtgtgaaacgattaatatacac

SEQ ID NO: 21670 - DNA, 410 bp, Gossypium hirsutum
  Clone ID: LIB3272-002-P1-K1-G1
attttctcctttttatctttaaaacacgcacccaaaaaataaaaccctttgaaaaccaaagaaggaagaagaagatgtcgtggcaagcttacgtagatgatcacttgatgtgtgaaatcgaaggaaaccatctctctgccgccgctatcatcgcccacgacggcagcgtttgggcccaaagcgccaatttccctcagttcaagcccgaagaaattaatgccatcatgaatgactttaatgaaccgggtacgctcgctcccaccgggttgcacctcggtggcacgaaatacatggtgatccaaggcgaaccgggagctgttatccgagggaagaagggacccggaggtgttactgttaagaagaccaatatggccttgatcatcggaatctatgatgaaccaatgacaccc

SEQ ID NO: 21671 - DNA, 403 bp, Gossypium hirsutum
  Clone ID: LIB3272-002-P1-K1-G10
gcattttgttttcccttttttttccccacacctttttttaaacccatttgctaaaaatgcactgggttcttccagtgttgcttgccgttatcggagttactgcactgctcgttgtaactccggtaagtgggtaccgtccatggccgtacttaaaacccaacagctccgacttaatgttcggaggctctaagaaatttgagggctcatcggagtttatccatatgagatatcatatgggtccagtccttactgctaatatcaccatccacccaatctggtacggccggtggcagaaatcccagaagaaaatcatccgtgagttcatcaactcgatctccgccgttgattccaaacacccttcggtggctgggtggtggaagaccgtacagctttacaccgacca

SEQ ID NO: 21672 - DNA, 406 bp, Gossypium hirsutum
  unsure (1)..(406): unsure at all n locations
  Clone ID: LIB3272-002-P1-K1-G11
gttccttccttcgccgtctactgcacttgtgacatcgatttcaagtgaatcagaatgggtaaggaaaagagtcacattaacattgtggtcattggccacgtcgattccggaaaatcgaccaccactggccacctgatctacaagcttggtggtattgacaagcgtgtgattgaaaggtttgagaaagaagctgcggagatgaacaagaggtcattcaagtatgcttgggtgcttgacaagctcaaggctgaacgtgagcgtggtatcaccattgatattgccttgtggaaatttgagacgaccaaatactactgcactgtgattgatgcgcctggacaccgtgactntatcaagaacatgattactggtacctcgcaggctgattgtgctgttttgattattgatt

SEQ ID NO: 21673 - DNA, 408 bp, Gossypium hirsutum
  Clone ID: LIB3272-002-P1-K1-G12
aaaaattgagtgtcagtttgaaagtgttcttcagatatggctatgaaacaagttgctaattctgctatcaaagcaattgccaattctgggtcatcctctcttcttaccagacaactccatgcttctccagggagcaaaaagattgttggggtgttttacaaggccaacgagtactttacgaagaatcccaactttgttggttgtgtggagggagccttggggttgcgcccatggctggaatcacaggggcatcagtatattgttaccgacgacaaagaaggaccggactgcgaacttgaaaagcatatccctgatctccatgtgctcatatcgaccccattccacccggcttacgttacggctgagaggatcaagaaagccaaaaacttgcaactgcttctcacagca

SEQ ID NO: 21674 - DNA, 404 bp, Gossypium hirsutum
  unsure (1)..(404): unsure at all n locations
  Clone ID: LIB3272-002-P1-K1-G2
ctcttttgaagcctaacatggtgacccctggttcggactccccgaaggttgccccagatgttattgctgagtatactgtccgtgccttgcagcgaactgtccctgctgcagtcccagctattgtattcttgtctggtgggcaaagtgaggaggaggctaccctaaaccttaatgccatgaacaagctccagaccaagaaaccatggtcactctcattctcattcggacgcgcccttcagcagagcactctcaagacctgggcaggaaaagaggagaatgtgaagaaggcacaagatgctttgctcgttaggtgcaaggctaactcagaagccactttgggtacatacaagggtgatgcanaactttgtgagggtgccgcaaagagccttcatgtcaaggactac

SEQ ID NO: 21675 - DNA, 319 bp, Gossypium hirsutum
  Clone ID: LIB3272-002-P1-K1-G3
tgtttcttcaatggaattttggtgcatccttaacctcagagccactcttattactcttcttcttattctcttttttcatctttccaagaaactttactctaaattctttcctcctccttccgttcttcatcttccttctccttcttcatccacttcccttcctgaatctcaatcaagaatcccagagattgtatctgattcagacttgaagtttttgattgataatctggatgagaagctcgatgaggacgagaaatgggagactgtaattgataagaaaaccaactctttatcctacaaggcaaaatgctgcagacct

SEQ ID NO: 21676 - DNA, 404 bp, Gossypium hirsutum
  Clone ID: LIB3272-002-P1-K1-G4
gaagtgttaaggtctgggttttagctgtggaagatgctttgtcttaaaggttattggaggtgaatgcatggatcgaagggatgccatggcattatcagggtctgcatcttactatatgcaacaaagaggaataaccgggtcagggtccgaaccggagtctgggatacacggatctccaggcattcatccgttctctagtccaaatgtacaataccaatcaagtattccagtcactactgtgggatcaaccttagctatggagtctccatcaggaattgcccctcatagtgtcaatgtaggcacaccttcagcacagccatctagtgagacagtgaaacggaaaagaggcaggccccgaaagtacggtcctgatgggactgtttcgttggcgctgactcctgcat

SEQ ID NO: 21677 - DNA, 411 bp, Gossypium hirsutum
  Clone ID: LIB3272-002-P1-K1-G5
atcggatacaagagtcaggttgaccctgataagggcagtgacgaatgcggtggtgttggcattcttggcattgcttgggcttttggtgggatgatctttatccttgtttactgcactgctggtatctctggaggacacatcaacccagcagtgacctttgggcttttcttggctaggaaggtgtccttagttcgagccatattttatatggctgctcaatgtttgggagccatatgtggatgtgggctagtgaaggcattccaaaagtcatattacaacaagtatggaggattggattaagttttatcaatgtggtcaagaggctttttcagaccactcaatttgtaaattataatggaggatgtcatgcttttatgtatgtggcacttattttcaatgtgccccatcatt

SEQ ID NO: 21678 - DNA, 397 bp, Gossypium hirsutum
  Clone ID: LIB3272-002-P1-K1-G7
ctccaaagctagaatggtttcaaaatcacatgatgtgtactcctcttgggatgatgaattcaaaaaactggtgcaaagcttccccaaagagaaaggctgggcaggatccaatctttatttctatcaaggtttttggtgcccctctcttgttctaaaagcttttatttctttccagaaacattttcaagcatttaattctgatatcatcgttgctacttttccaaaatgtggtactacttggctcaaggccttgactttctccactttgtaccgcaatcagttcccatgggatgaaaatccattgctcacctttggccctcaccaacttgttcgtttcttcgagtatgatctttacttgaacaacccttttcctgatcttcgaaatgtttgtgcttat

SEQ ID NO: 21679 - DNA, 411 bp, Gossypium hirsutum
  unsure (1)..(411): unsure at all n locations
  Clone ID: LIB3272-002-P1-K1-G8
gaaatccttccctatatctatcttcatttggccgactaagaaatcaaaaccctaacctctcttgattttccctcaaccgatcctaacacccctctcttaagcaccgatctgcctctatcaatggtgacaaacagatttgggcctcgaaggacgacaatctcgaccacgagattccttctacgcttcgatttcaacgaagaagacggaatctcttagcacatccgcaaggtacggaggcaacgtgacggggtagttggcgcgtacggaggctattggtggcgcagctgctgctagggctagggtttgctgcaaacatgatttangttttgggccctttttgggcttagggttttattagttttgggttttaaatttgggtttgggtttgtaatgttttgggttttaaatttg

SEQ ID NO: 21680 - DNA, 415 bp, Gossypium hirsutum
  Clone ID: LIB3272-002-P1-K1-G9
ggcttctaatcccaaggtcttcttcgacatgaccgtcggtggccaaccagctggtcggattgtgatggagctctttgccgattgcactccccggactgctgagaacttccgtgctctctgcaccggcgagaaaggggtaggccgtagcggcaaacctctccactacaaaggctcatccttccaccgggtgatccccaatttcatgtgtcaaggaggcgactttaccgccggaaacggtaccggaggtgaatccatctatggagccaagttcgcggacgagaacttcatcaagaagcacacgggacctggcatcctttccatggcgaacgctggacccggaacaaacggatctcaattcttcatctgcacgaccaagacggagtggctggacggaaagcacgtggtgttcggacag

SEQ ID NO: 21681 - DNA, 407 bp, Gossypium hirsutum
  Clone ID: LIB3272-002-P1-K1-H10
gcatatttcaatcgagaaatgtccaccatgtttttgagatctctgctattgcctctcatctgtgtcttcgccctggccacacggtcacacgggctgagcccagggcaacagcgaccttcctctttagacgctgcatccaacacactccaataccatggaggccctctcttgaccaagccgaatggcattaacgtttacctcatatggtatggagggttctctctgaaagacagaaactccataactgatttcttcgcttccttcgcgagccctggtcgtcgccaaggaccctcggtttcgacatggtggagaacgatcagtacatacaaggataaaactgggaaacctgtttccgacactgttagacttgtcaaacaagttggtgatgtatattcttcggggaaaac

SEQ ID NO: 21682 - DNA, 375 bp, Gossypium hirsutum
  Clone ID: LIB3272-002-P1-K1-H11
gagtggttggggacaagaagattatgatcgggattaacggatttggaagagtcggacgtttagttgctagagttgctcttcacaggaacgatgttgaacttgatgcagctaacgatcccttcattcccatcgattacatgacatacatgttgaaatacgacagcaatcacgggcaatggaagcactatgatcttaaagtaaaagactgtaaaactctgctgtttgaaaaaaaacccgtcactgatttcggaatcaggaaccatgaggagatttcatgggctgaacacggagctgctttcgatgttgagtcaactggagtgtgcactgacaaagacaaggctgctgctcacttgaagggtggtgctaactaaagtg

SEQ ID NO: 21683 - DNA, 405 bp, Gossypium hirsutum
  Clone ID: LIB3272-002-P1-K1-H12
ttgcattaagtctcaaagatatcactgcaagaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaaaagcccaccctcggcacctgaacagccaggcacttgccccagagatgcactgaaactaggcgtttgtgctgatttgttgggctcagtgcgcgttgttgttggaccgtcgaggaccaaatgctgctctctcatttcgggtttggctgatctcgatgctgctgtttgcctttgcactgctattaaagctaatgtgttgggggttaacctaaacgttcctgtttcattgtcttt

SEQ ID NO: 21684 - DNA, 386 bp, Gossypium hirsutum
  Clone ID: LIB3272-002-P1-K1-H2
ctaaaccagttcataaacagataaaccctagccttaaaatccctaaaattgctacatcgtttcgtttctagttctttttcgcaatggatggcgaagacgacgccccgaaatcattgatggaggagatgtacgcgaacggcatcgagggcgttgacgatgcgccgtcatcctcaacttcgacaacgatccggaagaaccggcccatcattagcggcgagcagctagacatcgaggcctacgctgcgctttactcgggccgtaccaagatcgtgcggctcatattcttagctgaccactgcgacaattcaaggatgcaattggaggccctaaggatggcttacgatgagctcaagaagggggagaacactcagctattccgtgaagtg

SEQ ID NO: 21685 - DNA, 394 bp, Gossypium hirsutum
  Clone ID: LIB3272-002-P1-K1-H3
aaagagcaggaaaacaagaaaagcagagccgcatcactttttgctagctaagctgctgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaagatatgcgatgaaagagtcgtcgtcgtcggagacaagggcttattcttcagcttgggcgcctg

SEQ ID NO: 21686 - DNA, 387 bp, Gossypium hirsutum
  Clone ID: LIB3272-002-P1-K1-H4
gcaactatatcgtccgggtaaagattggcactccgggtcagctcatgttcatggtattggacactagcaatgatgtggcttgggtcccatgctccggctgcaacgggtgctcagccaccactttctcacccaacacttattccacctatggttcgttagattgcggtttgccccaatgcgcccaggtccgtgggctgtcgtgcccggctacggggtctgcggcttgctcttttaaccaatcctacggtggagattcatcattttcggccaacttggttcgagattccttaagattagccaatgacattgtcccagattttgctttcggatgtataaacgtcatctctggtggatcagtaccaccgcaaggactgttgggtttgggtc

SEQ ID NO: 21687 - DNA, 406 bp, Gossypium hirsutum
  Clone ID: LIB3272-002-P1-K1-H5
tgatgatcggagaaccaacacgaccaaatcccaccgttaaaatcccggcgtgggacccactcaatgatccgacgtctaattattcttccgttaattataactgcaatgcgccgtccagtccttgtcccgtcgattacctctcatcgctccaccgttacctcccgtcaaacgatttcgagtcgtccgactctctgagtgaggattcggattttcctgttgacgcgttctcgtgtgaccatttccgtatgtatgagttcaaagtgaggaggtgtgctcgtggcaggtcacatgactggactgagtgtccgtacgctcaccccggggagaaagcccggaggagagacccgaggaagtttcattactcgggtacagcttgccctgatttccgtaaaggaatctgcaaaaa

SEQ ID NO: 21688 - DNA, 411 bp, Gossypium hirsutum
  Clone ID: LIB3272-002-P1-K1-H6
atcaatctaagttgaaggaatgtagtggggagtcaagttcttttgttagcaattgtcaaattgctcataaacctgccaccatttgctgtgccgtagaagctgaggataattgcaacagggatggtgatgcaaaacacagcaaaatcattgaggatattcaacaaccaaggttaaattttcctgaaaaggagtttgtggatgtagaatttggagaacagttggattctcaaactgtggagacgatgttcctgttgggcatgagctcttcttgtggttcagatattattgatataaagccctgctccagttcttcaacacaatataggttggagcgttttctgaagcaagttcaaattatgaagaagtatcgtggtgatgcaaatgttcagcatgcttggcttgcttgctcta

SEQ ID NO: 21689 - DNA, 392 bp, Gossypium hirsutum
  Clone ID: LIB3272-002-P1-K1-H7
acggagatgggtgtgggacgctaaccggaacgatccggttcatgaaaatgccaccctcaaatttggcgaggacgggaatttcgtgttggcggatgcggatggtcgtgttgtgtggcaaaccaatacggctaacaaaggtgtcactgggattaggttactaccaaatggtaacttggtactgtttgataaaaatgggaaattcatttggcaaagctttgattaccctactgatactttgttggtgggtcaatcggttaaaatcaacggtcggaacaagctcgttagccggaaatctgacatggacggctctgatggaccgtatagtctgatactagaccataatgggttcattatgtatctaaataatttgggccaacaacttatttatgggg

SEQ ID NO: 21690 - DNA, 413 bp, Gossypium hirsutum
  Clone ID: LIB3272-002-P1-K1-H8
ggatctcctcttcttggagaaggccctcctgggccttttcgtggcggtggtactagccatcaccatctctaaacttcgtggcaagcggttcaagctccctcctggaccattacccgtgccggtgttcggcaactggctccaagtgggtgatgacttgaaccaccgcaacttgacagatttggccaagaaattcggtgacatatttttacttcgaatgggacagcgtaatctggtggtggtgtcttcacctgagctagccaaagaggtgctccacacgcagggagtggagttcggctcaagaactaggaacgtagtgtttgatatattcacgggtaagggtcaagacatggttttcacggtgtacggagagcactggaggaaaatgaagcggatcatgacggtaccatttttta

SEQ ID NO: 21691 - DNA, 387 bp, Gossypium hirsutum
  unsure (1)..(387): unsure at all n locations
  Clone ID: LIB3272-002-P1-K1-H9
caaaagctcacttcccaaatccaccgtctcccacgtgtatcctaccacatcctcacctgatcctccgccaccttgtcctcctccaagaaggttgccgacaggatcgtcaagctcttcgccatcgacccagaaggccaaaagcgtgaggttgtggcctagccggccacagcttacttcgggccttgactaacagcgggctgatcgatccggcgtctcaccggctcgaggagattgatgcttgctccgccgaatgcgaggtcaacatcgcccaggaatggctcgagaagcttccaccccgtacctacgatgaggaatatgtgttggtaaggaattcgagcggtcgtatcttgaacaagcattccangcttgggtgtcaagtcgtgctta

SEQ ID NO: 21692 - DNA, 419 bp, Gossypium hirsutum
  Clone ID: LIB3272-003-P1-K1-A1
ctttttgttgcctttttacctgaaaatatactccaattttaccataatcagtttctttatactctgaagaagcctatctcccgggattgtttctataatttacaaaagaaaaataataatatctggttaatttcgtcaggggctaagcttatttgcttccataaattgttctatttagttcttctttcaatttattggttctgggtattcttggttcttgttcgatcgtttattttcaatttgtttgaggatggtttgcatggtttctcgcactggaaggcacttgcagcgatacgataacctaggccgacgccaagttgttgggtgcattccctatagatacaaatctagcagtgatggaaccatgactgatgacttggaggtacttgtgatctcctcccagaaatgtcaaaaaatga

SEQ ID NO: 21693 - DNA, 397 bp, Gossypium hirsutum
  Clone ID: LIB3272-003-P1-K1-A11
ccgttagagatattcctagggtttgcatttgcggtttggggtatagggttggggacaacgccaaatcttggatttgaggaatggcgactgcgacgggacaggtgaacgcgaagagaaagccggtgttcgtgaaagtggaggatttgaagcccggtactagtgggcacactttgatcgtcaaagtggtggagatgaccccagtcaagacttccgccaggcccaacaggtcccgtgctctcctttctcgacctgtccctccggtccggatcgctgagtgcgtcgttggggacgagactggcaccatcatcttcaccgcacgcaacgaaaaaagttgatcttatgacaaaaggtgcaacccggaatttacgtaatgctaagattgttatgttcaagcaac

SEQ ID NO: 21694 - DNA, 278 bp, Gossypium hirsutum
  Clone ID: LIB3272-003-P1-K1-A2
gcgtaacaccgggtcttctgaaaaaattccctttcctttacaaacaaatccacacagttaatgaaaaaattcattgttcttcatgttcctcaaaaacccagattataactttttttgaatcttcttgttgttcatcttgtctttttgtttctgtttcattcatcattttgaagctatggtgacaactttgctattattagctattcttttcatactgggtttcattcatatttacttttcttttttgcccaataaattttattattggatccaatcat

SEQ ID NO: 21695 - DNA, 400 bp, Gossypium hirsutum
  unsure (1)..(400): unsure at all n locations
  Clone ID: LIB3272-003-P1-K1-A3
gaagatcactcccgtccagaaacaaacacgtgccggccagcgcactcgtttcaaggcattcgttgtcgtcggcgacggaaacgggcacgttgggttgggggtgaagtgcagcaaagaagtagcgacggcaataagaggggcgataatattggccaagttgtcggtgataccagtaaggagaggctactgggggaataagatcgggaagcctcatacagtgccgtgtaaggttaccggaaaatgtggttcggtcactgttaggatggtgccagctcctagaggtgcggngattgtggctgctagggtgcccaagaaggtgcttcagtttgctgggattgaagatgttttcactttttcaaggggttctaccaagactctgggtaactttgtaaaggccacc

SEQ ID NO: 21696 - DNA, 396 bp, Gossypium hirsutum
  Clone ID: LIB3272-003-P1-K1-A4
ctttcatcccatagctttctttctggtaaaaggccatggatgggaatggaagagttcacccagattgtcctaatgctgcaaatccctaccatgaatgtggtggactctgcttagagaagattgctgaaggcaaaggaccaaaggcaaaagaaactaaaaagtcattaagttcaaaatttcttgatgcttccagaagctttggccggagaaagaagggatccgactctctgccgagatcccctaaagctctcgagacaacccctgcagtaggtgcagtttatcctggtggccctaggtcacctcgttctcatttttctagaaagaaaatggaagcagaaaacggtgattcgtattcatcttccgagcaccactctggcgagatatattcccaagatc

SEQ ID NO: 21697 - DNA, 419 bp, Gossypium hirsutum
  Clone ID: LIB3272-003-P1-K1-A5
atttaataattagcttaatccccactcatgattttctccctatatatttgctccattgccaatttcaattccactatagttttctcaaataataaatagtcaatctttgtggtgggtttttatttgacttaaaattttctgggttcaagagcaatggcgacaacagtgtttctacagcagtcttctttattttctttctcttcatttactcacaacagccgccctttaactaaacttttcgatagtagtaccgcaacaattgtccctttctctaaccggcgtcgtttcagagttgtttctgactctgtttctgtatctgctctgcccactgttcgtgggaaactcaaggttcatcagttggttcaattaacgagttgattgagtgtttgattaatcgagttgatttaacggagtccgag

SEQ ID NO: 21698 - DNA, 419 bp, Gossypium hirsutum
  Clone ID: LIB3272-003-P1-K1-A6
gaaccaaaagctatatctgtcctcacagacaacatgatgcagaaagctatgatggctgctacttcaagaactctgctttctgtctctcttctttcctctcccaaacatttctcttactacccttttctcaaaccctctagggtttttcgagggtttaaggctttctgcagtgccccatccccaatccccaccaccgttgatcctgacgacttgaaacactccatgctacttgaaaggcttagaaccagacatcttagacattctacgaaactcccatcctcatcaccctctaagcctccacaaaacctgcctgttttgggtcaagagaccgaggcttatgataaggggaaagggaagaagaagaagaaaattatggccgatagttttgaggagttgggtttgagtgaagaagtgatggg

SEQ ID NO: 21699 - DNA, 365 bp, Gossypium hirsutum
  Clone ID: LIB3272-003-P1-K1-A8
cttgccttctctgtttatttacggatatagcattcaggttatgatagcttttagtgaccggaaacctgagagccgccgcaccgctcccgctctcggtttccctcgcgttaggttcttccgtttccggcgcttgacgtaatcgtcgactccgctccacccgtattcccaacaagaaaaaaaaaacggagaagagaagttcatttattacttttttttttattttcttctttatatttctcggttgaattattggataatatgacacttggaatatgccgaattccaaaaataatcgtaaggagcaagagaagaaccggaagggtaagttatctgaaaaggcgtcgtcgtttcacgggaaattcccg

SEQ ID NO: 21700 - DNA, 419 bp, Gossypium hirsutum
  Clone ID: LIB3272-003-P1-K1-A9
tttttatctttaaaacacgcacccaaaaaataaaaccctttgaaaaccaaagaaggaagaagaagatgtcgtggcaagcttacgtagatgatcacttgatgtgtgaaatcgaaggaaaccatctctctgccgccgctatcatcgcccacgacggcagcgtttgggcccaaagcgccaatttccctcagttcaagcccgaagaaattaatgccatcatgaatgactttaatgaaccgggtacgctcgctcccaccgggttgcacctcggtggcacgaaatacatggtgatccaaggcgaaccgggagctgttatccgagggaagaagggacccggaggtgttactgttaagaagaccaatatggccttgatcatcggaatctatgatgaaccaatgacacccggccaatgcaacatgatc

SEQ ID NO: 21701 - DNA, 417 bp, Gossypium hirsutum
  Clone ID: LIB3272-003-P1-K1-B1
cttcaaagctcatctgtcaacccagagccccttctctccgccgaatctcctttttctcccgtaaaaatgtctctggtggccaacgaagattttcagcacattttgcgtgtcctgaacaccaacgttgatggaaagcagaagattatgtttgctttgacctccatcaagggtatcggaaggcgtttcgccaacattgtttgcaagaaagccgatgtagacatgaacaagagggctggtgaactgactgcacaggaattggacaatctcatgacgattgtggcgaacccgaggcagtttaaaatcccagattggtttttgaacaggcagaaggattacaaggatggaaagtattcccaagttgtgtccaatgctctcgacatgaagttgagagatgacttggagcgcttgaagaagatc

SEQ ID NO: 21702 - DNA, 413 bp, Gossypium hirsutum
  Clone ID: LIB3272-003-P1-K1-B10
gaaaaaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaagagcccaccctcggcacctaaacagccagccacttgccccaaagatacactgaaactaggtgtttgtgctgatttgttgggctcggtgcgcgttgttgttggaccgtcgaggaccaaatgctgctcactcatttcgggtttggctgatctcgatgctgctgtttgcctttgcactgctattaaagctaatgtgttgggggttaacctaaacgttcctgtttcattgtctttgctcctcaattcctgcgaaaagcaaatgcctgct

SEQ ID NO: 21703 - DNA, 424 bp, Gossypium hirsutum
  unsure (1)..(424): unsure at all n locations
  Clone ID: LIB3272-003-P1-K1-B12
cgccacgcgnccttttatggncatagtatagtcttgttcaatgnggcacacaaacttccggtggtgcagtaagagttaaaggctgaggctgttaaggaggaaaaagcagagaaaggtcccatgaccgggcctgtttggagagcaaccttgtggaatatagtaggaacagtcaagtggtatggatttgggatcgtcctcatatatgttgtgactttatcaatattttcaggatacatcacggaggatgtgcactcattggttctcaaggactggtatccggtcctccttataacaggctacaatgtgtttgacctggttggcaaatcgttgactgcagtctatctccttgaaaatgcaaaggttgctatttccgcttgtgttgtgaggttacctgtctttcctctcttcataggttgtttgcacg

SEQ ID NO: 21704 - DNA, 352 bp, Gossypium hirsutum
  Clone ID: LIB3272-003-P1-K1-B2
atcgtattaaggaacttccatcctcacttggaaactgctcagatttatcagagttaaaggtatcgaataattagataacaagcttgcctgaagatcttacaaactgtttgaaattgacaaaactagatgaggaggggaacaagttaacagcttaatctgagaatttgtttgcatcatgtacaatgcttacggaattcaatcaaagaacttgctgagtggtataccagagaacattggatgccttacacgtgtcatccgtcttgatattcaccagaacaccgagtgaaatacagagttatgctagaaatcatccttttgtactgcatgataagtcattctggtactgtatgat

SEQ ID NO: 21705 - DNA, 417 bp, Gossypium hirsutum
  Clone ID: LIB3272-003-P1-K1-B4
gttgtttggctttgttttccttgtaggatctgaaaaagaatgtcggcaaatggaactgacaactcaacttctaagaagcctccaagtccttctcctttgagattttccaagttttttcagtccaacatgagaattcttgttactggtggagctggattcattggctcccatttagtggataaattgatggagaatgaaaagaatgaggttattgtcgtcgacaactactttaccggcacaaaggacaatctcaagaaatggattggacatccgagattcgagcttattcgtcacgatgtcaccgagccgttgctcattgaggttgatcagatctaccatcttgcttgcccggcttcgccaatcttttacaaatacaatcctgttaagacaataaagacgaatgtgatcggtacattg

SEQ ID NO: 21706 - DNA, 311 bp, Gossypium hirsutum
  Clone ID: LIB3272-003-P1-K1-B5
gttcaatgtgatctgcactcgcacatggattatacaacacctacaatactgtgggggcgcttacgacatcaacgcacaacgctagcttaaaaaggtaatcattttaaaattgctgaaccgaaactctccttgctgacagaaaattagggaatgctgagacatctagctgcgcctcctaatgagttatcttttctgtttaacggtcgttccactcttaaaactattctatcggaagtatgatcctaacctagaaagagcaccgtacgtcacttaaagttttttgcgcccccaacgccccttgtaaattcaga

SEQ ID NO: 21707 - DNA, 413 bp, Gossypium hirsutum
  Clone ID: LIB3272-003-P1-K1-B6
gttctgcctccgcaagtgtgccttcttatctgataatgggttggtgtcttttgctaaagcagcaggttcactagagagcttggaactggaggagtgccactgggtcacccaatttgggttttttggttgtcttattaactgtggtgcaaagttcaaatctatctctcttgtgaactgcttggcgatcaaggacctaaatgtaggattgcctcctctaccaccttgtgagtcccttcgatcgctgtctatccgtaactgccgggggtttggtgatgctagcttggctgcgttggggaagttgtgccctcaactgcagaatgtggagttgagtgggcttcatggaataacagatgttgggtttttcccattgctcgagagttgtgaggccggtttggtgaaggttaatctcagcg

SEQ ID NO: 21708 - DNA, 387 bp, Gossypium hirsutum
  Clone ID: LIB3272-003-P1-K1-B7
tgtttaaacccttttatggttttgcataaactaatttgggaatgtattgaatcactttctcccttatttggtttatttcttgtttgtagtaactttgaagaacaattttaatggaggaggtaccgtttttgactaagttacagtggatgaaaacagagtaagatttggggtaagttgtttgatgctagaaaaagacagggattgagccaacgatcatgcaattgaagacggaccggcaggtgaagctgtcgcctctgggttggagacaaaaatcaaaatctaaaaatttctggagaatgatggaggtttcgttggaacaaagctgctggtgcaatctctaattttattccatcaacttgaagtttattactcttggagcgagagatg

SEQ ID NO: 21709 - DNA, 416 bp, Gossypium hirsutum
  unsure (1)..(416): unsure at all n locations
  Clone ID: LIB3272-003-P1-K1-B8
gttttaactctaaagccaagaaagtaagccactaaggttttgagagaagatcaaaatggcttctaaaagatcagcttccatggtcctccttttggcactcaacattctctttttttccctagtcagtgcttgtggctcttgctcttcacccacccctaaaccaaggccaaacccaaaccccaacacccccactcctactccatctgcacgaggcaggtgccctagggatgccctcaaattaggtgtatgtgccaatgtgcttaacctagtcaatgtcaccattggttcacccccagtgatgccatgctgttcccttctcaatggccttgtcgacctcgaagccgctgcatgcctttgcaccgctatcagagctaacattntaggcatcaaccttaacatcccagtttcccttagct

SEQ ID NO: 21710 - DNA, 403 bp, Gossypium hirsutum
  Clone ID: LIB3272-003-P1-K1-B9
aaaaaaggtttaaaaactctctcaaccccttttatgtccggcccaactccggccgtggtccaatcatcggaccgacgtcgtccaccgcgccggccaccatacacggtggccgaaaatcgaaagaaggttggggaagaagtcaacgaggtaggtggccattttggtgttagcgggctaggggagccgaccctcgagtgaagaacgtgctgacgaggcacgtgggcgatagcagggaggcacgacgctaaagggtggctaaggtttcctttgctgaaactagtttaggtagtgggcttatcgggcttagggttattttaattttgggcctattgggttgtaattttggctgggtttaattgtgtttaatgtttgagttgatgtaatgggcttattatggtttagt

SEQ ID NO: 21711 - DNA, 370 bp, Gossypium hirsutum
  Clone ID: LIB3272-003-P1-K1-C1
gccgcgatgagatggggtttcttcatccggaagaaagctgctgagagacgggcacaggtagtcgagttagaagacgaagaagaagaataggctatcaacaagtcgtattggtactatggttttggaagttgctaacaacaacaatgtatgaaattaaggggtttcaaaactcttgaagaaccctaaattaggcaatgggaaatctctttgtacaatttcctgtatagtaagccgcttcttttgacttcccattattaaatatattttactgtatatgagaggctaaatttggttttaaattcatggccctcctttctttccttgttgattgatttttctaatggcatttaggtgtgagtttgttacagtt

SEQ ID NO: 21712 - DNA, 418 bp, Gossypium hirsutum
  Clone ID: LIB3272-003-P1-K1-C10
aaaaaaatctcttttattttttctcgagagaattcgagttccttttcactctctttcacttcggttcttgaaagggatgtgagtttttaaagaaaaagcttttttataaatatatatattttaaatttccactatgagtcttaggtaaaatcttcagatctggtcaattcttgtggatttcatcaagatctctgccttttcatgtagggaattcttcaaatttttccccttttttttcttcctcttttccctggttttctccggagaaaggaaaacaaaaaaagaaagtaaaactgtgtatgttctggcgggggaaagtagtaaaacaataaaagatgaattatttcccagatgaagttttagagcacgtgtttgatttcatcacatctcacaaagaccgtaactcagtgtctttagg

SEQ ID NO: 21713 - DNA, 417 bp, Gossypium hirsutum
  Clone ID: LIB3272-003-P1-K1-C11
tttcgataaaaatatatatatttttttctcaccattttcctcttcttccctggcatttttctttccttttaatctttccttttctcttttcggaaaactcaacgacgttggagtatgagcgaagaagagtgggtcaaagaagctttgaccgattccatgttggcggcaaaggtgttactcagcctctaccaagcgtcgtctccgccgccacggtcagacagtgcttcctcccaggctttgcaagtcgagtggagtgtccgtcaacgtcggtctaagcaatctcttaagaagaaaagcgaaccggcacgagccagtcccaccacgccgctttcttggagtggtggcatttctgttagtggaggcggtagtgctgacggatccgaggagtctagccgtcctcctttgaagccggttgat

SEQ ID NO: 21714 - DNA, 153 bp, Gossypium hirsutum
  Clone ID: LIB3272-003-P1-K1-C12
tctatcaatataaaatcccactcatttttttaaagaaagcaaaaatttacttgctctttatagaactataaaccttcaaatcattaaaatccttcaaatatatacatataaatcttaagataattaattaaacacttttttataaattatttt

SEQ ID NO: 21715 - DNA, 395 bp, Gossypium hirsutum
  Clone ID: LIB3272-003-P1-K1-C2
atcgtcgtctccgacgttcgaagattataaaaaaccggcgtcgtttcaaatggctacaagaacggatcttgatgggaggccaataaagccgttgacgatatgcatgatcggcgccggaggcttgatcggctcccacctttgcgagaaattgatgtcggagacgccgcacaaggtgctcgccttggacgtttacaatgacaagatcaagcatctcctcgagcctgactctatgccttgggctggccgtattcagttccaccgacttaacattaagcacgattctaggctcgaaggcctcatcaagatggcagatctcacgataaatcttgctgccatatgtactccggcagattataatacgcgtccactagacacgatttacagcaattttattg

SEQ ID NO: 21716 - DNA, 378 bp, Gossypium hirsutum
  Clone ID: LIB3272-003-P1-K1-C3
ctttttgttgcctttttacctgaaaatatactccaattttaccataatcagtttctttatactctgaagaagcctatctcccgggattgtttctataatttacaaaagaaaaataataatatctggttaatttcgtcaggggctaagcttatttgcttccataaattgttctatttagttcttctttcaatttattggttctgggtattcttggttcttgttcgatcgtttattttcaatttgtttgaggatggtttgcatggtttctcgcactggaaggcacttgcagcgatacgataacctaggccgacgccaagttgttgggtgcattccctatagatacaaatctagcagtgatggaaccatgactgatgactt

SEQ ID NO: 21717 - DNA, 420 bp, Gossypium hirsutum
  Clone ID: LIB3272-003-P1-K1-C4
ctccagcagctgcaccacaactacagagaagagagtaaaggggaaaaaaagcgtcgtcgtttttgcttcttcttctacttcgctctctctccttctccgaagttcctctttcgttctttcatttattcagtattgtaaaagatggccgacggtgaggatattcaacccctcgtctgtgataatggaactggaatggtgaaggctggttttgctggtgatgatgctccaagggcagtttttcccagtattgttggtcgtccccggcacactggtgttatggttgggatgggtcagaaggatgcctatgtaggagatgaagcacaatctaaaagaggtatccttactttgaaatatcctattgagcatggtattgtgagcaactgggatgatatggaaaagatctggcatcatacattctac

SEQ ID NO: 21718 - DNA, 419 bp, Gossypium hirsutum
  Clone ID: LIB3272-003-P1-K1-C5
gccaaaacacccatcaaatactatgtggttgatgcattcaccaactccgccttcaagggaaacccagctgcggtttgtttgttggaggaagaaagagatgagaaatggatgcaatcagtggctgctgagtttaatatctccgagacttgttacttgactcggatcaccaattccacctctccaaacaccaggtttcgtcttagatggtttacccccgttgccgaggtaaatctatgtggtcatgcaaccttagcatctgctcatactctctttacaactggtttggtaaattcaaacattattgaatttgatacattatctggaatcctaactgccacaaaggttccagatgtttgtccaaccaatgtctctgaggttcagaacggcggagtgagcgactgctctctgatcgaactgaa

SEQ ID NO: 21719 - DNA, 416 bp, Gossypium hirsutum
  Clone ID: LIB3272-003-P1-K1-C6
ctctagactcttcccttgtaactgttaaaatctttgtcactgtgatcattaatggccaccgctgaacctgaagttccagtcactgagcagcagccggcggcagcagaggagccaaagccggcggaaaagcctgtgaaggagaagagacccaaagctccaaaggagaaaaagcctaaacaacccaaatccacagcacgtcctccttattttcagatgatcaaggaggcgcttttggctttgaaagagaagagtggttcaagtccgtacgctatagccaaatacatggaagagaagcacaaggcggtgcttccagcgaatttcaggaaaatcttaggtcttcagcttaaaaactcagctgccagaggcaagctgataaagatcaaggcctcttacaagctctccgaagccggcaaaaa

SEQ ID NO: 21720 - DNA, 376 bp, Gossypium hirsutum
  Clone ID: LIB3272-003-P1-K1-C7
cttccagcagcagtttccttggggcctatgcaacctcctgtaattcctgattctttggctactttgtctcaatatcttagccatatgaagcatgaatttgatggcattgcgaggaggagtggagatagagattctattcctgcatcaaattcaggaactatacgggaaggtcttccaacacctgcatctttggctgaagtgttacaatctaccaggcaaatgctcattgatcaagctggagaatgtctacaacaacttgcaaggcaactagaggatcaaatgaatgtgaccgacacctcagcacgaatgatcgctcagtcgaatgcatggagaattggagttctgctacataacctaagctcacttttacttgagc

SEQ ID NO: 21721 - DNA, 409 bp, Gossypium hirsutum
  Clone ID: LIB3272-003-P1-K1-C8
ttcttttcctctttaatccaaaaaccaaaatctgggtttctcttctttgagttcaaaatccattaccccatcatcaaaaatcctttcttttctcagttcaaaaaagctgcctgcttggtgtgcttgatattgcctcaaccaaccattctcaaagttttctttttatataaatttccaagtttttgtttttcctaacatcttcatgctcaatcttctgttcttgatgtttgagattcatgtctccaattctcagtgaaatcttcttttctgggtttatgatcaattctacattcattcgaaggacccaactcgttcaatctttctcagttgttttcctttactggttgtactacgtttcatgattttctagcccttttttttctttcaaggtttctatctctctatatat

SEQ ID NO: 21722 - DNA, 410 bp, Gossypium hirsutum
  unsure (1)..(410): unsure at all n locations
  Clone ID: LIB3272-003-P1-K1-C9
gttttatgaaattggcattggagctgggttggaatctatgaccactaatccaatggcatgggaaggttcagttaacccaagggtgaagcaaatggagcaagctcagaattgtctccttcctatgggtattacgtcagagaacgttgctcatcgctttggtgtgacaaggcaggagcaggatcaggctgcggttgaatctcacaggaaagcagctgctgctacagcttctggtaaattcaaagatgaaatagtccctgtggccaccaagattgttgatccaaagactggtgatgagaaacctgtcacaatctctgttgatgatgggatccgagctaacacatcaatgccagatcntgggaaaatgaaacctgtattcaagaaaatgggaccactactgctgaaattctagt

SEQ ID NO: 21723 - DNA, 380 bp, Gossypium hirsutum
  Clone ID: LIB3272-003-P1-K1-D1
attcccatttccaatctccagctcccaaggtaaatatgccgatcagaaacatagcagttggccggcccgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaggtggccacgtcaaccccgccgtcaccttcggtgctttcgttggcgggaacatcactctcttgcgcggcattctttactggatcgcccaactcctaggctcaacc

SEQ ID NO: 21724 - DNA, 417 bp, Gossypium hirsutum
  Clone ID: LIB3272-003-P1-K1-D10
gcccgtttccatgtctcgagagctttatctctcctccgttgtccccatcggtgctctttactctctcagcctctggctctctaactccgcttacatttacttgtctgtttcctttattcagatgctcaaagccctgatgcctgttgccgtttattccattggggttctttttaaaaaagagggctttaagactgacactatggccaacatgttgtcgatctctttaggggtcgctattgctgcttatggtgaagctaaatttgatacctggggagtgatgttgcagcttgggagccgttgcttttgaggctaccaggttggttatgatccagatcttgcttacttctaaagggatcaccttgaatccgattacttctctgtattatgttgcgccatgctgtttcgttttcttggtgg

SEQ ID NO: 21725 - DNA, 106 bp, Gossypium hirsutum
  Clone ID: LIB3272-003-P1-K1-D12
atcatcagtcatgcactgtagtggtgttttcttttcataatatatatattgtgtaatatttatgtcatagcagttgtatggaatgatgctttttaatggttgctat

SEQ ID NO: 21726 - DNA, 417 bp, Gossypium hirsutum
  Clone ID: LIB3272-003-P1-K1-D2
gtacctttttaactctaaagccaagaaagtaagccactaaggttttgagagaagatcaaaatggcttctaaaagatcagcttccatggtcctccttttggcactcaacattctctttttttccctagtcagtgcttgtggctcttgctcttcacccacccctaaaccaaggccaaacccaaaccccaacacccccactcctactccatctgcacgaggcaggtgccctagggatgccctcaaattaggtgtatgtgccaatgtgcttaacctagtcaatgtcaccattggttcacccccagtgatgccatgctgttcccttctcaatggccttgtcgacctcgaagccgctgcatgcctttgcaccgctatcagagctaacattttaggcatcaaccttaacatcccagtttccctt

SEQ ID NO: 21727 - DNA, 410 bp, Gossypium hirsutum
  Clone ID: LIB3272-003-P1-K1-D3
ctcggaaacaagtctgctatcaccgggggtagcgggaaggttgtcgatagtggccccgatgatcatatcttcttatactacactgaccatgggggtcccggtgtccttgggatgcctacctttccttatctttatgctgatgacttgattgaggttttaaagaaaaagcatgcttcagggaattataaaagcatggtattctatcttgaagcttgtgagtcaggtagtatctttgagggtcttcttcctcaggggttgaatatctatgcaaccacagcatcaaatgcggaagagagtagctggggaacctattgtcccggagagtacccaagtcctcccccagaatatgaaacctgcttgggagacttgtacagtgtcgcttggatggaggacagtgacatgcataatct

SEQ ID NO: 21728 - DNA, 403 bp, Gossypium hirsutum
  unsure (1)..(403): unsure at all n locations
  Clone ID: LIB3272-003-P1-K1-D4
ccgaccagcaaatgagttgggtacttttcgccacaccagtcgtgttaatactcttggcacgatggctctcctctatggaagtctctggtatgctgtttggttcatcaccctgggaacgtatccgccggactcatcatcacccttctgaaggtacctcaccctgggtggtggctgctttcattgtgttgctgttagtcctgttgcagtaccagtccatttttcgtgagagctggatggtatgatctttatatatgtgtgtgtgtagtactatagtttgaaaaaactgtgttggaatttctcatctttaacagggttttgccttgttagatccaacacagtatctgtgctagcaacggttctaaatatacactgcaaaatttaagcnaaaaaaaaaaaaagaaaa

SEQ ID NO: 21729 - DNA, 409 bp, Gossypium hirsutum
  Clone ID: LIB3272-003-P1-K1-D5
ccaaaacgctgtgctcttctacgaacccattactcttcacttccaaaagagcctatcgtcccaatgaaggacagcgcccctactacttcatctaggccagccaagtctggaggtggcaagcagaagacgggcatctttccattatatcttatgctatatatatagtggggtcgatctctctgcttttcaaaagttaaatatgaagcggtggggtctctgtcgttgaaccacacaattccggagtcagggttagcgtggggagcaagcgaacaacacgggtctgtttgctcaactttgctaggacacgcacatatcttgctctcatattaccaggttgatcacttccttaatcacctacacttgcctgtgtggtaacggaacactatcagggtaggtactgctagtgtta

SEQ ID NO: 21730 - DNA, 422 bp, Gossypium hirsutum
  Clone ID: LIB3272-003-P1-K1-D6
ctaatacatatgtttttttgttatcttatattactacaagactgcagtagtttcagaagaccagtagtttcagcttggcttggggctttcatttgatttcctttcaaatttttttcctccttcctattatatgttttagttaacccagaaaggaactgagtcaaagtgacagtagcagtagccgcagctaagctaacagaaaactcgcaatctctttcagtatagctagcagattaatggcagaaggcaaaggagagccaaaaaaaaaaaagaaataaacaattctgcttgctgtgctgttcactaattggaaagccacccaacaaagatctctttctctttctttttatcttcttctgttacaatttcagagattcgaccccaccctttcccccttctctccaactcatataacacctaaa

SEQ ID NO: 21731 - DNA, 413 bp, Gossypium hirsutum
  Clone ID: LIB3272-003-P1-K1-D7
ttcaaaaacatagcagccatggcagtccgtatgcttcttgggttaggtgtcctgctactctgccttgcaaaggtttcatctgatctgaaggcagaagaagttataaccaatgtcggtgaggtgggttctttggttaccagaggcggaaacagaagactgatgctagagattgattgtggaggattatgcaagaaaagatgcagtcaacactcgaggccaaacagatgcaacagggcgtgtgggacttgctgcttgaggtgcaagtgcgtgccaccggggacttcagggaacagggaggtctgcgggacctgctatactggcatgaccacccatggaaacgttgccaagtgcccttaacctttacgtcgcccaatatgtgttgcagccatcaaggcgaaaaatgaaatgtttgt

SEQ ID NO: 21732 - DNA, 367 bp, Gossypium hirsutum
  Clone ID: LIB3272-003-P1-K1-D8
aaaaatctttccttccttcaaaaagccaaactctctcccttcctacctgccatccttcctttaaaaattaaccaaatatctctcaccaaaccctcccccatttcccttctcccttcatatatctaacatccttttttccccctcccatttcctccctcatttccatctccccccaaaatggaagcatcccctgctctttctcgcataggccttgccggcttggcggtcatgggccaaaacctcgctctaaacgtcgccgaaaaaggcttccctatctctgtctacaatcgtactacctccaaagtcgatgaaaccattcagcgagcccaagacgaaggccaactcccactcttcggtcactacactc

SEQ ID NO: 21733 - DNA, 411 bp, Gossypium hirsutum
  Clone ID: LIB3272-003-P1-K1-E1
aagaaaagcagtttccgaatcttttacgactcgtaaaatagttgaattgactcatggcttccgccgttgcttccgttgcgaagaagaaaactgctggctctaagaagtctaaatcagctccttcacatcctccatttcttgagatgatttcagatgcaatcgtttcgttgaaagagaggacagggtcgagccaatatgcgatcgcgaaattcatcgaagagaagtataagcaattaccggcgaatttccgcaaagtcttacttgttcagacgaagaagtttgttgcttctggaaagcttgtcaaagtaaaagcctcttttaagctgccttcggcttctgccgcagctaagaaaccggccgccgtagctaagaagcctgccgccgcgaagcctaaatcttgcagctaccact

SEQ ID NO: 21734 - DNA, 293 bp, Gossypium hirsutum
  Clone ID: LIB3272-003-P1-K1-E10
ggaaaatcaaagttattcgctcctttgtctcagattcgagacgacaccggatgagtcggtatcactaggaaccacaaggcttacaacttttagggaagaagaaacccggccccaaatgggatagatgggcaacgctgatgcactcgtaaactacagtgtacggactgtatctggtacgggtaggaggggggatgatattgcttacacggtcagtgtgaggacgggaaaggtgatgaagtgtatgggctcaaaggctctggttgaggtatcgacaagacagggatggctgatga

SEQ ID NO: 21735 - DNA, 419 bp, Gossypium hirsutum
  Clone ID: LIB3272-003-P1-K1-E11
agaacattagcctcttttgcccttttgccccccttttttgtttacaccccattcccctctcttcacagccactgtttgtctcacagattttttgaaaataatggaccggtaccaaaaggtagagaagcctaaagctgacacacccataaacgagaatgaactgaggattacagctcaagggaggatgaggaattatatttcttacgccatcactctgcttcaggagaaaggtgctaatgagattgtgcttaaagccactggtagagctatcaacaagactgtcatgattgctgaattaattaagaggaggattgctggtcttcatcaaaacacatcaacgggatcgatagacataactgacacatgggaaccgctggaagaaggccttcttcccctagaaaccacacgccatgtttcga

SEQ ID NO: 21736 - DNA, 417 bp, Gossypium hirsutum
  Clone ID: LIB3272-003-P1-K1-E12
tttcttaagaagaacaactttcagctgaaacagccgcttcctccaacatgggtggagggttgaagaaacacttgaagaggctcaatgcccccaggcattggatgcttgacaagcttggtggtgcattcgcgccaaagccatcgtctggaccccacaagtcgagggaatgtttgccacttattctcattctgcgaaacagactgaagtatgctttgacatacagagaagtgattgctattcttatgcaaaggcatgttatggtagatgggaaggttaggactgataagacctaccctgctggttttatggatgttgtgtcaattcccaagacaaatgaggacttccgtctcctttatgacactaaaggtcgtttccgccttcatgccatcactggtgatgagactaagtttaagctct

SEQ ID NO: 21737 - DNA, 418 bp, Gossypium hirsutum
  Clone ID: LIB3272-003-P1-K1-E2
cttcgaagtcgtagctttggaagcatggacttcatagctactatcctgtttctagctcttgtcatctcctccaccaaagctttggacccttgcggccctcagccagatgactcggaccttttggtcatcccaatctatggcaaatgttcaccattcaacccacccaaacctgactcatcgttcaacacagtcatgaacatggcatcaaaagacccagcaagggtcaagtacttgtcgagccttgtagcccaaaagaccactgcggttcccattgcttcaggccaacaagtcctaaacattggcaactatatcgtccgggtaaagattggcactccgggtcagctcatgttcatggtattggacactagcaatgatgtggcttgggtcccatgctccggctgcaacgggtgctcagcca

SEQ ID NO: 21738 - DNA, 396 bp, Gossypium hirsutum
  Clone ID: LIB3272-003-P1-K1-E3
gggaactacaaccaatctctgggacagtttttcgttcggctaaggttcgcattgctgtgttcagtcaacaccatgttgatgggctagacctgtcttcaaatcccctgctatatatgatgcgctgctatccaggagtgcctgaacaaaaacttcgtggacacttgggttcttttggtgtgactggaaatcttgcactgcagccaatgtatactttgtctggcggtcaaaaaagtagagttgcttttgcaaagataactttcaagaaaccacacataatattgcttgatgagccatccaatcatcttgatttggatgctgtggaggcactaattcaaggccttgtcttgttccaaggagggattctgatggttagtcatgatgaacatctgatatctg

SEQ ID NO: 21739 - DNA, 386 bp, Gossypium hirsutum
  Clone ID: LIB3272-003-P1-K1-E4
gcggctttcagcagtcgacacggtgactttcttcaccaactctctcccgtgacagtgtgtcaccttcccaaataccgccaccgctttaggcggcttccgccgctccatcacttgccgaagccgcccttcaccaagtgccataaacaaaagagagaggtcattaagcaaatagagtgagaaatggggtgtgggaatgtgttcttcacgttgatcataacattatcagtagctctaatcacctacaacatcctcatctcagccaatgcttctttaaagcaagagctttctgggccttcaacctcatacatcatcgaccccataatccagatgccggtagaaaaatccagaaagtatgggtcaaatgcagagaaaaagttgtttccaca

SEQ ID NO: 21740 - DNA, 316 bp, Gossypium hirsutum
  Clone ID: LIB3272-003-P1-K1-E6
gaaaaccggcgcgcccacacatccgtacaaccataatttattcttcaacttctttttcttctacactccctttaaaagttgttttttttcttcaacatacacaaaactaaataatgctcttctacaccatctctcaaattttaatcaatccataatatgaattttaatcgaacaaattattattaagataagagaaatggctctctctctctccaacactaatcttttctctactcttgttctcaatcgaatctctaaccttatcttcacactagtatattcttctccatcacaagaaattgtcttcaatgtaata

SEQ ID NO: 21741 - DNA, 416 bp, Gossypium hirsutum
  Clone ID: LIB3272-003-P1-K1-E7
cccacgcgtccgactcgcccgctgcgcaatcaccgatcaaagctgaagatgggaagccttggaaaagcaatatacaccgtcggattctggattcgggagaccggtcaggctctcgatcgcctaggctgccgcctacaaggcaactattttttccaggagcaactttctaggcatcggactctgatgaacgtatttgataaatctcctctggtggacaaggatgcatttgtagcccctagcgcatctgtcattggcgatgttcaggtgggaagaggatcatctatttggtatggatgtgttttaaggggggatgtcaacagcattagtgttggatctggaactaatatacaagacaactcccttgtgcatgttgcaaagtctaatctaagtgggaaagtgctaccaactaacattgg

SEQ ID NO: 21742 - DNA, 372 bp, Gossypium hirsutum
  Clone ID: LIB3272-003-P1-K1-E8
taatttttcttcactctgttctcaagactttgaaagatcagttcttgaggcgggtcttatgatggatggagtttctcttaataccgatccggttgttgatgatgatgctgatgctgatgaatttgaaattgaaggagactgtggaatggccaaatgtattagttaaagtggtgtaatacaaggagagaatccgcttactccttgttgtcggaatggaatttgattcgtacgaggatgtatattactcttacaattgtaatgccaaggaacaaggatttggtgttagagtaagcaatacgttgtaccggaagaccaaagaaagatactgtggcaaactaagctgcattagtgcaggatttaagaagaagagtg

SEQ ID NO: 21743 - DNA, 412 bp, Gossypium hirsutum
  Clone ID: LIB3272-003-P1-K1-E9
ggatttgcagaaagatccacccacttcttgcagtgctggtccagtagctgaagacatgtttcattggcaagcaacaatcatgggaccctcagatagcccttatgctggaggtgtgtttttagttactatccatttccctccagattatcctttcaagcctcctaaggttgcatttaggaccaaggtcttccatcccaacatcaacagcaatggaagcatttgtcttgatatcctcaaagaacaatggagccctgcactaaccatttccaaggttctgctctcaatctgctcactgctgaccgatccaaaccctgatgaccctcttgttccggagattgctcacatgtataagaccgatcgggccaagtatgaagccactgctcgtagctggacccagaagtatgcgatggga

SEQ ID NO: 21744 - DNA, 418 bp, Gossypium hirsutum
  Clone ID: LIB3272-003-P1-K1-F1
cttttctgattattttttgataatccggagttcaatcatctaaaagaagccctaaaatccttgaatcaggtctgagcttgtggtttgttaggcctctttgatcaaactaagtttcatgtctgatcttgacgttcaaattcctactgcctttgatccctttgctgatgcaaatgctgaggactcaggtgcgggtgcaaaggagtatgtgcatattcgtattcagcaaaggaatggtcgcaaaagcctgacaactgtccaggggttgaagaaagaattcagctataacaagatacttaaagacctgaagaaggagttttgctgcaatgggaccgtggtccaggaccctgaattaggacaggtgattcaacttcaaggtgaccagcgtaagaatgtatcaaccttccttgttcaggctggc

SEQ ID NO: 21745 - DNA, 419 bp, Gossypium hirsutum
  Clone ID: LIB3272-003-P1-K1-F10
tctctgtcaacaacttgccgttgttttttattttcttgcttaaacaaggttaacaagagatggcggatgaggatattcaacctcttgtgtgtgacaatggaactggaatggtcaaggctggttttgctggtgatgatgcccctagggcagtcttccctagtattgttggtcgcccacgccacacaggtgtcatggttgggatgggtcaaaaggatgcttatgtaggtgatgaagcccagtcaaagagaggtatcctcactttaaagtaccctatcgaacatggcattgtcagcaattgggatgacatggagaagatttggcaccatactttctacaatgagcttcgtgttgcccctgaagagcatccagtgcttcttacagaagcaccactcaaccctaaggcgaatagggagaagatg

SEQ ID NO: 21746 - DNA, 418 bp, Gossypium hirsutum
  Clone ID: LIB3272-003-P1-K1-F11
gatcaaacaaagctatccactcctttttctcagatccgaaacgccgtcgtcttagtcggaaccacttcgatccacaatgtcttctactttcagcggcgatgaaacggcaccgttcttcggcttcctcggcgccgctgctgctctcgtcttctcctgtatgggagctgcatatgggacggctaagagcggtgttggtgtggcttcaatgggtgtgatgaggcctgaattggtgatgaaatctattgtaccagttgttatggctggtgttttgggtatttatggcttgattatcgctgtcattattagtactgggatcaatcctaaggccaaatcgtattaccttttcgatggttacgcccatctttcttctggtcttgcttgtggccttgctgggctttctgctggaatggcaattgga

SEQ ID NO: 21747 - DNA, 418 bp, Gossypium hirsutum
  Clone ID: LIB3272-003-P1-K1-F12
agatccacaaagataatgatgctgaattaacagaatttgaggagtctatggcgcaggcattcttcgatttggagaataccaatcaagatctgaaaagtgaccttaaagatctctatattaattcagcagtccaaattgatgtttctgggagccggaaagctgttgttatccatgtcccgtatagattgaggaaagctttccgcaaggttcatgttaagcttgtgagggaacttgaaaagaagttcagtggcaaggatgtgattcttattgccaccagtaggatattaaggcctccaaagaaaggttctgcagttcataggccacgcattcgcacattgactgcttgacatgaggcaatgctagaagatgttgtcttacctgctgagattgttgggaagctcactagatatagaattga

SEQ ID NO: 21748 - DNA, 420 bp, Gossypium hirsutum
  Clone ID: LIB3272-003-P1-K1-F2
ttatctttaaaacacgcacccaaaaaataaaaccctttgaaaaccaaagaaggaagaagaagatgtcgtggcaagcttacgtagatgatcacttgatgtgtgaaatcgaaggaaaccatctctctgccgccgctatcatcgcccacgacggcagcgtttgggcccaaagcgccaatttccctcagttcaagcccgaagaaattaatgccatcatgaatgactttaatgaaccgggtacgctcgctcccaccgggttgcacctcggtggcacgaaatacatggtgatccaaggcgaaccgggagctgttatccgagggaagaagggacccggaggtgttactgttaagaagaccaatatggccttgatcatcggaatctatgatgaaccaatgacacccggccaatgcaacatgatcgtcg

SEQ ID NO: 21749 - DNA, 412 bp, Gossypium hirsutum
  Clone ID: LIB3272-003-P1-K1-F3
cccaaatctcctccctcctcttctttagcgtccttttcatttccgctcatgcagcgcgctttgaaatccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccggtgattgtggtggactccttcaatgcaaaagttggggtgtacctccaaacaccctggcttgatattgcacttaaccaatttggaaacattgatttctaacaccatttcttaagtggagggtttaacatccccatggtgtttggtccaactaatggcgggtgtcacaacattc

SEQ ID NO: 21750 - DNA, 422 bp, Gossypium hirsutum
  Clone ID: LIB3272-003-P1-K1-F4
ccttaacataatcatatcctctgctaaagcgttttttcttcactccatttctatattctgcaaatttccgcaccttgctatggatgagaggatgataggtgctgcacaaacaggagacataaacatcttgtacgagttaattctgaatgatccatatgttttacagcgtatcgatgatgtaccttttttccatactcctttgcatgtagcagcctctgcagggcatattgattttatgatggagatgatcaacttaaagccatcgtttgcaagaaagctaaaccaagctgggtttagccccatgcacttggctctgcaaaatcaaaaaactctagcagtgcttcgactcctcaggtttgatgaaggccttgttcgtgtcaaagggcgggagggcttcactcctttgcatcatgtggttcaaa

SEQ ID NO: 21751 - DNA, 423 bp, Gossypium hirsutum
  Clone ID: LIB3272-003-P1-K1-F6
atcgattcctgctcctcagatcgttaagaaatctgaagacccatatgctataacagacaatgattggagttgggaagataaagcaatactcaaacatccttgagaagccccttagcaagggcaaacaagaggttagcttgagtgcctttacatttttgttctctgagcttgttcagtacaatcaaactcgggttgacaacattgctgaattagaaagaaggctggaggatgcagggtatgctgttggggctcgagttcttgaacttttatgccatagggataaggggaatagaagggagacacgattgttgggtattttatcctttgtgcacagcactgtctggaaggtgttatttggaaaggtggctgactctcttgagaagggcactgaacatgaagacgaatacatgatcagtgagaaag

SEQ ID NO: 21752 - DNA, 416 bp, Gossypium hirsutum
  Clone ID: LIB3272-003-P1-K1-F7
atcgtattaaggaacttccatcctcacttggaaactgctcagatttatcagatttaaaggtatcgaataatttgataacaagcttgcctgaagatcttacaaactgtttgaaattgacaaaactagatgaggaggggaacaagttaacagcttaatctgagaatttgtttgcatcatgtacaatgcttacggaattcaatcaaagaacttgctgagtggtataccagagaacattggatgccttacacgtctcatccgtcttgatattcaccagaacaccgagtgaaatacagagttatgctagaaatcatccttttgtactgcatgataagtcattctggtactgtatgatgcaagaatttcaacaatcccaccatcagtatcgagttgctcttctcaaattttcaggaataatg

SEQ ID NO: 21753 - DNA, 415 bp, Gossypium hirsutum
  Clone ID: LIB3272-003-P1-K1-F8
tgaaaaccgaggtttctggaatggaagaaagaaaagtaaagggagaggttatgtgcggcactctcgacctgactgctctcccactagattgtgtcaccctcattatttccttgacctcccctcgagatgcctgtagattgtcgcttgtttcaactgcttttaattcggctgctgaatccgatgctgttgggaaagcttcttgccatcccaataccaggaattaattccctcatcgctctctttctcgtccaagaaacaactttatcttagcctctgtgaaaatccccttctcattgaagctggacgaaagagtttttggctcgaaagagtgagtgggaagaaatgttacatgctgtcacccagggacctctccattatatggagtgacaccccagattattggagatgggtgtct

SEQ ID NO: 21754 - DNA, 417 bp, Gossypium hirsutum
  Clone ID: LIB3272-003-P1-K1-G1
gcttgctggtgctaattcgtatgctggtgtagtctgcgcccgcgccgcttatattccctttttctttttctcgctaaacaaacagaaaatcagcaaccctcttcttttacattctgtggtaatttaactaagagctgaatcttatggcgtcttctttggcttctccgtccccaacttcttcctttatcaggaacaagaaagatttgggtttctctgctttcccttcaacatctcaaatcgcaattcagaaatgtaagaaacaagtttcgaagaaaatcgtctcagtcatggcacctcagcaatcagagcgtaaaccagcgaccacaggctctgtgaagactggaatgacaatgacagaaaagattcttgcaaaagcctctgagaaaccacagctgagtcctggtgataatgtttggg

SEQ ID NO: 21755 - DNA, 417 bp, Gossypium hirsutum
  Clone ID: LIB3272-003-P1-K1-G10
gtgattgggcaaccatcaggtagtgaggttggtgatagagctgcttcttatgaatcacggggccctagtcctcgcaagcgaagcttggaaataggtgccagttcagatgataggccacagttatgcacacaacaggctgatagtgttgaagaaactgtgattgatcgtgatggtgacaaattcaatgattgcagacaatattctgctggcccttccaaacgtgcccgtgattcagatttttttgatacttactgctcaccatatccaagagattcctctgaggcaggcccaagccattcggtgggttttgaaactcatggagatggtggcaatagagttgctctgtttaggcaaggaagtaaccaggttattgaaatcccgtcagtgagagattcaatgcgtgcgtcctctgtcatt

SEQ ID NO: 21756 - DNA, 140 bp, Gossypium hirsutum
  Clone ID: LIB3272-003-P1-K1-G11
caacattgaatcagtgaaagtaaagctgacaaaagaagatttgaaagaaattgtgagatgcgatcccaatccatgaggttgcagggggtacttatcctgaaggtttaattgcatttacttggaaatatggctttacactc

SEQ ID NO: 21757 - DNA, 187 bp, Gossypium hirsutum
  Clone ID: LIB3272-003-P1-K1-G12
cgacccagcgtccttttttatatacaattaatacccatttaaacccccacactcacagccagggcgaagcttttttcctacagaaaacttactctgaaccttatccaatattaaagaatcttcaatttataatactctgcccactaaactaccaagcctgatcttctatataatcgtctacagaaaa

SEQ ID NO: 21758 - DNA, 355 bp, Gossypium hirsutum
  Clone ID: LIB3272-003-P1-K1-G2
gacgcatctgttgttcatctacgaaccaaatggcctgctttcgatatcgaaacagcgcgctctcttactgctaacaatagtgctgggtgcatcaaaagctcaactcagtgccaacttttatgccaaaaccttccctagtgtgtccacccttgctagtcatgtgctctagcacgctcaagggaaggatcttaggctctcgactaataccggtccgcttcattaagatgcttgctccgatcatgggtgggacgcttcggtactgttaaaccccacggatggagcgaaaccggccaccccaaacctcacaactgggggatatgaacttatctacaatatcaaaccggcgttgccgaaa

SEQ ID NO: 21759 - DNA, 348 bp, Gossypium hirsutum
  Clone ID: LIB3272-003-P1-K1-G3
taaaaacttaaatattctctctcccaaaccaaaccttcaaatttcagcaagagagggagattgaacttacatagctcacacttctatcatcaatttaaggttatttaattatattcctcgtttacccgttaccccaattctacagatcacttcatattgttctattctttcccctgattctatcctctaagtttcatgtcttatcttgacatccatattactactgcctttgatccttttgctgatgcaaatgcttaatacacttttccttatgccaattgaattccttcacattcgtattcaacatctgaactatttgaaaagccataccacttttcatgcatataa

SEQ ID NO: 21760 - DNA, 409 bp, Gossypium hirsutum
  Clone ID: LIB3272-003-P1-K1-G4
caccctgctcgttaccgtactcagccttgcaaagacggtaccagttgtcaaagaagggtttgttttttcgctcacacaccggagcagcttcgggtgttgccgcagcagagtccgagaggaaatgggtccgcttcagctgatttggattatgttgtttcgcccatgcgccatcgtgtagagtttgtttcttcaccaacttctattctggcttcacctacgatatgcccaccttctgagtcacctcctatgtcacccagtggctcatttaactcggagagtgaacttgctgcttctatgcgaagtttgcagctgggtaagactaaaatgaatggtgcttgttcctggggcctgcaaatgggatcgggtttcagttctgcacgtgggtccacactccgacccggtttttgca

SEQ ID NO: 21761 - DNA, 422 bp, Gossypium hirsutum
  Clone ID: LIB3272-003-P1-K1-G5
gtctctctctctcatagttgtctgcttctctctcttaccattataacagctcatgctctgcatcagcttttctttaacaatgcagacaagaactgtacaagtcaagaacctgtcagatctagctactgagagggagattcacgagttcttttctttctctggtgaaattgagcacattgatatcataagtgaagctagtcaatcaaagactgcatatgttacattcaaggatccgaaagctcttgaaatcgccttgttattatcgggggcaacaatcgttgacaagattgtgacgataatttctgttgaaaattatgtaccaaaacttgagattcatgaatcaagagcggcggacaacattgtgtctattgctcctgctgggcatagtgcatcaaatgatgagggcagaacgagtccacctg

SEQ ID NO: 21762 - DNA, 423 bp, Gossypium hirsutum
  Clone ID: LIB3272-003-P1-K1-G6
gagagtgagaaagatgggagagacagacaaagacagggaacaggctgagcatgggtggatctaccaactgattctgttgtttctccgcccatgcactgcctacttccctggctctgcctcctccatttttttcctccctctttttttatttaactttttcaccttatcccattttggaattattattatgactgtaatttagatccaggttcatgataggtaccttttaacaaggtaattgtggtgacttttgttgagccccaatggccccagctcttttttcttcattttctctctattcttttcaatccacgtatagagattattcgttatactggtaatggaaatttgcattttgattctccaaccatttccaggaaccttattgttttttccactatcaccattgattggggggaaatg

SEQ ID NO: 21763 - DNA, 414 bp, Gossypium hirsutum
  Clone ID: LIB3272-003-P1-K1-G7
ctcaaagaaaaaattgagtgtcagtttgaaagtgttcttcagatatggctatgaaacaagttgctaattctgctatcaaagcaattgccaattctgggtcatcctctcttcttaccagacaactccatgcttctccagggagcaaaaagattgttggggtgttttacaaggccaacgagtactttacgaagaatcccaactttgttggttgtgtggagggagccttggggttgcgcccatggctggaatcacaggggcatcagtatattgttaccgacgacaaagaaggaccggactgcgaacttgaaaagcatatccctgatctccatgtgctcatatcgaccccattccacccggcttacgttacggctgagaggatcaagaaagccaaaaacttgcaactgcttctcacag

SEQ ID NO: 21764 - DNA, 394 bp, Gossypium hirsutum
  Clone ID: LIB3272-003-P1-K1-G8
gaagcagcatacacttactaagatgtatcatgtcggcgggagaaaaacccaggtcccttcttagttcttgctacctagactgaccattggagtgttaccacggtggagccattacttggcatgtgaagctgctctcctaatagttaaaaaggacagctcttgtatatgatcaacacaaaaagaaaaaaccgggtctatcggggcttccagctccataagaaggagcagcatttatacatcttgacaaacacatctgtatctatatctattgataaaggcgtaaacatggcgagccttcgctggggcgaaaatcatctgacacaaccaccatcggagaacactgaaaatccctcagaagcgaatgaggtgcaccttaatacttctgaaagacaca

SEQ ID NO: 21765 - DNA, 420 bp, Gossypium hirsutum
  Clone ID: LIB3272-003-P1-K1-G9
gatggctactacccatttgctaatattgctacttggagtggtggctcttgcgactccctgttccggaacctacgagtgtcacaactatgggaagccccctgctcctgttcataatcctactaagctgaaaccgccaccatatgaacataaacctccggtctatgaaccaccaaagaaggagaagcctgaacctaacccaccagtttatacacttccaaagaaagataagcctgaaccgaaaccaccactatctgaacctccaaagaaggaaaaacctgagcctaaaccaccaggttataccaccaccaaagaaagaaaagcgttgaccccaggcctccgatgtatgaaccaccaaagaaggaaaagcctgagcctaaaccgccagtttatgtacctacaaagaaagaaaaaccagaacct

SEQ ID NO: 21766 - DNA, 420 bp, Gossypium hirsutum
  Clone ID: LIB3272-003-P1-K1-H1
gaaattgtgtttcgtcgagagagaataacagagggaaagcttaagcaatggcggccgaggaggacagcggagagttttacctccgctactacgtgggccacaaagggaaattcgggcacgagtttttggagttcgagttcaggccagatgggaagctccgatacgctaacaactccaactacaaaaacgacaccatgatccgcaaagaggtcttcctcactccttccgttcttaaggaatgccgccgcatcatcgccgacagcgagataatgaaggaagatgataacaattggccagaaccagaccgtgttgggcggcaagagcttgagatagtgatggggaatgagcacatctcttttcacaacttcaaagattgggtcccttgttgatgttcagagcagtaaggatcctgaaggtctt

SEQ ID NO: 21767 - DNA, 206 bp, Gossypium hirsutum
  Clone ID: LIB3272-003-P1-K1-H10
gacttactttctctctaaccgtttaatttattatagtactgacaaatcatggggagagtatattcataagatctgattataaagtacatgtatttacatattgctcattgtcttagttatagtgttcatggacacccttctgattcatacccttcacctccttactaatattcacctgctagtatttacccatcttaaggctatcc

SEQ ID NO: 21768 - DNA, 395 bp, Gossypium hirsutum
  Clone ID: LIB3272-003-P1-K1-H11
accaccgtcactagcggcgccgtcacaaaatgtcgtcaacggagtctgtgatgctccaactccatgaaatctctgccgttaaattcggtaacttcaagctgaaatctgggatcttctcccctatctacatagacctccgtctcatcgtctcttacccttccctcctccaccaaatctcccactccctcctctcctctctccctccccaaacacactttaacctcatatgcggtgtcccttacactgccctccctatagccaccttcatctctctcgacacctccatccccatgctcatgcgccgcaaagaagtgaaagactacggaactgccaagttcatcgaaggtgtttacgaaaagggtcaagctttgttggtggtgggagacctcgtaacg

SEQ ID NO: 21769 - DNA, 253 bp, Gossypium hirsutum
  Clone ID: LIB3272-003-P1-K1-H12
caaatccaacctccacggcggcgtttttctgatcttgacgattatcatacggatgtagtttactctcctatccattacaatgcaaccgacaacaacttgagcagaaacggcaacccgttttaccttcatgaagcgttatcagctttacaacgttatttgccatcgaacggcccggatgttgagttggattctgagtttacgggtttggatagtcctagattcaccggtcgatgtttattcctgtgaaccattt

SEQ ID NO: 21770 - DNA, 409 bp, Gossypium hirsutum
  Clone ID: LIB3272-003-P1-K1-H2
tatcctcccattttcttaatctagggtttctttcgcgcaaacagatatggcagacgaagcacagtactcttcaggtctcgatgccggcagcaacaagcgtaaatacgatgaccaaccccctctcccctccggcgctaggaggcctactggtttctcttccccagattcagctcctccttactacaacagcgttccgccgccgctcgatggcatcgagatggccaagcagcgagctcaggagattgctgctcgcctgactgcctacgtcgcctccgctggggccgagcccaagcgccctcgttatgaaaacggctccggcggtggttttgatcacgacaaggggtttagctccgctccttctgatgtaaaacctctttcgaattctgctccttcagctattaccggtttc

SEQ ID NO: 21771 - DNA, 418 bp, Gossypium hirsutum
  Clone ID: LIB3272-003-P1-K1-H3
cctcttcacaagactaacaaacctggaatcacttcaattgatatcaatttttcaaaggatattgttgccactggaggggttgattcaagtgctgtactctttgatcgaacatctggagagatcttatctacactcagtgggcattctaagaaggttactagtgtaaaatttgtagcccagaatgatgtatttttaagtggttcagcagataagactgttcggatttggcaagggtctgaagatggaaagtatgattgcaggcatattttgaaagatcatacagctgaggtgcaagctgtcacggtccatgccactaacaactactttgtaactgcttcacttgacatgacgtggtgtttttatgatctttcgtctggtttatgcttgacccaggttgaagacccatcaaattctatgg

SEQ ID NO: 21772 - DNA, 390 bp, Gossypium hirsutum
  Clone ID: LIB3272-003-P1-K1-H4
atataataaaacgtttttttgttcattcgccctttcgctgttgtatttggtttttgtttaatagcttaactgactctctgaaatatcgcggatctttggttttctacacgcattttcgcttttaattatagcctgattttactcggaagatgaggctggaggaagagttctctcattgcgacaactacgacgaagaggaggaacccaaaacgatgtcgcaatgttccatcggagctttacaacaacaacagcagcagcaaaagtttgtcgttgtcggttatgcccttacctctaaaaaaatcaagagctttttacaaccaaagttcgaaggtttagccaggaataaggggatattatttgttgcaattgatcaaaatagacctctctcag

SEQ ID NO: 21773 - DNA, 405 bp, Gossypium hirsutum
  unsure (1)..(405): unsure at all n locations
  Clone ID: LIB3272-003-P1-K1-H7
ccctgtgatgaagatgggttttaggagctaccatgttgatgaatttcaagcccttaatttcattgaatggctcaaaccatcttcctcacctactccttcttcatcactatcactctcgctatcatcttcatcgtcttcatcgtcttcgtcgtcttcgaatgatcagcaagttcagattataaaccccatggctatcttgaaactgcctgtttcatttcaacagcagcaacaacaacaagatggtgggcagcttgggcaggaacctattcaatgcctaccacttttaagcaggcttacagagaacaaatcattgaaaggggatgatgttgggaatattgttaaagaagaaaatatagagaaagttacagtttctttgcacattgngttgcctaacagtagtactgg

SEQ ID NO: 21774 - DNA, 415 bp, Gossypium hirsutum
  Clone ID: LIB3272-003-P1-K1-H8
cttcaaggtaagagtcgattgattcttcgaaaaccataaacgaaaccaaatatggcggagaaagcaatcgagtcggttcaatgctttggccggaagaagacggcggtagccgtaacacactgcaagagaggccgtggtttgatcaagatcaatggttgtcccattgagcttgtcgagcccgagatcctccgtttcaaggccgtcgagccaatccttctcctcggccgtcagcgttttgccggcgttgacatgaggatccgagtcaaaggtggaggtcacacttctcagatctacgctatccgtcaaagcatcgctaaagcccttgtcgctttttaccagaagtacgttgatgagcagagcaagaaggagattaaggatattttggtcgggtacgataggactttgctggtcgctg

SEQ ID NO: 21775 - DNA, 396 bp, Gossypium hirsutum
  Clone ID: LIB3272-003-P1-K1-H9
aaaaaggctttattttggttttgccaggaccgaaaaggggagaaaattaaaggtattattttattaaaggtttgtttgggggaaattgagagaaaaatttgaaaaaaaaaaaaatccacgatgaagatcacatcgttagtggtactgaagtgcaacccgcaaggagccgctccgataatactagcgaacactaccgatgtgagccattttggttactttcaaaggtcaagcgtcaaggagttcatcgtcttcgtttctcgaactgttgctaaacgtactccttctggtcagcgccagtccgttcagcacgaagagtacaaggtacatgcttacaacaaaaatggactttgtgccttgggatttatggatgatcattatccagttcgaagtgctttt

SEQ ID NO: 21776 - DNA, 419 bp, Gossypium hirsutum
  Clone ID: LIB3272-004-P1-K1-A1
ctaaatattttcagaaacttagatccaaataatatttttcccctaaaattttacccaaaataattccgtattgaaacaaaaaaatgggaattttatgcaaggtagttgatatgctgctgttggtggcgtttatggtgatgcttgtagccggacctttaatcgatgcgcagctggttttgccggaggccactttcccggaggtgctcgtccgtttgaagcagcaatatgcggaggagtaccaagattatttgatggtggagaagcctcatttcttcgtggccttggtctggttggagcttattttccagtggccttttgttttgcttaacatttatgggattttggcatccaagcattggttccacaccacttgtctcatctatggtgcctctgttattactgccatgactgctttatta

SEQ ID NO: 21777 - DNA, 424 bp, Gossypium hirsutum
  Clone ID: LIB3272-004-P1-K1-A10
tggagaagcaagcaaccattagtttgtttgtttcattcctttttcttttcttcctttaatggctccttctatttcttctattttcatttcccacactttcaatgctttcgcttccttcactaactgctctaaaaacaacaaaaaccacactactccaccttcacaacataaaaatcatcaacttttttcttcttctccaggaaaagtgtctttcgccgctgcaacaggggagcttttcttgggaattgcatcaagatttattaaaagcagttccaattatgaagattcaggctctacaatccctgttttcagcagacccagaaagagaatcaatgggagtgaggctggaaacaatgataaggacagaattgggttagtgatggaggatgaaattgagccagaggtgatatgggaacaacgagtc

SEQ ID NO: 21778 - DNA, 418 bp, Gossypium hirsutum
  Clone ID: LIB3272-004-P1-K1-A11
ctctgctcgaaatcttcttcattctcattctctctccactgaactcttgctaaacggtatcgttttagtcagtctttcatcaatggcgaaagaaccagttcgcgtcctcgttactggagctgcaggacaaatcgggtatgctcttgtacccatgattgctaggggagtcatgttgggtgctgaccagcccgtgatccttcacatgcttgatatcccacctgctgcggaggctttgaatggtgtcaaaatggagttggtggatgctgcatttcctcttctaaagggtgttgttgctacaactgatgctgttgaggcatgcactggagtcaatgttgctgtcatggttggtggtttcccaaggaaggaaggaatggagaggaaagatgttatgtcaaagaatgtgtctatttacaagtct

SEQ ID NO: 21779 - DNA, 406 bp, Gossypium hirsutum
  unsure (1)..(406): unsure at all n locations
  Clone ID: LIB3272-004-P1-K1-A12
gttttcctcaatttcctctcatctcctacaatttattatgtactatttttacaccgccattgataatatatataagtgtaattgcttttgatcactggttcacgagtagagtattgactgatagtgtttgcttagagagaaaaaaaaaaaggaaaaggagaaaaagctgtgctttgattttttatttggaggaatttgattagatatggttgagattcttggtgagattgagcctcctagccctgtttatgaggcggagctaccggaggaggatgaagaacaagaggagatcagctacgaagagctgaagaagcggatgtggaaggatcggttgcggatgcagaggttgaaggagacacgagagagttcaagttccgatcatcnagtcgnggtgaggcaagaagcg

SEQ ID NO: 21780 - DNA, 222 bp, Gossypium hirsutum
  Clone ID: LIB3272-004-P1-K1-A2
aaaaaaaaggcgatcatttctgtcaggcgaattttggttctctattaaatcctagatataaaccgaactgtaaaaaggaaacacaggatttcaaagatcggagtaattgcaagcagcgcagtagcctaaccgcactgaaaaaataatggactatcctgaaaattcacaagatatgtctgccccaccagttaatgttgctggggggggacacacaatatatgg

SEQ ID NO: 21781 - DNA, 423 bp, Gossypium hirsutum
  unsure (1)..(423): unsure at all n locations
  Clone ID: LIB3272-004-P1-K1-A3
ggtgttgtcacttataactatgagtctacctctccagtcgcccctgccaggcttttcaaggctttttctcttgaagctgacaaggtttggcccaaggctgctcctcaggcagtcaagagtgttgaggttgaagctaatcctggccctggaagtatcgtaaagatcaactttgctgaaggccttccattccaatatatgaagcaccagattggaggacatgacgacaagaatttgtcatacagttatagtttgatcgaaggtggacctttgggggacaagcttgagaaaatcagctatgacaacaagtttgaggcagctgcaggtggaggaagcctttgcaagagctcgatgaaattttacactgttggcgactatgtgatcactgaagatgagatcaaggctcanatcaaagggagtgaagga

SEQ ID NO: 21782 - DNA, 429 bp, Gossypium hirsutum
  Clone ID: LIB3272-004-P1-K1-A4
gtctgaaacaacacacaccaagaacgagagaaggccttcaaaaaacaaaaaaacaaaaaagaaaaacaattagaacatcaaacatgattggtccaggcagacctctcttcgtcctctttggatcttccatcgttcagtttagttacagcaacgaaggttggggtgcaattcttgctcatgcatatgctcgcaaggcagacataatactgcgaggatacgcagggtggaactcgaggcgtgctttggaagttctagataaagttttccccaaggatgctgctgtacaaccttcattagtgatagtttattttggtggcaatgactcaattaaaccccacgcatctggccttggtccccatgtacctcttccagaatatgttgagaacatgaagaagattgctatgcatctcaagggcctatcggagaaca

SEQ ID NO: 21783 - DNA, 420 bp, Gossypium hirsutum
  Clone ID: LIB3272-004-P1-K1-A5
cttcggtatcccctcttcttccaagccaacaagcgtaaaggttgaatcttttcccccatttctccactcctaaagtcagggtttcgagcaacaatagaacaaaaatggggttctcaatgcagccttatggcatacaatccatgctgaaggaaggtcacaagcatctctcaggtctcgacgaagctgttctcaaaaacattgatgcttgcaagcaactatccaccatcacccgcacttccctcggccccgaaggcatgaataagatggtaattaatcatttagacaagctctttgttaccaatgatgctgctactattgtcaatgagctcgaggttcaacatcctgcggccaagattttagttctagctggtaaggctcagcaagaggagatcggagatggcgctaacttgacgatttctt

SEQ ID NO: 21784 - DNA, 421 bp, Gossypium hirsutum
  Clone ID: LIB3272-004-P1-K1-A6
gatatactcaaacaagtaagcagattgatctttctctgaaacttacaacttcaccatgaacaaaagcaagctccagctgcaactttgtgcagggatatttactttaagcatcctctccaatggtgcttatggtagtgacaaaatctttgacataactcacaaaatcacttctcagttgccaacttttggatcacagaagggtcttggtcaattcatttggcttctttccagcatcaaaaatgggcccacagtgaatgtgtcggagttcaaattgggaacccacactggcactcacgttgatgctcctagtcacttctttcagaagtactatgaacaaggatttgatgttgcaacccttagccttgaaactcttaatggtcctgtcctagtagttgatgttcaaagaaataagaacattact

SEQ ID NO: 21785 - DNA, 260 bp, Gossypium hirsutum
  Clone ID: LIB3272-004-P1-K1-A7
agagttttacctcggagttccctcatgttgagaggtacttttggaccttggttaatcagccaaaaatcaagaagattcttggtgaagtgaagcaggcagtctctctaccacctgttccttcaaagaagcctgctgcccagccaaaagaaactaaaccaaaggctgaaccaaagaaagaagccaaaaaggaggttgagaaacaggcagcaaaggcagaggccgctgaggaggaggaggcaccaaaggccaaaccaaagaat

SEQ ID NO: 21786 - DNA, 275 bp, Gossypium hirsutum
  Clone ID: LIB3272-004-P1-K1-A8
tctttcttctctaattattgaggaaatccaccgatcaaagttgttcaaatcgtgggtgaaagttttgagaaactaaaatggcgtccacattcagcggcgatgaaactgctccattctttggcttccttggggccgctgctgctctcgttttctcctgtatgggagcggcgtacggaacggccaagagcggtgtcggagtggcgtcgatgggagtgatgaggccagagctggtattgaaatctatcgtccccgttgatttcgcttgtgtttcaggc

SEQ ID NO: 21787 - DNA, 421 bp, Gossypium hirsutum
  Clone ID: LIB3272-004-P1-K1-A9
cacacggacgggagggagacgagaaaaggaagacatcgatggtgtctttgaagttacagaagcggctcgccgctagcgtactgaagtgtggccgtggcaaggtttggcttgatcctaatgaaatcaatgaaatctccatggtcaactccaggcagaatgttaggaaacttgttaaggatggttttgtgatccggaagcctaccaagattcacttccgatctcgtgcacgcataatgaaagaggccaagagaaagggtcgtcattctggctatggtaagaggaagggtaccagtgaggcaagattgcctacaaagatcctttgtatgaggagaatgcgagttctaaggcgtttgcttggtaagtacagggtatctcagatgattgacacgcacatgtaccatgacatgtacatgaaggtgaa

SEQ ID NO: 21788 - DNA, 395 bp, Gossypium hirsutum
  Clone ID: LIB3272-004-P1-K1-B1
cttctgatcaaagcataaacaaccagaattcaatggggaagaaagctgcgttgattggaatcaactatgcaggcacaaaggctctactgaaaggctgcatacacgatgtgaacagaatgtacaaatgccttatacgaacgctatggattctgtgaagaagacatgacgggattgatagacaccgataattcttatgatcagcccacagggaagaacatcagaagggctttaaatgatcttgagagatcgggtgagcctggggattttatgttagtgcactacaggggccatgggactaggcttgctgctgagactgaggacgatgatgatactggctacgatgatgtgcattgtccactgcgatatgaatctcatcactgacgatgactgcagag

SEQ ID NO: 21789 - DNA, 423 bp, Gossypium hirsutum
  Clone ID: LIB3272-004-P1-K1-B11
gtcatcctcctgcctgaagggcttatagagagcattcctgaagtgtatgcgctattgaaggaaattcacagtttgctcaggcaaaatgtatctgctgataaaatttcttcccaattatcaccttgggcatctgctttgtttgaatttttgccacatttcataaggaaacagcttcttctccaacctgagtcagacgattctgcacagctatcacagattgagacagagaaactactggcgcaccttgtagagaatgaaattaataagcgcctgaaagcaggcacttacaaggggaagaaattcaatgctatttgccacttctttggctatcaagctcgtggatccttaccatcaaaatttgattgtgactatgcctatgttcttggacatatctgctatcatattcttgcagctggtctaaat

SEQ ID NO: 21790 - DNA, 419 bp, Gossypium hirsutum
  Clone ID: LIB3272-004-P1-K1-B12
cccttggcttacaagttccattgtttatcagagcaagaaaaaaaagggaaaatggaagggaaagaagaagatgttagactgggagctaacaagttctcagaaaggcaacctattgggacagcagctcagtcccaagatgataaggattacactgagccacccccagcacccttctttgagcctagtgagttgacttcatggtcgttttaccgagctggaatcgctgagttcgttgctactttcctattcttgtacatctcggtgttgaccgtgatgggagttgttaaggacaaaaccaagtgtacaactgttgggattcaagggattgcttgggcttttggtggtatgatctttgcccttgtttactgcactgctggtatctcaggtggtcatatcaatccggcggtgacatttgggct

SEQ ID NO: 21791 - DNA, 421 bp, Gossypium hirsutum
  Clone ID: LIB3272-004-P1-K1-B2
gtacaacccgcgtgtctcctcctctcgccgcaagagccgcaaggctcatttcacagcaccttcttccgtccgccgcgtcttaatgagcgcacccctctcatccgatctgaagtccaagtacaacgtccggtctatgccggtgcgcaaggatgacgaggtccaagtggttcgtgggacctacaagggacgcgaagggaaagtggttcaagtgtaccgccgcaaatgggtgatccacatcgagcgcatcacgcgcgagaaagtgaacggttccaccgtcaacgttgggatcaacccatccaaggttgtcatcaccaagctgaggctggacaaggataggaagtctttgctggatcgcaaggctaagggacgcgccgctgctgataaagataatgcgactaagttctcagctgatgatataatg

SEQ ID NO: 21792 - DNA, 430 bp, Gossypium hirsutum
  Clone ID: LIB3272-004-P1-K1-B3
gtttctttatactccgaagaagcctctctcccaggattgtttctataatttacaaaagaaaaaataataataactggttaatttcgtcaggggctaagcttgtttgcttccataaattgttctatttacttctttcaatttattggttctgggtattcttggttcttgttcgatcgtttattttcaatttgtttgaggatggtttgcatggtttctcgcactggaaggcacttgcagcgatacgataacctaggccgccgccaagttgtcggttgcattccctatagatacaaatctagcagtgatggaaccatgactgatgacttggaggtacttgtgatctcctcccagaaatgtcaaaaaatgatgtttcccaagggtggctgggagcttgatgaatctagagaagaagctgcattaagagagtcac

SEQ ID NO: 21793 - DNA, 152 bp, Gossypium hirsutum
  Clone ID: LIB3272-004-P1-K1-B4
gtctccctgcatttatcttttcttttttttaccgaactctacggatgcgatatttacgttctgtctatttgacgaaaatccatcaaatactagaagatacatttactcactctttctgtcctgttcttcgtttaaaccgtttgccttggatg

SEQ ID NO: 21794 - DNA, 420 bp, Gossypium hirsutum
  Clone ID: LIB3272-004-P1-K1-B5
gggtcccgagatccgaactggttttcttaaggatggaaaaattcaactcaaacagggtcaagaaatcaccataacaactgactatagcataaagggtgatgagacactgataagtatgagttacaaaaagttggccgaggatgtcaaaccagggatggtcatactttgtgcagatgggacaatctcttttacagtcttatcttgtgacaaacaaaagggtttggttcactgtcgctgtgagaattctgcagttcttggtgagaggaagaacgttaatcttccaggggtcgttgttgacctcccaaccttgactgaaaaggacaaggaagatatcttggaatggggagttccgaaccaaattgacatgattgctctttcttttgttcgaaaaggatcagacctcgtggaggttcggaagct

SEQ ID NO: 21795 - DNA, 411 bp, Gossypium hirsutum
  Clone ID: LIB3272-004-P1-K1-B6
gagatgaggaaaatcatgggtgccaaagttcttttcttctttgctttgctttccttgtcagctgtctcggcatttgcacaggatgaggaagaccaaggtcttgttatgaacttctacaaggattcttgtcctcacgctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgccctgtctgctagg

SEQ ID NO: 21796 - DNA, 413 bp, Gossypium hirsutum
  Clone ID: LIB3272-004-P1-K1-B7
gcggcttctgcttctatttacaatcttctcactctcctgctcctttctggcatcccttttaccttctccgagctcgttaaagagcagcctctggtgttgaaataccacaatgggccactcttgaaggggaagatcactgttaatctcatttggtacgggaagttctccccaacccaacgctccataatcgtcgatttcatcaactctttgagctccgccgtcaaacccaaggttccgtcggcgtcgttttggtggaaaacgacggagaaatacaagtccggttcctccactttggtcgtgggcaaacaaatcctcctcgaaaattacccgctcggtaaaatccttaagaacccacacttgccggcgttggccgtgaaattcaacggcgtatgtacggtcagcgttatcctcac

SEQ ID NO: 21797 - DNA, 324 bp, Gossypium hirsutum
  Clone ID: LIB3272-004-P1-K1-B8
aaaacaaccaaagccactactgggtggcaaagcaactttcgattaagcaaaaacacatttaaacaagactttaccagacatgagttattgtccattaacatatcaaaccccccacttcatcatcacatcacattgaacctaccactaccatcatggcttaaaagatgattagaaaaaacaaaaaaccaatacttttgcctaaaaataaacaatagttttttttaagcgactgatccacacttctggaaattaagcacgctctcccctgatcctacgagccaactggatgtccttgggcataattgggacacgcttggcatggat

SEQ ID NO: 21798 - DNA, 428 bp, Gossypium hirsutum
  Clone ID: LIB3272-004-P1-K1-B9
tggaccgtcgaggaccaaatgctgctctctcatttcgggtttggctgatctcgatgctgctgtttgcctttgcactgctattaaagctaatgtgttggaggttgactgtccctgtgtgacacctgaggttgtccttaaggcatctggtcatgtggataaatttactgaccttatggttaaggatgagaaaactggaacctgctatcgagctgatcacttgctgaaggatttctgcaacgagaagcttcaaaaagacctcaccataagtgcagagaaggctgctgagcttaagcatgtacttgctacattggatgatctatcagctgaagcactaggtgcaaagatcaaagagtatggtattactgctccagatacaaagaatcctctctccgatccttatccattcaacttaatgttccaaagcaaag

SEQ ID NO: 21799 - DNA, 422 bp, Gossypium hirsutum
  Clone ID: LIB3272-004-P1-K1-C1
gtggagagccttttttgtgtagcgattctcagttagtcttttctttaagcttacagcttctctccagagttttataatgggtaaggagaaggttcacatcaaccttgttgtcattggccatgtcgactctggcaagtcgaccactaccggtcatttgatctacaagcttggtggtatagacaagcgtgtgattgagaggttcgagaaggaggctgctgaaatgaacaaaaggtcattcaagtatgcttgggtgctcgacaagcttaaggctgagcgtgaacgtggtctcaccattgatcttgccctgtggaagtttgagaccaccaaatactattgcaccgttattgatgcacctggacaccgcgactttatcaagaacatgattacccttacctcacaggctgactgcgctgatctcatta

SEQ ID NO: 21800 - DNA, 411 bp, Gossypium hirsutum
  Clone ID: LIB3272-004-P1-K1-C11
ctctgctcgaaatcttcttcattctcattctctctccactgaactcttgctaaacggtatcgttttagtcagtctttcatcaatggcgaaagaaccagttcgcgtcctcgttactggagctgcaggacaaatcgggtatgctcttgtacccatgattgctaggggagtcatgttgggtgctgaccagcccgtgatccttcacatgcttgatatcccacctgctgcggaggctttgaatggtgtcaaaatggagttggtggatgctgcatttcctcttctaaagggtgttgttgctacaactgatgctgttgaggcatgcactggagtcaatgttgctgtcatggttggtggtttcccaaggaaggaaggaatggagaggaaagatgttatgtcaaagaatgtgtctattta

SEQ ID NO: 21801 - DNA, 415 bp, Gossypium hirsutum
  Clone ID: LIB3272-004-P1-K1-C12
gtagccgccgcctgcgtctctctcttcatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgaaggttgttgacattgttgacactttcaggcttcaggagcaaccccctttcgacaagaagcagtttgtcgtgttcatcaagaagttcatcaagaacttgacaccaaaactggatgcggaaaaagcagagtccttcaagaaaacatt

SEQ ID NO: 21802 - DNA, 416 bp, Gossypium hirsutum
  Clone ID: LIB3272-004-P1-K1-C2
ctttcctctctcaaaatctcaaacccagatttgttctctctctctctctctctctatttccaatcaattaattcctccattggaggagcttagggtttgttggtgttctggactttgctttgtctgaaaaataaacagaattataaacgaacaccaacgccatgggaagatttgaagagagaggattcgattcagtggtttgccctaagcctatccgaacctttagatggtctaccaactgttatcagactgagatggctgattcaaaaactggtgcagagcttcttgatataatcctccccgagggagggtatggggccgagaatcctaccaaccaaatggcttcatcaccaccgtatttctgtggatcaccgacgagcagggcgtcgaatgccgttatccaagatgcccgattc

SEQ ID NO: 21803 - DNA, 432 bp, Gossypium hirsutum
  unsure (1)..(432): unsure at all n locations
  Clone ID: LIB3272-004-P1-K1-C3
ggaaaaagcagctcactttctccttcatcaaaccccaaaaacctagctttgcctcctttttaatttcttggattttggtgaactttatgaatccaagatcagagtataaaggattcgagttttaaccccagaattaagtacatctgctctttttgatctttgggttgaaattgtctacacaaagagggtgatttagaaatggatgctgatccatggactctttgtctttcttcaactgctaggagatatcaatcagctcttcagtcacgatctgatatgtttatggggtttgaagaaatggatggagaagacgatgtaagagaggagtttccatgccctttntgttcagagtatttcgatatcgtgggcttgtgctgtcacattgatgatgaacatcctgtggaggctaacaatggggtatgtcctgtctgt

SEQ ID NO: 21804 - DNA, 419 bp, Gossypium hirsutum
  Clone ID: LIB3272-004-P1-K1-C4
tcctccttgatatctactcattgtttcgacgctttggcctctcatcgatccacaaagatgattgatgatcagcagctggggtttcttgcaaattttttaggggtttttatatttggactggtaattgcttaccattacgtgatggccgatcccaaatatgagggaaactgaaaccgttagacagttaaattatattacatgttagataagaacttagattatgttcgtaaacatgttagttttctttgcataattgaactgcttgttttggtcaatcttcttttacatactaaagattgatctatgatcgattttcgttagatttgaaggatattaacttttgtctttcaatgcatttagtgatgcttttgtcaagatagcgattatacatgcatgggcttgcatgatatttgccttgg

SEQ ID NO: 21805 - DNA, 429 bp, Gossypium hirsutum
  Clone ID: LIB3272-004-P1-K1-C5
cgaaaaagagggggaaaaaaagagcggtcgagattttcacagccatggcgagcaccaaagtacagaggattatgacccaacccatcaacctgatcttcaggtttctccaaagtaaagctcgcattcagatttggcttttcgaacagaaagatttgaggattgaaggccgaatcattggttttgacgagtacatgaatttggttctggatgatgctgaagaagttaacgtcaagaagaaaagccgaaagtcattaggaaggattcttcttaaaggagacaacattactcttatgatgaatagtggaaaatgattgtagatccagcagttatttggactcgtgaatgcaaaatcttcttgtcatcgtataggtcaatctactatgactatatcgtactatctttaaaaacatgccttcgtgttaggacatt

SEQ ID NO: 21806 - DNA, 276 bp, Gossypium hirsutum
  Clone ID: LIB3272-004-P1-K1-C6
gatccgttggtgagacgaacgatgcttgccataaccacctctcacgcacatgacgtgttacgaagctaaagtaacatacgtctgatgagatgtgcgctgatcataccaacatgtggatgggtggttcatgttgatcaatgctcatcgtgtgaggtctgattgttcctttagatgtccactttatgacagcctgttccacttgtgacgctgcacatactatgccttatgaatgggaggataagctttgcgcaagcagaggatatgtcttttatttca

SEQ ID NO: 21807 - DNA, 418 bp, Gossypium hirsutum
  Clone ID: LIB3272-004-P1-K1-C7
cttttctcttcactccacatctcatattccttcatttctctctaaatccttccattttttgatattttttttgtaagtaaaggaacagtgaaaagcaacaggaaatggcaaatatagatatcgatgggatcttgaaggagcttcccaatgatgggcgtatccctaaaaccaagatcgtttgtactttgggtccggcttcacggtccgtacctatgatagagaagctgttgagggccgggatgaacgttgctcgcttcaatttctctcatggcagtcatgagtatcatcaagagaccttggataatcttaggtctgctatgcacaacaccggcatcctttgcgctgtcatgcttgacaccaagggccctgagattcgaactggattcctgaaggatggaaaagctgttcagctgaagga

SEQ ID NO: 21808 - DNA, 430 bp, Gossypium hirsutum
  Clone ID: LIB3272-004-P1-K1-C8
ctctcaccatgtcattgctgtctttttccttcttgttgctgtttgcttttagtgccaaagctgttgttcctccatctgaaacttttaggtttgtcaacgaaggggaatttgggccttttattgttgaatatggtgcagattaccgtgtcataagcatagctaatgcccccttccagcttgcgttttataacaccacgcctaatgccttcacccttgcgttacgcatggctacaacacgttccgagtcgctcttccgatgggtttgggaggccaacagggggaaccctgttcgcgagaacgccacgttctctctcgggactgacgggaaccttgtcttggctgatgccgatggtcggattgcttggcaaagtaacactgccaacaaagctgtggtagggttccaattgttgcctaatggtaacatggtgtt

SEQ ID NO: 21809 - DNA, 419 bp, Gossypium hirsutum
  Clone ID: LIB3272-004-P1-K1-C9
gctttcctctcctgccgatccaaagttccttcaggcatcaaaaaggacccccccgatcaaatttatcttttctggtttcgctatggcatcgaagcgaatcttgaaggaattgaaggatttacaaaaggatcctccaacatcttgcagtgctggtcctgttgctgaagacatgtttcattggcaggcaactatcatgggtccaccagacagtccgtatgctgggggtgttttccaagtgaccattcattttcctccagactatccttttaagccacccaaggtggcatttagaacaaaggtattccaccctaatattaacagcaatggaagcatttgcctagacatcttgaaagagcagtggagtcctgcactaactatttccaaggtattgctatcaatatgttcattgctgaccgatc

SEQ ID NO: 21810 - DNA, 419 bp, Gossypium hirsutum
  Clone ID: LIB3272-004-P1-K1-D1
caaatttagattataagtatgagcagcaagtgccctgattctccaatttgttcccaaaccaaaggaacactattttcaccaatatggacccaaatatgccgaaaaaaaacacaaacagctgttggacaaataaccatcaatgtggcatgcttagactctttcccttgtgacaaaaaaaagtgatcaaagctatgctgaatcatcttagcaaaatggatacctatcttaatgtgaaggaaccattgagctttggagaaggaagttcagattagagctatttatctgaagtttggaattaatgcctaaactacatagtcatggttgtataaagttaaattacaaacttagggcatatctgtttcccattaaagcatcatacacttgtttcataatactttaatattgatcttaaactggaa

SEQ ID NO: 21811 - DNA, 421 bp, Gossypium hirsutum
  Clone ID: LIB3272-004-P1-K1-D10
ctagactgagatcgctccaagctccctttgattcccatcatcacaatcatgatttggacccataaatctaaaatctcccaatttcccaattctttatctgtagggttccgttcttagcttcaaatttgcaaatttagatctcaatcactcaaatcactgaaaaaacaacccagcaaaatgtacggattcgaagctatgacgttcaacatccacggcggttacctagaagcgatcgtgagaggtcaccgggccggtctcttaaccgtcgccgattacaacaatctctgccaatgcgagacccttgacgatatcaagatgcacctctccgccaccgaatacggtccttacctacaaaatgaaccttcaccattgcatacgactactattgtggagaaatgcactcttaaactcgttgatgagt

SEQ ID NO: 21812 - DNA, 396 bp, Gossypium hirsutum
  Clone ID: LIB3272-004-P1-K1-D11
attttcagtcgtcttctcttttagtcctctcgatcccaaagcaagctctcgattccgaatctctcccagaagatgcagatctttgtgaaaacccttactggtaaaaccatcacccttgaggtggaaagctccgatactattgataatgtcaaggccaaaatccaagacaaagaaggcattcctccagaccaacagaggcttatttttgccggaaaacaactcgaggatggccgaactcttgccgactacaacatccaaaaggagtccaccctccacctagtccttcgtctaaggggtggcatgcagatatttgtgaaaacccttacgggcaagaccatcaccctcgaggtggaaagttctgatacgattgataatgtcaaggccaagatccaagac

SEQ ID NO: 21813 - DNA, 418 bp, Gossypium hirsutum
  Clone ID: LIB3272-004-P1-K1-D2
ttcatgcaaaccatgtgctacggaggtgctatgactatgacggctccgccggcgagcggaggctccgcgtttgcatatactattaaggatgtgatgctcgagagagaaagcgagctgataatcgaggtgtgtaatgaaacgccgcttaaacttctattactaaacgggtcagccgagattctggtatgctaattgtgcccctgagatgcgaattactttccccactcacctgaaatgtcgctagttgacacttcgtatggtgctacaatctacatggatggtgctactgaagactgattatacagcagatgagacacctatggtcagatacgtgaatgtacatgctgtactacaaggactaataagccgttctgaagctcagtcaccaaatgactatgacgcatactagggacccaga

SEQ ID NO: 21814 - DNA, 429 bp, Gossypium hirsutum
  unsure (1)..(429): unsure at all n locations
  Clone ID: LIB3272-004-P1-K1-D3
gctcgatctccttacagctaccgtacacactcacacacacattcactgaatgggtcgagtcatccgagctcaacgtaagggtgctggttccgtcttcaaggcccacacccaccaccgcaagggtcctgctcgtttccgcagcctcgacttcggtgaacgaaatggctacctcaagggtgttgtcaccgatgtcatccacgaccctggtcgtggcgctcctttagcccgtgttgtcttccgtcaccctttccgttacaagaagcagaaggaacttttcgttgccgcagagggtatgtacactggacagttcgtctattgtggtaagaaggctactcttgtggtcggaaatgtattgcctcttagatctatccctgaaggagctgtcgtttgcaacgtcgagcatcatgtcngtgatcgtggggttttcgc

SEQ ID NO: 21815 - DNA, 314 bp, Gossypium hirsutum
  Clone ID: LIB3272-004-P1-K1-D5
taatatttgttcaaagctttcgattacaaatccctcgcgaaagatgcagatctttgtgaaaactcttactggtaagaccatcaccctcgaggtggaaagctccgacacaattgataatgtcaaggccaagatccaagacaaggaagggatcccccctgaccaacagaggcttatcttcgccgggaaacagcttgaggatggccgtacccttgctgactacaacatccaaaaggagtccaccctccaccttgtccttcgtctcaggggtggcatgcagatcttcgtaaaaacccttactggcaagacaatcaccc

SEQ ID NO: 21816 - DNA, 414 bp, Gossypium hirsutum
  Clone ID: LIB3272-004-P1-K1-D7
cgaactctgaaaaatccatgcaattcaatggtcaagctgagaaatgtgcgaaaagaaagaggaagaaccagtatcgtggaatccggcagcgcccatggggtaaatgggctgctgagatccgtgacccaaggaaaggggttagggtctggttaggaactttcaatactgctgaagaagctgcgagagcttatgatgctgaggcgcggagaattcgtggtaagaaagcgaaggtgaacttccctaacgagactccgcgtacctctccaaagtgtgcggtcaagacaaattctcagaaaccactttccaagtcgaatttgagccctgttcagctaaatctcaaccagaattacaattacttgagccagcctgagcaggaatacttcgataccatgggtttcgtagaagagaagccac

SEQ ID NO: 21817 - DNA, 428 bp, Gossypium hirsutum
  Clone ID: LIB3272-004-P1-K1-D9
ccatgagctacttaaccatttcccaaatctcctccctcctcttctttagcgtccttttcatttccgctcatgcagcgcgctttgaaatccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccggtgattgtggtggactccttcaatgcaaaggttggggtgtacctccaaacaccctggctgaatatgcacttaaccaatttggaaacatggatttctacgacatttccttagttgatgggtttaacatccccatggtgtttggtccaactaatggcggttgtcacaac

SEQ ID NO: 21818 - DNA, 430 bp, Gossypium hirsutum
  Clone ID: LIB3272-004-P1-K1-E1
gaattatttaagcagcacgtcacaagggatctagagcaaggttagtgaccttgggttgagtgtagagatgaggaaaatcatgggtgccaaagttcttttcttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaagggaattcaggtacattgagaccatcaaagaagctgtagaaagggaatgt

SEQ ID NO: 21819 - DNA, 422 bp, Gossypium hirsutum
  Clone ID: LIB3272-004-P1-K1-E11
ggcggtttgatcggagaatttaaccatgttcaaccggctttttggaaaacccaagcaagaaatcaatgctctaaccacgttagacaaattaaatgagacccttgaaatgctagagaagaaggagaaggtacttctcaaaaaggctgctgcagaggttgaaaaggccaaggaattcgccaaagcgagaaacaagagagcggctatacagtgcttgaagaggaagagactatatgaacaacaaatagagcagcttggcaacttccagcttcgtgttcatgatcaaatgataatgttagaaggtgctaaagccacaaccgaaaccgtagatgctttgagaaccggagctgctgcaatgaaggcaatgcagaaagcaacgaatatagatgatgttgacaaaacaatggacgagatcaatgaacaaa

SEQ ID NO: 21820 - DNA, 419 bp, Gossypium hirsutum
  Clone ID: LIB3272-004-P1-K1-E12
aaataaacaagttgccatcttgtcctgcacccctactgctttcccactcccccaaaaaaggcaaggggagcgtaaccaaacctcccccaacaatgttggtctcaacctcaggcctgctcctccccgtgtgcttgttgtttcttctaatatttggcactgtcaccgctactgaccacatcgtgggtgctaacaaaggctggaaccctggcatcaactacaccctttgggccaacaatcagaccttctacgtcggagacctcatctcgtttaggtaccaaaagacacaatacaatgtgtttgaagtgaaccaaactgggtatgactcctgcacaacggaaggagcagtagggaactggagcagcggcaaggattttatacctctcaacgagtccaagagatactacttcatttgtggcaat

SEQ ID NO: 21821 - DNA, 424 bp, Gossypium hirsutum
  unsure (1)..(424): unsure at all n locations
  Clone ID: LIB3272-004-P1-K1-E2
cagaaaataggatccagcgatggcggaagatctggttctcgatacggcgatcagagattgggtgttgatacccctttcagtggtgatggttctgatcggcatcctccgctacttcgtctccaagctcatgcgctcctttcaagttcctgatcctaagatcgtcaaagaagggcaagtaatcgttagggctcggaatttacgaggtgctgcaaattttatccctcccaagtcttttcgatctcggagggtttatttcagcaatgaggaaaatggattactgtttgtccccaagggccaggctcaaaatgcgcaagcacaaatgttctctgaccctaacatggctatggacatgatgaagaaaaacctctctatgattatacctcagactctcacttttgcctgagtcaactntntcttctctgga

SEQ ID NO: 21822 - DNA, 429 bp, Gossypium hirsutum
  Clone ID: LIB3272-004-P1-K1-E3
gtcaaatgtctaatgcagctttagtcaccattgctcagaactgtccaaacttcactcgttttcgtctttgtcttcttgatccaaaaatagccgactaccggacccttcagccacttgatgtaggttttggagccattgttgagcactgcaaggatctgagacgcctttccctctctggtctcctcacagatcgtgtatttgaatatatcgggatgcatgcgaaaaagctagagatgctgtctgtggcttttgcaggagaaagcgatttggcacttcatcatgtgctttctgggtgtgaaagtctccggaaactggagattatgaactgccccttcggggacaaggctctattagcgaacgctgcaaagctggagacaatgcgatccctttggatgtcttcttgctctgtgagtctcggagcatgtaaga

SEQ ID NO: 21823 - DNA, 421 bp, Gossypium hirsutum
  Clone ID: LIB3272-004-P1-K1-E5
caaaagataaaggaatcgtttacttgttcgtagcaatttatcgtcatttcaagctcaagtctctgaaaatttttgtgctgaactccttttttctgtttgtactaccatgtgtggaggtgctattatttccgatttcataccgccgtcgcggtcgcgacgattgacggccgatttcttgtggcccgatctgaaaaaatccggattgaagaaggggtcggctaagagatactcgaagcccgtgatcgacttgggcgatgatttcgagactgactttcaggagttcaaagatgaagaatctgatatagatgattatgatgttgatgatgttttggctgatgtaaagcccttttcttttaacgctagaacgaaacctgcttgtgctgtatctcatggttcgaactctgaaaagtccatgcagttc

SEQ ID NO: 21824 - DNA, 423 bp, Gossypium hirsutum
  Clone ID: LIB3272-004-P1-K1-E6
gagaagcagccgctcctccttccatctcctaaacaagaatggattcgcaaattaagtttgctgtggtggtgaaaataatgggaaggaccggttcaagaggtcaagtgacgcaggtgagagtgaagttcttggacgatcagaaccggttcattatgaggaacgtgaagggaccggttcgtgagggagatatcctcacattgctggagtctgagagagaagctaggaggcttcgttgaagggttatttttatactttttggggtttatgcttgttttgaattgtctaccgtattgcttttgaattacgtttagtaggtattcgtatatcgagacttgcgatttgggagaatggttgttgcttaaacctggattttatgatgattatgttgaaatgaactgaattggttttgagttttggttaaaa

SEQ ID NO: 21825 - DNA, 430 bp, Gossypium hirsutum
  Clone ID: LIB3272-004-P1-K1-E8
ctaaccctcaaattcgcttaaaaattcccccccctttgttcaaatcctttctctaattacactaaaagccccttcaatttttgataaattcaatttattgtaaaaatttccccattcctttttttttaatttgagaaatttccatggccgccgttgtagaagaaaccatacaatgattgaattattggggtttcgtttcaattgtatggggtttatgaaatgcctgagttgcgaaaaggtgtttgtagaggccgtgccaagttagcgcagcctcagcagccacaagaaacccggaaacaaacgaggaatcaaggtcggaaacgtgcggcggcggcggttattgaggtaggtaggccaaggacgagattggccgccaagagactaaaggaggaggaggaacaccctcaggtcgttgtgatttctgagagag

SEQ ID NO: 21826 - DNA, 358 bp, Gossypium hirsutum
  Clone ID: LIB3272-004-P1-K1-E9
gtgtgttttgtatttcatactcatttagcccctttcattagcatcgaaatcactccagttttctttatcactgaaaaatgtcttgctgtggtggaaactgtggctgcggttctggctgcaagtgtggcagtggctgtggaggatgcaagatgtacccagacctgaacgttgccgagatgaccaccactggaacttttgttcttggtggagcaccccaaaaaggcccctttgagggagctgagatggaattcgggctgagaacgctgcagtgtgagacactgccctgcacctgcaatgaatgtagagccaagccagctctgagcaaacccttgcttaaaatattgttgtgtatggttta

SEQ ID NO: 21827 - DNA, 255 bp, Gossypium hirsutum
  Clone ID: LIB3272-004-P1-K1-F1
gcgaaacgtgttgaaagcctgctggcttttgccccccgcagagaggtcggttttactagctactccttctttacctaaccaacttctggatcatgagcttcccagggggaggcctttcctagatgtgaagcaaccacaacacaagccattccatgcacaccgaccgacaatacacactggacctgccggtctaggtcaggagccaccacatggtgaaacacctactcatagaaacttattgagtgtggaagttgc

SEQ ID NO: 21828 - DNA, 411 bp, Gossypium hirsutum
  Clone ID: LIB3272-004-P1-K1-F10
gtcgtatattgctggatggcattgtccctaagcatgatgcacaaatacacagagatagacccaaacgccggctattttatggcatttcggagtgtaggaatgaaacgggccaggtatcttgtagcgcttggagctcttaaggggatgaccactgtgcttctggtaggagcccttgggcaggcacgatatactactacatattgcacgagcacacatgatcccaccatggttcgcgcttgtccacccaaagactggaacaccatataaatgcgacgcttttgatgaccatttcaagtggcctgattgcatttttgtgaagcttggatgtcttagcaagcttgctatctgtgagcactctattcatattcatgatgatggctgtagcactacttgtgaggagatactatgtga

SEQ ID NO: 21829 - DNA, 398 bp, Gossypium hirsutum
  Clone ID: LIB3272-004-P1-K1-F12
ctttgtatgtatctcttggtggaggaatgcttgtcacctactctttttttagttggtcagtccctttaaaactttctctcacgacacagtccagaattcacacactttcagacatacacagacctgtagaactgtgttttctctgtttatcccactccttttttctgggcaatggataaacataagtgtaagttgtgtttcaaaagctttgcatatggaagagctttgggtggtcatatgaggtctcatatgttgaatcttccaattgctcccaaacttgcagaacaagaacgatcgggattaccacgaccaacgaatcaactcagccaagagtcagagtcagagtcgggttcggcatcttattccgcgtcttcatcggaagaagaagaagaagggga

SEQ ID NO: 21830 - DNA, 310 bp, Gossypium hirsutum
  Clone ID: LIB3272-004-P1-K1-F2
gttcttgagattatttctgtttactgcaaggcctggcaacattgtatgcagccgtggactgcaaaaagagcatatcgccttgtttgtctttggggattcacagtgtgatcctggacataataactacatcgacacgattgctcggacatattattatccatatggagaaaccttattaaaatacccgactgggaggttttctgatggacgtttaattccagactacattgccgggtctgcacttgtacctctagttgcaccatatcttcaacctgggaatcatgagcttactactgatgtcaactttgct

SEQ ID NO: 21831 - DNA, 424 bp, Gossypium hirsutum
  Clone ID: LIB3272-004-P1-K1-F3
cgaacattttcacagcttaaaacacaatatgactaaggatattgagaccacggcggagcaaggcggcggagcggagttctcagcgaaggactaccaggacccaccaccggcaccgttgattgacttggaagaactcaccaaatggtcgctttatagggcggcgatcgctgagttcattgccacccttcttttcttgtatgtcacggtgttgactgtgatcgggtataaagtccaaaccgacccggtaaagaatactgttgacccggattgtggtggtgttgttatacttggtattgcttgggcttttggtggcatgatctttatccttgtttactgcactgctggtatctctggaggacacatcaacccggcggtgacgtttggactgttcgtggggcggaaggtgtcactgatccgagccctg

SEQ ID NO: 21832 - DNA, 422 bp, Gossypium hirsutum
  Clone ID: LIB3272-004-P1-K1-F4
aatttcttccgttgatctttgttagagattagctttttaatttttcattatgggaaagatcaagatcggaatcaatggatttggaaggatcgggcgtttggttgcgagagttgctctccaaagcgatgatattgagctcgttgctgttaacgatcctttcatcaccactgaatacatgacgtacatgtttaagtacgacagtgttcacggtcaatggaagcatcatgagcttaaggtgaaggactcaaagacccttctctttggtgaaaagcctgtcacagttttcggtatcagaaaccctgaggaaatcccatgggctgaggctggagctgagtatgttgttgagtctactggtgtttttactgacaaggacaaggctgctgctcacttgaagggtggcgcgaagaaggttatcatttctg

SEQ ID NO: 21833 - DNA, 424 bp, Gossypium hirsutum
  Clone ID: LIB3272-004-P1-K1-F5
tttcaaactgaaacaggcgctgatgcttcaatttttcatcttctatcaagaataaaatctagggttagggttagctaaagagggtaaacccggaaaatggaaggctgggacccgaatacgaagtcgacgctgacccagatcccgctattgacgacgaaggcgggccccagagacggagcggcatggactcagaggcttaaagaggaatacagagctctaatagcctacacccagatgaacaagtccaacgataacgattggttccgtatatcggcagccaatcccgaaggtacccgttggacaggcaagtgttggtacgtccataatctccttaagtacgagtttgatctccagtttgatatccccgttacttatcccgccactgctcccgagcttgagttgcccgaactcgatggcaagactc

SEQ ID NO: 21834 - DNA, 424 bp, Gossypium hirsutum
  Clone ID: LIB3272-004-P1-K1-F6
ctctgcagtattttgctggaaagaagagagcgaacatggcgataggagttaaggccttgcacttgtcgtttgtgcctcatgccctcgcgattgccggcgctgttatggtattggtttggtgcattcacttcaggggtggattagcttgggaatcttctaacaaaaatctcatctttaatctccatcctgtattgatgttgattggcttcattatcttaggaggtgaagccattatgagctacaagtctttgccactgaagaaggaagttaagaaagtcatacatcttgtgctccatgccactgctctgattctaggcattattggaatctatacggcattcaagaatcataatgagagttcaatacctaatctctacagcgtgcattcttggctggggattggaatcattaccctttatggcat

SEQ ID NO: 21835 - DNA, 413 bp, Gossypium hirsutum
  Clone ID: LIB3272-004-P1-K1-F7
aaaagaaaagaaaaaatacagtgaaaatggcaacccttaaggttccagctcatgtacctgccccttctgaggatgctgagcaacttcgtaaagcttttgaaggatggggtacaaatgagcaattgattatcgacatattggctcacaggaatgcagctcagcgcaatttgattcgtaaaacttatcgtgaagcttatggggaagatctccttaagtctttggatgaggaactttcaagtgactttgagcgagctgtggtgctgtttactttggaccctgcagagcgtgatgcatttctggctcatgaagctacaaagaggttcacatcaagccattgggttctcatggaaattgcttgcactaggtcttcacatgaactgttcaatgtgagggaagcgtatcacgatctttac

SEQ ID NO: 21836 - DNA, 424 bp, Gossypium hirsutum
  Clone ID: LIB3272-004-P1-K1-F8
aaaaaaaagagataatcaacttgtcagaaggaagaagatatgggaagcgagtcatacgaggaagccattgcagctttgtcgaagcttctcagtgacaaagctgatctcgggagtgtcgccgccgcaaaaatcaagcagataacagccgagttagaggcagctgccgattccactcagttcgacccggtcaagcggctcgagaccggtttccttcacttcaagaaagaaaaatttgacaaaaatcctgatctgtacggtgcacttgccaaagggcaaagtcctaagttcttggtatttgcatgctccgactctcgggtgtgcccctcccacatcctgaatttccaaccaggggaggcttttatcgtccgtaacattgccagcatggtcccgccctatgacaagaaaaaatactctggagctgggg

SEQ ID NO: 21837 - DNA, 232 bp, Gossypium hirsutum
  Clone ID: LIB3272-004-P1-K1-G10
cggacgcgtgggttccgccaccgtccccaacgccaaaacatccgatcttccgcctatgagttgttgaatattagggtttatttctttcgggtttgggtctaaaaggattgatgtttatggttttagatttttgtttttatcttttaatctgtgctttgctctgtatttgtttttcatttgatacaaaaaaaaaaaaaagattgcttaataaccagtgattgtacattttacc

SEQ ID NO: 21838 - DNA, 416 bp, Gossypium hirsutum
  Clone ID: LIB3272-004-P1-K1-G11
tttcggttgaaaatttgtttaaaaaagagggtgatttagaaacaatggatgctgattcatggagtgctcgtctttcttcagcttctaagagatatcaatcggctcttcaattacgatctgatatgcttatggggtttgaagaaattgatggagaagatgaaataagagaggagtttcgatgccctttttgttcagagtatttcgacatcgttggcttgtgttgtcacattgatgatgagcatccagtggaggctaaaaatggggtttgtccagtctgtgcaatgagggtgggcgttgatatggttgcgcatttaaccctacaacatggaaatatatttaagatgcagcgcaagaggaaatcacgtaaaggtggatctcattccacgctttctcttctgaggaaagagctgcgagaa

SEQ ID NO: 21839 - DNA, 418 bp, Gossypium hirsutum
  Clone ID: LIB3272-004-P1-K1-G12
aacataccacacaacagccttttgattagcctctttctatttgtcaaaaatggcaacatcagcagtttctgcaacttctcttctgcttttcatcttcggtttttgcttgcgaggcgcctttggtgattatgggggaggatggcaaggtggccatgctacattctatgggggcggtgatgcatctggcacaatgggaggcgcttgtggatatggtaacttatatagccaaggttatgggaccaacactgcagcacttagcactgctttgttcaacaatggcctcagctgtggttcttgttatgaaatgaggtgtgatagcgaccccaaatggtgcctgcctggatccattaccgtcactgcaaccaacttctgtccccctaacttggccttgtccaatgataatggtggctggtgcaat

SEQ ID NO: 21840 - DNA, 428 bp, Gossypium hirsutum
  Clone ID: LIB3272-004-P1-K1-G3
gagaagcagtactccttccattccaactcagcgctcactcaatccaactcaccaatgggcgcgcaagacggaaatcagcaatcacagcaactcatccttggtcacaacgtcttgctgctgaagcatacagatgtccctgacatcgagaaggtccgtctcaaggatgaagtcctgaactcggttaaatccaatgaaatggctccgtattatgaaaccctaggtgccgattaagtggttgagctggatcagaacgttttggacgcgatgcgtgccaagaatgaggaggagattaagaagctcgacgagaagattgctgatgctgaagaaaacttgggtgaaagtgaaggtcgagaagcacatttagctaaatccttatattacattcggataggtgataaggagaaagcatcggagcaacttaagttgac

SEQ ID NO: 21841 - DNA, 399 bp, Gossypium hirsutum
  Clone ID: LIB3272-004-P1-K1-G4
cttaaccatttaccaaatctcctccctcctattctttagcgtccttttcatttccgctcatgcagcgcgctttgaaatccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccggtgattgtggtggactccttcaatgcaaaggtgggggtgtacctccaaacaccctggctgaatatgcacttaaccaatttggaaacatggatttctacgacatttacttagttgatgggtttaacatccgcatggtgtttgacacaac

SEQ ID NO: 21842 - DNA, 422 bp, Gossypium hirsutum
  Clone ID: LIB3272-004-P1-K1-G5
gttctagatcgcgagcggccgctcgcgatctagagtagatcccatccaacctcatggttgacacaaaataattacattccaaagtttttcctttttctttctgaatgttcggcaccgtgaaagtttctgtttcgagcttggcttgatactttacggcgtcgggatcgttcaaaatccaaccttgacgttgtttaaattagggtttcatcgaagcgaatggaggtttagttttccctttttgtttctgagaaatttgaagtgaatcaggacgtggattagccagcagtatcagatgtgaagctcctgtatcgcgggaaattttgaagctcagttcttttggaataaattagaatcaataagaaattttaccaaaaacaggaaaatggcaactccaattgagccccctaacggtattcattacc

SEQ ID NO: 21843 - DNA, 423 bp, Gossypium hirsutum
  Clone ID: LIB3272-004-P1-K1-G6
gaagatgctttgcaaggatgtgctaccactgtttgccctcccatcttcatctgcatctgtatctgtttcggttcctatttcagtaacatactacaaggatgcttccacatctgtctcatcttaccagactcacgaacacgggtttatagattatatttctttccaaatccccggtgactcttcctcaaatattgctaattgtataggcatatcaaggagattcatgcacagtttgagcaatagtagtattgaggaatctgcttctttggaagctgttttgctttctgttcctgatggttatcactgtgtggatctatctttatataaggaaggccaaattgttttgctattaaatgaaacaacttctgcttctgaatgctccggtgaatcttgtatgatgatcgtccaagctgatgatctccc

SEQ ID NO: 21844 - DNA, 426 bp, Gossypium hirsutum
  Clone ID: LIB3272-004-P1-K1-G7
tatcactagatgaagcttttgacaagttctaccatggaatctctgcgcatggaccattttttgatcatgtattgggatattggaaggcaagccaagaaaaccccaacaaaatattgtttttgaactttgaagatctcaaggaagatatggattcccacttgaaaaatttggccatgttcttaggagttcctttcaccgatgatgaagagacacaaggagttgttgaaaaaatatcgaaaatttgtagctttgagaacttgaaagaattggaagtgaacaagaagggcgtacatactactggaattccacacacacatttttttaggaaaggagaagtgggagattggagcaattatctcacacccttcatgattgaatgtttggagaagcttattcaagagaaattgaatggctcgggtttaacat

SEQ ID NO: 21845 - DNA, 426 bp, Gossypium hirsutum
  Clone ID: LIB3272-004-P1-K1-G8
gtcagttttccttttgtttttgtcgtatgtagtcgtaggatcagctgagcagtgtggaaggcaagcaggtggtgctctttgccccggtggtctatgttgtagccaatttggctggtgtggcagtactgctgactactgcacagttcctggttgccaaagtcagtgcagcggtagtggccctgcccctgggcctggtgggctaaccaatcttatatcaagagagacgtttaatcggatgcttttgcataggaacgatggggcttgtcctgcccgtggcttctatacatatgatgctttcattgctgctgcccgttcctttcctgcatttgctacaactggtgaccaagctactcgcaagagggaaatagctgccttcttagcccaaacttcccatgaaactactggtggggcagggtgggctgcacc

SEQ ID NO: 21846 - DNA, 425 bp, Gossypium hirsutum
  Clone ID: LIB3272-004-P1-K1-G9
ctttccagcaagcaagcaagcatgtattccacaccttgcctggaatcccaaatcctataaaccctaaattcacaatcacaaccccactttcacaatataccttactagagaaaaagagcccctattacgttcattgattcactatcattcctttgaacatcttagattatcttgactccaagtcattcacacaaccttaattagattcttaagttttcttacctgggtattatgcatagatctggagcaacgatggcctggaacgtcttcaagttttgtacagctctgaggggtctgggatcgatcatgatcctgttggttttaggggtcgtgggtgtctcatactactctgtcgttttgaccaattttggccctgctttgtacgatggtggccttgattcccttactgctgttgtcgtcttgat

SEQ ID NO: 21847 - DNA, 428 bp, Gossypium hirsutum
  Clone ID: LIB3272-004-P1-K1-H1
ttttcctcgttcatttttgtctcgctcaaaaaatccaatggcggaaacagatcaggcgccgccgccgtcggaccaactcgccgcgctgaacttgactgacaccgttgagaaacacgcattttctgaccgtgtcctgatccgttccatcgtgggccggccagatggcggggctggccttgctgggcaacgagtccgggccggtggttgggtaaagacagggagagagcaagggaaaggaactttcgccttcttggaattgaatgatgggtcgagcccggcgaacttgcaggtgattgtggacgccggactggctgttctgagcaagctggtggcgaccggcacctgcgtgatggtggatgggatattgaaggtgccacctgaaggcacgaggcagaagattgagcttcgggtcgaaaaagtgtttcttt

SEQ ID NO: 21848 - DNA, 379 bp, Gossypium hirsutum
  Clone ID: LIB3272-004-P1-K1-H11
cttttagtcctctcgatcccaaagcaagctctcgattccgaatctctcccagaagatgcagatctttgtgaaaacccttactggtaaaaccatcacccttgaggtggaaagctccgatactattgataatgtcaaggccaaaatccaagacaaagaaggcattcctccagaccaacagaggcttatttttgccggaaaacaactcgaggatggccgcactcttgtcgactacaacatccaaaaggagtccaccctccacctagtccttcgtctaaggggtggcatgcagatatttgtgaaaacccttacgggcaagaccatcaccctcgaggtggaaagttctgatacgattgataatgtcaaggccaagatccaagac

SEQ ID NO: 21849 - DNA, 401 bp, Gossypium hirsutum
  Clone ID: LIB3272-004-P1-K1-H12
actacttcaatcttagagcgcacagatatgagatgtccgtgattgaaatttatgaccagtctcgggctgacaacaaagacgtttggaagcttgttcttggaaagcacaaccttacttcaccaatttctttattttctcgacctgaggtcataacaaaatcacagtcctacttttttactcattctttgaaagctatagctgtgacatctacggcaaagggtataacttccaagcagcttctccttggtacaattggtgatcaggttttggcacttgataagcgtttcctagatcctcgtcgaacagttaatcctacacaagcagaaaaggaagaagggattataccactaacagattcattacccatcattcctcagtcctacgttacacatgcgctgaga

SEQ ID NO: 21850 - DNA, 413 bp, Gossypium hirsutum
  Clone ID: LIB3272-004-P1-K1-H3
tgagctttggcaacgctgctgttttggcttatgtccgccatgaacgtgctgcttcagttcatcagaggttgttttgtgggtttgatgacatatactgccttttcttagggagcttgaacaatctatttatgctgaatagacagtatggtctttccaaagggagcaatgaggcgatgtttgtgattgaagcatataggacactaagggataggggtccataccctgctgatcaggttgttaaggatcttgaaggaagctttgcctttgtgatctatgacagcaagactggaaccgtgtttgctgcactggggtctgatggtggagtgaagctgtattgggggattgcagctgatggctctgtggtcatatctgatgatttagatgtcattaaagaagggtgtgccaaatccttt

SEQ ID NO: 21851 - DNA, 426 bp, Gossypium hirsutum
  Clone ID: LIB3272-004-P1-K1-H4
aggcaataaagtgaaggaaatggagtcaccattcagagcaaatatactgaaacgcaaagtagctttggtaacaggaggaggctcaggaattggattcgagatctcagtgcagctggggaaacatggagcctcagttgccatcatggggcggcgcaaacatgttctcgactctgctgttgatgttcttcgttcccatggcatccctgccataggacttgagggagatgttagaagagaagatgatgcagctagaactgtggaatcaacttttaagcattttggcaggcttgacatccttgtcaatgccgcagctggcaatttccttgtgcctgctcaggatttatctcccaatggctttcgaacagtcattgatatagattctattggaacttttataatgtgtcatgaggctcccaaatatcttaa

SEQ ID NO: 21852 - DNA, 371 bp, Gossypium hirsutum
  Clone ID: LIB3272-004-P1-K1-H5
gattgaaatttatatatatatatatttgatccaagaacattaaaaaccaatagtgtatactaatgtcaaagcctaaaaatgaaaagggggagaaacggtaataactaatccatagtgtgggggagtgaaatctacacattctttggaacatggtttcatttgctcatttagatacctccattaaagtaatgagcttcttggacgaatcgggaccaataccagtgagatctacagactcggttcatctattctattggaataccctcggactcaggcaagaagttgtccacacagatcgacatttccaccacaaagattgcgaagaacaggaatagcccgaatttgaagtggcaaagcatggataagaacac

SEQ ID NO: 21853 - DNA, 435 bp, Gossypium hirsutum
  Clone ID: LIB3272-004-P1-K1-H6
cccgcgcgtccgaagaaccctaatcctaaaacatctgcagccagatactccattttggtgcctccatgtcttctctacaaacaattcgtcatttcagtgctccggaggatgcccaaatcttctccatgaaatcaacagagaatgccccttcagataagtatttgaacttgtaatttcagatcctagcaacaagatttcgtggatctaaggtttcatggatagaagactaaacccctgcatttccccctgtctccgcagtccgttcctctacaatgaccagaacccagacaagttttactcctatctttaagcccctctttagccaagggtctatcttatgcctagactggtccaaacatcaacagcaaaagggcactccctaaagacatgctcagtgtctcaagacagtcggagcattgtatgcagttagttgag

SEQ ID NO: 21854 - DNA, 424 bp, Gossypium hirsutum
  Clone ID: LIB3272-004-P1-K1-H8
cacaaattgcagctgttggatcctgctgcctggttggtgtcatatgtggtggaaccctctatgttgccaaccttggtgattcacgtgctgttttggggagagctgtgaaggcaacaggagaggttctagccattcagctgtcggctgagcataatgtgtgcatagaatctgtaagacaagagctgcagtcattgcaccctgatgactcacagattgttgttttgaagcacaatgtatggcgtgtaaaaggtcttatacaggtttccagatcaattggtgatgtatatttgaaaaaggccgagttcaacagggagcctttatattcaaaattccgccttcgggaacctttgaaaaggccaatattaagtgcagacccatcaatatcagttcaccaactgcagccacatgatcagtttgtgatatt

SEQ ID NO: 21855 - DNA, 414 bp, Gossypium hirsutum
  Clone ID: LIB3272-004-P1-K1-H9
ctttgatcgcccaggacagggttttcatgccctttatgcaggcggatagctcaacctctagaaattatggtgggactggcataggcctgagcattactaagtgtttggttgagctaatgggtggtcacataagcttcatcagcagaccacaagttggaagcacattctcattcaccacggtctttgggaggtgtaaaagagcttcatttagtgatacaaaaaaacccaatgctgaagatcttccatctggtttcagaggattgaaagctgtggtagttgatggaaaaccagttagagctgctgtaactcgataccacttgaagaggcttggcatgctggttgaatttgcaaatagtgtcaaaatagctgcttctgcttgtggtaaaaatggttcttcatgcggaagtaaaactc

SEQ ID NO: 21856 - DNA, 425 bp, Gossypium hirsutum
  Clone ID: LIB3272-005-P1-K1-A1
gcctaaagcactactccttccagtctcaaaagatgcttcaactctccaatatctcactcaaatcaagcaaagaacccctttagtgcctatcaagttgacccttgatcttggtggtgaatatctctgggtcgattgtgaccaaggctatgtctcatcttcctacaagcctgcccgttgtaactcggctcaatgcaacttggctaggtctaaggcttgcggaagttgcttcgatggtcccaagccaggctgcaacaataatacttgtagtctcctcccatccaacagcgtcaaaaacagtggcaccattggcgaggttgcccaagatgttgtatccatccaatctaccaatggaaagaatcctgggaaagaagttacagtgtctaagtttctcttcacttgcggttcttcttttctcttggacggtc

SEQ ID NO: 21857 - DNA, 406 bp, Gossypium hirsutum
  Clone ID: LIB3272-005-P1-K1-A10
aaccaccccactactaaaaagcccacaccgaccttcactttactatgttaacctaaccggaataagtgtaggccgggttcaagtccccattgccccggaatacctagcgtttaaccccaacaccggggcagggaccataatagattcgggtacggttgtaacccgattcgtccagcccatttacaaggcaatccgagatgagtttgtgaagcatgtgaaaggtccatttactgccattggagtatttgacacatgctttgatgctacagcagaagctgaggcacctttaataacattacatttcgaagccttgtcgatgccattgccaatggaaaacagcttcttacacaccagtgccgggtctcgggcatgcttggccatagcaccggtccccaacaatgtgaac

SEQ ID NO: 21858 - DNA, 419 bp, Gossypium hirsutum
  Clone ID: LIB3272-005-P1-K1-A12
ccgtcttcaaacacttcgaatcgttttccaattactctgacaagatgcaaatgtttgttaaaaccctcactggcaagaccatcaccctcgaggtggagagttcagacaccattgataatgtgaaggctaagatccaagataaggaagggatcccaccggatcagcagaggcttatatttgctggcaaacaacttgaggatggccgcacgctagccgactacaacattcaaaaagaatccacccttcacttggttcttcgacttcgtggcggcatgcaaatctttgtcaagactctcactggaaagacaattaccttggaggttgaaagctctgacacaattgataatgtaaaggcaaagatccaagacaaggaagggatcccaccagatcagcagaggcttatctgtgctggaaagcag

SEQ ID NO: 21859 - DNA, 441 bp, Gossypium hirsutum
  Clone ID: LIB3272-005-P1-K1-A2
gcgccacgcgtccgacctggccaagcggatgaagaaaggggtcgacggcgtggaaggggtagaagcggttctttatcgggttcccgagacgctcccggctgatgtgctggaccatatgaaggtgccgtcgaaaaaccccgaggttccagagattaaagcggcggaattggcgcaggcggatggggttctgtttgggtttccgacgaggtttgggtgtatggcggctcagatgaaggcgtttttcgattccagtggacagttttggaaggagcagactctggccgggaagccagctgggttctttgttagtactggaactcaaggaggcggccaagaggccaccgcttggacggcaataacgcagttggcacaccatggaatgctgtttgttcctattggctacacttttggagctggtatgttcaagatggattccatacg

SEQ ID NO: 21860 - DNA, 418 bp, Gossypium hirsutum
  Clone ID: LIB3272-005-P1-K1-A4
accggaactgtgaaatccctcatgaaggcccattctgcgatctcatgtggagtgatcctgaagatattgaaacatgggcagtcagtccacgtggagcaggttggctatttgggtccagggtcacatctgagttcaaccacataaacaagcttgatcttgtttgtcgagctcaccaacttgtgcaagaaggtcttaagtatatgtttcaagataaaggcctagtaacagtgtggtctgctccgaattattgttaccgttgtgggaatgtagcttctatattgagcttcaatgagaacatggagagagaagtaaagttcttcaccgaaacagaagagaataaccagatgcgagggccgaggactggagttccttacttcttgtaatccaaatgagttgcatactgcagtgcctgtaaaat

SEQ ID NO: 21861 - DNA, 419 bp, Gossypium hirsutum
  Clone ID: LIB3272-005-P1-K1-A5
caattattggagaacgtaactgttattgtggatgcttcagaggctgaggaatttgctgaagtagcttcaaagcctttaagacaacttccatatgattcacccggacagaccttcgtggcatttgaaaagccagagggggtctcagctgttggaaagttttcaaatatgctgaggttcattgtaaaagaggttgatccaagtactggcgaggctgaggatgacggagtagaggacgagtaccaactggaggaccttgaacttgttgcagccgattacatgttgaaggtgggtgtctctaatttcaggaatgcatgggaaagcatgggtgtggactttgaacgtgtaaaatgaatatggccttggcccaagggatagcctagccgaagctgtaaatgctgtcattaatcttctcggcatgc

SEQ ID NO: 21862 - DNA, 383 bp, Gossypium hirsutum
  Clone ID: LIB3272-005-P1-K1-A7
ccgggattcgcgcctcgccccacgcctgcgcgcgtgttttaatagatgttctccccccttttccttttttctctttctttgctattatcaatccttatcttcttcttcatccaaacgaacccattaacacatacttcttttttcccttggatcaaactttgttttgaaatcttctgggttttgcatgaaaatagtgttttcccaataagaatcatctatgacggtggaaactggtggattggtggagcaaagcaaaaataatatcacgacgactgtaaagcatgtaaacaacagggttaggtatggtaacaagacggagaagaagaacagatcatataagaagatgagaagaggaggttgtgtttccaagagttccggatgta

SEQ ID NO: 21863 - DNA, 333 bp, Gossypium hirsutum
  Clone ID: LIB3272-005-P1-K1-A8
gtctatgttgtatcaattgtgatatattagaagctcactctccactactcgatgaacgatattcggaacctccccagccaggcgctatattggtgtggattactgatgtcgaagccaaaatctcccctccctcacctggaacaatcaaacctgaagcagatcttgctcgttgcagatcgaaagctacatcaaagaagaccgacacacttgttcttgtttattcagttctcggaccaccatttactgccaaatgacccaaagcctacaacaaaaaagtcggcactgatcatttgagcgtcgactaataacccatgacatccacgaaagatatga

SEQ ID NO: 21864 - DNA, 430 bp, Gossypium hirsutum
  Clone ID: LIB3272-005-P1-K1-A9
aaactatgacactgttaacaagctctttgaagaaggccgaaccaagatatggcctcctgcatcactagaagagaaggtccagaaccttgtgaagacatgggaaatggaaatgttcaataaaatatccttccctgactacaaatcagtgaaactacagaattatacagtcagcgtgaatgggaggaaacctttgagtttagaagagaagaggaagctgggaggaggctataattcctttatgcaaacctccttaccagaggacctgaggggctataatccagcacaagaaactgaacactcctcacatcttgccttcacaacagctttcccaagaggatttgctttggaagttatccaagtctactctggcccgccatcgattgtgtataagttcaggcactgggggtataaggaaggtcctttcaaaggc

SEQ ID NO: 21865 - DNA, 406 bp, Gossypium hirsutum
  Clone ID: LIB3272-005-P1-K1-B1
tccaaatctctcaaaaccttcattacattccactcactccgaacaacctccctccaccaacatggggaaaacacgtggtatgggagctgggcgcaagctgaggacccaccgcaggcggcagaggtgggctgataaggcatacaagaagtctaaccttggaaatgaatggaagaagccatttgccggttcttcccatgctaaaggaattgtccttgagaagataggtatcgaggctaagcagccaaactctgccatccgaaagtgtgctagagttcaattgatcaaaaacggcaagaagattgctgcttttgttccaaatgatggttgcttaaactacattgaagagaatgatgaggtgttgattgctggatttggacgaaagggtcatgcgggtggtgatattcct

SEQ ID NO: 21866 - DNA, 137 bp, Gossypium hirsutum
  Clone ID: LIB3272-005-P1-K1-B10
ccgtttgaatggatcattgtagtctaggctagtcagcaaacagaatccgtgtcctggggaaaaggaacgactctgaggactggacacagcagtaccagtccaaaaatcttcggctgtctgcgcacgtgtaaagctgc

SEQ ID NO: 21867 - DNA, 411 bp, Gossypium hirsutum
  Clone ID: LIB3272-005-P1-K1-B12
acttgctcaaatagaactgtccaactcaaactagagatatcttgtcattttgggtaattttctctcattcgcattttccaaaacataatcgagctttgaacttgaagatgggtgctgaaaagaatttcattgacatggaggagggaactctggagatcggaatggagtatagaactgtgtccggtgttgctggaccattggtcattcttgacaaagttaagggtccaaagtatcaggagattgtcaatattcgtttgggtgatggaacaactcgacgaggtcaagtcttggaagttgatggagagaaagcagttgtgcaggtttttgaaggaacatctggaattgacaacaaatacacaactgtgcaatttacaggagaggttttgaaaacctctgtgtcattagatatgc

SEQ ID NO: 21868 - DNA, 409 bp, Gossypium hirsutum
  Clone ID: LIB3272-005-P1-K1-B3
ctcgcctgcgagaagaagccgacgccgccatggttcacgtcagtttctaccgcagttatgggaagacatttaagaagccaaggcgtccatacgagaaggaacgtttggatgctgagttgaggcttgtaggagaatatggtctacgatgtaagagggagttgtggagggttcaatatgcttagagtcgaatcagaaatgctgctagggatcttcttactgttgatgagaagaaccctcgtagcattttcgaaggtgaagctcttcttcggaggatgaacaggtttggacttttggatgagagtcacaacaagctcgattatgtcttggcttttaccgttgagaacttccttgaacgccgtttgcaaacacttgtgttcaagactggtatggccaagtcaattcaccatgc

SEQ ID NO: 21869 - DNA, 406 bp, Gossypium hirsutum
  unsure (1)..(406): unsure at all n locations
  Clone ID: LIB3272-005-P1-K1-B4
gaaatgattcttgtttacgagtatatggctaatggaccccttagaagtcatctttatggaacaaatctacctcctctgtcatggaagcaacgacttgaaatatgtattggtgctgctaggggacttcattatcttcacactggtgcagcccaaagcattattcaccgtgatgtgaagacaacaaatattctcttggatgagaattttgtagccaaagtagcagattttggtctttcaaaaactggtccagctttagatcagacacatgtgagtactgctgttaagggtagcttcggttaccttgaccctgaatatttccggaggcagcaacttacagagaagtctgatgtgtattcatttggngttgttctgatggaagttctctgcactaggccagctttaaatc

SEQ ID NO: 21870 - DNA, 391 bp, Gossypium hirsutum
  Clone ID: LIB3272-005-P1-K1-B5
atcaaatcttttgttttagataagaactttgctttaagaccaaatttttatttttggaacacaaataaagggtctttcttttttctcttttttacagtggggttgtgtttgtgtttgtgaatttggagttggtttagaggctgaagaaaagggtactaaagaaaattgggtgtttttgagggagagaaatggaggggaaagtttgtgattttacagtgttctgatagattgaagaaaaggatatccaaaaaagtttgatttttttaatgaaagatcaaaggtgcaagtaagaattgattccaaacccctttctatatctttttcgtttcattttcctagaaattttcagagagaaaatatggcaacgcttgtggagccaccaaatggggtg

SEQ ID NO: 21871 - DNA, 228 bp, Gossypium hirsutum
  unsure (1)..(228): unsure at all n locations
  Clone ID: LIB3272-005-P1-K1-B6
ggtaaatgctctataagctattcattgaagccaatcattcatagggaaaagctatgtggaagtttgtctctcatctcccaaaatttgctgccatgaacctaatgattctcttccttttttcttctctgttcattaaggcattctctttgaaacctgagccagcaaaaaataatgcccagatcactgtcatgggccttgtttattgtgacattngctccaacaacagct

SEQ ID NO: 21872 - DNA, 427 bp, Gossypium hirsutum
  Clone ID: LIB3272-005-P1-K1-B7
gctttcttcaggccttgtcaattttccttttgcttttgttgtatgtagtcgtaggatcagctgagcagtgtggaaggcaagcaggcggtgctctttgccccggtggtctatgttgtagccaatttggctggtgtggcagtactgctgactactgcacagttcctggttgccaaagtcagtgcagcggtagtggccctgcccctgggcctggtgggctaaccaatcttatatcaagagagacctttaatcagatgcttttgcataggaacgatggggcttgtcctgcccgtggcttctatacatatgatgctttcattgctgctgcccgttcttttcctgcatttgctacaactggtgaccaagctactcgcaagagggaaatagctgccttcttagcccaaacttcccatgaaactactggtggggc

SEQ ID NO: 21873 - DNA, 406 bp, Gossypium hirsutum
  Clone ID: LIB3272-005-P1-K1-B8
ccaaattaaaagcttaaaccaacaaaaaaaaaattgaagcttgcacactccaacaatggctaccgaaacagtagagtctttgcctcctacattggaagctaatgctgagcaacctccattgtttgatggaactaccaggttgtatacttcttatccttgcccttttgcacaacgtgtgtggatcaccaggaattataagggattgcaagatgagattaaacttgttcctttgaaccttcaaaatagacctgcttggtacaaggaaaaagtttaccctgtaaacaaggtgccatccttggaacataatggcaaaatcattggggagagtcttgatctgattaaatatgttgatagcaactttgaaggaccttctcttgtaccaaatgatcctgacaagaaaaggacc

SEQ ID NO: 21874 - DNA, 425 bp, Gossypium hirsutum
  Clone ID: LIB3272-005-P1-K1-B9
gaaaatccaggcggcttgctgtcggagttgacggctaacaaaaattcatcccacgcccccccttacgaagatttcgaagctgctcctagaaaacagccacaacaaactcccccaaaacaatatcccgattagagaaaaaaaaaggagggaagatgggcgtgaagcaagctattaaaaatctggatgcgttttcctcgcgcggaggaacatctgctgcagaagacgcaatcgggagcattagtgtccatcgttggtttagtgataatgaccacgctgttctttcacgagcttacctattatctttcgacgtacactgttcatcagatgtctgtagacttgaaacgtggagaaacacttccaattcacattaatatgacatttccttcattaccttgcgatgtattaagtgtagacgccattgacat

SEQ ID NO: 21875 - DNA, 430 bp, Gossypium hirsutum
  Clone ID: LIB3272-005-P1-K1-C1
ctcgtgtgttcctccccaggcagaagccgcttgatacgaacaagttccctctcatagtttattaccatgcaggaggcttcatccactgcagtgcggcatccacgatcttccatgttttttgctcaaacatggcgttggaactccaagccatcgtcgtgtccgtcgactatcgtcttgctcctgagcataggcttcctgctgcttacgacgacgctattgaagcgttgctctggatcaaaaccacccaagaagagtggttgacacaatacgcatatttcaccacttgtttcgttatggggtcgagttcaggtgctaacatagcctaccatgcaggaatacgtgtggcggaagaagccgactgtcttcgaccctggaagatccgagggctaatattgcaccaaccattcttcggcgggtccgtaaaggttga

SEQ ID NO: 21876 - DNA, 241 bp, Gossypium hirsutum
  Clone ID: LIB3272-005-P1-K1-C10
aaccatactcactgaagctcggctgtgattgcgccaaatctcgttggtttgagtataatgaactgaagacactcagaggcgtgaaagaagagggccaggtacgtcacattacgtcgttctgttgttatctactttgctccattagctggtagatgtgtatatgatagagaccgagctcatgtccgtaagctcggcggattttagggctatacgacttacaatggctctaagacagctgttg

SEQ ID NO: 21877 - DNA, 407 bp, Gossypium hirsutum
  Clone ID: LIB3272-005-P1-K1-C12
ctctctttagcactcagttatttggtttcgtctcatacattttcttttttctttttcgcttttttctctttggctgggcccgatctctgccacagccagcgatatcaacagggctgcaactgcttattatattaattcctacccttaagcgccgagctccctactctcaccaaatgctcccttcttttcccttctaataacctctctttgctgcttttcttttggcctttttttttcttttttttttctcttgctggttatggcggaggttttagacgacggtgagttttggctttcgtcccagttcttaaccgacgatgattttttcgccgacggagttaagactaccaacgataccaatagtcttaaagatgggttcgggttagagcttgatggtaacaagtctt

SEQ ID NO: 21878 - DNA, 307 bp, Gossypium hirsutum
  Clone ID: LIB3272-005-P1-K1-C2
aatgctctcaacttcctttcctgactgtctcgagacacttcttcctcttttctgttcataaacacttaccctctgttgcaacccataatcgtcgagatgacctgcagagtcaccagcttaagccctgggagggctagtctcctttggaagatgcgcggctttttgaccaacaagcgtagtcctaagaagcttgggtgtaggcacaagagatcgggttgcgcgccaactaaaatgcccgatggtgctgagactctcgacactgagaggaaaagttgcccgttctttgcagcggtatgggtgaggatcc

SEQ ID NO: 21879 - DNA, 415 bp, Gossypium hirsutum
  Clone ID: LIB3272-005-P1-K1-C4
agaaaagcagcgtaatgggtgaagaagtgaaggtttttggatactgggcaagcccttacagctacagggcagagcttgctttgaagttgaaaggtgtttcttatgagtacataaatgaggatatctttggcaacaagagcgatttgcttttgaaatacaatccggttcataagaaagtcccggttcttcttcacaacgggaaaccaattgtagagtctcttgttatacttgaatacattgaggaaacttggaagcataatccctatttgccacaagatccttatgacaaagctaccgctcgattctggatcaagttcatcgacgaaaagtgctttcctaccctttggctagctgcatggagcgccgagaatgagcgagaaaaagtgacgaatgaagcttgcgagtatctgaaaac

SEQ ID NO: 21880 - DNA, 423 bp, Gossypium hirsutum
  Clone ID: LIB3272-005-P1-K1-C5
ctcactcaacattcccatttccaatctccagctcccaaggtaaatatgccgatcagaaacatagcagttggccggcccgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaggtggccacgtcaaccccgccgtcaccttcggtgctttcgttggcgggaacatcactctcttgcgcggcattctttactggatcgcccaactcctaggctcaaccgtcgcttgcctgttgcttaagttcgctaccggc

SEQ ID NO: 21881 - DNA, 422 bp, Gossypium hirsutum
  Clone ID: LIB3272-005-P1-K1-C6
ggaacatgggcagctcatccaggtctcatcaaaacatgcatggaagttttcaccaacaccatggggaactctccgaaccaaatcgaaactgtcaagcgcgaagacgcttccaacttaactgaagacgatttattacaaaggcctcgaggtgttcgtacgatggaaggccttcgtttgaacactcgtgtcgggatccaatacttagcagcttggttaaccggttcgggttcggtcccgctttataacctaatggaagatgctgcgacagccgagatcagtagggttcaaatctggcagtggttgaaatatggtgttgaattagacggtgatggacttggggttcgagtgaaccatgtgttccgggcgagtggttgaagaagaaatggctcggatcgaacgtgaggtcggaaaagagaagttta

SEQ ID NO: 21882 - DNA, 424 bp, Gossypium hirsutum
  Clone ID: LIB3272-005-P1-K1-C7
ggagcaaaaagattgtgggggtgttttacaaggccaatgagtactttacgaagaatcccaactttgttggttgtgtggagggagccttggggttgcgccaatggctcgaatcacaggggcatcagtatatcgttaccgacgacaaagaaggaccggactgcgaacttgaaaagcatatccctgatctccatgtgctcatatcgaccccattccacccggcttacgttacggctgagaggatcaagaaagccaaaaacttgcaactgcttctcacagcagggattggctccgatcatgttgatcttaaggcagctgcagaagctggtttgactgttgctgaagttactgggagcaatgttgtctcggttgctgaggatgagctaatgagaattcttattcttgttcggaattttgtacctggtta

SEQ ID NO: 21883 - DNA, 426 bp, Gossypium hirsutum
  Clone ID: LIB3272-005-P1-K1-C8
gaaaagagctggctttcggactttggggtgttgatagtttggttgaagaaagtgaaaacactgaagcagaaagctttttactttggggaatttttcccttgttgaatttgggtattgaaagttttcaagttatagtacaaggcttgagatttttgcttttagctctttggccaatgcaaactttatgttcttgtgaaaacgggatagaggtcagaacgatgatggaaaacaaaaggagcccttgctctgttgatcatagcagtttcactcctttggcgtcgaagcgacagaagtccgacttattgatctcgacaaaggataggaaagataaggtcggtgaacgcattgtcactctgcagcagctagtttcgccatacgggaagacagatacagcttctgtcctcctgcaggcaatggagtacatac

SEQ ID NO: 21884 - DNA, 425 bp, Gossypium hirsutum
  Clone ID: LIB3272-005-P1-K1-C9
ctcgaaggctaggtatgatgaaattgtgaaggaagtctcttcctacttgaagaaggtgggatacaaccctgacaagattccatttgttcccatttctggttttgagggtgacaacatgattgagaggtctaccaacttggactggtacaagggccctactcttcttgaggctcttgaccagatcaacgagcccaagaggccttcagacaagcctctccgtctcccacttcaggatgtgtacaagattggtggtattggaactgttccagtcggccgtgttgaaaccggtgtcttgaagcctggtatggttgtgacctttggcccgtctggtctgacaactgaagttaagtcagttgagatgcaccatgaagctcttacagaagcactttccggtgataatgttgggttcaatgttaaaaacgttg

SEQ ID NO: 21885 - DNA, 121 bp, Gossypium hirsutum
  Clone ID: LIB3272-005-P1-K1-D1
tttcgtctttctacagattgaaaagaggcggctgggttcaccctgctggcatggactgatgggaagctgtttgtgtgatgtctccagctgtttccattgtgcgcccaccactgtgtaggtg

SEQ ID NO: 21886 - DNA, 317 bp, Gossypium hirsutum
  Clone ID: LIB3272-005-P1-K1-D11
cgaaatgaataccaatactgttaacggttttactactccggaatggacgcacagcacgggccgtttttatacccaaggcgcttagccgccgatccgggcggaagacttgcaggaaggagtttggtccgcacacatctttaaaagatacaaaggtatctaagatagctcatcggtcagacatctccgcgaacatagggtgaaagctcattcgatttcatgcagctcaatcgaccggaaagctgcctataatcatttagaccttgctattgaatctagaggcgtagactagtaccacaggtgactgcttgatgcagcca

SEQ ID NO: 21887 - DNA, 228 bp, Gossypium hirsutum
  Clone ID: LIB3272-005-P1-K1-D2
gatatgatcaatgaagttgatgctgatggaaatgggaccattgattttcctgaattccttaacctaatggcaaggaagatgaaggatactgattccgaggaagaacttaaagaggctttcagggtgtttgacaaggaccagaatggtttcatatctgctgctgagcttcgccatgtcatgacaaatctcggtgagaagcttacagatgaagaagttgatgagatgatc

SEQ ID NO: 21888 - DNA, 420 bp, Gossypium hirsutum
  Clone ID: LIB3272-005-P1-K1-D3
acggatctcatgagcaccattcaacgcgaccctccttattgctgcttggctttttggtgtggcccatgtgtatcctacatgctccggaaacgagctctttataatgacatgtcaaggtatacatgttgtgctggttatatgccatgcagtggtaggtgtggtgaaagtaaatgtcccgagttttgcctttgcactgaggttttcctctgctgttgtaactccgtggcttcaacccggtttctgctgcaagatgaattcaacattcaaacaacaaaatgtgacaactgcatcattggtttcatgttttgcctgcaacaagttgcctgcatattttccatagttgcaatgattgttggaagtgatgagcttcaagatgctgcacaggtgctgaactgtttggctgatatggtttattgcacg

SEQ ID NO: 21889 - DNA, 259 bp, Gossypium hirsutum
  Clone ID: LIB3272-005-P1-K1-D4
ggaatgaattatttgcatgagaataaaccaccaataattcatcgtgatcttgagccttcaaacattttgcgggatgactctggacatctgaaagtcgcagattttggtgttagcaagctgctcacagttaaagaagttaaacctctaacatgtccagtgacatcttgtcgatatgttgccccagaggttttcaaaaattatgactatgataccaaagcggatgtgttttcatttgccctgattctacaggagatgattg

SEQ ID NO: 21890 - DNA, 426 bp, Gossypium hirsutum
  Clone ID: LIB3272-005-P1-K1-D5
aagagatataattgaaagaaaagaaaaatggttctgctagagaaactttgggatgatgtagtggccggacctcaaccggaacgtggccttggccggctgaggaagatcacaaccaccccacccttgtccaccaaagatgaggcttcatcaatggcgatgccgacgagtccgacgacacctgggacaccgtcgacgccggtgtcggctcgtagggacaacgtgtggaggagcgtgttcaatccaggtagcaaccttgcaaccaaaggtattggcgctgaagttttcgacaagcctcaacctaactctcctactgtttatgactggctttacagcggtgagacccggagcaagcatcaccgctgattgggcgatggctgacggcggcggagggtagcataaccactagcagagggtgctgctactgaa

SEQ ID NO: 21891 - DNA, 421 bp, Gossypium hirsutum
  Clone ID: LIB3272-005-P1-K1-D6
ctcttccaactctcttaaaactcaataaattttcttcttctttttttgttttttgttgtatttgtattctctcatcaatatcctttgcatgtttctaccaatgtcttctctcaaaacccttgctttcctttcaatctttcttcttttgcatcttaagattgccaaaactgactttctatccccacttttatcacccttatttgatgatgtatgcaaagaagtggaatgtggcagaggaaaatgcaagccatctattaatggaacattgcctttttatatatgtgaatgtgatcctggttggaagcaaaccttttctgataaagatgatcatgctcatctcaagttcctcccttgcattgttcccaattgttcgatgaacaatgtttgttcggcagctccatccccggcgcaagagaaggca

SEQ ID NO: 21892 - DNA, 421 bp, Gossypium hirsutum
  Clone ID: LIB3272-005-P1-K1-D8
gaaagatccacccacttcttgcagtgctggtccagtagctgaagacatgtttcattggcaagcaacaatcatgggaccctcagatagcccttatgctggaggtctgtttttagttactatccatttccctccagattatcctttcaagcctcctaaggtcgcgtttaggaccaaggtcttccatcccaacatcaacagcaatggaagcatttgtcttgatatcctcaaagaacaatggagccctgcactaaccatttccaaggttctgctctcaatctgctcgttgctgaccgatccaaaccctgatgaccctcttgttccgtagattgctcacatgtataagactgatcgggcaaagtatgaagccactgctcgtagctggacccagaagtatgccatgggatgacaagtgttggtgtgt

SEQ ID NO: 21893 - DNA, 343 bp, Gossypium hirsutum
  Clone ID: LIB3272-005-P1-K1-D9
ggttcacggtcattgcactttgttttctcttttgtgaatgattatggaagcctatccgatagcaattcctgtgcgagcttctaaatgatatctggttattagtgttgaacgactacacgataattgaccgaaacgattgaaatttctaccactcattcttgaaccattgctttatcaatatttgaggttaaactgcctgtacacaatagtgacatttaattactatgtagggtacatcatgcagaagagcacgactacgcatcgtaataagacagatgcaatccatctgtatttactattaaatatgctcatggggcttgcgtaccacgttggactaataact

SEQ ID NO: 21894 - DNA, 180 bp, Gossypium hirsutum
  Clone ID: LIB3272-005-P1-K1-E1
ctccagcttgtgcttcgtctcaggggtggcatgcaaatatttgtcaaaaccctgactggcaagacaatcacccttgaagtggaaagctccgacacaattgataatatcaaggccaatatccaagacatagaaggtatccctccagaccaacaaaggcttatctttgctggtattcaactg

SEQ ID NO: 21895 - DNA, 422 bp, Gossypium hirsutum
  Clone ID: LIB3272-005-P1-K1-E10
gggacaacaacaggcagctcttcttccttttctgcgtctcatcatcaaaccccaaactcttaactagcctcttcctcctcctctttactttaatttcattttgctttcacaaatctaagaccagagctccaaaagattgaatttttaacccctcaaattaaaatccttcctttttcgcgttttcggttgaaaatttgtataaaaaagagggtgatttagaaacaatggatgctgattcatggagtgctcgtctttcttcagcttctaagagatatcaatcggctcttcaattacgatctgatatgcttatggggtttgaagaaattgatggagaagatgaaataagagaggagtttcgatgccctttttgttcagagtatttcgacatcgttggcttgtgttgtcacattgatgatgagcat

SEQ ID NO: 21896 - DNA, 424 bp, Gossypium hirsutum
  Clone ID: LIB3272-005-P1-K1-E11
tcttggtgggttttgagtgtaaatggtgctaatttaccaccatgtcaattccctgctatttacaactttggtgactcaaactcagacactggtgggatttcagctgcttttgaacccattagagctccatatggtgtgccctattttcacaaaccatctggtagagactctgatggtcgcctcatcattgacttcatagctgagagacttaagttgccatatcttcatgcatatttgaattccttgggagcaaatttcaggcatggagcaaatttcgctactggtggatcaaccataagaagaccgaatgaaaccatttatgaatatgggataagtccatttggtttagatatgcagattatacaattcgaacagttcaaggcaagggctactgaaatgtataatcaagctaaagatccttctg

SEQ ID NO: 21897 - DNA, 426 bp, Gossypium hirsutum
  Clone ID: LIB3272-005-P1-K1-E12
aaagttttcttttataatctttctattctctgaccaaagatcatataaaatctcacaattttccagcaatcgctaaaaaataataaaaatctcaaatccgatcccatggcttctcgtcggcgtatgctgttaaaggttataattctcggtgatagcggggttgggaaaacatctctcatgaatcagtatgttaatcgtaagttcagtaatcagtacaaagctacgattggagccgattttttgacaaaagaggttcagtttgatgatagattgtttacattgcagatatgggatactgctgggcaggaaaggtttcaaagtttaggtgtggctttctatcggggtgctgattgctgtgtacttgtgcatgatgttaatgtcatgaagtcctttgataatcttaacaactggcgagaagagtttctg

SEQ ID NO: 21898 - DNA, 424 bp, Gossypium hirsutum
  Clone ID: LIB3272-005-P1-K1-E2
agcaaaccctaaccctaaactttcttttcttcatctttttttttcctctcaatcgcgataatgtctcacttcggaaggtcaggcccgcccgacatcaccgacacctactcccttctcgtcctcaacattaccttccgcacgactgctgatgatttgtttccgctcttcgacaagtacgggaaggtcgtcgacatcttcattcccaaagatcgaaggactggtgattctcgaggctttgcatttgtgcgctacaagtatgccgatgaggctcagaaagctgtagataggctcgatgggagagttgttgatggtcgggagataactgttcagtttgcaaaatatgggcctaatgcagagagaattcagaaaggaaggattattgaatcatttccaaagtcaaggagccgcagtcctcgcagaaggc

SEQ ID NO: 21899 - DNA, 412 bp, Gossypium hirsutum
  unsure (1)..(412): unsure at all n locations
  Clone ID: LIB3272-005-P1-K1-E3
agtgtatgggttttatgatgagtgcctaaggaagtacggcagtgccaacgtttggaagatcttcactgatctgtttgattattttccactaacagcattggttgaatctgaaattttctgtctccatggtgggttatctccatccattgaaacactggataacatacgtaactttgaccgtgttcaagaagttcctcatgagggtcctatgtgcgatcttttgtggtctgaccctgatgatcggtgtggatggggcatttcacctaggggtgccggatatacctttggccaagacatatccgagcaatttaaccatacaaacagtttgaagctgattgctagggctcatcagctggtcatggaaggatacaattggggtcatgaacatnaagttgttactatattcagtgcg

SEQ ID NO: 21900 - DNA, 403 bp, Gossypium hirsutum
  Clone ID: LIB3272-005-P1-K1-E4
atttgaagccacctgcctgcccctttctcaattcgccggaatgaagctcatcatcaaaaccctaaaaggcagtcactttgaattagggttcagcccaatgataccgttatggctgtgaagaaaaacatagaggatatacaagggaaagacaattatccatgtgggcaacagctgttgattcataatgggaaggttttgaaagatgaaactactttagctgaaaataaagtatctgaggatggttttctggttgtcatgcttagcaagagcaagtctctgggttcaactggagcctgttctgctcagcctgcttcatcaactccatctaccactgttgctgcttctgcgccttcttcaaattctacacctgccacaggagctcctgcacaagcatctcaacaaa

SEQ ID NO: 21901 - DNA, 416 bp, Gossypium hirsutum
  Clone ID: LIB3272-005-P1-K1-E5
tttaaaaaaaaaagaaaatcctctgaaagaggaatggggaaggggctttcagcgctccgttgagcttccgtctccgacctttcacgcgcccacgcgccgccaaatacggtggctcagaaggctaaaaaccttcgttattctgggtaaaacacaggttaatggcgcaatcttcggcggtgggtcatgatccatgcgccgattgcggcgtggcatgggaactggaaccacagcgctgatggtggctactagaacggcgtgattcgaaaaggcgcgtctttcgggatgattgcggcgcctagggtttctgaaaccctaggcttctctttattctgctaatatcttgagccgtttgggctctgtgtactttgggttgagggtgtaaatgggtctgctgggtggttgggtttactgggtta

SEQ ID NO: 21902 - DNA, 424 bp, Gossypium hirsutum
  Clone ID: LIB3272-005-P1-K1-E7
ttaacacattggaggatggtttcggcagaacatgactccagcagtaattgccagcgttgaaacaatgctagacaagtggcaagagaaagaaggagaagagatcgaagcgttccaaggatttagattgttgacttcagaagtcatatcaagaacagcttttggtagcagttacttggaaggagagaagatcttttacatgttgcagaagctcgcagatattgtgagccgcaatacaaacaagtctaggattccaatcctcagcaagttttggaaaactgacgatgacatagagtcagaaaaacttgctagagaaatacaagatttggtgatagagattgtgaagaaaagagaaaacaaagttgcgagtggaggagcagagagcttcggctgtgattttctgggattattagtaaaagcgtttaat

SEQ ID NO: 21903 - DNA, 420 bp, Gossypium hirsutum
  Clone ID: LIB3272-005-P1-K1-E8
tattcttcacaaaaaagaaaagaaaaaatacagtgaaaatggcaacccttaaagttccagctcatgtacctgccccttctgaggatgctgagcaacttcgtaaagcttttgaaggatggggtacaaatgagcaattgattatcgacatattggctcacaggaatgcagctcagcgcaatttgattcgtaaaacttatcgtgaagcttatggggaagatctccttaagtctttggatgaggaactttcaagtgactttgagcgagctgtggtgctgtttactttggaccctgcagagcgtgatgcatttctggctcatgaagctacaaagaggttcacatcaagccattgggttctcatggaaattgcttgcactaagtcttcacatgaactgttcaatgtgaggaaggcgtatcacgatc

SEQ ID NO: 21904 - DNA, 416 bp, Gossypium hirsutum
  Clone ID: LIB3272-005-P1-K1-E9
ctgtaatccaagcttctattcagttttgtaagagctatggctaaggacattgaggttggtggtgagttccaggccaaggactaccatgatcctccacccgctccattggtcgacgctcaggagttagccaagtggtctttttacagggctgtcatagctgagttcattgccactctcctctttctctacatcactgtcttgactgtgatcggttacaagacccagaccgaccctgctaagggcggtgaagattgtggcggcgttggcattctcggcattgcttgggcttttggtggcatgatctttatccttgtttactgcactgccggtatctctgggggacacatcaacccagcagtaacctttggacttttcttggctaggaaggtgtcgttggttcgagccatattttacat

SEQ ID NO: 21905 - DNA, 402 bp, Gossypium hirsutum
  Clone ID: LIB3272-005-P1-K1-F1
aaaaaaaacactacttgtctgagatatttaggccaactcaaaacaaaatgtcacatccactgctgcaaaggatgcttataaaccaaggaaataaacactctgcctgacaacatatatgaaacattcaacgcttcttagagacacctacagtctttcctctgcgaccagtggtcttggtgtgctgaccacggacacgaagaccccaatagtgcctcagcccacggtggttcctgatcttcttcaatcgctccaagtcatctctcaacttcatgtcgagagcattagacacaacttggcctccgctgtttattcggttcaactcatcactttccataaacctttcctgctccctcaccaaatcaaaatgtctctgggggcgaacgaagactttcagcacatttt

SEQ ID NO: 21906 - DNA, 423 bp, Gossypium hirsutum
  Clone ID: LIB3272-005-P1-K1-F10
tgttttctctctcacgcacgaaaacagaggaaaaaaatatgtcactctccttgcaatcttcgccttcatcatttctctcttcttctctaccaaaattaagattgggatttgcaaatgggtgtccttcttccagcctactcttcaaattcaacgcatcttttccagctattcgtgcttcctcgggcttctcttcttctctcgacactgggttaagaactgaattggatgctgtgtctactttcagtgagatagttcctgacactgtcatctttgatgattttgaaaagtttccaccaacagctgcaactgttagctcttcactgctgttgggtatattgagccttccagataccatttttagaaatgctgtggatttggccctggcggattcaacttgttctaggcttgacaatcctgaactga

SEQ ID NO: 21907 - DNA, 427 bp, Gossypium hirsutum
  Clone ID: LIB3272-005-P1-K1-F11
tcccagtgtaggtgatctcctatcgcactacaccattatatgatgtacataatatctcttctgaaatcaatgactgggacctcaagttcatgtttcttcaagaaactggatttgcttcgctccaagaactgcatcaagaaactggatttgcttcgctccaagaactgcatcaagaaactggatttgcttcgctccaagaactgcatcatcgtttgcaaatgtcatgctctgccagtttcttttgaacataacaggatctgatgaatggataatcaagacggatcagtaaccttaggaagatcatgctggtgcatgatatgctaaggaatttcggtcgaaaatttttatcgttttcagtaaccaaatccggcttgactgactaatttttagggtgatttttgatgttgtccagcagcattccaagttg

SEQ ID NO: 21908 - DNA, 421 bp, Gossypium hirsutum
  Clone ID: LIB3272-005-P1-K1-F12
cactctcccaccccgaccgcttgattttgatcagacggtaatcatgccgatcagaaacatagccgttggccggcctgaagaagctactcatccagatgctcttaaagcagctttagctgagttcatatcaacgttaatcttcgtttttgctggatctggttcaggcatggcttttaataagctgaccgacggcggtgcaacaactccggctggtctcgttgccgcctctctagctcacggatttgcgcttttcgtcgctgtctcagtcggtgctaacatctccggtggccatgtgaatcccgccgttacattcggtgctttcgttggcgggaacattactcttttacgtggtatcctttattggattgctcaactccttggctcaaccgtcgcttgcctgttacttaagttcgccactagt

SEQ ID NO: 21909 - DNA, 421 bp, Gossypium hirsutum
  unsure (1)..(421): unsure at all n locations
  Clone ID: LIB3272-005-P1-K1-F2
atttatttcactacccaacaccccaaaagataaaaggaatcgtttacttgttcgtagcaatttatcgtcatttcaagctcaattctctgaaaatttttgtgctgaacttcttttttctctttgtaccaccatgtgtggaggtgctattatctccgatttcataccgccgtcgcggtcgcgacgattgacggccgatttcttgtggcccgatctgaaaaaatccgggttgaagaaggggtcgggtaagagatactcgaagcccgtgatcgacttgggcgatgatttcgagactgactntcaggagttcaaagatgaagaatctgatatagatgattatgatgttgatgatgttttggctgatgtaaagccctttgcttttaacgctacaaagaaacctgcttctgctgtatctcatggttcg

SEQ ID NO: 21910 - DNA, 325 bp, Gossypium hirsutum
  Clone ID: LIB3272-005-P1-K1-F3
ctttaaggtatgagacgattgttccttcaaaaaccatatacggatccatatatggacgagaaagcaatcgagtcctttcaatgctgagctcagaagaagacggcggtcgccgcaacgcactgcaagaggggccgagctttgatcaaaaccaacgcctgccccattgagctagtcgagcccagaatactccattttaaggccggcgagccaattattctaatctgtcgatagcgtaccaactgcgttgacacgaggatccgtgtcaaaggtggaggtgacactttttcagatcttcactctccgccaaagcatgtatgaagccctt

SEQ ID NO: 21911 - DNA, 418 bp, Gossypium hirsutum
  unsure (1)..(418): unsure at all n locations
  Clone ID: LIB3272-005-P1-K1-F5
gagaatttgaagaacaagaatggattctgccatagctcagaaaacatgggaattagaaaacaatatacttaccgtcgagacacctgacccttcatcggattctatattctactacgacgaggcggctcaagccaagttccagcaagagaagccttgggccaatgatcctcactacttcaagcgcgttaagatctctgcgctcgctcttcttaagatggttgtccacgcccgatctggtggtaccatagaggtgatggggctgatgcaaggcaagactgacggcgatgctatcattgtcatggacgcctttgctttgcctgttgaaggcactgagactagggttaacgctcaggcggatgcctatgagtatatggtcgattattcccagaccaacaagcangctgggcgattggaaaat

SEQ ID NO: 21912 - DNA, 428 bp, Gossypium hirsutum
  Clone ID: LIB3272-005-P1-K1-F6
ttcaaagcaaaaatcccagcatcatccatagctgtaagaaaatttgaaaaaaaaaaaaaccagacatggaagccactgctgtttatagcagcaaaggaagtccatttcttttttcctctaggattacaactaaaaaatcatttaaatcatcacaaaatgctgcaactttctcaccttttctcattcaatccatggctactcagaaaccattgccttcagttgccaaaactgttggttctagaaagggctcgaactcgaccgtttttccgctcggcgagccagggccaaggaacagcacagtggtgacacaaccagtgaagctactgacaaatgtagagaaactgaaactgctaaccaaagcagagaaagcagggctactatccgcggcagagaagttcgggttatcgttatcgtccatagagaaactc

SEQ ID NO: 21913 - DNA, 418 bp, Gossypium hirsutum
  Clone ID: LIB3272-005-P1-K1-F7
gccacgagaagcgacttttggacctcaatctctgtctttgtgtttctctgttttgtattattttttcctttgtgtcatcaatggcgagcagatactgggtggtgtctcttccggttcagaactcagcctccacttggaataacttacaggatcaaatctccaagcattccttcgacactcctctctaccgattcaatatacccaatctccgtgttggaactcttgattccctacttgctctcagtgatgatctcttgaaatccaatacctttatcgaaggagtttcccacaagatcaggaggcagatcgaggaactggagagggcatctggcttggaaaccaatgctctcactgttgatggagtgcccgttgattcttatctaaccaggtttgtttgggatgaagcaaagtacccaac

SEQ ID NO: 21914 - DNA, 417 bp, Gossypium hirsutum
  Clone ID: LIB3272-005-P1-K1-F8
aaagatgctaaggaacgtacagcctctatgcgtaaacttttgatggcagtagtgctttgtgttgtctttatgagcgtagaagtggttggaggcattaaagccaacagccttgcaatcctaactgatgcagctcatctcttgtcagatgttgcagcatttgcaatctccttgttctccctttgggcatcggggtgggaggcaactccgcgtcaatcttatggattcttcaggattgaaattcttggtgcccttgtgtccatccagatgatatggcttctagctggcatccttgtttatgaagccatagctagacttatccatgatactggtgaagttcgaggctttctcatgtttgcagtttctgcatttggtctagttgttaatattgctatggctctcctgttgggtcacgaccat

SEQ ID NO: 21915 - DNA, 424 bp, Gossypium hirsutum
  Clone ID: LIB3272-005-P1-K1-G1
gttcgtgcatttttcgcctgcaatttttgaaagcagtaatcggtcttcttctctttgttccctaaactaaacttttcttcgttggctgttttgagaagttttggtttctgatgtctccaccactgctgggcgtggaggaggaagtgcagagtagtgtttcttctccctctgttgaatgtatctccgagaatggcatggggttaaaggagcgtaattatcttggattatcagattgttcttcagttgacagcctccggtgtctcgaggtaatctgaatttgaaggctacggagcttaggcttggtcttcctggatcacaatcccctgagagagaaacagagctttgcttgttgaacttgggaaaacttgacgagaagccactatttcctctactcccttccaaagatggaatctgctcatcatct

SEQ ID NO: 21916 - DNA, 421 bp, Gossypium hirsutum
  Clone ID: LIB3272-005-P1-K1-G10
gtaatgttgagcaaaggcttggcacaaagggcgctaatgaaattaaggctcacccatggtttaaaggtattgaatgggacaaattgtatcaaatgaaagctgcatttattcctgaagtcaatgacgagttggacacgcaaaatttcgagaagtttgaggaggctgacaaccaaattccatctgccacaaaatcaggtccttggagaaagatgctttcatccaaggatgtaaactttgtcggttacacatacaagaactttgaaattgtagatgacaatcaattacctggcattgcggagttgaagaagaagagctcaaagcccaagagaccctccatcaaatccctttttgaggacgagtccgctgcagctgccagtcaacctgttcaagggagtttcataaacctcttgccaccgcaaca

SEQ ID NO: 21917 - DNA, 420 bp, Gossypium hirsutum
  Clone ID: LIB3272-005-P1-K1-G11
ggtggcttgtgttgtgagtgttcgtttttgctgcaggcttcattgagatgtttgtttattgcatcaatctacggttggtactgcatctgggaaggttagacatgttaacggtgggcaatcgaattatatggattctaaatccatgcaggcatgtttctatctgtgaaatctgctccagaagagtagttgcatactgaaagaagttagttcagaggacgtggaggatccgagggaaacaggaactacaaattttattatggatctctcaaggtcgtaatatgcctacccctaaacatgattcaccctcttattggttactaattatggtgtagacggttcaatagtcaaaactgttgatgaatttattcctatttgtggttgcaccttttatagcctctttaattcaaccctcttattaca

SEQ ID NO: 21918 - DNA, 227 bp, Gossypium hirsutum
  Clone ID: LIB3272-005-P1-K1-G12
gaaaattgccagaggagtacatagtgtgcttttcaaaacacttaacactgacaggtggctgatgcataaaacggagtttgcttcacacttcacaggattgaagaaagatggggcacaatggtgggtcgataacacagacatcaaactttgtggacttgattacctatcaacttgtgcttatgttgatgctgccacaactcatcatatatttgtaatgaagagggaaa

SEQ ID NO: 21919 - DNA, 408 bp, Gossypium hirsutum
  unsure (1)..(408): unsure at all n locations
  Clone ID: LIB3272-005-P1-K1-G2
gacactactagacttgtagaaatgcaagggctcgtcttgttgccggtcctcctttgcgccacctaccatatcgctctttccgcgaccaacgttacggtggcggacgggctgttagataatggtaactttgagcaagccccgaatgcctcatacatgaagggcacggttgttgtggtgcgttatgcaataccaggatgggtaaacgaagggtttgtggaatacataatagtccggcaaaagcaagggacatgttgctggtggtgcctgagggagcctatgcagtcaggttggggaacgaggcttcaatcaagcangagataaaggtggccgaaagggatgtattactccatcaccttcagtgctgcccgtacttgtgctcaagaggagcgtttgaacgtgacggtagca

SEQ ID NO: 21920 - DNA, 339 bp, Gossypium hirsutum
  Clone ID: LIB3272-005-P1-K1-G3
atggattaaggtgtcaagaaaagagaacatgagttctgttaccgtatcttcgactggattacttcacatggctgatgtcgagtgccataccaagcgatctaaatcaactttcggctcataccttctgcctcctgctcgatgacatcacatgattgatcacactgcttgtgtcctgatcggctgcggcatacatcccggatatgtaatgggtcttactttgcgaaacaccggggagcttgcaatcatgatactgtctaaagtccggggacagaccaccgtcgatcacctgaacgtaacttattctgaccaggaatttgacttgtacgttactgattcaga

SEQ ID NO: 21921 - DNA, 422 bp, Gossypium hirsutum
  unsure (1)..(422): unsure at all n locations
  Clone ID: LIB3272-005-P1-K1-G4
ataaaggatgagtacactggatgcaactagagcagaacttgctcttgtagttttgtatttgaataaggctgaagcaagggataagatatgcagggctatacaatatggctcgaaattcctaagtgatgggcagcctggcacagcacaaaatgttgacaaatcaaccagcttggcacggaaagttttccgtctttttaagtttgtgaacgatttgcatggtcttattagcccagttcctcaaggaactccccttccacttgttctgctaggaaagtcaaagaatgcactgttgtcaactttcttatttctcgatcaatttgtgtggctnggcagaacaggcatctataaaaacaaagaacgtgctgagttgattggacgaatatcccttttcttgtggatgggatcatcaatatgtaccacat

SEQ ID NO: 21922 - DNA, 309 bp, Gossypium hirsutum
  unsure (1)..(309): unsure at all n locations
  Clone ID: LIB3272-005-P1-K1-G5
ttccttttgcacgcgctctgttgatatatcggctctggacgagaagccgccgccgacatggttcacgtgagcttgtaccgcagttatgggaagacctttaagaagcctaggcgtncatatgaaaaggaacgattggatgcatagttgagacttggaggagagtatggactcctatgtaagagggagttgtggagggttcaacatgctgagagccgtatccgaaatgctgctagggatcttctcactcttgatgagaagaaccctcggcgtattgccgaaggcgaagcactctttcgtaggatgaatagg

SEQ ID NO: 21923 - DNA, 240 bp, Gossypium hirsutum
  unsure (1)..(240): unsure at all n locations
  Clone ID: LIB3272-005-P1-K1-G6
caaaaacagtgttcatcgcatctaactgtttgaaacctgttcaattcagataaagctaaagcattattcgagcctcttaaatggggaacgaaactgttcctaccatccactcactctttctttcgcatttttgactcgtccgcgcttggggtcgtatccacccggtcccctgctgtgctaactatngctcgcgtttactatggggtaaaagagtcgagcgttaagtctctactctggtcc

SEQ ID NO: 21924 - DNA, 420 bp, Gossypium hirsutum
  Clone ID: LIB3272-005-P1-K1-G7
caaatagacttgagaaagaaaaacagtctcaaaatgcagcagaagtcaggcttcctcatcctcttcctctccctcattttccttcctctcatcttctccgacgccagaaaggaggctcccctcggaggttggaggccgatcaaagacaccaaggacccacacgtgatggagatcgcggaattcgccgtcgaggagtataacaagcagtcaaatgggagtttaaagttggataaggtggtgaaaggcgagactcaggtggtggccgggacaaattaccggctgattttgcaggcgaagaaaggggcagtcgataacacgtatcaggctgtggtgtgggagaagttgtggctgaatctcaggaatctcacctcctttaacctcgtcaagggttagattggattataatgtaatttatgttca

SEQ ID NO: 21925 - DNA, 413 bp, Gossypium hirsutum
  Clone ID: LIB3272-005-P1-K1-G8
ggaaaatcatgggtgccaaagttcttttcttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgttctgtctgctagggaaggcatc

SEQ ID NO: 21926 - DNA, 417 bp, Gossypium hirsutum
  Clone ID: LIB3272-005-P1-K1-G9
ggagtggggagtattttacccgggtcggagtcggtaacccggctaaacaattctacatggttcttgataccgggagtgatgttaattggatccaatgtgaaccatgtacggattgttaccaacaatccgacccgatttttgacccgtcggcgtcgtcgacttacagtccggttacttgcgagtcaaggcaatgttctcttctacgacaatcggcttgtcgtggcgggaaatgtctttaccaggtgtcctacggtgatggatcttacacagtaggggatttcgtgactgaaacggtgtcgtttgggaactccggtgatatcaaaggcgttgctatgggttgtggccataccaacgaaggcttatttgttgcagctgccggtttggttggactcggtggtggtcccttgtctttaacat

SEQ ID NO: 21927 - DNA, 399 bp, Gossypium hirsutum
  Clone ID: LIB3272-005-P1-K1-H1
ggaaaaatcaaggccaacgaagtccctggtctgccgggtgggtgatatcgatggcaccacgtccatgaactcgtagttcccggcggttagaccaccagaagaaccccacttggtcttgcagatcgctgcattgtagccgacctggcgaagattagccattactttacgcctgaaaatagctttatccgtcttgaaaaacgaaagcatttctattgcattcaaaacggtatccgcgagccgatttaagtaagaacccgtgctgttaagaaaggacgacttgatcatgatctggagggagtcagcagcatcaatgttggagtcgactagttcagattcggatcggtaaccggtttgttcagcggcaccgtgatcatctcccaagaaactatgaacgagttc

SEQ ID NO: 21928 - DNA, 301 bp, Gossypium hirsutum
  Clone ID: LIB3272-005-P1-K1-H10
atggagcttgcgtgtttgcctaaagaatcctgaacttgacttcatagagaaaggaaaaacttacgcagggagcaaccgaagatctatctgaacgggctgatctggctgtaatgacggagagaactgctcaatatacctgatcctgagatgctctgagaagacatcgaacactcagaccatcctatcccgagccgcgccaacgaagaagacatgtcgagtaccagaaatgggcactaccaaagcaggacatgcgtgcaattggagatcgagcatgaaatgctattcatacacctgttgcaaa

SEQ ID NO: 21929 - DNA, 392 bp, Gossypium hirsutum
  Clone ID: LIB3272-005-P1-K1-H11
gctgtccaagacaaagcttgatattatcttttttagttccgacacaagaaaagggaaaaaaagaagaagaaatacaatcgttttctttttgaagacgggttttagttttcggggtgaaaaaaatgttgggagtattcagcagtgcgatagtgtctgcgccagacgagctgttggcggccgtttgccgaactccatcacctaagataacggcggacgctctggtgaaacggttccttgagacgaactcctccggcgtgttcatgcacatgggataccatgtgcaattcgcttattctcaccataaagagtcttctttacagaccagatcatgtgctgtgaaagacgaaatcttttgcttgtttgacggagcccttgatatcttggggagttta

SEQ ID NO: 21930 - DNA, 418 bp, Gossypium hirsutum
  Clone ID: LIB3272-005-P1-K1-H12
ctagaataccgactcatcatctgcccttcaatggcggaccaaccacaaccacccccccaagtcctcttagtaacattcgcttctcaaggccacattaacccttcccttcaatttgccaataaactcatcaacaatggcgtccacgtcacgttgatgtcggcttcttccatgattcaccaattcaacaaagcttcacctgtccatggcttgtcctacgcctattactccgacggctatgaccatgcctttcaactttccggtgacacgaatcattacctttccgagacaaagcgtcacggtactcaatccttgagagagtttcttgctgatcaaggcactaggttcacttccattgtttactgtactcttctcccttgggtggcaacggtggctcgtgagtttcacatcccagccaccc

SEQ ID NO: 21931 - DNA, 336 bp, Gossypium hirsutum
  Clone ID: LIB3272-005-P1-K1-H2
cgaagttctaccgtcatggggtgaagacctgcaaggtgtgatcgtcagataaaaaacaaaccttacccgaagtcacgttattgacgaagcgcacctgatcccaagatgaggattgatgatgcgggaatgaaaaagaggggtgtggatgagttgcgtatctgagttcacttgtacttttgtgagaaggaaaacgtctgtagctaatctctggaatctgctcgtattagtcgccacaagtctatggctaaatatgctggacaggatgccttacacttgcgagttcgtgttcaaccaattccatggcttgcacttcaacaaaatgctttcatgtgcttg

SEQ ID NO: 21932 - DNA, 426 bp, Gossypium hirsutum
  Clone ID: LIB3272-005-P1-K1-H4
ctctcgccgccgcctgcgtctctctcttcatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctattgatgttgacattggtgccaatccttcagccgaagatgctgatgaggatgaaggtgttgatgaccaatctgtgaaggttgttgacattgttgacactttcaggcttcaggagcaaccccctttcgacatgaagcagtttgtcgtgttcatgaagaagttcatcaagaacttgacaccgaaactggatgcggaaaagcaagagtccttcaagaaaaacattgagggagc

SEQ ID NO: 21933 - DNA, 441 bp, Gossypium hirsutum
  Clone ID: LIB3272-005-P1-K1-H5
cgagaaaaggaagacaacgatggtgtctttgaagttacagaagcggctcgccgctagcgtcctgaagtgtggccgtggcaaggtttggcttgatcctaatgaaatcaatgaaatctccatggccaactccaggcagaatgttaggaaacttgttaaggatggttttgtcatccggaagcctaccaagattcactcccgatctcgtgcacgcagaatgaaagaggccaagagaaagggtcgtcattctggctatggtaagaggaagggtaccagggaggcaagattgcctacaaagatcctttggatgaggagaatgcgagtactaaggcgtttgcttcgtaagtacagggaatccaagaagattgacaagcacatgtaccatgacatgtacatgaaggtgaagggtaatgtatttaagaacaagcgtgtcttgatggaaag

SEQ ID NO: 21934 - DNA, 449 bp, Gossypium hirsutum
  Clone ID: LIB3272-005-P1-K1-H6
tcgcccacgcgtccgttttgccttttctttgctttgggtttatttggacatttcaatcccacatgggttactttgcttgatttcaataagctaagctagcttcgagtttggggactttgagagatttcatataagttaaaacatatatacaaacttgagctagctggttgaggagggtcttttttttttctttgtcgagagtttttaagttttaagcatggaaggtcaaaagtttgttgtaaatggagggatcaaaatgcccattggttacaggttccgtcctacagatgaagagcttgtggttcattacttgaagagaaaggctttgaaccttcctttacctgcttctgtcattcctgagtttgatgtttttcagactgatccttggagtctaccaggtgatgtggaagaaaaaaggtgtttctttagcaacagatattgtaatgaga

SEQ ID NO: 21935 - DNA, 416 bp, Gossypium hirsutum
  Clone ID: LIB3272-005-P1-K1-H7
ctaaatacaggagtcatttgttttgggggaatgcctgagaaaatggcttgttttcaatatatagtagctgctctatgctttgcagttttacttgagggatcgttatcaaaagctcaactgaccccgacattttacgatgaaacatgcccaaacgtgacagccattatccgacatgtgctcgtgaatgcttcgttttcagatccaaggattggtgccagtctcatcaggcttcacttccatgattgttttgttcaaggatgtgatgcgtcgattttattggacgatcctgtgaatggtgagaaagaagctattccaaataataattcagctaggggttatgaagttattgatgccatgaaggctgccttagagagtgcttgccccaacactgtttcctgcgctgatattctcgctat

SEQ ID NO: 21936 - DNA, 417 bp, Gossypium hirsutum
  Clone ID: LIB3272-005-P1-K1-H8
gaagacaaggcggtaaagatgtgcttcttcagctgagggaacttgaagatgttatcattcccccatctccagttgcatttcctgatgaccatgaaacttggaatgtacagttatttagatcaattgatggtggggctgcttttggtttccctgagacacctgaagatgctgccagggctgggcttgtgagtggaaaggacaatatcattgaccgaagtattcaggatgcctatattaatgctatacgacgagcaaagaattttatctatattgaaaatcagtatttcctcggaagctcatttggctggagtcctgatgacatcaagcctgaggatattaatgctttgcatctgattcccaaagaactttcacttaaaattgttagcaagatcgaggcaagagaacggtttacagttt

SEQ ID NO: 21937 - DNA, 419 bp, Gossypium hirsutum
  Clone ID: LIB3272-005-P1-K1-H9
ctccatgttgtgagaaagctcatacaaacaaaggtgcatggaccaaagaagaagatgatcgcctcatcgcttatatccgagcccacggcgaaggttgttggcgttcccttcctaaagccgctggcctccttcgttgcggaaaaagctgtcggcttcggtggatcaactatttaagacctgaccttaaacgaggcaatttcactgaggatgaagatgaagtcattatcaagcttcatagccttcttggtaataagtggtcacttatagccgcgagattaccaggaagaacagataacgagataaagaactactggaacacacatataagaaggaagctattgaaccgaggggtcgatcccttgactcataagcaactcaatgaaagcactgcacgtcatgttgcaaatgcaatatgttgc

SEQ ID NO: 21938 - DNA, 398 bp, Gossypium hirsutum
  Clone ID: LIB3272-006-P1-K1-A10
ctttttctcctaaattctctcaccttcactttctttcaatcatcttacctggggtaacaaactgctgctgaaaactatttctttactattttgattttgtttttattccagagaaaaaacagaacaatttttcttatttaatttgattcattgttttcggccaattttttcccagccgttatcttttatttgattgcatatagatgtttgattttgcctgttgattactcttcttctctagtcaatgtagctgggttttttttttccttttctgaattagggtttcagttttaaaaaattggggattttgctatcaagctgtgtagttgaggaaactggaggagcctttctgataattataatgataaaagtttgtttttttctttgttgtgcttaga

SEQ ID NO: 21939 - DNA, 352 bp, Gossypium hirsutum
  Clone ID: LIB3272-006-P1-K1-A2
agaaattaaaaatcatgcgtggttcttgagaaatctccctgctgacttgatggatgagaacacaatgggttatcactttgaagagcccgatcaacctatgcagagtattgatacgatcatgcagataattgctgaggccactattccagccgctggagcccatggcttaaaccatttaatggtagacaaccttgatgatgaggacatggatgacttttattctgaatctgagcttgatgtttatagcagcggtgagatcatctatgcaatgtaatatgaagaagaaaacttctctccaatgttgtagttgattcaggcatgtcacagctgcagagggtggtaagatgctggt

SEQ ID NO: 21940 - DNA, 283 bp, Gossypium hirsutum
  Clone ID: LIB3272-006-P1-K1-A3
ctgagagaggtaaattaggttgttgaacaaggctaatttcatagcacaaaaaggtgttgaccctactgttcattggtttttcaaggccctgccaaacttaattcctttattaaggaccccttttccaaataaaacttaaaaaaaacccctgttttttgtttccccattttttcaaaccaaaccaccggccacttgtttaataaaaacaaaaccttccattaattaataaactcttccaaatgggaatcgtttaattcccagcagttatgaccagaatacccaa

SEQ ID NO: 21941 - DNA, 401 bp, Gossypium hirsutum
  Clone ID: LIB3272-006-P1-K1-A4
caataattgagggaatcagaaaatggagaaaactgatggaattgggaacgaaggtggaagcacagaagaaaagcaaagtttcaaagatggatcaatttttgggtataatttgcttcaccaccttttgagcgcaaatctcaagccttaactctaccaggaagtcaacttgtttcttctggggctgaattgcggaaaagcactttaaactattgttccaactgaattaactaaaagcccttttttaaaacaatgattttgatcttaaggctttcaaattttctgctgacaaagatttgttaagagaaccccgtttagtaagggtcggtcttattcagaactgcattgttttcccaaccactgctcccatttcaaaccagaaaaaagctatctttgagaaattg

SEQ ID NO: 21942 - DNA, 375 bp, Gossypium hirsutum
  Clone ID: LIB3272-006-P1-K1-A6
attgaagtgaactttctcgattttgtatttagccaaacaagatgcagatcttggtgaagactctaaccggcaagacgatcactctcgaggtcgagagctacgatacaatcgacaacgtgaaggccaaaatccaagataaggaaggcatccctccagaccagcagcgtctgatcttggccggaaaacaactcgaagacaggcggaccttggccgattacaacatccaaaaggagtcaactctccacctcgtcctccctctgcgcggggggatgcaaatcttcgtcaaaaccctgactggcaagacaatcactctcgaggtcgagagctccgacacgatcgacaacattaaagcgaagatccaagacaaggaaggca

SEQ ID NO: 21943 - DNA, 401 bp, Gossypium hirsutum
  Clone ID: LIB3272-006-P1-K1-A7
attctgccattcggcgggtgcattctgtggaaattatgctcggttcttgataggaaatctagtgttgataaaagcttttatttttggattttccagatttttaatacatacagcctcggcacttaacggcagatttctcagaacttttggctctgttttctttgttctattttcaccttttttaaaaaaaattattattatttcatttccttaaatttctaaaccggggactgagataatgggaggggcttcactgccaccaggttttcggttccatcccactgacgaagaactgataggttattacttgaaaagaaaaactgaaggccttgaaattgagcttgaagtgattcctgtgatcgatttgtacaagtttgatccttgggacttaccaaagaagt

SEQ ID NO: 21944 - DNA, 298 bp, Gossypium hirsutum
  Clone ID: LIB3272-006-P1-K1-A8
ggaaaacaagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaagtgcaccgcctgcggcagtgaccgctagctttggtaggcct

SEQ ID NO: 21945 - DNA, 262 bp, Gossypium hirsutum
  Clone ID: LIB3272-006-P1-K1-A9
ataaaacaataaaaccacaaccttattacttatttataactaatctactttgtttattattattttttataacacctttaacacacctaataataactttatatatcatctaaattttatacatactttataccctaccacaccatatatatccaattaaaaataaatattactaccttctttacatactttaatcaccatttcacttccctaaatctacactctctatgactccatataaaaaataggttactcactcaca

SEQ ID NO: 21946 - DNA, 245 bp, Gossypium hirsutum
  Clone ID: LIB3272-006-P1-K1-B1
cgcaaaaccctacaattggactggttgtatttattgataccaaatcatcccgggtggctctcaataaaacgataccgtctaccgcgacaattcatttgatttccagtaagaacggcatttttaagcttaagtatccggttactgcaatttgtattttgttgcagggcatattgggaaggcattattggaagcatacaaaacatgctcgtcctgagccacccccggtagcacaacaacaacttaga

SEQ ID NO: 21947 - DNA, 385 bp, Gossypium hirsutum
  Clone ID: LIB3272-006-P1-K1-B10
gtgacttcttcagatactatctttccctcaaaaatggttactttcaggtttgagcagtaccaagttgtttgaagggctcacccaacagagagcgatgagcatcccaagatctataggatgatgctctgggccaccaatgaggttcgggccaaatccaagttctggtacttcttgaggaagctgaagaaggttaagaagagcaatggtcaagtccttgccatcaatgagatatttgagaagaaccctaccaagatcaagaattatggtatatggctccgctaccaaagccgtaccggttatcataacatgtacaaggaataccgtgacactactctaaacggagctgttgaacaaatgtacactgagatggcttctcgccacagag

SEQ ID NO: 21948 - DNA, 366 bp, Gossypium hirsutum
  Clone ID: LIB3272-006-P1-K1-B11
gttacttcctcacaaactaacaatccttcaaaaatggctactcttcaactggcgtccatttccaaattttttttaacaacccacccaacacagaacgataaacattccaagacctatactatcattctctcccccaccaaataagttactgtccaaatccaaattcaattactcataaaacaaacttaataatgataataatagcattggacaagtactttccatcaatgacatatataataataaccctaccaagaacaataattattatatatgtctcctctaccaaacccgaaccagatatcataacatatacaaataataccccaacactactctaaacttaactcttcaacaaatttacac

SEQ ID NO: 21949 - DNA, 393 bp, Gossypium hirsutum
  Clone ID: LIB3272-006-P1-K1-B3
gtcaccggaaaaagtcgtggaactattgaaatcacaaggaataaacaaagtggaggtttacgacaccgacgcgacggttttgacggcgttagcggattccggtataaccgtggtcgtcgcacttcctaatgaactactttcatccaccgctgctgatcagtcgtttgcagacaactgggttgaagcaaacataacaaagttttacccaaagacaaaaatcgaagccatagctgtcggtaacgaagtgtttgtcgatccggccaacacgaccaaatacctcgtaccggcgatgaagaacatccacgcttcgttagttaaatccaagcttgattccgccattaaaatctcttctgcgatagctttcagtgctttaaaaacctcgtatccttcatc

SEQ ID NO: 21950 - DNA, 399 bp, Gossypium hirsutum
  Clone ID: LIB3272-006-P1-K1-B4
gaaaatggaagctagaaattttggtaaaagataaacacaacaactcctcccctttggctctctttcttgcttctgccaataattttagatcgaatcccaaacgtaactctattctcttttgtgttttttattagattatttttttgtttcgtttcttagaaggaaaaaaaaagtcatttataaagtcaagtgtttgggaactttgggttgtttacgaaaaagaacatgagcaaagagattgtaaaggaagaagcgccttcctcgtcccctgttgtttcgggtagctttgcttctctgagaagcgtccgatggcgtattagtctcagtattttgccttcttcttcttcagatgatgatcttcgcagggtaactgctgattctcgccgaagatatgctggg

SEQ ID NO: 21951 - DNA, 404 bp, Gossypium hirsutum
  Clone ID: LIB3272-006-P1-K1-B5
gtttctttcttctgattttccatgttagggaagcgaggtcgacccatgatcgggagcttatctgaattactagttccaacacataaatccgggttatcggatccttcaaggagccccaaaagtccactagacttattcaagaccccatcatcatcatcaagaagagggtcgatgaagagatgctatgatgtttttggtgatggagtagggcttggaatcattgcttcaatggagaaatccactgttgatcatcatccttcttgtaagctacaacacaccatttgtagattcaaaggaagatttcaagaaaattcagaagaggattacacttttgttacaagacatggagaatcatctacaaaagtttattttaatggaggtgacgaagaagaagaacagagact

SEQ ID NO: 21952 - DNA, 403 bp, Gossypium hirsutum
  Clone ID: LIB3272-006-P1-K1-B6
gtaccctacagtgacagcaatttattcttcttctttttattatatttgggttgtgtgtgacgtataagcagctaaataatcatcttctgctcttcattgattcttacaaatgctaaatctgctttgtttgaactctagttcttgcaaattgtagaactgaaagaggtaaaccatgaatccaacaatgttattgcaacaatggtggcaactgtttaattcaactgatgtgttcaaccctctcaccttagttcctcttctcctcaccattagttttctctttaagcttttaagaacttggaagctcaatctcccaccatctccacccaagctgcccatcattggcaacatccaccaagttgggaaatcgccccaccgatctttccgagccttgtctgagaaatat

SEQ ID NO: 21953 - DNA, 404 bp, Gossypium hirsutum
  Clone ID: LIB3272-006-P1-K1-B7
cttttgttactttgtgacaaatggagggtccttagctttctctctctctccggaaaaaaaaaaaaagaaaacgaaaaaaagtttcgcttctttgctttctttcgagtaaaaatcaaacgaaaaacaacttaaataatattaaaagaattttatttttatcatcaaattttttgttttttatccaccaatccaatcaaaatgttgaaatattgaaaccttctggggttttggttggtttttgaaatctgatgtctcccccccttcttggcctggaagaagggggtcagaacaatgtgactttacttggttcttctggctctattgatagtgtgtgccaaaataatgctgaattgaaagagcgcaattacatgggcttgtctgattggtcttctattgaatgctct

SEQ ID NO: 21954 - DNA, 405 bp, Gossypium hirsutum
  Clone ID: LIB3272-006-P1-K1-B9
gctcctcgctgtggaaagaaaaaaaaaagttctctatcagatcaagtattagggtgatatagtaaagatgtcgccaaccgaatcatcacgagaggaaaatgtttacatggccaagctggctgagcaggccgagcgctatgaggaaatggttgagttcatggaaaatgtagcaaaaactgtagatgttggtgagctgactgtggaggaaaggaaccttctttctgtagcttacaaaaatgtgattggggctaggagggcttcttggaggattatctcttctattgagcagaaggaagagagcagaggaaatgaggatcatgttgcaaccatcaaggagtataggagcaagattgaagctgagctcagcaagatatgtgatgggattttgagcctccttgagtctca

SEQ ID NO: 21955 - DNA, 323 bp, Gossypium hirsutum
  unsure (1)..(323): unsure at all n locations
  Clone ID: LIB3272-006-P1-K1-C1
agaatgttcattcttttgggaaagtagtatttatggatacacaatctcgtaggtggttcttanatctgtgaaactgtcaacccacgactctttattggcgtttcagggaaaactcgcattgatgcgcttaaggatccaaataccgcaagatgcactgattgctatggcagattgattgaacagatcgagatatcaaaatgaagatgcacgtgcgattacacccgcggcagctcacgctaatcctagtcctggaaccgatcatctgcggctgggacatatgagagcaaggaatcggcctgctattaaccttgatatagggttag

SEQ ID NO: 21956 - DNA, 402 bp, Gossypium hirsutum
  Clone ID: LIB3272-006-P1-K1-C10
cacgtttcaatggcgttactttctctctcctctctcagtcctctcgctccgcgatgtccgtcttttcctttgcaacttcaaacgcgaatctctttctctcgtgccagaatcggagcgtcttcgacttcgtctccgtcgacttcgcaagtgattcagcatgcttcttcgaatccgaaagtcgtcgtcaccagggaacgaggcaaaaacaccaagcttattgacgctctggccgaacatgggatcaattgcttggaacttccccttattcagcatttacaagggcctgactcggataggcttgcttctgttttaagtgaaacggcgtttgactggattgtcataacttcacctgaagctggttcggtctttcttgaggcatggaaggcagcaagaacaccaaat

SEQ ID NO: 21957 - DNA, 408 bp, Gossypium hirsutum
  Clone ID: LIB3272-006-P1-K1-C2
cttgcattgagtctctaagatatcactgcaaggaaaaaaaaaaaaaaccaggcgtggcttccaacactgttgcatccgctgctcttcttcttaccttgaacttgttgttcttcactttggttagctctacctacgtgccttgcccaccaccaccaaagagccacaagcctacccacaagagcccaccctcggcacctaaacagccagccacttgccccaaagatacactgaaactaggtgtttgtgctgatttgttgggctcggtgcgcgttgttgttggaccgtcgaggaccaaatgctgctcactcatttcgggtttggctgatctcgatgctgctgtttgcctttgcactgctattaaagctaatgtgttgggggttaacctaaacgttcctgtttcattgtctt

SEQ ID NO: 21958 - DNA, 404 bp, Gossypium hirsutum
  Clone ID: LIB3272-006-P1-K1-C3
gtagagatgaggaaaatcatgggtgccaaagttcttttcttctttgctttgcgttgcttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgttct

SEQ ID NO: 21959 - DNA, 404 bp, Gossypium hirsutum
  Clone ID: LIB3272-006-P1-K1-C4
cttcaatgcaaaggttggggtgtacctccaaacaccctggctgaatatgcactgtggcaatttggaaacatggatttctacgacatttccttagttgatgggtttaacatccccatggtgtttggtccaactaatggcggttgtcacaacattcggtgcactgcagacatcaacggacaatgcccgaatgagttaagagctcctggtgggtgcaataacccatgcacggtgtttaagaccaatgaatattgttgcactcaagggtacgggacctgtggtccgacccgttattcaaggtttttcaaggaccggtgccgtgattcatacagttatcctcaagatgatccttcgagcacctttacttgccctgctggttccaattacagggtcgtgttttgcccccg

SEQ ID NO: 21960 - DNA, 406 bp, Gossypium hirsutum
  Clone ID: LIB3272-006-P1-K1-C5
cggacgcgtggtttgcatatcactttgaaagcagttttttgaggtaaaaatccgtggataagaaggggaaaagaaacacttagctgctccggaaatggcggacgcgttttgttcggactgcaagcggaacacggaggtcgttttcgacacattccggcggcgacaccgtctgttcggagtgcggcttggtcttagagtcacattctatcgatgagacatcggagtggagaaccttcgccaacgagtccggcgataatgatcccgtccgtgtcggcggtcccaccaatcctattttggcggatggcggtttatcgaccgtaatcgctaaacctaacggtgctttcggggagttcctttcgtccctcgtgggtcggtggcagaatcgcgggtcgaatccggatcgggg

SEQ ID NO: 21961 - DNA, 339 bp, Gossypium hirsutum
  Clone ID: LIB3272-006-P1-K1-C6
ggtgagtttaccctttcttcctctgctttgatcttgtttttcatgtaaatcagagccccattttgtttatctgcctaaaaaattcatttcttctttcttaagctgcaaacgagaagttcaactcgatgatcaagacctttcctttttcactagttaatgtttgggatggttgaataaaatctccaaattcttgatcttaagtcgataatctgttgaatttcctgttggggtatcctttgtttaaatctcgaagcttttcagctggatttctgttatcatgaataactatccatttgggtcaaatagccctaagtccttcaatgcctatccaaggggggc

SEQ ID NO: 21962 - DNA, 365 bp, Gossypium hirsutum
  Clone ID: LIB3272-006-P1-K1-C7
atttcatactcatttagcccctctcattagcatccaaatcactccagttgtgggtatcactgaaaaatgtcttgctgcagaggaaactggggctgccgtactggctgcaagtagcgcaaaggctgaggaggatgcaagatctacccaaacctgaacgtcgcctggatgaccacatctgaaactctggttcttggtgtagcaccccagaaagcacactttgcgggagctgggatggaattcgaagctgctaaccgctgccagtgtggatacaactgcccctgcaaccctcgcaatcgtaaatgattagcgaccaaagccaaagctcccttgaagcacagacgcctttgtctttaagaaataatatg

SEQ ID NO: 21963 - DNA, 404 bp, Gossypium hirsutum
  Clone ID: LIB3272-006-P1-K1-C9
tttgaagacctagtccctgtgaacaaatcttgttgttcatttctgggtttaggttctcaagaaaaagaagatgacaaaagataggcaaatcggtgtagcaatggatttctccaagggaagcaaagcagctcttaaatggacaatcgacaatctggtagacaaaggggataccctttacctcatccacgtcaaacccaatcagagcgacgagtctcgtaaccttctttggtccaccagtggctcacctttgattccattatcggagttcagagagaaggaagtgatgaaacattatgaggtggaacctgatcctgaggttttagacttggttgatacggcttcaaggcagaaagaggtgaatattgtcacaaagatttactggggtgatgccagggataaaatat

SEQ ID NO: 21964 - DNA, 404 bp, Gossypium hirsutum
  Clone ID: LIB3272-006-P1-K1-D1
cgcaggctctcccgctccttatcgctgcgatttctgattcaagatctcagttgtgagatcgtaacgctcttttctatcaagccatggctctgatcttgcatgcaggaaaaacaaacaaaaatgcctttaaggcactcattgctgcaaaatatagtggtgtgcacgtcaaaatggaagagaattttgagatgggtgtgtcaaataagactcctgagttcatcaagatgaaccctttgtggaaggttcccgtgttcgaaacacctgtgggtccgccatatgagagcaaggccagtggtcgatacttaactcgctcaaaggttaacaaccgtatatgaaggtctacaaggattgattatgatcatatcaagcaatggattgggtatgcagccttggaaagtgatgct

SEQ ID NO: 21965 - DNA, 400 bp, Gossypium hirsutum
  Clone ID: LIB3272-006-P1-K1-D10
cgccttttccccttaaccctcaaccgcaaaaaagaaaaaaaaagagtagcagtgccggtttcaccagctatgggtatcgacttggtcgccggcggcaagagcaagaagacgaagagaactgctcccaagtctgatgatatatatctcaagcttcttgtcaagctttaccggtttctggtaagaaggactggcagcaaattcaatgccgtgattctggaagcggttatttatgaccaaaaccaacaggcctcctttatctctttctaggttgattcaattcatgaagggcaaggaggataagattgctgtggtagtcggggctgtcaccgatgacattcgtgtgtatgaagttcctgcgctgaaggttactgcgttaaggttcactgaaacggccagggca

SEQ ID NO: 21966 - DNA, 402 bp, Gossypium hirsutum
  Clone ID: LIB3272-006-P1-K1-D11
agaaaattgaaaattcagatttaaaagattctaatttcttgaaccaaagcggtgctttttcacttttggattcaattagcgaataaaagaaaaccctaacggaccttccattttcaaagctctcaccaaatcaggaactcaaagattgcattaagggattgctgtatttggtgggagtggtagaacatcgattccgggttttcagaactgatggatacggatagagagagacacagcgccagagaaacagctttttatctgtttactcagcaaagtcttacggcttgcaaacctgtcttaacaccaggatgggttatagcaatatttttgtatatgggtgtcatttacattcctgggggcctggacactctgcgtgcttctaattgtgttgttaaaattggg

SEQ ID NO: 21967 - DNA, 398 bp, Gossypium hirsutum
  Clone ID: LIB3272-006-P1-K1-D12
ctgatgagttcactggtgctggagccatcggtcaggtttgtcaagtaatcggggccgtcgtcgatgttagattcgatgaaggcttgcctccgattttgactgcgcttgaagtgatggaccactcgatccggcttgtgttggaagtggctcaacacttgggtgaaaacatggttaggaccattgctatggatggaacggagggactcgtcagagggcagccggttctcaacaccggatctcctatcactgtgcctgtcggtagagctactcttggtcgtatcataaatgtcattggagagcctattgacgagaaaggcgaactcaaaaccgaccatttcttgcccatacacagagaagcaccagcctttgtcgatcaagctactgaacaacagatcctt

SEQ ID NO: 21968 - DNA, 400 bp, Gossypium hirsutum
  Clone ID: LIB3272-006-P1-K1-D2
cttaaccatttcccaaatctccttcctcctcttctttagcgtccttttcatttgcggtcatgcagcgcgctttgaaatccgcaatgagtgctcctacaccgtctgggcagcaacctctcctggtggtggccgtcgcctagaccctctgcaaagttggaccatcgatgtgcctgctggcactgctatggctcgtatttggggtcgaaccaattgcaatttcgatgccagtggtaggggtcattgccaaaccggtgattgtggtggactccttcaatgcaaaggttggggtgtacctccaaacaccctggctgaatatgcacttaaccaatttggaaacatggatttctacgacattttcttagttgatgggtttaacatccccatggtgtttggtccaact

SEQ ID NO: 21969 - DNA, 390 bp, Gossypium hirsutum
  Clone ID: LIB3272-006-P1-K1-D3
ccgccagggtttccaggcctttgggggagtccaatcggcccgtccgtaccgtccgtacacaaaacttattagatcccgaaccctcaaaaaagtttacccggcattctatccagaaaaaagaattgaagtttcatatgaaccaaatcaagctaaagaatttttcccccgatcccgcgatgatctatctgctttattttgaggtccccgtgttcaggtcatttacccacaacaccatattctctttgtacagattttttcgtgacgcggaacataacacactcaatttcataaccgcagtatgtactccttggaatttttgggaatataggaagaaacatatgcacgtctcaatgaaggcgttgaagaagaggtcaaagcagatttttaaag

SEQ ID NO: 21970 - DNA, 412 bp, Gossypium hirsutum
  Clone ID: LIB3272-006-P1-K1-D4
cttcggaagtttaatttacccattacttttttaagggaaaaaacagagctcgctcttgggggtttgcttaggggtttcttttaatcaaaactaatctgattctgctttctactccaaaatcaccaaaagcccagatttcgtttagaaattagaaaaccccaccgtttatagcgctgttattaaatacctccataaacatcatcccctcaaaaaaggagaagcttctctctcccattaaccctaactacacaagaaataaaattacctcaaaacaataggatggcagaagcagaggtaggatctggtgaaggaaagccccaagagatgtcgttgaaggataaagggaatgagtttttcaaggctgggaactaccttaaagctgctgctctttacactcaggccattaaacaag

SEQ ID NO: 21971 - DNA, 394 bp, Gossypium hirsutum
  Clone ID: LIB3272-006-P1-K1-D5
ggcgatgcagacatgggacttttgggtattgttcacatcgttcctttgtggggtgggaacaggtatggcggtgataaacaacatggcacagatcgggttagccttgggtcacgccgacgtttctatattcatttcattgaccagtatttggggcttttttggacgaatcattttcggctctgtttccgagtactttctcaagaaagcaggaactcctaggccactttggaatgcagcatctcagatcttgatggcgggtgggcctcctttaaatggcatgggcatggcctggttgccttaacatgggtccaattgttgttggcttgtgttacggagtccgtatagcattgactgtcccggttgcctcagaactattcggtctcaaatactacgg

SEQ ID NO: 21972 - DNA, 402 bp, Gossypium hirsutum
  Clone ID: LIB3272-006-P1-K1-D6
aaaacacccaggtacagaagcactaacattttctctttggcttaccaaccttgggtgctgaaatggcaaagtcacccgaagaagaacaccctgtcaagacctttggctgggctgcaagggacccatctggtcatctctctcctttcaccttctccagaagggtaactggtgaagaagatgtgaggtttaaggtgctgtattgtgggatttgtcattctgaccttcacagtatcaagagtgaatggggctcctccaactaccccatggttcctgggcatgaaatagtaggggaagtgacagaagtaggcagcaaagtggaaaaggttaaggtgggagataaagtgggcgtgggatgcatggtcggagcttgccacagctgcgacagttgtgcaaacgaccttg

SEQ ID NO: 21973 - DNA, 399 bp, Gossypium hirsutum
  Clone ID: LIB3272-006-P1-K1-D8
ctttcctagcaagcacctctcttcttaactgtaaatttcaaatctctcttgtgccttaaacatggctactatttaccgccttgccactctcatgctcttctgctttatccaactcagcttctccgagttggttcaagagcaacccttggttttgaagtaccacaacggtccactcttgaaaggcaagatcaccgttaatctcatctggtacggcaagtttacacccatccaacgctccataatcgttgatttcatcaactctttgagttccgataaggccacaatggttccttccacgtcgtcgtggtggaaaattactgaaaagtacaagggtggttcttctaccttagctgtaggcaaacaaatccttctcgaaaattacccgctcggtaaattcct

SEQ ID NO: 21974 - DNA, 398 bp, Gossypium hirsutum
  Clone ID: LIB3272-006-P1-K1-D9
atatcctctaattctaaagctaagagttttaagttaacgaagcatttgggtgggttcgaagtaatggaaacttcaggaaaagtaaagaagggagccggaggaaggaaaggtggtggcccgaagaagaagcccgtttcaaggtctgtcaaagctggtctccagttccccgttggtaggatcggccgttacttgaagaaaggaaggtattcacagcgtgttggaaccggagccccggtttacttggctgctgttcttgagtacttggctgctgaggtcctggaattggctgggaacgctgcacgtgacaacaagaaaaacaggatcatcccaaggcacgttctacttgccgtgaggaacgacgaaaaattagggaagcttctcgccggcgtaacaatcgc

SEQ ID NO: 21975 - DNA, 402 bp, Gossypium hirsutum
  Clone ID: LIB3272-006-P1-K1-E1
caaaagctttagaattgcaaatggaggttctttctcaacgaccatcttatttgtcgactttgaatcccaacgcttcatagtccgttccgttagcgtaccgtacgggcgaggatttctatgatgagtggtgggctctcgttcaatcctaccatagttttcgggactactggcttcaagaacgtttccacgatccccaaaacgacgacgctcgtctttttttacccgacgatcttgatgccgtgtttgacgattacgaccactttttcgttgaccctacccgtgaagggaaggaagaagatactcaaaaggaattattacccgctggagcattcaaatggcggaaggggctagttgtgagtgagtcacctaggtttcttgagaaagcgcccaagatcgtgaatg

SEQ ID NO: 21976 - DNA, 402 bp, Gossypium hirsutum
  Clone ID: LIB3272-006-P1-K1-E10
gcttactttgggcccacagttcatccatcatcctcaaattccagtggaagtggtgtcagatagttctagttacaataatcactggaatggtccatcagtgcctggtgaggtacctgcatcatatgcttttcctgcaatggatcaccattaccataattgggagcatcattccccaccattctccacatctagcagtcgaattggtagttctgatcaaccttcaaatcctcctgtcagtcaaaggtctgccaggagtggttctgatatgccaagatcaggatcttttatgcgcccgtatgttgttggccacagttctggtgctagagcagggagttcagtggcatcctcattgattcctccttaccctggtagcaatgctcgagcacgtgatagagttcaagc

SEQ ID NO: 21977 - DNA, 216 bp, Gossypium hirsutum
  Clone ID: LIB3272-006-P1-K1-E11
gaaaattgttgtcgtattagtatgttctgattgctttatctataatcttcctgtgccttctcaatttcggtgagcaaagtttcaatcgacaccacctccaattttcctttttacaaaaatggcttttactaatgaagggcctgcctggcctccttttatggtttcaactaatatactgttacaaattctggcttttgcattatataacaacttggg

SEQ ID NO: 21978 - DNA, 396 bp, Gossypium hirsutum
  Clone ID: LIB3272-006-P1-K1-E12
ctgcaatctatcttctaatttcgagtcttccttgaattttctttgccctgtggtgcttttaaagttcaccagtaccactctttatttttttccttcgttttcactgggaatttctctgccacaagtcgagatttcatttccaagtaatttgttttccttctttactggggttattctagtattcacttcgcaagatttgaagcaaaatccgtttccgtgtgatggatactcacgaccaaattgaagacaaaacatcgcccaatgcttttaaatctggcatatgcccccaatctatgacattgaaccagttgcaggagttatacacatttaatcatgatcacacacccaaggctagaaaaccctacactataactaaacagagggagaaatggactg

SEQ ID NO: 21979 - DNA, 404 bp, Gossypium hirsutum
  Clone ID: LIB3272-006-P1-K1-E2
cccatttccaatctccagctcccaaggtaaatatgccgatcagaaacatagcaggtggccggcccgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaggtggccacgtcaaccccgccgtcaccttcggtgctttcgttggcgggaacatcactctcttgcgcggcattctttactggatcgcccaactcctaggctcaaccgtcgcttgcctgttgcttaagttcgct

SEQ ID NO: 21980 - DNA, 402 bp, Gossypium hirsutum
  Clone ID: LIB3272-006-P1-K1-E4
gtaattttctttttatttatcgttgcccatttgttttcagtacacctcttttgtttttcttcttctttttctagtttcagatctttgcttttcttagggtttttgtttctgcttgcgttttaattccaaaaaaaaatagagatttaggggtttcttttggaattttcctgagaaaatggagaaggacaaatccccaggcttgccaccgccgtctggtcggtatactgggtttgcggccgtcgggaatgttttgaactcaactggatgttttggtcaaagttctgatgcgaatctttttagtcaggatattatcaaaatgcctgataatccaccaaagaacttgggtcatcgccgcgctcattcttaaatccttactcttcctgatgatattagctttgatag

SEQ ID NO: 21981 - DNA, 401 bp, Gossypium hirsutum
  Clone ID: LIB3272-006-P1-K1-E5
agcacgcatgggtgtctctacataaagagctagctcagcgccaattaaacaacgagtatcagtccaattttgcacacccaagctatctaatgtacaaaccagactggtactctccttttaggactcatatgtgaaaagtatgatcctacctgcacacaaatatgtgtttgctactgcatgcttgacaacaatctatcaaattcatctgcagtcaatcaactttacaaaggaaacaacacacccgcgattaatgctgatctatccaacatcaacaagcatatacacgctctatagaggctccaacatacaaataatattacgcgatcaaaatgatcaactacaaaaccttgctgaccccaacaaagcacaatcatagttccaatcaaagagctgagctcatt

SEQ ID NO: 21982 - DNA, 313 bp, Gossypium hirsutum
  Clone ID: LIB3272-006-P1-K1-E6
tgagaaatcaaaattcaaaaccctagttagggtttttatcttcctcaatctcccgttgtcacactgcaaatcggccacaatgtcgatgtccaagagttccaaaatgcttcaattcatcaactaccgtatgcgggtcactatccaagacggccgtcagttggtgggtaagtttatggctttcgatcgtcacatgaatctcgtactcggtgactgcgaggagttccgtaagttgccgccggctaaagggaagaaaaaccccagtaccaatgaggagcgtgaagatcgtagaacgcttggtcttgttcttcttcgt

SEQ ID NO: 21983 - DNA, 396 bp, Gossypium hirsutum
  Clone ID: LIB3272-006-P1-K1-E7
cttccgtttttttttctaacctttcctttcgcttggagaggccgattggaggtatttggcttgttttcaagatcttcaaattcaatttcaaatttgaccatccaaatatttatttcttgtcaaatcgaaatttctaacccattaaagggggaaagggaaaatgtcatcatacgaaaacgttgtaggtgggaagcttaaactcaagggaaaagccttggatgttaaggctggtggaatcaagaagaaaaagagacatatgaagccgattcaacatgatgaccaaattacccagaacgatccctctgatgccccttccgctggtgaaaccacaaaagtttctgttgatccccaagaagaagatatcaacaatgcggagatgtcaagtggggagaaggc

SEQ ID NO: 21984 - DNA, 402 bp, Gossypium hirsutum
  Clone ID: LIB3272-006-P1-K1-E8
attcagtagcttcattatccatgggtgcaccatctcctgcattgcatccatggatgcaaccatcttcatcagcctcaagacgaggtcctatgccaggagcaaatagcaagaagtcaaaatctttgatgcagcatccttccagaggccttcctggaaagccccaggctcctaatcgtacctcaacaggagcatttgctgcaaatgtacgtgctgaagctgcaccatatgatccattaattggaaggaaagtttggacaaggtggcctgaagacaatcatttctatgaggctgttataacagactataactcagttgaggggcggcatgctttggtttatgatataaatactgcagatgaaacctgggaatgggtcaatctcaaagagatatctcctgaagata

SEQ ID NO: 21985 - DNA, 128 bp, Gossypium hirsutum
  Clone ID: LIB3272-006-P1-K1-F1
atatgacatcgttctatcatatcgaccactagatacaggcactgaatcagaggtggttaatgccgattaggtatcacccacatcatcaatgtcctatactggaccaggtttcgttgtatcttctctta

SEQ ID NO: 21986 - DNA, 327 bp, Gossypium hirsutum
  Clone ID: LIB3272-006-P1-K1-F10
gaaacacagtgagggagaaatggtttctctgaagctacagaagcggctctgcgggagcgttctaaagtgtggaaaaggaaaggtttggctcgatcctaatgaagtcaacgagatctctatggcaaactcccgccagaacataaggaagttggttaaagatggttttatcatcaggaagccaaccaagattcactctcgatctcgtgctcgtcgcatgaaggaagccaagagaaagggacgtcactctggatatggtaagcgcaagggtacaagggaggcaaggttgcccacaaagatcttgtggatgagaaggatgcgtgtacttag

SEQ ID NO: 21987 - DNA, 404 bp, Gossypium hirsutum
  Clone ID: LIB3272-006-P1-K1-F11
gttgcagaaaactgcaaaccctaattatcaagaaaattgcattccctacaaaggatcttcatggcgaagaagggcaaggccaaatcagcaaaatttgagatcgaagagaacgaatcgggaccattagattcgaaaccattgatggtactaagcattagtgacgacgaggaagccaatgaagacctaagcttgaagatcgtggagaaagcactattggtgaaagcgacgaggtttagtgaaggatgccacggcgtttccgatgacccaggcgtcgtttctgtggtgggtttggcttcgtcgtcacgcgggggatctgatgtagctggtaccagtggtggccgtgaacaggcagatttggatttggaaagtaagaaaattgttagaaggaaaaagaagaaaacgaa

SEQ ID NO: 21988 - DNA, 402 bp, Gossypium hirsutum
  Clone ID: LIB3272-006-P1-K1-F12
caggaaaacaagaaaagcagagccgcatcactttttgctagctaagctactgggggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaaaatatgcgatgaaagagtcgtcgtcgtcggagacaagggcttattcttcagcttgggcgcctgaccctgttacgggg

SEQ ID NO: 21989 - DNA, 403 bp, Gossypium hirsutum
  Clone ID: LIB3272-006-P1-K1-F2
ggttcctttttttttttgttcaaaagcgaagccctaactcgcatgctgttcggatcttaatcgtcgaagatccgattcatatctatctctgatctgatccaaaacgaaaccacccggcctctgagaaatgacgcgtcgctgctcgcattgcagccacaacgggcacaactccagaacctgcccgaatcgtggtgtcaagttgttcggagttcggttgactgacgggttggttcggaagagtgccagtatgagtaacttatcccaattcgccgggtccaattctgccgggcataacgggaatgggtcgggttcgcccggtgaaggtccggatcacgccgatggttatgcttccgaggattttgtccctggatcgtcttcgagtcgtgataggaaaaaaggtgtt

SEQ ID NO: 21990 - DNA, 391 bp, Gossypium hirsutum
  Clone ID: LIB3272-006-P1-K1-F4
gaaatagataaaccaatacactgagagaaaatattgcccacatcacccaaaaagtgtgtgtgacacgagcccgcggctaccttggctcttgcgatgtcaagcatgttttctacaacaactacacagttcacggcactcatagacaacctgggggtgccaaatatgcccatttgaatcaatttcagagagcatcccacaacctacaactcttgaaggctgatgttctggattacgattctgtttgatccgtcattacaggtttaaccggtttcttctttattccctttcccgttccttcaacataatttctaatccccaggaagaacttattgaaccggctgtctaaggcacacttaatgtgcttaaagcatgtgttcaatccaatgttaaa

SEQ ID NO: 21991 - DNA, 405 bp, Gossypium hirsutum
  Clone ID: LIB3272-006-P1-K1-F5
caagaatgaggacgcctcatcatcttttcactctagctctcttcttcaccttcatgtgtgtttctgttgaagcccttaatgttggaatccaggccgctgataccgccatctctgtgagcaaagaatgcagtaggacatgtgagtcagagttctgttcagtgcctccatttttgaggtatggcaagtattgcggcctattgtacagtggatgccctggagagaaaccttgcgatggacttgatgcttgctgtatgaagcacgatgcctgcgttcaagctatgaacaatgactatctgagtcaaaagtgcagccaaagcttcataaagtgcatgaaggatttccagaaaggaggaggaaggagtttcaagggtaataaatgccaagtcgatcaagtcgttgatgtca

SEQ ID NO: 21992 - DNA, 392 bp, Gossypium hirsutum
  Clone ID: LIB3272-006-P1-K1-F6
ccgccgcctgcgtctctctcttcatctctctgaaccaaaaagtctttacctttgggcttcgagagagaccatgttggtttaccaggatctcatctccggtgacgagcttctttctgactcattcccctacaaggaaatcgagaatgggatgctgtgggaagttgagggaaagtgggttgtgcaaggagctattgatgttgacattggtgccaatccttcagccgaagatgctgatgaggatgaaggtgttgatgaccaatctgtgaaggttgttgacattgttgacactttcaggcttcaggagcaaccccctttcgacaagaagcagtttgtcgtgttcatgaagaagttcatcaagaacttgacaccgaaactggatgcggaaaagcaag

SEQ ID NO: 21993 - DNA, 382 bp, Gossypium hirsutum
  Clone ID: LIB3272-006-P1-K1-F7
cccacgcgtgcgcccacgcgttcgtattgggaaataaccgccaccggtgtggggcctttggttgtaattccgaaattcttaaaggggccctgggccaaatcttttcttttttttcttaaggctgtttctacttcacagcagtagggggattaagaagctatgagaattcttagaaccagatcacttccatgccttgttaaaaagaggagatattgggtgctaaattcaaggtggaagggccaacagttgttgctgccacagagtaatcctttgctttcttcttctaaatctatggatccatgggaatataggagcttcaaatgcatagcatatgggtcactcttccatgtgaataactgagttccagtacttgtagaatggg

SEQ ID NO: 21994 - DNA, 399 bp, Gossypium hirsutum
  Clone ID: LIB3272-006-P1-K1-F8
aaataaggtaagaatggaaggcggaggaccaccacaggcggcggacaccgagggggcagaagcagcccagcaacagccacaacaccaccagcaacgtccgcctcaggtggccgctggcctggaaaatattccggccactctaagccacggcggtaggtttattcagtataacatctttggtaacattttcgaggtcactgctaaatataaaccacctattatgcctatcggtaaaggcgcttacggcatcgtttgttccgcattgaattccgagacaaatgaacacgttgcgttaaagaagatagcgaacgcatttgataacaagattgatgcgaagagaactcttcgtgagatcaagctgcttcgtcacatggatcatgaaaacgttgttgcaatcag

SEQ ID NO: 21995 - DNA, 400 bp, Gossypium hirsutum
  Clone ID: LIB3272-006-P1-K1-F9
cgcagctttggctaatttcttgagttacgatgtttacgacattgatttgtccgaagtttccgatgactccgaccttaaacttctcttgttacaaagctcggccaaatccgtgattgtcatcgaggatcttgaccggtatttgtcggagaaatcaacggccgtcagtttgtcgggaattttaaactttatggacgggatgttaacctccagctgcggcgaagaaagggtcatggtcttcacaatgaacggcaaggatcacgtcgaccaggcggttctcagaccgggaaggattgatgttcatatacatttccccctatgcgatttcacggcatttaaaacgctggccaatagttacctggggctcaaggatcataagctgtttccgcaagtagaggagatt

SEQ ID NO: 21996 - DNA, 404 bp, Gossypium hirsutum
  unsure (1)..(404): unsure at all n locations
  Clone ID: LIB3272-006-P1-K1-G1
ctcggagatcggacccttgagtcgccggataatcatcgacgactgaccnagactgcgtcggagccaccagaaaagtacttcttaccgtttctacggcgagagagtggatttgaatatattggccgtgttttgagtttcgatggcttcggaggatgtgaagactagtgaatcacctgtatcgacgatcgtgaatctagctgaagaagcgaagctcggttgagaaggcgttaaagctcccagttcttctgttcttagtatctgcaagtctctcgttgccggccgcattgctggtggagtgtcacgaactgtcgttgcttctttggaacgtttaaaaatcttactttaggtttcagaatccacatagtttaaaatacaatggaacaattcaaggcttgaagttcatt

SEQ ID NO: 21997 - DNA, 404 bp, Gossypium hirsutum
  Clone ID: LIB3272-006-P1-K1-G10
attttaactgctaagaataatcaattagaaatccctctcttattcgttctcgggcgctcttcaccgttcggattctacaataaaagaaaccctagcctaggcgtttccgatcaaatcaggggagtaatggatggatcgggtggaagaggaggaagtggagtggataatgtattacctaattacaagcttggaaaaacgcttggaattggttcttttggaaaggtcaaaattgctgagcacattttgactggtcacaaagttgccattaagattcttaaccgaaggaagattaagaatatggagatggaggaaaaagttagaagagagattaaaattttgaggttgtttatgcatcctcacatcattcgactctatgaggtgatagagacagcaactgacatttt

SEQ ID NO: 21998 - DNA, 395 bp, Gossypium hirsutum
  Clone ID: LIB3272-006-P1-K1-G11
ttgaaattttctttctcgattttctctttagccaaaaaagatgcagatcgggggcaagactctaaccggcaagacgatcactctcgaggtcgagagctccgacacgatcgacaacgtgaagaccaaaatccaagataaggaaggcatccctccagaccagcagcgtctgatcttcgccggaaaacagcttgaggacggccggaccttggccgattacaacatccaaaaggagtcaactctccacctcgtcctccgtttgcgcggtgggatgcaaatcttcgtgaaaaccttgaccggcaagacaatcactctcgaggtcgagagctccgacacgatcgacaacgttaaggcgaagatccaagacaaggaaggcatccccccagaccagcaacgtc

SEQ ID NO: 21999 - DNA, 340 bp, Gossypium hirsutum
  Clone ID: LIB3272-006-P1-K1-G12
atcgaactctacttttcctttacacgttccttttcacgcacccttcacagttgtgtgcaaaacccacttgtccttttctatttaaatccctttctccgtttcaaactcaactcacggccaactctatcccatctgccagacctgccttttttccattcccactcttccaaacctcacacgttcagcacctaatttaccacatcctcttgaactactgctctgtgtcaccagcatccaacttcgatgtgaacaacgaggtggactcgatccacctcaagtttgcagaggcaccagcaccaatcccgatggcaatggactctaaaaagaccgtttatttcaa

SEQ ID NO: 22000 - DNA, 387 bp, Gossypium hirsutum
  Clone ID: LIB3272-006-P1-K1-G2
aaaacggagcagacagtcagataagcagagaaaatggaggctgccagaactggggaggacgtttcccctcatgacttcgtcaaggcttacgccgcccatctcaagcgttccggcaagatcgagcttccttcatggactgatattgtgaagactggtaaactcaaggaacttcctccctacgatccagattggtactatatcagagctgcttccatggcaaggaagatatacttgaggggaggtcttggtgttggtgcctttaggaggatttatggaggggctaagagaaatggaagtcgccctcgccatttctgcaagagtagtggatctgttgcccgtcacattcttcaacaattgcagaatgtgaacatcattgatattgatcct

SEQ ID NO: 22001 - DNA, 410 bp, Gossypium hirsutum
  unsure (1)..(410): unsure at all n locations
  Clone ID: LIB3272-006-P1-K1-G3
ntccggaaaaaggaaacaaaagatggcaattgagattcctagagtgaaacttggaactggaggatttgaggtttcaaagctgggatttgggtgcatgagtcttacaggtcacgatcattcagtgtcagatgaagatggcatatccatcattaagcatgcagtcgaaagaggagtcactcacatcgatacagccgacctctatggacccaaaactaacgaaattctggtcggaaaggcattgaagcatctgccacgagagaaggtacagttggctacaaaattcggtgttgaaagcatgggtccagatggtccggttatcaatggcactcctgaatttgttcgttcttcacttgaggctagccttcaacgcctcgatgtggattatattgatctttactatataatcagag

SEQ ID NO: 22002 - DNA, 405 bp, Gossypium hirsutum
  Clone ID: LIB3272-006-P1-K1-G4
gccatctttagcttctaggctgagttcagatacaccaacgatatcagcatcacgcaggatcagtgtcggatcctccattgtcccctttccaaccattatcacctgatattgctcctttgttgccatctcctggtggagtggtgcctactactggctcatctatgccaaccatccctttcaccccaagtccccctaaccccgacgacttcatcgcccccggtccaacctccgcgttcccaccgttcggaccattgccggtttcttcttcatctccaatatttttgctttcgtctctacacttgacaactttttcggttctggtagtaccttactacttactgcacctactgtaaattcatttgttgattgtaatactttactctttaatttgctcatcttccttca

SEQ ID NO: 22003 - DNA, 401 bp, Gossypium hirsutum
  Clone ID: LIB3272-006-P1-K1-G5
gcgttcttcatatggttttcctgtttgtttccatggaaaacctgtaccattaccgtggtaatcatcttattcattcttctcaccatcaaacttttgactcataaaaccaaaaatttgcctcccagtcccttttctctgccaattattggccaccttcacctcatcaaaaacccactttaccaatcactgaccacgttattatccaaatatggccctgttttatatctcaaattcggttgcagacatgtccttgttctttcttctccttctgctgttgaagaatgcttgaacaagaatgatataatatttgcaaaccggcctcggactatggctggggatcttatgacgtacaactacactactttcgtttggactccttacggatcactttggcggaacca

SEQ ID NO: 22004 - DNA, 407 bp, Gossypium hirsutum
  Clone ID: LIB3272-006-P1-K1-G6
gcagatctgtagttgctttgcttttatcgttcacttcagcttcgactcaaaggcgtgactcaccaatacattggctttctccaaggaccagctgcttgatcgtttaaaggagctttcaaatagaattttcccagtatgaacatcccgttgttttgacagttgagctcaggcaaaatatgttgggaatttgggaggtgcattgagcaaaaaatttgttcttgaaggacaagaaacataggtactatgttgtctctgctcttgcagatacaaaagtagatttgaaagttttatctcagaggcttggtttagggaaaggtggtctaagaatggctgcagaagaggcactggttgagatacttaaggttccacttggatgtgttactccatttgccgtggtaaatgaatct

SEQ ID NO: 22005 - DNA, 404 bp, Gossypium hirsutum
  Clone ID: LIB3272-006-P1-K1-G7
aaattttcgtcaagaccctcaccggcaagaccatcacccttgaggtggaaaggtccgacaccatcgtataatgtcaaggccaaaatccaagataaagaaggaatcccaccagatcaacagaggcttatctttgctggtaagcagctagaggatggtcctacacttgctgactacaacattcagaaggagtccaccctccacttggtccttcgtttgaggggtggtatgcaaatctttgttaagaccctcaccggcaagactatcaccctcgaggtggaaagctcggacaccattgataatgtcaaggccaagatccaagacaaagaaaggatcccttcagaccagcatagacttatctttgccggtaagcaactagaagatggccgtaccctggctgattacaa

SEQ ID NO: 22006 - DNA, 401 bp, Gossypium hirsutum
  Clone ID: LIB3272-006-P1-K1-G8
atcggtttcagttcagctgctccgtattatatagtcaactactatggcagcgggaatgtctgttagatacgtttctcgtaggttctcgagtgggagtgggaagatactcagtgaggaagaaaaggctgctgaaaatatttacatccagaaaactgagcgagagaaattggagaaacttgcacgcaagggacccaagccagaggagaaaccggatgctggttcagggggtgctgcaccgatggtagcactacctttacatcgggaacatctgctgagaaagtatcaaccgataagtaccgaaactaccgggttcttgctggtgttgcaacccttggtgctgctgtgggatggtatctcaactcttaagacaagaagcaagaggcctgaaatgggggttaatg

SEQ ID NO: 22007 - DNA, 403 bp, Gossypium hirsutum
  Clone ID: LIB3272-006-P1-K1-G9
gagaactatgatgatgggttcagagaaaatgaataaccccatggaaatagagggcaagaacattgagaagacaaagataagtcttatgagaatcttggttgaaaaacaagatccatcttccaaggaagttgaagatgggacattgagaagatttctaagagctcgtgatttagatgtagagaaagcatcaaacatgttccttaaatacctcaactggaaacgaaactttgttcccaatggttccatttcaccatccgaaatcaggcatgaaatccaacagaataagatgttcttgcaaggttgggacaagaaaggacgaccgatagcccttcttcttgctgcaagacatttccaacatgaaggcggtgtggatgaattcaagcgttttatagtctaccttttc

SEQ ID NO: 22008 - DNA, 263 bp, Gossypium hirsutum
  Clone ID: LIB3272-006-P1-K1-H1
gtgactaaataaaatactatctttccctaaaaaaaggttacctctcaccattagggtggggccaacctgttggaagggctcacccaccagagagccaggagcataccaagatctatatgatgatgctctgggccaccaatgagggtcgggccaaatccaaatactggtacttcttgaggaagctgcaaaagggtatcaagagcaatggtcaagtccttgccattaaagagatatttttgaaaatctctaccaagatcaaaaat

SEQ ID NO: 22009 - DNA, 276 bp, Gossypium hirsutum
  Clone ID: LIB3272-006-P1-K1-H11
caaaacacacggtcttgtgcaacatgtaagtgactgggaacacttcactctggggttaatcaactttttatgggaaccgtcccaaatttacttctcacagcataactgtggtcagtgggtttatgctttcgacctggaatatatttaacgtaataagccaattgtttactcatccagacatggacatgctagttttccgcatccccgaacttaccttcaaaggtcagttaaactcgggataaggattaggaacgatgcttcacgaaacaagtattt

SEQ ID NO: 22010 - DNA, 292 bp, Gossypium hirsutum
  Clone ID: LIB3272-006-P1-K1-H12
attttctaacacctttgcatttgcatctttctttttcacaccagatctgggggtccaagctatggctgaaaaggtgaccataatggtgctgaaggtcgaccttcagtgtagtaaatgttacaagaaggtcaagaaagtgctctgtaaataccctcaaatacgagaccagatgtacgatgaaaaggctaatacggtgaccatcacggtggtatgctgtagccctgagaagatcagggacaagttatgttacaaaggtggtggatccatcaagagcattgaactcaagtcggcg

SEQ ID NO: 22011 - DNA, 317 bp, Gossypium hirsutum
  Clone ID: LIB3272-006-P1-K1-H2
gtaagagtgacacacacactactatttgctgaaggggtaaatacactaatacaagcgctgttcgtaactcggttgcctaccgcgaaaggaaggtcttatgccaagaaggctcccattatatcaataatgcacgacacttccattgtgagcctagaacacaatcacgcgagattattaaacactatgaaagctttccaaggtccattaatacatgcatcaaccatacaaaacctgctgggatacacacatatgaggtccatttactccaggtatttaaaacccctaagaaatgatccagccatttcacaaaccctctt

SEQ ID NO: 22012 - DNA, 404 bp, Gossypium hirsutum
  Clone ID: LIB3272-006-P1-K1-H3
tgcttgcttcatcatctcttcatttcccttgggttttctgagtttggatcaaagtggagaaaaccagtttgagttcattcgctatcagatcggcaaagctccttagactttctgtttctacgacacgcaactcttctctagcgggtgtgcaacgtacctccaagatgtggtattcaacaggttcgcttgatgacttcgaaactgaggaagcgaaaagcgaagagatagatgagattcttggcgacaagcctaacaggcgtgagccactgctccaaggtgtcagacccggaaagggttggaatttccgtggtgtacacaaggcaattatttgtggaaaagttgggcaagcccccgtgcagaagatattgcgaaatgggagaactgtaactatatttactgttggg

SEQ ID NO: 22013 - DNA, 398 bp, Gossypium hirsutum
  unsure (1)..(398): unsure at all n locations
  Clone ID: LIB3272-006-P1-K1-H4
gtactcactcaacattcccattttcaatctccagctcccaaggtaaatatcccgatgagaaacatatcttttttccgtccccaanaagctactcacccctatgctctcaaggctgctttagctaacttcatctcaaccttgatcttcgttttcgctgcatccggctcaggaatggcctataacaagttgactgacaacggagcaaccaccccggctggtctcgtagccaccactctagctcatagcttccttcttttcgtcactctctccgttagcgccaacatctcaggtggccacgtcaaccctgccgtcaccttcagtgctttttttggcggaaacatcactctcttgcgcggcattctatactggatcgcccaactcctaagctcaacctactc

SEQ ID NO: 22014 - DNA, 400 bp, Gossypium hirsutum
  Clone ID: LIB3272-006-P1-K1-H5
aaccataccgttttggtaattcccttatccaacacaaggcgcatgttattggctgtcgtggaactctttccaaaacttagccaaacaaggcatcaaaatcagctttgttaacacagtgtttaatcacaagagggtcctagatgcattctgcgagaaggtggatgaaaatggcttacttcatctactttcagtccccgatggactggaagatggggaagataggaatcagttagggaagttaactgaaagattatgccaggttatgcctactcaactcaaggagctcattcataaggttaatggatcagatgatgataagatttcatgtgttttagctgatattaacattgggttggctcttgatgttgcggcggagttggggattcctacggtgggcttg

SEQ ID NO: 22015 - DNA, 191 bp, Gossypium hirsutum
  unsure (1)..(191): unsure at all n locations
  Clone ID: LIB3272-006-P1-K1-H6
tgcctnaaaataaataattaaataaataacggctttttcttcagaaaacaantaagggtggtcgctctcttcactaaatggtcactctctaaaggcagtacttaattttctactgctccaagtaatatcgcgctatgtaaattctcattaagcaacaagatgagcaacgaccttttttattggctgatact

SEQ ID NO: 22016 - DNA, 326 bp, Gossypium hirsutum
  Clone ID: LIB3272-006-P1-K1-H7
cttccatcttcactccacatttcacactctttttcaactttctcttcttctgggtgttttaaagaggggctggagttttagccaaagaaaactccatggctaaacttgttgctactttcttcttggctctcattgccatctccatggttcaaactttggttatggcatcacatggacatggtggtcaccattatgataacaaacgttattgacctggaagtctcaaaccttaccaatgtccatcttaatgcacaaggaggtgtagccagacacaataccataaaccatgcgtgttcttctgtcaaaaatgttgcaagacatgcctt

SEQ ID NO: 22017 - DNA, 381 bp, Gossypium hirsutum
  Clone ID: LIB3272-006-P1-K1-H8
aaaaaaaaagagaaggaaaaatgatgcgaagtcggttgctatggttcaccttagggttttcggtgacagcggcttcaatctctcaattcatatatagagacctttggactgatcgttacgcccttaaatctgatatgaaggagaaattcgatgctttagaagctagggtttcgaatctggaaaccctccctacggagaatccaaatccagctcaggttgatggctagatgtttatttggggttcacataacttttgtgctttgaatatatttgaattttttgtttcctttttattatatatttgaggttttttgaactaagagttcaaaactctatcaacagaccggatcacccggttgttggcgaatgtatttgatttcg

SEQ ID NO: 22018 - DNA, 278 bp, Gossypium hirsutum
  Clone ID: LIB3272-007-P1-K1-A1
gacacatgttacttatttcacaatccgtggacatctactctggtgttttatcatagtgcctacccaggttgaagttctactacatttagggttctatgaaactaagagcagttggactacccaagaacataataaccaccccgcttctataaagcctacacgcgcccttcactgtactatgttcacctaacattaataagcgtaggccgttttcaaggccaacattgccctggactacctatcgtttaaccccaacaccgctgcacaaaccataatat

SEQ ID NO: 22019 - DNA, 147 bp, Gossypium hirsutum
  Clone ID: LIB3272-007-P1-K1-A10
tatttaaaccctaactttcctttaactttgaacccgggattaacaaaatcctctttcaaatgggaaattgaaggagaacccatggagggcacttaagggaggatccaggtcggtttattaccgaatttaaagcgccatataaaggtt

SEQ ID NO: 22020 - DNA, 191 bp, Gossypium hirsutum
  unsure (1)..(191): unsure at all n locations
  Clone ID: LIB3272-007-P1-K1-A11
cttgaatgtagggatttgcgggtggagaagacgagagctcatctctctgcttcaaagctcctgtccgggtagaattctcttcttcctttgcgttgtgttctttgttgttcaatcgccatggcttcaaagcggattttgaaggaactcaaggatttgcagaaagatccacccacttcttgtantgctagtcc

SEQ ID NO: 22021 - DNA, 311 bp, Gossypium hirsutum
  unsure (1)..(311): unsure at all n locations
  Clone ID: LIB3272-007-P1-K1-A12
ctgccatcaatttgctctgaagatcatgttggctatttttcacaaggcatttgctaatccaccagaggagctgaatagtccagcttctcataaatctaccaagaagcctaaacagcctgaagaaaccctaaatgatttcctatctcatcaccctcacaacactttctccatgagctttggcaacgctgctgttttggcttatgtccgccatgaacgtgctgcttcagttcatcagaggttgttttgtgggtttgatgacatatactgcctcttcttagggagctngaacaatctatntatgctgaatagac

SEQ ID NO: 22022 - DNA, 404 bp, Gossypium hirsutum
  Clone ID: LIB3272-007-P1-K1-A2
ggaggagttggactttcaggcactataaagtataaatctctctctctatctaatcattccccttttactgttttactctttacaaattttcctctcctttttcgtgtttttactcttaattttgctttttgttttggattgtctcttctgaatcagagaaaaccctacctttttttttctcttttatttctttgaattggaacgatcaaaagaaggaatgggttctgaaggatcgagggttgttgtgccaaggaatttcagattgcttgaagagcttgagagaggtgaaaagggaattggggatggaactgttagttatggaatggatgatgctgatgatatttacatgcagtcatggactgggactattattggcccgcctaacacttgtcatgagggacgca

SEQ ID NO: 22023 - DNA, 414 bp, Gossypium hirsutum
  Clone ID: LIB3272-007-P1-K1-A3
tttatcaatagtgtttcaaactccagtttgcttctccttttgctcataatttcatctgtgatctcttctttttctttgctcttttagccctattttcctaccctcaaattgttgcagtctcgtccatctgaaacaatttgctaaatattattatcaatatgttccttctctaaatggagaaacaaatacaaccctttttcggtgtctctctagtttgattgtttctttctttcaatctctttgttattttattcagttatctgttatggaagccatgcagaatcttgcatttcatcattgcttgagctatcatcgtcacccatatacctgaagttcgaaaaaaaggctttgaaactgttctccctccttaattatctatctaggttctgtgaggtaatcctgatcgggttattt

SEQ ID NO: 22024 - DNA, 358 bp, Gossypium hirsutum
  Clone ID: LIB3272-007-P1-K1-A4
tatttaaaccctaactttcccttaactttgaaaccctgattttcgtctcctctttcaaaatggaaattgaaagagaaaccaatgaaggcaactcaaggaggattcaagtccgatttataacgaaattaaaagcaccatataaagttccgacaacagccattgccatcccttctgacctctctcgtataggcctttcctccattgttaacaagcttcttcaagctgcagtggattctgagtggaaaaccgagccctttgatttcctgatcgatggggagctggttcggatgtcacttgagcagtttcttcttgtcaaaggcatttctgcggagaaaattttggaaattgaatacataag

SEQ ID NO: 22025 - DNA, 321 bp, Gossypium hirsutum
  Clone ID: LIB3272-007-P1-K1-A6
ggcggaatcacccgctgagtgtaatctttttaataatccgaaaaaaaaaagggggccatgattcccctggggacggtcaccccaccccgaaaagctcttcgttggaaaatcgccatggcttcaaagcggattttgaaggaactcaaggatttgcagaaagatccacccacttcttgtagtgctggtccagtagctgaagacatgtttcattggcaagcaacaatcatgggaccctcagatagcccttatgctggaggtgtgtttttagttactatccatttccctccagattatcctttcaagccttctaaggttgcgttt

SEQ ID NO: 22026 - DNA, 409 bp, Gossypium hirsutum
  Clone ID: LIB3272-007-P1-K1-A7
ctggaatctcttgaaaagatcaagtttaaaaaaattgttctgttacatggagaaggctttggagcttggtgttggtataaaacgattgctcagttggaggaagtaggccttcagcctactgcactggatctcacaggctctggtattgatctgacggatacaaacacagtcaccacattggctgaatattcgaaaccattgattaagtatctagagaaccttcccgtagatgagacggttatcttggtaggtcatagcagccgaggtgcttgcctttcatatgcatcggagcatttcccggaaaagatctccaaagcaattttcctttgtgctacaatggtgtccaacggtcagagaccttttgatgtgtttgccgaagagcttggatctgctgaacgtttcatgaaag

SEQ ID NO: 22027 - DNA, 405 bp, Gossypium hirsutum
  Clone ID: LIB3272-007-P1-K1-A9
gaaagtacccgtgcctaaggttgagaaagtgaggattaagtgtttggggtatcaagaaagggctaagatttctaagaatccaactgggaaaaagctgtttgagattatggttaagaaagagagtaatctctgtttggcggctgatgttgccactgctgctgagttgcttgatattgctgagaaggttggacctgaaatttgcctattgaagacccatgttgacatattccctgatttcactccagagttcggttctaagcttcgcgcgattgcagaaaaacataacttcatgatatttgaagaccgtaaatttgcagacatcggtaacacagtaacaatgcagtatgaagggggtatcttccatatattggattgggctgatattgttaatgctcacataatctc

SEQ ID NO: 22028 - DNA, 395 bp, Gossypium hirsutum
  Clone ID: LIB3272-007-P1-K1-B1
agcacttgttcttctttttcttttcgttggagatctcggcggagatggggaaacgacgctgtgttgtggcggcattagcagcgataatgttgatgatggagttagcggcgttgacagtagcagaacacagaagaagtatgttgagtaatggtcttggaatgactcctcccatgggttggaacagctggaatcactttggatgcaatattgatgaaaaaatgatcaaagaaactgctgatgctctagtttcaaccgggctctccaagcttggatatgaatatgttaatatagatgattgctgggctgaaatttcccgtgatgacaagggtaatctagtgcctaagaagtcaacatttccatctggaataaaggctcttgcagattatgttaacaag

SEQ ID NO: 22029 - DNA, 307 bp, Gossypium hirsutum
  Clone ID: LIB3272-007-P1-K1-B10
ctcggctctcgattcccccaaaatccagctcttcctttcgtgaatcaaagattctcaaagatgactcaagatgtggagatgaaagagcaaccagctccgtccaattccgttccttcctcttctcctttcactttgcaccatttgaaggaaattgcgtctctgattgagaccggtgcttatgaccgtgaagctcgccgtattttgagggctatacgacttacaatggctttaagacggaagttgaaagcatccgtgctatcctctttcctcagttacgctcttacccctggatccgaggccttcactc

SEQ ID NO: 22030 - DNA, 299 bp, Gossypium hirsutum
  unsure (1)..(299): unsure at all n locations
  Clone ID: LIB3272-007-P1-K1-B11
cacaaagggtgcctttgtgcaacccgcattatatgaagcctttgggttgactgtcgttgaggccatgacttgtggtttgccgacattcgcaacttgcaatggtggacctgccgagattatcgttcatggtaaatccggcttcaacattgatccttaccacggcgaccaagctgctgagatccttgtcgacttctttgagaaatgcaagacagatccatcttactggaccaagatctccgagggaggtttgaaacgtatcgaagagaagtacacatgggaaaatntactctgagagacta

SEQ ID NO: 22031 - DNA, 306 bp, Gossypium hirsutum
  Clone ID: LIB3272-007-P1-K1-B12
gccaaagagaaagccgagtgtggccgaataaaatgtttgcaagattgcattgcttcctgatctcacccttgctaccagtgagaggattgttctcagagaggagagtaatggcccttgagaactccttgaagaaatagtcttggctcttggccattttcttcacataaggtctggtccttttgtcgtacgccagttggtgatccacaatcaacaaacccttgttgtccagtatgatcctggagtagttgtatccaaaaccatggagtgtccacggtcgtttctcacatacttgaccggcttggggtc

SEQ ID NO: 22032 - DNA, 370 bp, Gossypium hirsutum
  Clone ID: LIB3272-007-P1-K1-B2
ctcacatccttgtgtcatggcagcaccttccagcattccccttaagttcactgtccgacgttgtgaaccagaacttgttgctcctgctaagcctacgccatatgaacaaaaactgttatcagacattgatgatcaggcgagtttgcagtttcaagttccggtaatcaacttttatcaatatgaaccttccatggaaggaaaagatccagctgaggttattagggaggcaattgcacaaaccctagtgtgttattatccatttgcaggtagattaagagaaggggccactggtaagcttatagtggattgcaccggtgagtgtgtgatatttataaaagccgatgctgatgttacacttgaacagtttggt

SEQ ID NO: 22033 - DNA, 366 bp, Gossypium hirsutum
  Clone ID: LIB3272-007-P1-K1-B3
gcaggatatatattttccggcgatatgatccgagccttggaggcctatggcaatgacctggtgaattcagtgatgggtcgagctgaagatatatgtggcaaatttagcagcaatataaaagtggaccgaattgttggaagtggagatgcaagggacgttatatgtaatatagtggataaaatcaaagcagatacgttggtgatgggaagccatggttacggtttcttcaaaagggcgatattaggaagcgtgagtgatcattgtgccaaacatgttaaatgtccagtggtgatcgtgaaacatccagagaagatataaagcttattcttcattgacggagatatggcttttactaccatgtacacc

SEQ ID NO: 22034 - DNA, 335 bp, Gossypium hirsutum
  Clone ID: LIB3272-007-P1-K1-B4
gccatttcgaaaaccttatcttttgagaacgaagtttaaaggaaccacaccagccatgtctgcaacatctgcctcatctcttattctcccatcgctcaaacccaaagttttatctttatccgactcaactcccaattcactttccctcttctccctttctccaaccccccatgcaaagcctctcttttgttctgctcttccaagtttccagcttttaaccaaaaagtcctctttttcttccaggttccttacaaaagttgccgtttcttctgagtatgaccaggaagaggacttatttggcagcgatgatgaagaaaggtctcctactttctccc

SEQ ID NO: 22035 - DNA, 364 bp, Gossypium hirsutum
  Clone ID: LIB3272-007-P1-K1-B6
gaaaaaaatccctaatcaaaaaatggggaaattgtggctaatttgcattgcttcgatctcaatccttctcccatttctctgcaatgctttctctcccgaatcgccaacggatcgccgagtccttgttctcctcgacgacttcgccatcaagtcgtcacactccctctacttcaatgccctcaaatcacgtggcttcgacctggaattcaaactcgccgatgatccaaagatcgccttgcaacgctacggccagtatctttacgatgccttgatcctcttcttgccctccgtcgaacgatttggaggatctattgatggtgcccgcattggcaattttggtgattcccgtcatgaattaattggt

SEQ ID NO: 22036 - DNA, 412 bp, Gossypium hirsutum
  Clone ID: LIB3272-007-P1-K1-B7
aaaaaaaaaacgaagaaaatggcgtccctctctgcccaaatccctccctgcttggccttaatgatggctgcctgtttgatgataggcatcaatggaagcatagatggagctcagagggagttcgattactttgctttgtctcttcaatggcccggcaccatctgccacaagactcgccattgctgctcctccaatgcctgctgccgaggctcaaactctccaactgaatttaccattcatggtttgtggccggattataatgatggaacctggccctcctgttgttaccgatctcagtttgatgtcaaagagatttcaacattgcttgatgcacttgagaagtactggccatcgttatattgtggcaaatcatcaacttgcttcagtggaaaagggttattttgggctcatg

SEQ ID NO: 22037 - DNA, 320 bp, Gossypium hirsutum
  Clone ID: LIB3272-007-P1-K1-B8
gctttatttcctcttttgttctttctctaacttttgctctgcatctaactatatatattttgctcgaattatttccatccttcatacattatagaggcttttttgtttctgtttgcttatttcgattggtggattgatggtagctggcctatgtaacgtgtgccacattcacagatctaagtttgtagtcatatcaccgacaactgtcccgggctggtaggggctttatataactataccgaactctaactgaatagtgaatgaatgagcgcaatatagatcccttaccgaggatccaatagaggtcgagattgttgcca

SEQ ID NO: 22038 - DNA, 395 bp, Gossypium hirsutum
  Clone ID: LIB3272-007-P1-K1-B9
ctcgtaagtaataaggataaacaaaaacccttctgatcattaaaattagggttttagcaacaaataaaagcaaccatcaccgatgattcatgcagcagttaagctatcgaaatcggtcatttccctgtctcgaacttcctcagtagctgcaacttcatcgcagcctttgagattcctccacgatggaaccaacggtcccagttccaacccagtcgctgttcagatgatcaattacgctctgtcacatgccaggtcccagaaatcagatgaatcatatgctcaaggcatgttgatattggagcagtgtctttctactcagtcaagtgaaagtgaaggtcaatttgctcaaaattctattggagcggtgttacttgcaatgtctaatttgttatatg

SEQ ID NO: 22039 - DNA, 315 bp, Gossypium hirsutum
  Clone ID: LIB3272-007-P1-K1-C1
ctttgaagcttttcatggaagctgggattgatgaactcgctaagatgtcgttcgaggatcttgataaagctaaggctacaaaggacgacattgatgttagacttaaatggctcggcttgttccataggagaaaacatcaatatgggagatttatgatgagactaaaactaccaaatggtgtaacaacaagtgcacaaacactgtacttagccagtgtgataaggaaatacggcaaagaagggtgtgccgatgttacgacaaggcaaaactgtcaaatccgtggagcggagttgcctgatgtgcctgaaatactta

SEQ ID NO: 22040 - DNA, 324 bp, Gossypium hirsutum
  Clone ID: LIB3272-007-P1-K1-C10
ctcgccgtctcgcctctcgcttattggttcaagatctggttttgatctgatcagatcggataaaaatatcaaaacatgtttgggagagcaccgaagaaaagcgataataccaaatactatgagattttgggagtatcgaaaaacgcttctcaagatgatctaaagaaagcttatagaaaagccgctattaagaatcatcccgataaaggcggcgatcctgaaaagtttaaagagttggctcaagcttatgaggtgctgagtgacccggagaagcgtgagatttatgatcagtatggggaggacgcccttaaagaaaggatgggc

SEQ ID NO: 22041 - DNA, 296 bp, Gossypium hirsutum
  Clone ID: LIB3272-007-P1-K1-C11
ttgtaatgtaagcaccttctttcagtatacaagaaacgcaaaaaggaaaccccagaaaaatgagaactagcaaccatttgatagggttactaaacttcttaacatttttgttgtcaatagtaatattgggtggtggaatatggctaagcagccgagccaacagcacagattgtctcaagttcttacagtggccattgatagtcataggagcttcaatcatggtggtttccttagcaggtttcgcaggcgcgtgttataagaacaccttcctgatgtggctttacctcttcgtcatg

SEQ ID NO: 22042 - DNA, 326 bp, Gossypium hirsutum
  Clone ID: LIB3272-007-P1-K1-C12
cttttctcttcacccttacttttctcctcttcaccttctctcaagcccgcttcatcacatctgaatcccaacatgatgtcacccccgaaaaatccgttaccgattttcccgaatccgaccccgaatccgccatccttctccccagcgagaaaccccactttgaaccccccaaattactcgacttcaagcacgatgatgatgcctccggcgtcgcctccgttcctttgaccaagatcagttttaaccctgtcaaccgccacttcccaaggcgtcccttgattccgttccgtcacaagcacaactgccgtttccataaacgctttcat

SEQ ID NO: 22043 - DNA, 416 bp, Gossypium hirsutum
  Clone ID: LIB3272-007-P1-K1-C2
atacctcactgcccctaaaatttaatcgaggagatctcgttgttctttagctccggtttgcagccatggctactctagattccgatgtgccgatggtgcccgccggtgaagcttccggtagctccgccgcgtcttcctctactaagaagcccaagcgcttcgagatcaagaagtggagtgccgctgccctctgggcctgggatattgtggtggataattgtgcaatttgcaggaatcacattatggatctctgtatcgagtgccaagctaaccaagccagcgccaccagtgaggaatgcactgttgcttggggggtctgcaaccatgcatttcacttccattgtatcagccgatggctcaagactcgtcaagtttgcccattggataacagtgagtgggagttccaaaagtatggg

SEQ ID NO: 22044 - DNA, 399 bp, Gossypium hirsutum
  Clone ID: LIB3272-007-P1-K1-C3
gactcgtgatgttgaggaagaactaattcccctttgcagggaactcggaattgggattgttgcatatagtccccttggtcatggtttctttgccggtaaagcaaaggaggatacctctaatagttctctgggagtgttcccaaggtttcaaggagaaaacttggagcaaaataggatcctatattcgaaagtagagaagttggctggaaagcatggatgtacaccggcacaacttgcacttgcctgggttcttcatcaaggggatgatgtttctcctatacccggaacaaccaagattaaaaatctagacagcaacattgaatcagtgaaagtaaagctgacaaaagaagatttgaaagaaattacagatgcgatcccaatccatgaggttgcaggggg

SEQ ID NO: 22045 - DNA, 243 bp, Gossypium hirsutum
  Clone ID: LIB3272-007-P1-K1-C4
gggggaagcccgtccgacagcgcgtccagcgcgagcttcgaaagggaatcgggttaaaattcctgaaccgggacgcggcggctgacggcaacgttagggagtccggagacgtcggcgggggcctcgggaagagttatcttttctgtttaacggcctgcccaccctggaaacggctcagccggaggtagggtccagcggccggaagagcaccgcacgtcgcgtggtgtccggtgcgcccccggc

SEQ ID NO: 22046 - DNA, 232 bp, Gossypium hirsutum
  Clone ID: LIB3272-007-P1-K1-C5
tcggtggaagggtagcctctttcttattggttcaagaactggttttggtctgatccggtccgattaaaatatgaaaacatttttgggagagcacccaagaaaagcgattatacccaattcttttagattttgggaggttcgaaaaacgcttcttaaggtggtctaaagaaaggttattgaaaagccggtattaagaattattccgattaagggcgggattcttgaaaggtta

SEQ ID NO: 22047 - DNA, 197 bp, Gossypium hirsutum
  Clone ID: LIB3272-007-P1-K1-C6
tttctttccgacaacgtctgtgatgtctgccagtgctacttagggcttcgtcttcttcttcttctttcttcatctccatctttatcttcatttcagggttgttgggttacgtttttttcctattggttgggacgaattattgaatcatgagataaccttcgccgctggaacggctgaggcagaggtacatctctgca

SEQ ID NO: 22048 - DNA, 394 bp, Gossypium hirsutum
  Clone ID: LIB3272-007-P1-K1-C7
cttcaatcctcatagcaattagctatggcgactaggactttttttctctttatttgattcttctcctctcctctaagcccggtcttttctctttatgaagatcaagtaggtctcatggattggcatcaacaatacatcggcaaagtgaagcaggcagtgttctcctctcaaagagctggtcgaaaacgagttgtagtttccaccgaagagaatgttattgcttcacttgatctccgccacggcgagattttttggagacatttgcttggggctgatgatgttattgatggaattgatatcggtcttggccaatatgtcattaccctttcatcgggaggaagtattctaagatcatggaaccttcctgatgggcaaatggggtgggaatcttcac

SEQ ID NO: 22049 - DNA, 397 bp, Gossypium hirsutum
  Clone ID: LIB3272-007-P1-K1-C8
aaaaaagttatacatacttcccctttcttgcggttctctctctcttccactaactttttttttttggtccacagctattctgatcgaaaccaattaaaggaatcgcaggtgggactgatagaggtttgtgtattgcctgcatggagacacccgccatggctacgcagacgcaggcaccaaaacttaatcagaaattgaattattccatggttggtaaagagaatgatatgatgatgataggtggtctaatttctaagaagtctggtattgatttgatgcaaaactgtgatctccctccacctctcaaggtgtttgctgggttggataaggcggtggagttgatgtcgttgaataacagggcggtttatagcatcatgggacaagaggacgattaaaa

SEQ ID NO: 22050 - DNA, 384 bp, Gossypium hirsutum
  Clone ID: LIB3272-007-P1-K1-C9
ctttaagacgttgttatcacacatggacgaatttccagggatggtgtatgctacatttaaaggagactcaacaaaggatgctgatgctgcttttgatctcttggaaactgctcttgcaaaatatgatggtccattcctcctaggcaacgagtttactctggcggacattgccttcattccttttgtcgaaaggttccagatctacttatcagaggtgtttaattatgacctcacagcaggcaggcctaaagtggccgcatggattgaggcggcggacaagatcgatgcctataagcagacaaagaaaactgatccaaaagaattagtggaaatttataagaagatattctcaccccagaagtgaagatgaaattggcaccatgt

SEQ ID NO: 22051 - DNA, 166 bp, Gossypium hirsutum
  Clone ID: LIB3272-007-P1-K1-D1
gaagatgtatcgggaggatgaggaggatgtctagtgtgtgggtttggatttatttgcatatgaaatgtgatgttgtctgctatttgttatgtgaattgcttcgttatttctacgttagaggacttctataacttatttttctttcaaattctattgccaattatat

SEQ ID NO: 22052 - DNA, 298 bp, Gossypium hirsutum
  Clone ID: LIB3272-007-P1-K1-D10
ggagaatagcggcattcactaggccaacccaggagcatgaatcataatctggtgtggatgctttggccaatgctgctacccttggagacaatgcagataattcaggcacaacgtcagtggcaactactactaaacatccaaggcatcgtcctggttgttcttgcatcgtatgcatccagcctccaagtggaaagggaaaacacaagccgacatgcacatgcgttgtgtgcatgacagttaaacgtcgttttaaaaccctcacaatgcgcaagaagaagcgtcaatcggagcgtgaagc

SEQ ID NO: 22053 - DNA, 264 bp, Gossypium hirsutum
  unsure (1)..(264): unsure at all n locations
  Clone ID: LIB3272-007-P1-K1-D11
aaaaccccaacccctcttccttttccactcgctctcttttccttgtcaccaaaaaacatctttctggtcaattcaatcctccttttttctattcaaccataatgtcttgcttcattagcaaatacgccgatgagttggctaaaaacgctgcttacattggcacccctggaaagggtatccttgctgctgatgaatccaccggcaccattggcaagcgtctntcaagcattaatgtagaaaatattgaagaaaacaggcgtgctc

SEQ ID NO: 22054 - DNA, 293 bp, Gossypium hirsutum
  Clone ID: LIB3272-007-P1-K1-D12
taaaaattgaaatcataaacaaaaacacttgcagttttctgaatggggacgatagttcaaactaccgttgtcactgtttttctttgtcttctttttcctattgtcttttccacatccaatgacggattgttcagaattggactgaagaagagaaagtttgatcgcaacaatctgttagctgcccaacttgattccaaggaaggagaagcgttgagaggttcttttagaaagtatcttcatggcaacttacaggagtcaaaggatattgatatagtggcactaaaagaactaca

SEQ ID NO: 22055 - DNA, 361 bp, Gossypium hirsutum
  Clone ID: LIB3272-007-P1-K1-D2
cttgcaagctgtgtgaggcggcctaaatttattttatgcagtggtggaaacccttcagcttacatccccacttatactgctcaaaattcaccctccagtgcactattttctggaaacatttggagaaacttgtcttcgtggatgccgcagagggggacaacagctcagccggcacaagatgatcccagatttcctgggagaggcagaactcttggttctgttcaaaatactgctgtaaattcagattctaacttacaagctaggcttttggataatagtagacccactagtccatcagatattgcagcagctggtgctggggagaggctttcaaatgaaaggcagttacaagtgagtgatg

SEQ ID NO: 22056 - DNA, 262 bp, Gossypium hirsutum
  Clone ID: LIB3272-007-P1-K1-D4
cggacgcgtgggcttctttcctcctagcccaaaaaaaaaaaaccctctttcctttctctcgttctttttcccgttcaatcatgtcttgcttcattagcaaatatgccgatgagttggctaaaaacgctgcttacattggaacccctggaaagggtatccttgctgctgatgaatccactggcaccatcggcaagcgtctttcaagcattaatgtagagaatgttgaagataacaggcgtgctctccgtgagctcctattcac

SEQ ID NO: 22057 - DNA, 216 bp, Gossypium hirsutum
  Clone ID: LIB3272-007-P1-K1-D5
ccagcgcgagcttcgaaagggaatcgggttaaaattcctgaaccgggacgcggcggctgacggcaacgttagggagtccggagacgtcggcgggggcctcgggaagagttatcttttctgtttaacggcctgcccaccctggaaaccgctcagccggaggtagggtccagcggtcggaagagcaccgcacgtcgcgtggtgttcggtgcgcccccg

SEQ ID NO: 22058 - DNA, 270 bp, Gossypium hirsutum
  Clone ID: LIB3272-007-P1-K1-D6
ctactcgtctgttgcacaaagaattggggtttacactgcccgggactatgctgatatagttgaatatctggttgaccgatggaagttgaaggaactcattggactttcacctgagggccgtgaagctcaggaatttgtgtgtggacttgcaccgagaattagaaagttagaggagagagctcaattgagggccaaggaatcacccagtgttccattcagttgggtttctggtagagaagtgacgctctaaattggctatcctccaagtga

SEQ ID NO: 22059 - DNA, 380 bp, Gossypium hirsutum
  Clone ID: LIB3272-007-P1-K1-D7
gtcaatgaatagcgtccccaaaaaggtcattgcacatcttctgaagcctcgtggttggaaaccaccagtttgtcgacagtttttcttagactgcaacgaaatagcagatctgtgcgaaagtgctgaacgaatatttgctgttgaaccaactgttctacagctgacagctcctattaagacttttggtgatctacatggacaattcggggatcttatgcgtctttgcgatgaatatggtgcaccttcaacagctggagacattgcgtatatcgattatctattcttaggagattatgtggaccgtgggcgacacagcttggagaccattactcttctgcttgcattgaaggatgagcatcccaattatgtacatttaattc

SEQ ID NO: 22060 - DNA, 301 bp, Gossypium hirsutum
  Clone ID: LIB3272-007-P1-K1-D8
tctcctttctatcgacacacgacccttccgttacgtctcaagctctctcttcctgtcttcgtctacttcgcctctttctctatggatccctacaagcaccgtccatcaagtgctttcaattcaccattctggactaccaattctggcgctccagtttggaataacaattcatctctcactgttggacccagaggtccaattctccttgaggactatcatctggtggaaaagcttgccaactttgacagggagcggattccagaacgtgttgtccatgctaggggagcaagcgcaaagggtt

SEQ ID NO: 22061 - DNA, 155 bp, Gossypium hirsutum
  Clone ID: LIB3272-007-P1-K1-E10
gcgcgaacttcatcttcatcttaatcttctctggtcggccttccaggaaaaggaattcaaggtcggagtcttggacaggtttcttttgggtagctcctgttgggccaacacttttgccccccatatggagatcctggttacggaaggtcttaccg

SEQ ID NO: 22062 - DNA, 224 bp, Gossypium hirsutum
  Clone ID: LIB3272-007-P1-K1-E11
tccgcctcaacccccgttgtaaccttcccccccctcctccgccgcagcattctcctctgtacagatatgaaattagcttagattaaaatttctttggggggttttggggttttcgtctttgtgatcagttcttttttttccttttaaattttccgatggcttctacgaggaaagatatggatcggatcaaaggtccatggagtccaaaagaagatgaagcttta

SEQ ID NO: 22063 - DNA, 325 bp, Gossypium hirsutum
  Clone ID: LIB3272-007-P1-K1-E2
cttcctcctccactttcagatcaccaaaaccttcaacaatgggctttgttaaggctcaaaaaaaccaaagcttactttaagcgttttcaggttccattcaagagaaggagagagggaaagactgattacagggctaggattcgcttaaccaatcaagacaagaacaaatacaacacgcctaaataccgattcgttgttcgatttagcaacaaagatatcaccgcacaaataatttctgccaatattactggtgatatggttcttgcttcggcttactcacatgagcttcctcgttatggacttgaagtcggtcttacaaactatg

SEQ ID NO: 22064 - DNA, 310 bp, Gossypium hirsutum
  Clone ID: LIB3272-007-P1-K1-E3
ttcaaaattaagggtttttagtaaccaaatatgattggccttgggagttacggttacactgcaccatcttccaaaaaaatcaacgcctacgatgttcctcaaggcgtcgatattcgtggtcgattcgatgaagaattcgctaagattttaacaaaggatgccttacaattcgtcgctgatttgcagagagagttcaggaaccatattaagtacgcgatggaatgtcgcaaagaggcgaaaagacgacacaatgaaggggcgttgcctggtttcgatcctgcaacgaggtatattagaagaggggaatgga

SEQ ID NO: 22065 - DNA, 267 bp, Gossypium hirsutum
  Clone ID: LIB3272-007-P1-K1-E4
aaaatccccctttctgaatctcttctctcaaaagtgtgaaaggaaaaagaggagggcaacagagtctttgaaacgatgtctttttcgtctcccatgaggaaaacctcctgcctgcccccaatatgaagatcttgttcacgaaagttctaacgaacaccgatgtagagaaaagattggcggttcccaacaattcactgaagcatttcgagcttgaaaatggtaattgctccaaaatttttggagttaaagatgaaaacggaagcacat

SEQ ID NO: 22066 - DNA, 223 bp, Gossypium hirsutum
  Clone ID: LIB3272-007-P1-K1-E5
ccccaaaaaaccccgttgtaaccttctctctcctacgacggcgcagcattctcctctgtacagatatgaaattagcttagattaaaatttctttggggggttaagacgctttcgcctttgtgatcaggtcttttttttccttataaattttccgacggcttctacgaggaaagatatggatcggatcaaaagtccatggagtccataagaaaatgaagcttta

SEQ ID NO: 22067 - DNA, 299 bp, Gossypium hirsutum
  Clone ID: LIB3272-007-P1-K1-E8
gctctctcatcctgcttctggtcaagccaatctcaaaagactccccttttagctcacagctctctcgagttctgtaatgggtaaggagaaggttcacatcaacattgtggtcatcggccatgtcgactctgggaagtctacaaccactggtcatttgatctacacgcttggtggtattgacaagcgtgtgattgagaggtttgagaaggaggctgctgagatgaacaaaaggtcatttaagtatgcatgggtgcttgacaagcttaaggccgaacgtgaacgtggtattaccatcgata

SEQ ID NO: 22068 - DNA, 355 bp, Gossypium hirsutum
  unsure (1)..(355): unsure at all n locations
  Clone ID: LIB3272-007-P1-K1-E9
aacaagacaagtggactggttgcttccctgtgaagtggcacatcattaaggacgtcccaaacactttgctgaggcacataacacttgagaacaacgagaacaagcctgtcactaatagtagggacacccaagaggttaattttgagcaggggatccacattcttaaaatttttaaagatcatcccagtaagacgtgcattcttgatgattttgaattttatgaagctcgtcaaaagacaatccaagagaaaaaggctaagcatcagctgttacaagaaaaggttttgagtggagagcctaatgatngctgtatggagaagaaagaaatgtggaatagcaaagacgctcggaaaat

SEQ ID NO: 22069 - DNA, 304 bp, Gossypium hirsutum
  unsure (1)..(304): unsure at all n locations
  Clone ID: LIB3272-007-P1-K1-F1
tttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctattgatgttgacattggtgccaatccttcagccgaagatgctgatgaggatgaaggtgttgatgaccaatctgtgaaggttgttgacattgttgacactttcaggcttcaggagcanacccctttcgacaagaagcagtttgtcgtgttcatgaagaa

SEQ ID NO: 22070 - DNA, 399 bp, Gossypium hirsutum
  Clone ID: LIB3272-007-P1-K1-F11
attaaaacagagaaaggaaagcagcgaaatgggtgaagaagtgaaggtttttggatattgggcaagcccttacagctacagggcagagcttgctttgaagttgaaaggtgtttcttatgagtacataaatgaggatatctttggcaacaagagcgatttacttttgaaatacaatccggttcataagaaagtcccagttcttcttcacaacggaaaatcaattgtagagtctgttgttattcttgaatacattgaggaaacttggaagcataatctttatttgccacaagatccttatgacaaagctaccgctcgattctggatcaagttcatcgacgaaaagtgctttcctaccctttggctagctgcatggagccccgagaatgagcgagaaaaagt

SEQ ID NO: 22071 - DNA, 256 bp, Gossypium hirsutum
  unsure (1)..(256): unsure at all n locations
  Clone ID: LIB3272-007-P1-K1-F12
ccgaccggcnncggaaaaacgggnggacccacgcgtgcgtctgtctcccctatcgctcttttgtattgatcagatctcttcaaacccatcaattcaaacagccgtccactcattccatgcatgacgcttggctcatgaggatccagtgttgtggtgcctcggaacttcagattgctggacgagcttgagcgtggagaaaaaggtattggagacggtactgtcagctatggaatggatgacggagatgacatttaca

SEQ ID NO: 22072 - DNA, 359 bp, Gossypium hirsutum
  Clone ID: LIB3272-007-P1-K1-F2
agaacattagcctttttagcccttttgccccccttttttggttacaccccattcccgtctcttcgcagccactgtttgtcacacagattttttgaaaataatggaccggtaccaaaaggtagagaagcctaaagctgatacacccataaacgagaatgaactgaggattacagctcaagggaggatgaggaattatatttcttacgccatcactctgcttcaggagaaaggtgctaatgagattgtgcttaaagccactggtagagctatcaacacgactgtcatgattgctgaataattaagagggagattgcttgtcttcatcaaacacatcgacggatcgatagctaactgcacat

SEQ ID NO: 22073 - DNA, 369 bp, Gossypium hirsutum
  Clone ID: LIB3272-007-P1-K1-F3
ggaaaatgaagggaagaaaagcagcataaaggtgaagatagttcttacaaaagaggaactagacttgttattagtgaagctgaagaacaagggtaatggtgggaagagcttagaggaaattttgggtgaaatagagaaagccagatctgagaaacttgactcttcatggaaaccttcgttggagagtatcatggaagacgacgatgtcattaattcatgaaactttcaatcccttttctgtaaattaccctctctcttttttttttttttttacgttcatatactattatacttgcgtaactcgatgacaaagtatttaccagacctctccccaccctttttattttctctggaaccttggcattgagc

SEQ ID NO: 22074 - DNA, 295 bp, Gossypium hirsutum
  Clone ID: LIB3272-007-P1-K1-F7
ctccaaaccgcatgtctactcgctctcgttctttggctactgaggatctgagaagcttcatcgccaaattttacagagttcattgaaacaaattagctagtttcatgggtttgtcgtctattggcactgctactgaaggcatgcaactctgcatatttgatttgagaagaggccaacatgaagggcaagaacttgataaaattttgtacttctttcctactgattcgcccttttcgactcaactctctggggctgggctcagcgaagggcttattacattcacgcgaattttctc

SEQ ID NO: 22075 - DNA, 264 bp, Gossypium hirsutum
  Clone ID: LIB3272-007-P1-K1-F8
gacaccacataccgtagccgtagtaccttcaattttctgcctgctttaggtgagtgcaaagataaatggtagaaacaggggacaactatgcttacgaggaggagctttttgattacgaggaagaagaagagaaagcccctgactctgtcactgctaaagtcaacggcgagggcggcaagaagggctatgttggcatacacagttcacgattcagagacttccttctgaaaccagagcttcttcgggccatggtctactctagat

SEQ ID NO: 22076 - DNA, 342 bp, Gossypium hirsutum
  Clone ID: LIB3272-007-P1-K1-F9
cttcttctcttatttgaactcaaagtcccagctaatattagaatcatgggtgttgtcacttatgactatgagaatacctccccagtcgcccctgccaggcttttcaaggcctttactgttgaagctccgaaagtttggcccacggctgcacctaatgcagtaaagagccttgaggttgaagctaatcctagctctggaagtatcgtaaaaatcaactttgttgaaggccttccattccaatatatgaagcaccagatcggaggacatgatgaaagtaatttttcatacagttacgatttaatcgaaagtgggcctttggggggataagcttgaaaaaatagc

SEQ ID NO: 22077 - DNA, 250 bp, Gossypium hirsutum
  unsure (1)..(250): unsure at all n locations
  Clone ID: LIB3272-007-P1-K1-G11
ccgcccggaacgncngggncgggcacgcgtgcgtnnttctcttgcgacactgctaatattttttttattgtcgtctccggcgttcgaagatcataaaaaaccggagtcgtttcaaatggctacgagaacggatctagatgggaggccaataaagccgatgacgatatgcatgatcggggccggaggcttcatcggctcccacctttgcgagaaattgatgtcggagacgccgcacaaggtgctcggcttg

SEQ ID NO: 22078 - DNA, 310 bp, Gossypium hirsutum
  Clone ID: LIB3272-007-P1-K1-G12
ctccacttcctcttcaataggctttaggaaggggaaagtagaaacaaagaaaacatatggcaagtgaggcggcggaggaagctaacgtccctgcagcggctgcggcggaagcacccacaacagggaccgagaagcaaccacataagcttgaaagaaagtggaccttttggtttgataaccaatcaaagcctaaacaaggcgctgcttggggttcctctttacgcaaagtttacacttttgacactgtagaagaattttggtgtttgtatgatcaaatattcaagcctagcaagttgccttgaaatgctga

SEQ ID NO: 22079 - DNA, 332 bp, Gossypium hirsutum
  Clone ID: LIB3272-007-P1-K1-G2
gtttttattttttttattttctctctctgtgttatcaagaatggcggaaatatcgccatctcccatgtgcacttcaccagatattattattaatacccactgggtttaagttcccttgtttttctctgcccttttcatctccctaaacgatgtcgcttgtctatgataggaataatgaaaatagtagttcaatgagacgctcggggtttatccacgggatgcagtgtatctccgtctatgattcgccggaggagaaaagagatgataggttgcggttgctttcgacggatgaagaggaagaagagagagacgatgatgagtcggggtcttgc

SEQ ID NO: 22080 - DNA, 347 bp, Gossypium hirsutum
  Clone ID: LIB3272-007-P1-K1-G3
gagaatataacgcgctttttagttcgctgttgactgaaaaactccgttcattacttcgatccgatcattattctcagacgaagttcaaattttctgacgtctactttgcaggataatgatgttttctccaattagcacagctttggatttgtgaaggttttttttatgaggaacaccgatttgtagaaatgtctgaagcggagtgccctttgttaaaccaaatgaggatgccagagattcagttgggtgctcatactgtaaggtctcatggggttaaagttgcaaggactcacatgcatgactggatcattcttttgcttctcaatgtgatagaggtcattttaaat

SEQ ID NO: 22081 - DNA, 290 bp, Gossypium hirsutum
  Clone ID: LIB3272-007-P1-K1-G4
tctgtctcccctatcgctctttttcatcgatcagatctcttcaaacccatcaattcaaacaaccctgcactcattccatgcatgacgcttggctcaggaggatccagtgttgtggtgcctcggaacttcagattgctggaggagcttgagcgtggaaaaaaaggtattggagatggtactgtcagctatggaatggatgacggagatgacatttacatgcgctcttggactggcaccattattggtcctcataatacttgtcatgaaggtcgaatttatcaactggagct

SEQ ID NO: 22082 - DNA, 222 bp, Gossypium hirsutum
  Clone ID: LIB3272-007-P1-K1-G6
ctacttaaccatttcccaaatctcctccctactcttctttaacgtggtttttatttccgctcatgcagcgcgctttgaaatccgtaatgagtgcttctacaccgtttgggcacaacctcttcttgcggtagccgtcccctagacccttatcaaagtttgaccattgatgttcctgctggcactgctatggcttgtatttgggggtcaaaccaattacaattt

SEQ ID NO: 22083 - DNA, 217 bp, Gossypium hirsutum
  Clone ID: LIB3272-007-P1-K1-G7
aattttcagtcgtcttctcttttagtcctctcgatcccaaagcaagctctcgagtccgaatctctccgagaggaatgcagatcttggtgaaacccctacctgttaaaccaataaccctggagggggaaggttccgatcttttggttatggcaagggcaaaattcaagaccaaggaggcgtttcttcaaaacaaccaaagcttatttttggccgaaaa

SEQ ID NO: 22084 - DNA, 244 bp, Gossypium hirsutum
  Clone ID: LIB3272-007-P1-K1-G8
gaaatttggaaaggaacaaaaagatttagccaatttcctcaaagtttcctcccaagtcgaagaagaagtcctaataatttaggactgttggggtggttttcgtttccgttttgtttccttcatttctgcttctgatcccccgtttgtaggagggtaaagaagagagattgaatggagagtgtagtatggcaagggttggctttatctggacttttctcttggattgtaattacttgttatttcg

SEQ ID NO: 22085 - DNA, 200 bp, Gossypium hirsutum
  Clone ID: LIB3272-007-P1-K1-G9
gaagacgggtaattatattcataaaggtagcgtttgaactcgatcttcaatccagagtaactaactcagatcgaacctgaaccaagccctttctgagacgctgtacatttttataacctatgaccactcagaacttatactgatcggaaggggtgtatttatatgacatacaacgactacggcggatagtttcaccatac

SEQ ID NO: 22086 - DNA, 105 bp, Gossypium hirsutum
  Clone ID: LIB3272-007-P1-K1-H1
ctcacatccttgtttcatggcaacacctggcagaattcccataaagttcactgatcgacgttgcgaaccaaagcttgtcgctctagctcagcctacgacatctga

SEQ ID NO: 22087 - DNA, 417 bp, Gossypium hirsutum
  Clone ID: LIB3272-007-P1-K1-H10
aattttaaagattattcctcttgttctgttttctgctcaaagctcttttatctgtcccttttttttagtttctgacatggcatcctctggcactggctccccttgtggtgcatgcaagtttctgagacgaaaatgcgcctctgactgtatatttgcgccttatttctgctcggaacaaggtcctgcaaggtttgcagccatccacaaagtttttggtgctagcaatgcctccaaattgctgttgcatatcccagctcatgatcgctgtgaggcggttgtcaccattgcttatgaggcccaagcaaggattagagacccctgctatggttgtgttgctcatattttccgcttgcaacaacaggtggcataccttcaaggtcaattaatgcaagtgaaagcacaactagctcaaaatgc

SEQ ID NO: 22088 - DNA, 381 bp, Gossypium hirsutum
  Clone ID: LIB3272-007-P1-K1-H11
ccggaccacaatgagaccatctctggcgttcttgacaggtttgccgccatgggtattgacacccctggagtcgttgccctcctaggagctcacagtgtcggcagaactcactgtgtgaagctggtgcatcgtttgtacccagaggttgaccctgccctcaaccccgaccatgttccacacatactccataaatgccctgatcagatcccagaccccaaggccgtccagtatgtgagaaacgaccgtgggacacccatggttttggataacaactactacaggaacatactggacaacaagggtttgttgattgtggatcaccaactggcgtacgacaaaaggaccagaccttatgtgaagaaaatggccaagagccaagac

SEQ ID NO: 22089 - DNA, 408 bp, Gossypium hirsutum
  Clone ID: LIB3272-007-P1-K1-H12
ccgatttcttcttcttcactttgaggtttgagcagatcgtatggcaccaaagaaagacaaggcccctccaccttcttccaagccagcaaagtctggtggtggcaagcaaaagaagaagaagtggagcaagggaaagcaaaaggagaaggtgaacaacatggtgttgtttgaccaggctacttatgataagcttttatctgaggctcctaaatataagctcatcactccctcaattttgtctgatcgtatgaggattaatgggtcccttgctaggaaagctataagggagttgatggcaagaagatcgattcgtttggtgtctgcccattcgagccagcagatttacactagggcaaccaacaactagatccctttgtatatttttgcttaaattaattctatgtagta

SEQ ID NO: 22090 - DNA, 411 bp, Gossypium hirsutum
  Clone ID: LIB3272-007-P1-K1-H2
ctttgaaattgaattttttttttcaaattatccataaagcaaaaaatcaattgtatttgaaatttgaaatcaaatggcaacttcaaggccttattcatctcattccacggctccatcggcgccggagctgcctccacagtcatacgaccaccaccaccagccgccgccgccgccgccgcagcaccagagctattacggacagtacccgacgccgtctccgccgccttcgtcatcatcaagttatgggccgagtggtggcggatttccagcaggaacatctccagatgttataagggcgtttcaaatggtagatagggatcgaagtggattcatcgatgaatatgagttgcagcaggcactgtcttcaggttaccagaggtttaatcttaggactataaggctgcttatgtt

SEQ ID NO: 22091 - DNA, 420 bp, Gossypium hirsutum
  Clone ID: LIB3272-007-P1-K1-H3
cttagctttctttttagttttcctttaacttttgtaatatccttttagccttccgctcatactctttgtaaccctgctcatcttctcccccagaattggtatcagaggtgttggtgtaacgatttcttggagaaataatatcatagtgttcattgtatgtatagttagattgaggaatgaaatctgtggacgttagtgtctcaagacttgacccacggtgatgaatattcagttgaatatcttcttgcataagtcactttcttgatgggagacaatggtttcaaaagagatgcaacaatagtggggacaatgggttagagcttccattttcatcaatggagagtggagccatgatcgtctttaatgtaaagctgttaaattctttgttaactgcttcgttttttttttcaatgggcatgt

SEQ ID NO: 22092 - DNA, 324 bp, Gossypium hirsutum
  Clone ID: LIB3272-007-P1-K1-H4
gggaaatcaatggaagcagaggtgataaaagcagagttggtattgccaacgcatatgagtttcaagaggattcaaatgtatgagaaatacccaaagggccaatcgaaagtgagatggaaacagctcaagcaaatccttcaagctgaaaattgccagaattactctcctgatgaacccaattatgttaatatcgaatcaccgccttcgatgcaaccgtgcaaaagaatttgtgatataacgggatttgaggcaccgtaccacgatccgaggacgaatctccgctatgcaaatgccgatgttttcaagcttgtgagatctcttccc

SEQ ID NO: 22093 - DNA, 435 bp, Gossypium hirsutum
  Clone ID: LIB3272-007-P1-K1-H5
ggcccggaggcggtggaggaattagtcgagtgttgcaagacggtgacgttttcgaaaaggctggtgtcaatatctctgttgtttacggagttatgccccctgaagcttatcgagctgccaaggctaatgtcactgatcagatgcccggtcccgttccctttttcgctgctgggatcagctcggttttgcatcccaagaacccctttgctcctacgctgcattttaactacagatatttcgaaacagatgctcccaaagatgctcctggagctccaaggcaatggtggtttgggggtggaactgatttgactccatcctacatctttggggaggatgtcaagcacttccattcaatacaaaaaaaggcatgtgacaaatttgatccatccttctatcctcgattcaaaaaattgtgcgacgacttcttttacatta

SEQ ID NO: 22094 - DNA, 269 bp, Gossypium hirsutum
  Clone ID: LIB3272-007-P1-K1-H6
cacgttttcaaagggccaaatggaagctgggaaaccccatgctgtctgtattcctctaccagctcaagggcacattaaccctatcttattatttgccaaactcctccacttccatggcttccatatcactttcatccataccgagttcaactactatcgcttgattcagtcgagaggactcgactcgctcaggggctcacccgatttccggttcgaaacgataaccgatggtttgccatcgaccaacatgcgggggatacaagatttac

SEQ ID NO: 22095 - DNA, 265 bp, Gossypium hirsutum
  Clone ID: LIB3272-007-P1-K1-H7
gccgaactgagctatgtctgtatatctgtctgtctctctctgtgtctactatgcccctgcatgggcggctatggtaaaatgcgcgcgtgtgtcggcctatgggatattattatgcgccgggggctcggaagcgaaggtcagttagacgagccgtaccgactctgatgagctatgcatcattacatctatgacggagagctccttaagctcaaactactcaactcttcaggtgctggctttgcctatactagcaaggatctatttg

SEQ ID NO: 22096 - DNA, 420 bp, Gossypium hirsutum
  Clone ID: LIB3272-007-P1-K1-H8
ggcgacttcagccatgtcggaaaaacgggtcgtcctgctctgcggcgactatgccgaggactatgaggttatggtccctttccaggctctgttggcttatggtatatcagtggacgctgtttgtcccggcaagaaggccggcgaaacttgccgcaccgctattcatcaactttccggccatcagacctataccgagatccgtggtcacaatttcacactaaatgcatcatttgaagatatagaccatactaaatatgatggtttagttatagccggaggacgagctcctgaatatcttgctatggatgcatttgtattgaacatggttcgcaattttgttaattctggaaagcctgttgcttcaatttgtcatggtcaattgatattaactgctgccggggcagttggtggtctaaaatg

SEQ ID NO: 22097 - DNA, 425 bp, Gossypium hirsutum
  Clone ID: LIB3272-008-P1-K1-A10
ggacctactctagcctctcttaaaacacctccgtcgccgccagacaagcctctcggcaccacttccgacagtccgttttttggattttttgatttctgggtgaagtgcggaaagagttgctttcctaaagggtacagaaatcttaacacacaggtgccagaactacctacaatatgtcaggcaggaaggaaacagtgttggatttggctaagtttgttgacaaaggtgttcaggtcaaactcaccggtggtagacaagtcacggggaccctaaaaggatacgaccagctactgaatcttgtcctggatgaagctgtagagtttcttcgagatatacaacttgttcatgtgtctgaactactggatgacaagattcatttgctgtttatggatactctacagaccaggatgatccgttgaagacta

SEQ ID NO: 22098 - DNA, 314 bp, Gossypium hirsutum
  Clone ID: LIB3272-008-P1-K1-A11
ctttaaatggacacgaccttcaaagctaagcccccggagtaaggcaacaatcgaatggataatcccatcattttcctcaccgggagtatacagaataagacatttcggtgcttcaaaagggcttatgggatcaattcggcatttcactggttcatcaagtgcttttgtagtggcatgagaaaattaaaggtcaaagccatttatacatgatatggcacagcgtcttcaaagtttaattatttttatgctatttatgtaatgaattgtctttaggttataagttcaaacacggtcgaatccaacaatgttcctat

SEQ ID NO: 22099 - DNA, 372 bp, Gossypium hirsutum
  Clone ID: LIB3272-008-P1-K1-A2
gtgaaattgataattggcgaacagcagaactcttgcttaattggatcaataagcaaataggcagttcatatggcttggatgatgaaaagtttgaaaacgagcaacttccatccaatatatcagatcctggacagactgctcaagccatttttgatgtggaggaggcaaccgcaattgcatttgacatcattttagaacagaagatgattaaatcaaaaactcgagcttcacttataaaatttcttcagcttttagtcgctcatcatccttcccagaggtgccgaaaaggaagtgcagaagtacttgtgaactttgatgagttctgcccgttagatatgtggtcttctgataaacatgatggttccaccagta

SEQ ID NO: 22100 - DNA, 385 bp, Gossypium hirsutum
  Clone ID: LIB3272-008-P1-K1-A3
tctggattcaacccgccaccgttttcgacatctattatttttacttcaacggatacgaatccgccattaaagctcaagctgatgaaacaaaccccaagtgttcgataaaattaccaggtctaccgccactcttcccccgcgaccttccatcgttcgttatcgcttcgaacgtttaccaatcggcactgtcgttgttccaagaacaaatggacgtcctcgcagaagaacccaacgctaaaatccttattaacaccttcgatgctttggaacacgaagcattaaacgccattgaaaagttcaagacagttggtattggacctttagtcccatcttcattccttaacctaaaagacgcattagataattccttaagagtcgatctttt

SEQ ID NO: 22101 - DNA, 425 bp, Gossypium hirsutum
  Clone ID: LIB3272-008-P1-K1-A4
cttaaaacccagccaaaccacatacagctcctcctcagaattcacctactctatacgttgaataaaacaagatggggggtgggtttagagtgcttcatcttgtaagaccgtttctttcatttctgcctgaagttcagagtgctgacaagaaagttcccttcagagagaaggtcatatacactgtgatctctattttcatcttcttggtttgtagccagctccctctgtatggcatacattctactactggtgcagatccattctattggatgcgtgttattcttgcctcaaatcgtgggactgtcatggaacttgtaatcactcccattgtgacgtctggactgccgatacaacttattgctggttctaaaatcattgaagtggacaacaatgtccgcgaagatcgtgctcttgtaaatggtgcc

SEQ ID NO: 22102 - DNA, 425 bp, Gossypium hirsutum
  Clone ID: LIB3272-008-P1-K1-A5
caagaatccattttccaaatcccccattttgcctctcaagccctccaagaatgtcttcaagcatccctccctctccctctctctcaaagctgtcctctctcagaaccctgctaaaaccctcaacccaacttttcaacactgcttcactaaatccccagatgggtttctctactgtgaggataccaaggtccaggatgtcatggaaaaggtcgaaaagaggccgttttatttgtatagtaagcctcagattactaggaatgtggaagcttataaggaggcccttgaaggcttgaagaattccattattgggtacgccatcaaggcgaataacaatttcaagattttgcagcatttgaggatgttgggttgcggtgctgtgcttgttagtggcaatgaactcaagttggctcttcgtgccggcttcg

SEQ ID NO: 22103 - DNA, 156 bp, Gossypium hirsutum
  Clone ID: LIB3272-008-P1-K1-A6
ttataaaaccatctcatataattttcacttttttctttcaagcccaccaagaatgtccggggggtattcttaacttgttctgatctcttaaagcacccctatcttcagaaccctgcttaaacctttaacccaactctttaacactgctgtactaaa

SEQ ID NO: 22104 - DNA, 375 bp, Gossypium hirsutum
  Clone ID: LIB3272-008-P1-K1-A7
gtgagtttgggtggaaacaaatagcagagcctgttatgaaattgtacacggagtccactgatggctcctctattgaaaccaaggagagtgctttggtctggcaccatcgagatgcatacccgggttttggatctagccaagcgaaggagatgttagaccatctagagagtgtattagcaaatgaacctgtggctgcgaagagtggccagtttatcgttgaagagaaaccgcagggagtgagtaaaggtatggctgccgaaacgatcttcacaaccatgtctgagaagggaaagcaagccgatttcgctctctgcattggtgatgacagatctgatgaggaaatgttcgagatcatcagcaatgcaatgtctagtg

SEQ ID NO: 22105 - DNA, 337 bp, Gossypium hirsutum
  Clone ID: LIB3272-008-P1-K1-A8
caacaattaggggagggattaacatttcatattacaacaaaacgacaaggcgcggatgtttggcgccaaacgacagcgtcccagattgacctatcctttatccttgcctgccgttgaatgtacttccccaaatcgtttcttgcaatcatgcttgtttggcaaatgaatgtttagttgattatgtaacactttaggctgtgatatctagctttgtctgcctctcactaacaaatgcttaaagctacaatggggccgacgatgaatctacataagctagggaaagaatcggaggaatgcgcaacgccgcttaaccatctgtaggtcacatatctttcgg

SEQ ID NO: 22106 - DNA, 419 bp, Gossypium hirsutum
  Clone ID: LIB3272-008-P1-K1-A9
aaagcacccaaagcttggcgccattcaaatgctatatattcttctcttttcttcttaaccaatccttcctaaaaaaacccaacctatatcaattacacatgactgatcagagaagaagtaaccaaaaacaggggagactctgtgattattgcaaccaatccaaagctcttttatattgcagagctgactccgccaagctatgtttttcgtgtgacagggaagttcactcggctaaccaactattctctaagcactctcggtcacagctctgtgacgcttgtgatggttcccctgcttccatcttttgcgaaacagagcaatcggtgttttgctccaactgtgattgggaaagccacaagttttcgtcgtcttcgttgcataataggaggccaatagaagggtttactgggtgtccttcg

SEQ ID NO: 22107 - DNA, 415 bp, Gossypium hirsutum
  Clone ID: LIB3272-008-P1-K1-B10
ggttcttatggaatgcttgccagaaggattgtggagactgaaatgccaatcatgggtcagatacagcaattgatccgaggagcgaaaaatgctgtgtcactcgctcagggagtggtttactggaaaccacccaaacaggcattggataaggttaaagcacttgtagaggagtcttcagttagttgttatggtgctgatgaaggtcttcctgaacttagagaagcattgataagaaagttacgtcaggagaacaatttgcagaggtcttcagtgatggtcactgcaggagcaaatcaagcatttgtgaatcttgttctaacactgtgtgatgcgggggactccgttgtcatgttagctccatactatgtcaattcctacatgtccttccagatgacaggtgtcactaagatattag

SEQ ID NO: 22108 - DNA, 420 bp, Gossypium hirsutum
  Clone ID: LIB3272-008-P1-K1-B11
aaacaaattgcgaacaagctgtaaaaaatatctggtgaaataggaaatcactatcatcagcagattaaaactgtatcgaactttgaaagcagtatctagagattcggatatttgtttctctttctttcttcgcggataatggaagctgatgtatctatttcctgctaaggccctcatcacaatcaaatctgtttcgttccacagagagctagggttttctttttcaatcgaatttcttttgggtttttaaattttcagttttaggatgaagatgaatcgagtcgtggttttattattgttatcatggtttctctgtttctcgagttcgtgaatttcatggaatgagccggcgtttagtaaaagcaatgcctagcttgatattcactgctgtcttggaagataattgtacttcaataacct

SEQ ID NO: 22109 - DNA, 424 bp, Gossypium hirsutum
  Clone ID: LIB3272-008-P1-K1-B12
gggacgccaaggagagcgagtgagactctatgtaagaggaaccatcttgggttacaagaggtcaaagtcgaaccagtatccaaacacttcattgatccagattgagggagttaacaccaaggaggaagtagcttggtatgctggcaagcgtatggcttatatctacaaggccaaagtgaagaagaatggctcacactatcgctgcatttggggaaaagttactagacctcatggtaacagtggggttgttcgtgctaagttcaagtctaaccttcccccgaagtctatgggagatagagtcagagtcttcatgtaccccagcaatatatgagtagtgtagatcgacgactcgaatgacgctctaccatttcacttttgtttttatgaacttagtcaagattttgtgtgctttgaatcagtcatt

SEQ ID NO: 22110 - DNA, 385 bp, Gossypium hirsutum
  Clone ID: LIB3272-008-P1-K1-B2
tcactctcgaagagggacaacaacaggcagctcttcttccttttctgcgtctcatcatcaaaccccaaactcttaactagcctcttcctcctcctctttactttaatttcattttgctttcacaaatctaagaccagagctccaaaagattgaatttttaacccctcaaattaaaatccttcctttttcgcgttttcggttgaaaatttgtataaaaaagagggtgatttagaaacaatggatgctgattcatggagtgctcgtctttcttcagcttctaagagatatcaatcggctcttcaattacgatctgatatgcttatggggtttgaagaaattgatggagaagatgaaataagagagggagtttcgatgcccctttttg

SEQ ID NO: 22111 - DNA, 427 bp, Gossypium hirsutum
  unsure (1)..(427): unsure at all n locations
  Clone ID: LIB3272-008-P1-K1-B3
ggagcattattaggagttgggattgtcaattgtggtgttaagaatgattgcgaccctgcactggctctattgagtgattatattagtaaagaggattcttcagtccgtattggtgcaattatgggtttgggaattgcatatgctggtgcccagaatgagcagattcgtagcagcttgactctgatacttaatgatgcaaaggctccccttgatgtgatagcatttactgcaatttcgttgggtttgatatacgtgggttcctgcaatgaggaggttgcacaggctattatatttgctttaatggaccgaagtgagtcagagttgggggagcccctcactcgtcttctgccacttgctcttggtcttttataccttgngaagcaggaaagagtggaggcgactgcagaggtctcaaagacgttcaatg

SEQ ID NO: 22112 - DNA, 425 bp, Gossypium hirsutum
  Clone ID: LIB3272-008-P1-K1-B4
ctcagcagagcagaaaaatagaaataaaaataataaaaggaagggattttttaaaaatttttaaattaagaaaaatttctagaaaaaaaaaaatccttccttttttcctttgatttccccttatgagatcgtaaaatattcgagaatcccttttttttttcctgtaaaatttatatatctaattatcgctttgtctttgattttatttggggttgttttgagttaattaatatggggagtgaagttttacgacctcaggattgtttgatcgaacggattcggttacctccgacggcgtgtcctcgccggagatacggaaacggtagctttaatcctagttattatcataactacaacaataacaatggaaatggtagatctaacaggaaacccgttcagaggaagcggatcggatcggagcaggg

SEQ ID NO: 22113 - DNA, 424 bp, Gossypium hirsutum
  Clone ID: LIB3272-008-P1-K1-B5
tgtgtcttgaactctcatggcttcaagtgctgcaacccttccatctaaaatgaaagcatggacttaccctgagtacggaaaatcatctgatgttctgaaactacaatccgatgttgttgttccccaacccagggatgatcaagttcttctccaagtcgtagctgctgggattaaccccattgatttcaaaagaatgcttggaatgttcaaaaacattgattcccctttacccatcattccagggtatgatgtagcaggcgtggtggtgaaagtggggagccaagttaagaaattcaaggaaggggatcaggtgtatggagatataaatgaaaaggccgtggatcacccaacacaatttggcactatagctgaattcactgttgttgcagagaagctgttggctttaaaacccaaaaatctcagc

SEQ ID NO: 22114 - DNA, 419 bp, Gossypium hirsutum
  Clone ID: LIB3272-008-P1-K1-B6
ggttcttatggcgtgctagacataaggattgaggagactgaaatgccaatcatagggcagatactatagtcgatccgagaagtaaacaatgctgcgacagtcgctcaaggagtgctgtactggaaaccacccaaacatgcatcggattaagggaaagcacttgtagaggatatcttcagatgcagtgatggtgctggtgaaggtgttcctagaattagaggatcattgataagaaagttacgtgaggagaacaatgtgcataggtctacacagatggtcactgcagcgagcaaatgaagcgataccgagaactatcggactagacactgacgatgcatgggactacaacgtgatggaacctacatactagtggaatggctacatcaactgctagatgacaggtccaactaagacatgag

SEQ ID NO: 22115 - DNA, 275 bp, Gossypium hirsutum
  Clone ID: LIB3272-008-P1-K1-B8
gctctctgtttcttgttagttaatcagccaagtattctttcaaaatctcctctctctctctctctctctctctctctctctatctctctctctctatctctctctctctctctcactctctctctataattagaggatcaggctttaggccaaaaactttggtaatgtccgatctgtgaattggggcaagtgtctgcgaaaaaaaaaagccgctctaatgatcctgcgtgcacaatgagcatccgatatccctacgcatcgcatccatattcttc

SEQ ID NO: 22116 - DNA, 423 bp, Gossypium hirsutum
  Clone ID: LIB3272-008-P1-K1-B9
ctctaccattgattttttttccttttttccttttgttttgtttctggttctggtttcctttttctcttcacatttctttctcccgatgagcaaacgctcctttgtcgttacaattagagtttattgccactcaactcaccactatttgatctgaccttggttatttctgcttcagttttttctcttttaatttttcttgtattttcttgaagcttctttccaacggagaaatagatagaagagagagggagagccagagagagtcaactgagaaagttttgctgtatgtcagtagattgtattgagacttactgcggtggatttggcgagcttgcaaaccctttacaatggcctcagctaagaaaaagacgacgcttctttcttcttcatcttcttccccttcttcatgttgcgcatcgcact

SEQ ID NO: 22117 - DNA, 418 bp, Gossypium hirsutum
  Clone ID: LIB3272-008-P1-K1-C1
ctctacgtgtgttagtaggtctgctgaatcttaattcttgattaattagccaatcacagcagccatgtctctgctcaatgatctcatcaacctcaacctcagggacaccactgaaaagatcatagccgaatacatatggatcagaggatctggtatggatctgagaagcaaagcacggactttgcctggaccagtgacggaccctgcaaaactcccgaagtggaactacgatcgtgtccagtaccaatcaagcacctggagatgacagtgaggtcattctttatcctcaagctatattcagggatccattgagaaaaggaaacaacatcttggcgatgtgcgatgcttacacaccagtcggcgaacccattcctaccaacaagagagctaatgcggccaagatctttagccaccctga

SEQ ID NO: 22118 - DNA, 423 bp, Gossypium hirsutum
  Clone ID: LIB3272-008-P1-K1-C10
ctttcctcctagccaaaaaaaaaaaaaaagcctctttcctgtctctcgttctttttcctgttcaatcatgtcttgcttcattagcaaatatgctgatgagttggctaaaaacgctgcttacattggaacccctggaaagggtatccttgctgctgatgaatccactggcaccatcggcaagcgtctttcaagtattaatgtagagaatgttgaagacaacaggcgtgctctccgtgagctcctattcacaactcctggagctcttcagcacctcagtggtgttattctctttgaggaaaccctttatcaaaaaaccgcttcgggcaagcccttcgttgatgttttgaaggaaggtggtgtcctccctggcatcaaggttgacaagggtacggttgagcttaatggaacccatggcgaaacttt

SEQ ID NO: 22119 - DNA, 423 bp, Gossypium hirsutum
  Clone ID: LIB3272-008-P1-K1-C11
cgaagttcaaccccaaaacccaccatgggtctttcaaaagattgtcgactttgatagcaaggtcttacaaagttgtattggagcatgaaggcaactctaccgagctagaggtggaagacgatgagaccatactatcaaaggcattggacttgggcataaccgtgccatatgattgtcagcttggggtttgcatgacttgccctgctaagctcttaagtggaaccgttgatcaaagtgaaggtatgcttagtgatgatgttatagaccgtgggtttgcattactttgtgtagcttatccaacttcagattgccatatcaggactatccctgaagaagaactgctttctttgcagttaaaaacagctaatgattgacactgaaactgtttttgtgtgtgtctgtatgttggatgctgagttttta

SEQ ID NO: 22120 - DNA, 422 bp, Gossypium hirsutum
  Clone ID: LIB3272-008-P1-K1-C12
atttttatttaagttcattgcttgatccatttccatcccagcaaaagcctgaaacagtattaatcgtcgataaaatggaaggacaaggtgaagatgttaggctgggagcaaataagtacagggaaaggcagcctataggaacagctgctcaaacccaagataccaaggactacaaggaaccacctgctgcaccactgtttgagcctgccgagttatcctcatggtccttttacagggctggcattgccgaattcgttgccactttcttgtttctttacatcaccgttttaactgtaatgggtgtcgctaaatcttcaaccaagtgttctactgtagggattcagggcattgcttgggcttttggtggcatgatctttgctcttgtctactgcactgctggcatttcagggggtcatattaac

SEQ ID NO: 22121 - DNA, 428 bp, Gossypium hirsutum
  Clone ID: LIB3272-008-P1-K1-C2
gggaaaaggaggaaagaacagaaagagaggaaagaacgaagcagacgatgagaagcgtgagcttgtcttcaaggaagacgggcaagagtatgcccaagtgcttcgtatgctcggcaacggcaggtgtgaagcaatgtgcatcgatggtactaaacgcctttgccacatccgcgggaagatgcataagaaggtatggattgctgctggtgatataattcttgtcggccttcgcgactatcaagatgacaaggccgatgtgatccttaagtacatgcctgacgaagcaaggctattgaaggcctatggtgagcttccggagaacacccgtctcaatgaaggcattgttgatgaggaagacgaaggcggtgtagatgattatgtcgagttcgaagatgaagatatagataaaatctaaggtaactataatg

SEQ ID NO: 22122 - DNA, 429 bp, Gossypium hirsutum
  Clone ID: LIB3272-008-P1-K1-C3
acgaagttgattttggaaagagtacagggggaaattcgaaacttatttcgtgtgcaaaagggctgcaaagtttggccaagagaactatcgaaagaagcactgctggtgaagcagggaattttgaatgggatgattttcgggaggacgaaggagggggtgacatctatcggagaatgaaggaagaattctatggtaatagaagccaagcacggaaatcttctaccaacctacggaagcctaaaggaaagaaactaaatgaatcttgtaatgtagaccaaccaaagtccggtgataaaaggatggttcattctgagtcaaaattattgttgtgcaagttgaaagataatgacatgacgttacaagaaggtcaaatgaattttagaaaaaatctttccaatgagtttgatgaacagtttaactcagattcct

SEQ ID NO: 22123 - DNA, 423 bp, Gossypium hirsutum
  Clone ID: LIB3272-008-P1-K1-C4
gcaaagctcctctcttcttgctcttcattttcctctgaattctttgtctctatttaaaaaaagcaatttttttgaggtggtaagtgtacaaaaacaaaatgaagatctgttgcattggagctggttatgttggtgggcctacaatggctgtgatcgcgcttaaatgtccggatattgaagtggctgtcgttgatatctctgtacctaggatcgctgcctggaacagtgaccagctccctatctatgagcctggtcttgatggtgttgtgaaggagtgtcgtggcagaaaccttttcttcagcactgatgtagagaaacatgtgcgtgaggctgatatagtctttgtttctgtcaacactcccaccaagactcgggggctcggagctggcaaagctgcagaccttacatattgagaaagtgctg

SEQ ID NO: 22124 - DNA, 311 bp, Gossypium hirsutum
  Clone ID: LIB3272-008-P1-K1-C5
gcgaggggcttgaaactcgctcacctcaccattcggtcctacaagcttaatcttataagctgccattaatgttttgtgattggaggaacatttcaagccaaaagatttggagatgttcttaaaagatccaagagaagtcggggccttgacaatggcactcgtgaatcggttcgggattgaagcttgaacgatactagaggaggtaacccgcacagttgccatctttgctgttgaacagaaggggtatggggatttggggtatgagcggagaatacgaaggggtctaagtttctttgagacttatacaaaaa

SEQ ID NO: 22125 - DNA, 419 bp, Gossypium hirsutum
  Clone ID: LIB3272-008-P1-K1-C6
cagcaacgcacagtagcaccaaatttccgtacgtccaaacttttgatccattatcaccttctctgatcttccctctactatcggagacttgaagatggtgtcggacgcgagcaagaagaaggctgctcagaagaaggctgctgccgctgcgaagagaggagggaaggctgctgcagccgctgcatcttccaaggcggcagctgccgcgaccgcggagaacggcgttgataaggtttctgataaagttagtatgctccagatatccgatcggacctgtaccggtgttctctgctcgcatcctctttcccgagatattcgtatagagtccttatcagttactttccacggacatgatcttattgttgattcaatattggagcttaattatggcagacgctatggtttgctaggattaaatg

SEQ ID NO: 22126 - DNA, 423 bp, Gossypium hirsutum
  Clone ID: LIB3272-008-P1-K1-C7
ctctcccgcctaccatcccttatcctttcaatttcatcttcttcataaaccctctccttcattttcctccagcttccctttcttcaatcaatgaaaatgtcttctataaccaaatccatatccatggcggactcatgttgcctcgtttgtatcccttcactcttaaccacttgttccaaatccccatccctactctcctttcccccaaaaccaatcaatcttttcctctcatcttcccattcttcaacctctttgaccctcaaaaccagaacccatttctcttctctagtttcctttgttgcccaaacatcagattgggctcaacaaggggaagaaaatgacaccaccatcaccatcgatgaggatgaaagtgaaactgaagggggggaatcgaaatgggaaaacgatgaaaatgatggagct

SEQ ID NO: 22127 - DNA, 422 bp, Gossypium hirsutum
  Clone ID: LIB3272-008-P1-K1-C8
gaaccatccatgctcatggtgaggagactgtcaaaataccagttactttgatatatgatgatatcaaaagtacatatgatgacattaagcctggcagcatcattccatataggctgaaagttgatctcattgttgatgttcctgtttttgggaggttaactttacctcttgagaaaactggagagatccctataccttacaagccagatatcgatatggagaagatacactttgagagattctcttgggaggaaactatagcagttcttcatttgaaattggagaatatgaatgactttgacttgggactcaatgcccttgactatgaggtctggctatctgaggtcagcattggatctgcagaacttgaaaaatctgcaaagataggcaaaaatggaatcagttatattgagattcctatc

SEQ ID NO: 22128 - DNA, 390 bp, Gossypium hirsutum
  Clone ID: LIB3272-008-P1-K1-C9
gaaaaccctaaacgtccgttcacgtgcgttgcgtgtgctctacgctcacgttatgtccgggctgatcgtagcacacgccttctacctgttttttttctttagccataagctaaacaacacgcagaattggtcttaaaatgcctacacgtaatagatgcataggatttggttgggtaaatacggcggaaaggtggtggatcagatcgacgcgtgtcgcgattgtcagtttcgaccgttgcaagcccaagaagtgccgtatggaatgcaaggcgagctgccctgttgctaaagctgggaaacttggcattgaggttacaccggacttagagattgctatcatctttgaggaggagcgcattggttgaggtatctgtgtcgagagatgcccat

SEQ ID NO: 22129 - DNA, 427 bp, Gossypium hirsutum
  Clone ID: LIB3272-008-P1-K1-D1
ggaaaagccctaatttgacagctctctcagtctctcattttgcctgaaaaccatgtcgaggagaaaggttagggagcccaaggaggagaatactacccttgggccggctgtacgagacggcgaacatgttttcggggtggctcacatttttgcttcatttaatgacacatttattcatgtaacagatttgtctggaagggaaacaatggttcgcattacgggtggtatgaaggtgaaagctgatagggatgagtcttccccttatgccgccatgcttgcagcacaagatgtttctcaacgctgcaaggagttgggtattacagcctttcatataaagcttcgagctactggagggaacaaaaccaagacacctggtcctggtgcccagtcagcacttagagccctcgctcgttctggcatgaaaatt

SEQ ID NO: 22130 - DNA, 418 bp, Gossypium hirsutum
  Clone ID: LIB3272-008-P1-K1-D10
ctcagctactttttctctcaaaatttctccaattagctctggtttaggcgatggcttcaaagcggatcttgaaggagctcaaggatctacagaaagatcctcctacctcttgcagtgcaggccctgttgctgaagacatgtttcattggcaagcgactcttatgggtccacctgacagtccatatgccggtggagtgtttctagtcaccattcatttccctccggactatccatttaagccacccaaggttgcattcaggacaaaggtctttcaccctaatattaacagcaatggcagcatttgcctcgatattttgaaggagcagtggagccctgccctcaccatatccaaggtattgctctcaatctgctcacttttgacggacccaaatcccgatgatcccttggtgccagagat

SEQ ID NO: 22131 - DNA, 382 bp, Gossypium hirsutum
  Clone ID: LIB3272-008-P1-K1-D12
gtaataatgaaaggaggtggtgctgttggttcagcgaatgatgacccaatgaggggtgtactcaatgctttacaggagaaaggcacaaaacttatccaatcgtggttaaactgcgggagtgactgatactatctgaaggtaccaaagtgcctctcacatctaacaacggacgccgcaactatgaattaacttagagtagaaccggcatagcatactatgatataaaccgcatcctagggaactgctttgccttaatcagtcttgaaagaagatcgagggatcttgactaataggcggctgcagaaactgacaggagaggcaacagagaagtcaaagctgttggtccaacttacaataccaatactgctgacgctactagact

SEQ ID NO: 22132 - DNA, 426 bp, Gossypium hirsutum
  Clone ID: LIB3272-008-P1-K1-D2
ccggattcccgaccaaacccggagaaacaaaggatcaactattcactgttccaattttttgcttaccccttttgatttctatcaaaaagggaatgacagatcccaacaacaaacctagaactgtaatctgcgtaggggacatccatggctacctcaccaaactcctcaatctttggtccaacctccgatcccaaatcgaccctgactccttcaacacctccaccgttatcttcctaggcgattactgtgaccgtggacccgacacgcgcaaagtgatggattttttaatcaccttgcccaagcgatatccaaatcagaagcatgtttttttatcgggaaaccatgactttgctttcggcgggtttgtgggggcgttggcaggtgagtttgaagcgaaggagacatggcaggagtatgctgataatg

SEQ ID NO: 22133 - DNA, 395 bp, Gossypium hirsutum
  Clone ID: LIB3272-008-P1-K1-D3
caaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgtacgttgctgttatttatgacatattaaggcttgatgtgtatcttttgtttttcatttttctatttttctgtttatttttattttttgtatttctttttttcttaataatgttttctttttgtttatatttctctcttgttatttaattttttttcctattttag

SEQ ID NO: 22134 - DNA, 425 bp, Gossypium hirsutum
  Clone ID: LIB3272-008-P1-K1-D4
gagaatgcgattaggaaagcgtatcgtttaacggatacaaatatattggaacaagccattgatttgggcaaagggggttcaacggcagtgacagcaatattgatcaactgccagaagctggtaatagcaaatgttggcgattcccgggctgtgatttctaagaacggcgtggctaagcagctttcagttgatcatgagcccgcttctgaaagggagagcattgaaaatagaggcggttttgtttcgaactttccaggggatgtcgcgcgtgttgacggccagcttgcggtggcgagagcatttggtgacaagagtttaaagaaacatcttacttcggagccagatgtgagcattgaaacaatcgatgatgatactgacctcataatattggctagtgatggtttatggaaggtaatgtcaaacca

SEQ ID NO: 22135 - DNA, 425 bp, Gossypium hirsutum
  Clone ID: LIB3272-008-P1-K1-D6
attttaatgtggaagctctagagaagtttgttgaagaatctagcattcctcttgtgactctctttaacaatgacccaagcaatcaccccttcgttatcaaattctataacagtccccttgtgaaggctatgttgttcgcaaatttgagcaatgaaggagttgattccttaaaatataaatttcgtgaagttgctgagcaatacaaaggacagggtattggtttccttttgggagatcttgaggctagtcaagctgccttccagtattttggagttcaagaaagccaggtacctctcatcatcattctggagaatgatgggaagaagtatttgaagccaaacttggaggctgatcacattgcaccatgggtaaaggattacaaggaaggaaaagttccaccatatgtaaaatctgaacctattccg

SEQ ID NO: 22136 - DNA, 424 bp, Gossypium hirsutum
  Clone ID: LIB3272-008-P1-K1-D7
aaagatatcactgcaagaaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaaaagcccaccctcggcacctgaacagccaggcacttgccccagagatgcactgaaactaggcgtttgtgctgatttgttgggctcagtgcgcgttgttgttggaccgtcgaggaccaaatgctgctctctcatttcgggtttggctgatctcgatgctgctgtttgcctttgcactgctattaaagctaatgtgttgggggttaacctaaacgttcctgtttcattgtctttgctcctcaattcctgcgaaaagcaaatgcctg

SEQ ID NO: 22137 - DNA, 425 bp, Gossypium hirsutum
  Clone ID: LIB3272-008-P1-K1-E1
attggtagtcgctgcagatatggcagagggggagaacaaactcaagctctattcttactggaggagctcctgctccttccgtatcagaattgcccttaacctcaaaggtctggaataccagtacatacccgtgaacttgcttaagggggagcaattcagtcctgaattccaaaagctgaaccctattgggtatgtaccggtgctggtggacggtgacatgatcatttcagactcttttgcgattttcatgtatctggaggagaaataccctcaacaccctttattgccatctgatcttgcaaagaaggcactcaatttccaggctgcaaatattgtttcctctagcattcagcctcttcagaatctagctgtactgaagtacattgaggagaaagtaagtccagatgagaaaattccttggacaa

SEQ ID NO: 22138 - DNA, 417 bp, Gossypium hirsutum
  Clone ID: LIB3272-008-P1-K1-E10
tcagatccttggtatgggagttgtaactatattgtttgctgctcttggattcatgtctccggcatcccgtgggactctcattacaggtatgctattcttctacatgattctcggaattgcagctggctatgttgcagttcggctttggaggactatcggctgtggtgatcacaagggatgggcttcggttgcatggaaagccgcttgctttttccccggtatcgccttttttaattctcaccattttgaatttcctgttgtggggaagtcacagcactggagctatcccattttcgctctttgtcattctactcctattatggtactgcatctctgttccactcaccttagtcggaggatacttcggagccaaggcacctcacattgaataccctgtccgaaccaaccagatccctc

SEQ ID NO: 22139 - DNA, 400 bp, Gossypium hirsutum
  Clone ID: LIB3272-008-P1-K1-E11
ctttcttcggccgatgcagtttcttcttcaagagacagctctattctttttgctttacttaaatagactttctgggttttccgtgctgatcctaccactggcccctcacccgaaggcctcttgatttatatacacagcaagtagctttaggcggattctccatcatcagttaacgctttttgtttacggacaatggaggtgtacagcaaaaccaagactcgcgcccctgcaatgaaacagatttcgatactattctggaccatgacggtcctatacctgctcacaaacgctcatgcgaaaatcaaaactgacataatgccctcaacagctatcgtttcgtactaattggaattacacacatcggtgcccagtactgcaacccgcgcatcttgaatgaaaa

SEQ ID NO: 22140 - DNA, 425 bp, Gossypium hirsutum
  Clone ID: LIB3272-008-P1-K1-E12
gaagaaaagagttccgtcaaaggtatggtgttactattgcgacagggaattcgatgacgagaagatcctggtgcagcaccagaaagccaagcacttcaagtgccatgtctgccacaagaagctctccaccgccggtggtatggccatccacgttcttcaggttcacaaggagtccgtcaccaaggttcctaatgcaaaacctggcagagaatcgactgacattgaaatatacggaatgcaaggaatcccgcctgatgtgctggctgctcactatggagaagaagaagaagaagctccatcaaaagcggccaaactggatatcccatctactcagcttgtgggaggattgatgccagggccacttggtgttggatatcctcctcagtcaactttaggagcagtgcagccaatgtataatgctgcag

SEQ ID NO: 22141 - DNA, 426 bp, Gossypium hirsutum
  Clone ID: LIB3272-008-P1-K1-E3
caggggctaagcttgtttgcttccataaattgttctatttacttctttcaatttattggttctgggtattcttggttcttgttcgatcgtttattttcaatttgtttgaggatggtttgcatggtttctcgcactggaaggcacttgcagcgatacgataacctaggccgccgccaagttgtcggttgcattccctatagatacaaatctagcagtgatggaaccatgactgatgacttggaggtacttgtgatctcctcccagaaatgtcaaaaaatgatgtttcccaagggtggctgggagcttgatgaatctagagaagaagctgcattaagagagtcacttgaagaagctggtgttctaggcaatgttgagtgtgaactggggaagtgggacttcataagcaaaagccatggcacattttat

SEQ ID NO: 22142 - DNA, 426 bp, Gossypium hirsutum
  Clone ID: LIB3272-008-P1-K1-E4
caataatctaaaactcaacgttaccaactgtgtccttcggctcttagctatatttcaggccgaaacaaaacaaaacaaaaccaaatcaagtgaaataaacaagacttagaagtagaattagaagggaaaatggctagtggaggagggtatggggacccaagccagaagattgactacgttttcaaagtagtcttgattggtgactctgccgtcggtaagtctcagattcttgctcggttttccagaaatgagtttagtttagattccaaggccaccattggagttgagtttcagactagaactcttgttattgaacacaagagtgtcaaggctcagatctgggacactgctggtcaagaacgatacagagctgttacgagtgcatactataggggtgctgtcggagcaatgctggtgtatgacata

SEQ ID NO: 22143 - DNA, 421 bp, Gossypium hirsutum
  Clone ID: LIB3272-008-P1-K1-E5
cggacgcgtgggtgactctggaaagtcaaccacaacgggtcacttgatatacaagcttggaggtattgacaagcgtgtgatcgagaggttcgagaaggaagctgctgagatgaacaaaaggtcattcaagtatgcctgggtgctcgacaagttgaaggctgagcgtgagcgtggtatcaccattgatattgccttgtggaagtttgagacaaccaagtactactgcactgtcattgatgctcctggacatcgcgactttattaagaatatgattacgggtacttctcaagctgactgtgctgtccttatcattgactccacaactggaggttttgaagctggtatttccaaggatgggcagacccgtgagcatgctcttcttgccttcacccttggtgtcaagcaaatgatttgctgctgc

SEQ ID NO: 22144 - DNA, 424 bp, Gossypium hirsutum
  Clone ID: LIB3272-008-P1-K1-E6
caggcttttcaaggcttttgttcttgaggctgccaagatttggcccacggctgcccctcatgcagtcaagagtgttgagctcgaaggtgatgctagtcctggaagtattgtaaagatcacctttgttgaaggccttccataccaatatatgaagcaccagattggaggacatgacgaaaacaatttttcatacagttacagtatgattgaaggtgggcctttaggggacaagcttgagaaaatcagctatgagaaccagtttgtggcagctgcagacggaggaagcatttgcaagagctcaataaaatattacaccgttggcgactatgtaatcaccgaggatgaaatcaagactctcattaaagggagtgaggtagtttacaaggctattgaagcttatcttttggctaaccccgatgcctgc

SEQ ID NO: 22145 - DNA, 423 bp, Gossypium hirsutum
  Clone ID: LIB3272-008-P1-K1-E7
tagggtttctatcattgttttctctgtaaatttcagctgtcttcaagaatacgcttattttgctgcagatcgtctaatttctaggacatggactcgtttgagcaggatggaaatggggcggcacctgactctctgcctccacccccacctgtgcctcctgatgtggtgcctatcaaagcagaacctgaacctgcaaagaagaaggttgtgcgagtcccaatggccaggcgtggtcttggatctaaagggcagaagataactcttctcaccaatcacttcaaagtgaatgttggaagctctgatggacacttcttccattactgtgtttctctttattatgaagatggccgtccagttgatggcaagggtgttggaagaaaagtgatagagagggtgcaagagacctatggcaatgaattggct

SEQ ID NO: 22146 - DNA, 409 bp, Gossypium hirsutum
  Clone ID: LIB3272-008-P1-K1-E8
ttctgtaatagttgaattaaaggcatggtgctaaagggcattgctttgcccattattacattgatactagctttgggaatccaggctgggttttctcagaatattagcaaagccagttttccaaagggcttcatttttgggactgcctcttctgctttccagtatgaaggagcagtgaaggaggatggaaggggaccaactatttgggacacattctcgcatgcttttgggaagatacttgatggtagcaatgcggatgttgctgtggatcagtaccaccgttatcctgaagatatacaactcatgaaagacatggggatggatgcttataggttttcaatagcttggtctcggatattccctaatggtacgggcgaaataaaccaggccggtgttgatcattacaaca

SEQ ID NO: 22147 - DNA, 419 bp, Gossypium hirsutum
  Clone ID: LIB3272-008-P1-K1-E9
agaagatcaaaatggcttctaaaagatcagcttccatggtcctccttttggcactcaacattctctttttttccctagtcagtgcttgtggctcttgctcttcacccacccctaaaccaaggccaaacccaaaccccaacacccccactcctactccatctgcacgaggcaggtgccctagggatgccctcaaattaggtgtatgtgccaatgtgcttaacctagtcaatgtcaccattggttcacccccagtgatgccatgctgttcctttctcaatggccttgtcgacctcgaagccgctgcatgcctttgcaccgctatcagagctaacattttaggcatcaaccttaacatcccagtttcccttagcttgctcctcaacgtttgttcaaggaacgttcctactggcttccaatgc

SEQ ID NO: 22148 - DNA, 412 bp, Gossypium hirsutum
  unsure (1)..(412): unsure at all n locations
  Clone ID: LIB3272-008-P1-K1-F1
caagtctcttacagctaagctgcaagcaaaatatggggtttgcagtagcaactaaagctgccttgctcctgcacctttcccttttcgtactgagtagcttcacggtgtcttctcagatcttgcctgaggctttgcctactcattaccatggaatttcgcctgtagtgccatctgctcacccaccaagccaccactcaccaccattaccattcccatacgaatccgtatccgcatacgcatncgcattcacaccagccaaccctatagcctactaagcctctaactcacccacctgtttaccgctcatgcaaagcacccaagattgctccagcttatccaccacccaagtcaccaagcaagccgacaacgtacgctgctgcttgcaagtacccaacaagccgacaacttacgc

SEQ ID NO: 22149 - DNA, 422 bp, Gossypium hirsutum
  Clone ID: LIB3272-008-P1-K1-F10
cggacgcgtgggcggacgcgtgggtggaagtttaagaagatgagtgcttcaaagttcattaaatgtgttacagttggagatggagctgttggaaaaacatgtatgctcatttgttacaccagcaacaagttccccactgattatataccaacagggttggacaatttcagtgccaatgtgcctgtagatgggagcattgttaatttgggtttatgggacactgcaggtcaagaggattatagcagattaaggccattgagttaccgaggtgcagacatatttggcttagcttgctcattaattagcagagcaggctatgaaaatgttctgaagaagtggatgccagaactacgtgactttgtaccaaatgttcccgttgtgctggctggaacaaagctagatctctgaagagatagagctta

SEQ ID NO: 22150 - DNA, 251 bp, Gossypium hirsutum
  Clone ID: LIB3272-008-P1-K1-F11
gttactacgacatatacaatttagcccaactttggggatttcaatcccggaggatgcctttaaaaccttggcaaccctttctttccttttcttaaccctttttaacttaggccaaggcagcaaatttgatttaagaaaccactggccttacaccggttgggctggcgcatttacgggtggtggcaagagacttggccaaggttaagcatgtgaaattactgtgggctctggaaccacacaagaccgaattt

SEQ ID NO: 22151 - DNA, 343 bp, Gossypium hirsutum
  Clone ID: LIB3272-008-P1-K1-F12
ggaatagacagtttggtcttttcaaagggagcaatgaggcgatgtttgtgattgaagcatataagacacttagggattggggttcataccctgctgaacaggttggttaggatcttgaaggaagctttgtctttgtgatctatgacagcaagactggaaccgtgtttgctgtactggggtctgattggggagtgaaactctattgggggatagcagatcttggctctgtggtcatatatgaggatttagatgtgattaaagaaaggtgtgccaaatacttttctcatatacccacacgagacatgtgacacagagaatgggggctgatgagcttttagcatac

SEQ ID NO: 22152 - DNA, 410 bp, Gossypium hirsutum
  Clone ID: LIB3272-008-P1-K1-F2
aaatcaagggattgccggtggagacgacgcgctcgttgagggccaaggaaggaaggaagaagagagagagagagataaaaaggagaatctgcttcaaagtttcaaactttcccgtctcatatctaatccccaatttctctcttctgctctaggttccttcctgtcctcttaggattcttgtggtctgttcaaagcgtcatggcctcgaagcggattttgaaggaactcaaggatttgcaaaaggatccacccacttcttgcagtgcaggacctgtagctgaagacatgtttcattggcaagcaacaatcatgggcccttccgatagcccttatgcgggaggtgtatttttagttagtattcattttcctccagattatcctttcaagccccctaaggttgcatttaggac

SEQ ID NO: 22153 - DNA, 423 bp, Gossypium hirsutum
  Clone ID: LIB3272-008-P1-K1-F4
gctccggtcattggtcaatctcttcttctctctctccgttctgaccgtttcgatccaatcttcgttaaagagtaatcaagattttatttatgggaacatcgtcgggttctaatattaaccaccagcattcatcgaagatgttgcccccacggcaacaaccacgaccagggagcttacaaacttcgttgtccttagtctcctctgaacatcgcttgtcacctgatgctcaagaacctagatcgaactcagataacgttcacgaatccccaactgagagtgctagctcacaagagacttggcctactgctgatgctgtcacagcaaagaagatggaaaatgggaaaatagaaaatgactgccctgagcaatctgtcattcgtcgtgtttctagtgctgataagataactcttagagacatcgcaa

SEQ ID NO: 22154 - DNA, 413 bp, Gossypium hirsutum
  Clone ID: LIB3272-008-P1-K1-F5
gtcggtaaaaactcgcatgatcaccgatcgtatttgtatcccgcagatgaaagacgaggcgcaccattaccaatctatggcacgcgctgtctcctataaaagctatgctcatcctgccggtactatctcgatgatcgtgtatataccacataaaaaacacgccgatgcaggggtgagggagtgtccatcttctagactgcaaagcatggacaggctaagcggcactatgcaggaacatacattttaattggcgagatactggaagatattgcacgatcctaccacagctgagacgctacacatgtaaacacgcactgattacaagttgattgacatagctgaggacggatccgtgagtttgctgactgaaagtggagacaccaggggtgatttgaggctgacaactgatgaca

SEQ ID NO: 22155 - DNA, 417 bp, Gossypium hirsutum
  Clone ID: LIB3272-008-P1-K1-F7
ccattctaaagagattattgtaaattcgagtacaaagcgctaaccaagatgagagccaagtggaagaagaagcgtatgaggaggctgaaaaggaagcgccgaaagatgagacagagatccaagtagatgcgccttggactgaaatagttttgccctgacaatcccttgtcttcataattatcctgcatatgttgcttgaagttgtgaagattgaagggtattttcaggaaaccttatctgttgtcttctaaatctaggttaaagttttaagactatttgagctgtttgtctagtactattagatattatgttggggttttgtggtttgatctgtgtaagcagttatcttaacatcctaaatgtttgaaattgaaacttttgttcttcttatatggcctataatatgcgagatagatt

SEQ ID NO: 22156 - DNA, 420 bp, Gossypium hirsutum
  Clone ID: LIB3272-008-P1-K1-G1
atttatttcactacccaacaacccaaaagataaaggaatcgtttacttgttcgtagcaatttatcgtcatttcaagctcaagtctctgaaaatttttgtgctgaactccttttttctgtttgtactaccatgtgtggaggtgctattatttccgatttcataccgccgtcgcggtcgcgacgattgacggccgatttcttgtggcccgatctgaaaaaatccgggttgaagaaggggtcgggtaagagatactcgaagcccgtgatcgacttgggcgatgatttcgagactgactttcaggagttcaaagatgaagaatctgatatagatgattatgatgttgatgatgttttggctgatgtaaagccctgttcttttaacgcttgaacgaaactatgttgtaggggaagtccactttat

SEQ ID NO: 22157 - DNA, 382 bp, Gossypium hirsutum
  Clone ID: LIB3272-008-P1-K1-G10
ctctaccggagggtgcttatgctcgcgacctatacccgggcgtctgggtatgggtcactttttctgttgacattggtttgtcccgatgagcaaaccctgctttgcgagtacaatcagagtgtattgccactcaactcaccactattgtgatctgaccttggatattaatgcttcaggcctttctgtgttaaggtttcttgtgtactgttgaagctcatggttcaacggaaaaataaatacaagagagagggagagcccaacagagtcaactgaagcagttttggtgtatgtcagtaaattgtctggacacttactgcgggggttacggcgagcttgcagactctttacactggcctgaggtaataaaaaaacgacacttttt

SEQ ID NO: 22158 - DNA, 430 bp, Gossypium hirsutum
  Clone ID: LIB3272-008-P1-K1-G11
gtgtgtggactccccattttctcttcaaaaagaaaaacaaacactgtcgaaaatttagggttttcgatttcaatctcaatggatcaagaactagacccatatatctgcggttgcattattgaattccttgtcaggtactcacccgacgatatgcatgtaaagaaagttattgaagctttcccgccattgaagcccaggcctcagttgaaaaaagccgtgctcctccgtaccatgcgaaccgaagtctacgccggtgacgtttccgagaaaatactcgacgctttggagaagattgggcgcattgacagcaaccaagggctcccgattcccgattccatgaaggaagcctactgcgccgtcgcattggaatgcaccgtcaagtacttgcccggagatactgacacgtgcggcggcaagtacttggatgcgg

SEQ ID NO: 22159 - DNA, 355 bp, Gossypium hirsutum
  Clone ID: LIB3272-008-P1-K1-G12
agcattcggtggctgctattgctcgaactggataacaggccgcaatcaatcgggataactgctcttttgtcactctgcacgcttattggactagaaaatgccaccttagtatctgtcacacttcaatcaactctggaatccatgggagttctcatggctagccccatgcactcttacctcgaacaacaactggagaaccgtgtacagctattgaaattctggacagcgcccctcaaataatgctttcgggcttctgacaaggactcaatccagggcgtcgtaagaaactcctttgccggtgcctgtgctaagctgatcgaggcgtcggccaagttggagattgctgccaccttca

SEQ ID NO: 22160 - DNA, 430 bp, Gossypium hirsutum
  Clone ID: LIB3272-008-P1-K1-G2
gcgaacattaaagggatagaaagagaagaagacagcgctaaagtcccactaacatatagattagcgggccatatacatgttggaacaaatatattgggacgcttcgtataaccggaaagactgtaactatctattctacgtcgtgacaagacggctaaacagtatatcccatgatcggggcttattcttgttggatcatgaaccgggagagtagatgcaagtgcagagtcaagcatgaaacttatgacgtacacaaagccatgagaggctgagggcatttgatgcttaactacacactaaccatgtatagtacactggtaggacatacaaggagcgcgtatataggacgtaagctgtgcactacaccggccgcggttgcgtatccattgacagccacggcagaaggcatggggagtgagatgatggctta

SEQ ID NO: 22161 - DNA, 427 bp, Gossypium hirsutum
  Clone ID: LIB3272-008-P1-K1-G3
agaacatgccggtccagatctactcctatcaggtaaacgttttcctctctgtcaagagcactttttgccaacctatgtgcatgcgagttctctgatctattaatgtattgaaattttagttactggaaacatggtttcttattatggatatctctgataatagccccaatcactaatttatctagtgaagctttcaacattttttaataactgttctggagtcccccatgattttgattgataacattcttagtgagattcctaactttatactttccaaacatgtgtacgcctctgctacgaacgaggaagaaacattgttgtgaaccaccgtcttaagcaccaacaaatcccctttttggtcccatcctaccagtcctgttgctgacttggagcttcttctgtcaaacgctgcgtcgaactgaat

SEQ ID NO: 22162 - DNA, 430 bp, Gossypium hirsutum
  Clone ID: LIB3272-008-P1-K1-G4
gttccccatcgacgcctctgcttatcgcatcatcagccatgtcaaggagaaaggttagggagccaaaggaagagactacgacccttgggcctgctgtacgagacggagagcatgttttcggtgttgcccacatttttgcatcttttaatgacactttcattcatgtgactgatttgtctggaagagagactatggttcgtattacaggtggtatgaaggtgaaagccgacagggatgaatcttcaccttatgctgcgatgcttgcagcacaagatgtttcccagagatgcaaggaacttggaatcacggccctccacatcaaattacgtgctacaggaggtaacaaaaccaagacccctggtccgggtgctcagtcagctctcagggctcttgctcgctccgggatgaaaattggccgtatcgaggatgt

SEQ ID NO: 22163 - DNA, 397 bp, Gossypium hirsutum
  unsure (1)..(397): unsure at all n locations
  Clone ID: LIB3272-008-P1-K1-G5
gcacgttatggtcaaatcacgtgttaccttgtagaccttcaggaatcacattagatatcaagaaatcatctcataagaagttatcaaagtggctgcaagccaaaacatctactggactgataacagtaaaagaagacaagtacaagaaagaagctatgttgatttctgttaatcgaggtcacccaaaatacttgcaatttaagccaaaaaagccacccgtagaaaaaggtggtcaagcctgtgaattctgctgctagggaaggccgttcacagaaggcgcttgaagtggtagaggtctataagtcaagtgtgcatgtaaatcccatttttgcttctgttggagctgacactgngaaactgtactcagcttctgaagctactgatattgtcttcaagt

SEQ ID NO: 22164 - DNA, 420 bp, Gossypium hirsutum
  Clone ID: LIB3272-008-P1-K1-G6
tactaaccaaaaaatccaacgacatagataaacacttcactttttccgatagtcaccctttcttcgtctccgccgtctcctgaacttgacgtcatcatcgccgccatgggtgccactgaacatgtggtggtggaaggcgaaaataaggaaggaaggaaagaagatggaaaagaaagggtggatgaggtggtcgagcacgagaaggagggagagaaattggacttggagaaaggaccagttggagctgttgttgtcgaagacagcaagggcttagagagatttgaagacgaaagagaccattttcatgtctcaatgttgcagaggttgcaccctacaaatcctttaaggattgtcagtaatggtggtactagagtcgctacgccttccccttatcagtcttctcgggttcagcctactcct

SEQ ID NO: 22165 - DNA, 426 bp, Gossypium hirsutum
  Clone ID: LIB3272-008-P1-K1-G7
ctaaaattgaaatgccctcgaatatggccgccaccgccacaagcaccgccacattccgtcttggcaatcccctttcctcttcctcttcctcatccgtttactcctccaagaaattgcctgtcaatttcagaaaatttgcgcttcatgtcgcctgtgaaaagcttttctgtttcttgtactctaactagaaaaccagtcccagctgctccggtttccatggattcggacccgaacggatggcaacgacccgactcgtttggtcggtttggcaaatttggcggcaaatacgttcccgagaccctaatgtctgccctctctgagctggatgcggcttttcattccctctccaaagatgaaaaattccaggaagaattagctgggattttgaaagactatgttggtagggaaagtccactttattttgca

SEQ ID NO: 22166 - DNA, 424 bp, Gossypium hirsutum
  Clone ID: LIB3272-008-P1-K1-H1
atagaagtactttttcatttccccgtaacttatccgaagagagataaagagaaaagaggtagataaatcgagaaaaaaaatgatcacaattccgtatttgaccgctttaaccacgtatttcagctatggccttctcttcgcgtttggccaattccgtgatttcttcaggaacatcttcgattggtggcacgccagcaatcttgagggatatgcgccgatctgtttaggacttgaagatttctatattcggcgcttgtatcttcgtattcaggattgtttcggaagaccgatagcaagtgctccagatgcttggtttgatgtagtggagcgctactccaatgacaataataaaacattgaagcgaactgacaagataagtaggtgtcttaacttgggatcatacaattatcttggcttcgcagca

SEQ ID NO: 22167 - DNA, 385 bp, Gossypium hirsutum
  Clone ID: LIB3272-008-P1-K1-H10
tacaaaatggccgccgccgcgcgccctcttgtctccgtccaaaccatagagtccgacatggctactgatgccactccaaccgttcctctcgctgatgtgatgaaagcctcgattcgacccgacatcgtcaccttcgttcacgacaatatatccaaaaacagccgtcaaccctatgccgtctccaaacgcgctggtcaccaaacttcagctgaatcctggggtaccggtcgtgccgtctcacgtatccctcgtgttcctggtgggggtactcaccgtgcaggccaaggtgctttcggaaacatgtgtcgcggtggacgcatgtttgctcctaccaagatctggcgccgctggcaccggaaaatcaacgttaaccagaagcgttacg

SEQ ID NO: 22168 - DNA, 426 bp, Gossypium hirsutum
  Clone ID: LIB3272-008-P1-K1-H11
gggacgccaaggagagcgagtgagactctatgtaagaggaaccatcttgggttacaagaggtcaaagtcgaaccagtatccaaacacttcattgatccagattgagggagttaacaccaaggaggaagtagcttggtatgctggcaagcgtatggcttatatctacaaggccaaagtgaagaagaatggctcacactatcgctgcatttggggaaaagttactagacctcatggtaacagtggggttgttcgtgctaagttcaagtctaaccttcccccgaagtctatgggagatagagtcagagtcttcatgtaccccagcaatatatgagtagtgtagatcgacgacttgaatgacgctctaccatttcacttttgtttttatgaacttagtcaaagattttgtgtgctttgaatcaatcattt

SEQ ID NO: 22169 - DNA, 409 bp, Gossypium hirsutum
  Clone ID: LIB3272-008-P1-K1-H12
gaaagtacccgtgcctaaggttgagaaagtgaggattaagtgtttggggtatcaagaaagggctaagatttctaagaatccaactgggaaaaagctgtttgagattatggttaagaaagagagtaatctctgtttggcggctgatgttgccactgctgctgagttgcttgatattgctgagaaggttggacctgaaatttgcctattgaagacccatgttgacatattccctgatttcactccagagttcggttctaagcttcgcgcgattgcagaaaaacataacttcatgatatttgaagaccgtaaatttgcagacatcggtaacacagtaacaatgcagtatgaagggggtatcttccatatattggattgggctgatattgttaatgctcacataatctctggt

SEQ ID NO: 22170 - DNA, 428 bp, Gossypium hirsutum
  Clone ID: LIB3272-008-P1-K1-H2
ggagcaaaaagattgtgggggtgttttacaaggccaatgagtactttacgaagaatcccaactttgttggttgtgtggagggagccttggggttgcgccaatggctcgaatcacaggggcatcagtatatcgttaccgacgacaaagaaggaccggactgcgaacttgaaaagcatatccctgatctccatgtgctcatatcgaccccattccacccggcttacgttacggctgagaggatcaagaaagccaaaaacttgcaactgcttctcacagcagggattggctccgatcatgttgatcttaaggcagctgcagaagctggtttgactgttgctgaagttactgggagcaatgttgtctcggttgctgaggatgagctaatgagaattcttattcttgttcggaattttgtacctggttatcat

SEQ ID NO: 22171 - DNA, 421 bp, Gossypium hirsutum
  Clone ID: LIB3272-008-P1-K1-H3
ggaaaacaagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgtcggcggcagtgacggctagctttggtaggcctggagcgatggggaaagtggaacgaagatatgcgatgaaagagtcgtcgtcgtcggagacaagggcttattcttcagcttgggcgcctgaccctgttacggtgtattaccggccggagaactgt

SEQ ID NO: 22172 - DNA, 352 bp, Gossypium hirsutum
  Clone ID: LIB3272-008-P1-K1-H6
accatactcattattatctataacaacgcgcacttcaaagaaaaaactggagcttaaacctgcttgattacttttaatcaccgccgcagcttacggcatcggctaagcgttgtgcttagctttggcggaccaaggattatttgagtctatcgcagatttgtctgaagacaagggaggggtaggttctggtttagctgtgaaacagaattgtagatccactgcaaagaacgagattccatttactatttgtgttaaatgcgatgctccgactccatgagatatcacaatggcgtttgagaagcatctgtccacatacggaggattggatggttgtatgaacagctccggcatc

SEQ ID NO: 22173 - DNA, 361 bp, Gossypium hirsutum
  Clone ID: LIB3272-008-P1-K1-H7
ggcatttgagagagagtcgttggctgagatccgagttttgcgagaaaattaaagggaagggaagtactagtagttgaggcgaagctgaagctaatacaaaaccgcggctatttctgatttcagccctccgactcttcatccagattctgctcaatttctccgtttgattgaggattgggccaatcaaaacatcctataggtatctaaatcttctttatttacatttttggatctgcgccattgctattgcaatgtcccttttatccagattgcgatgtatcactgtggatgttactgggactctcatagcttataaaggggagcttggtgattactactgcatggcagccaaatctgttgg

SEQ ID NO: 22174 - DNA, 58 bp, Gossypium hirsutum
  Clone ID: LIB3272-008-P1-K1-H8
tcagcgttcggacagtaatagtgagttttttggatgttatttatgttttgtgagatat

SEQ ID NO: 22175 - DNA, 417 bp, Gossypium hirsutum
  Clone ID: LIB3272-008-P1-K1-H9
gcttgtgtctatatatatatatagatatggagtgaccatggtctaaccaaattcctcgacttctcttctgcttattagctctagtctacgccaagaggttcaaagattttatggctgtttccaagtcttcctcgggcaagcaacaaaacgaccgtgatcaagaatatcacaagaaatcggagccgttgattccagggctacccgacgagatcgcagagctttgtcttcttcatcttccatatccataccaatcgttggcacgttcagtatgttgctcatggaacaggaccataaccgaccctggcttccttctctccaggagatccttatcgctttctctgccttatctgttcgttttcgcttttcataactcaacggccaggatacaatggcaagcttttgacccgcgatcaggcc

SEQ ID NO: 22176 - DNA, 401 bp, Gossypium hirsutum
  Clone ID: LIB3272-009-P1-K1-A10
aaaaaaactctcttcttcacttttagaaaaaaagaagaagagatatatagctgtgttttagttgatattcagatagaaatcatgccggcgggtggattctcatcggttacaccggcgggggtggaattcgaagcaaagatcactcctatagtcatcatttcttgtataatggccgccaccggaggccttatgttcggttacgacgtcggcgtttctggtggcgttacgtccatgcccgacttcttgaaaaaattctttccggttgtttaccggaaaaccagaaaccctggaatcgatggaaattactgcaaatacgacaatcaaggccttcaattgttcacttcatcgctttatttggctggtttaactgccactttcttcgcatcctacaccactaggag

SEQ ID NO: 22177 - DNA, 406 bp, Gossypium hirsutum
  Clone ID: LIB3272-009-P1-K1-A12
ctcctccaccaaatctcccactccctcctctcctctctccctccccaaacacactttaacctcatatgcggtgtcccttacactgccctccctatagccacctccatctctctcgacacctccatccccatgctcatgcgccgcaaagaagtgaaagactacggaactgccaagtccatcgaaggtgtttacgaaaagggtcaagcttgtttggtggtggaagacctcgtaacgtccggtgcatcggttctcgaaacggcggcaccgcttcggtctttgggtatcaacgtaacggatgccgtcgtggttatagatagggagcaaggcgggagggaaacgctggaggagaatgggattaaacttcatgcactttttactttaactgagatggtcaaggttttaagag

SEQ ID NO: 22178 - DNA, 462 bp, Gossypium hirsutum
  Clone ID: LIB3272-009-P1-K1-A2
gctggcacgcctgcacgctgcccgtgccttactggctggacccacgcgtccgctccgacactccaaacctcgacgaggaagattccaacagtccacccacttttgattccgacgactgcgactctgattgtgattccacgcacttcactgatctctccgccggtcttcgtgtcttctctgattcgattcttaggatggagctggccgggatggagatggtcaaggcaatggaagcttcccgatgtgaggcggagaaacggagggcggaatccgaggccgaattgactcggatgatgttgcgaactcagtcccagatcgcttcgtttgtcgccggagatgctgataccaggaaaaggaagcgtggagcagaagacgaaccaagggattcctctgttagacaaggagctttgctgctgagcttgttgcagtgcaacttaatcttctgaagtttcactaaaatta

SEQ ID NO: 22179 - DNA, 402 bp, Gossypium hirsutum
  Clone ID: LIB3272-009-P1-K1-A4
cttgcccaaaaaataaacattcattgctatcttcataactcttccattcctcatcatcgtcttctagtctggatctcttgcccaacgaccttccgaaggcgagtcatgcaaattcggttctccttgtaccagcgaacggagatggcacattattgtgaaggactgactttgatgccaaaagttcatcaacactccggaggcagatctggaagttcgcttgtcgaacgcagcgtcgaaatatatcttaatcattgttgtcttcctatgataaatatccgttcatgtactagccgatttctggagtaccatattagccatagagcatagcaaaagagtcgactctgctccttagttccctgcagaagtacccaggtaagccaatcccgaaactcaggtattgag

SEQ ID NO: 22180 - DNA, 404 bp, Gossypium hirsutum
  Clone ID: LIB3272-009-P1-K1-A5
tttgagctttcgtgtttgtctattgaattctttccttcactttctcgagaaaaaaaaaacgtcttcaggttgcaattgcggatctagctgcacctgctgatctggctgcaattgccgtgagaactgctcaatgaaccttaaccttggatactcggagaagacaaccagcactcagaccatcatctccggagttgcgccagtgaagatgacctttgagggaccagagatgggcactactgaatcaggacatggatgcagctgtggatcaagcttcaaatgttatccatgcacctgttgaaaagctcgatgaaagccatagatcatgaaaaaagaaagcagcacaataacaggcctctgtaatgatttattttcaaggatggatgcctgcaaggtctataactatg

SEQ ID NO: 22181 - DNA, 380 bp, Gossypium hirsutum
  Clone ID: LIB3272-009-P1-K1-A6
ccggtcaccatcagctgatcgcctcctcttccagcaatggcggaagctcaaacagaaactccgccttccctatctgagcaatattcactgaaggagaaagcggagaaatcagatgtggctacaaaagtagctgacgcagaagaggtcgaaaattcagcgagtacttcttccaaggaagtggtgaccgaggaagttgagactcctgctcctcttgtggaaagtactgaggttcctcctgctgttgctgaagaaaacaccgaagccaatcctgttgctgagaacagtgttgaagatgctcaagttgctgcggaagaaagtaatgaacgtaccaaaaagagctcatgtgatgctgaagaaacaccggagataaagcttgagac

SEQ ID NO: 22182 - DNA, 413 bp, Gossypium hirsutum
  Clone ID: LIB3272-009-P1-K1-A7
cgtatttcaggttgaagaaatcctccttttgggttcgatctctggcttcaccaccaatgctagagatcggacatgccccaggtaatgcccttttcggcaaatacgagatcggccggctcctcggttgcggtgctttcgccaaggtttatcatgccagaaacctccgcaccggcctcagcgtcgctgttaaggtcatcaacaaaaagaagctacccaacctcaccatgatgtccaacgtcaagcgcgagatctccatcatgagtcgcttgaaccacccttatatcgtcaaactttacgaggttctggccaccaaaaccaagatctatgtcgtcatggaattcgtcaaaggtggagaattgttcgctaaggttgctaaaggaaggttcaccgaagatttcagccgtaagtatttc

SEQ ID NO: 22183 - DNA, 390 bp, Gossypium hirsutum
  Clone ID: LIB3272-009-P1-K1-A9
gaagacaaggcggtaaagatgtgcttcttcagctgagggaacttgaagatgttatcattcccccatctccagttgcatttcctgatgaccatgaaacttggaatgtacagttatttagatcaattgatggtggggctgcttttggtttccctgagacacctgaagatgctgccagggctgggcttgtgagtggaaaggacaatatcattgaccgaagtattcaggatgcctatattaatgctatacgacgagcaaagaattttatctatattgaaaatcagtatttcctcggaagctcatttggctggagtcctgatgacatcaagcctgaggatattaatgctttgcatctgattcccaaagaaacttcacttaaaattgtttgcaaga

SEQ ID NO: 22184 - DNA, 391 bp, Gossypium hirsutum
  unsure (1)..(391): unsure at all n locations
  Clone ID: LIB3272-009-P1-K1-B1
ctggtttcttttagcttacagcttccattgtttttcagtagtgaagagctaaaaaagaagggaaaccaatggaggggaaagaagaagatgttagattgggagcgaacaagttctcagagaggcaacctattggtacagcagcccagtcccaagatgatatggattacacttagccaccctcagcacccttgtttgagcccagtgagttgacttcatggtcgttttaccgagctggaatcgatgatttcgcttctacttttctattattgtacatattttttttagcgtgaacgtggtattaccattgattttgccctgtggaagtttgagaccaccaaatttttttngtgttgtttttttctttattttgcatctcttttttattattaaa

SEQ ID NO: 22185 - DNA, 403 bp, Gossypium hirsutum
  Clone ID: LIB3272-009-P1-K1-B10
ctttcttttatatatatatttatcttctccattaatccatctccgttggattcaggagaatcttttgtacgccataatcgaagctctatctctcgagtcttcaatcatgagtttcttcaaaagctaattcacgttattcttatttcattcatttatttttcttctttgaatccgctctctgaggagagaaaagagaggggagggaaatgacatcggggttctccgggggtggcacagagttttacggtagaatagcaggcggatccgtctctaacagtggcaccatgagcaacaaccaacccactgcaccgtacgggacacatggaatcttcatggaccctaagtctcaaatcgtgaacagggccgcacccggtttcgtcgggaagcgaacacgagctgactt

SEQ ID NO: 22186 - DNA, 407 bp, Gossypium hirsutum
  Clone ID: LIB3272-009-P1-K1-B11
gccgcacgccagcctagcgtttccataaggaagaaatggcggtccctttgctgtcgaagaagattgtgaagaagcgtgttaagaagttcaagaggccccaaagtgatcgcaagatctccgtcaagacaagaaaacacgccactatcttcccgatggatttaagaaattcgtggtgcacaatgtccaagagctagagcttctcatgatgcacaacaggacatactgtgctgagatagcacatgatgtttcaacgaagaagaggaaggaaatcgttgagcgagcagctcagttggatgttgtcgttaccaacaaattggctaggctgcgcagccaggagaacgagtaaaggtcggttcttgaatgttgattttgctctttttagtatgatattctcttgtttaggaagg

SEQ ID NO: 22187 - DNA, 401 bp, Gossypium hirsutum
  Clone ID: LIB3272-009-P1-K1-B12
gtttaagaaaaaaatttccttagagcataaaagaaaagttacgaacatgccgggtgtcaatcctgaaattgagttcccagccattgagttccgtccatcggatttgaagcgaggaaccgaaggatggaaccggttgtgcaagagggttcaagaggcttgtgagactttcggttgtttcgaggtggtatatgaaagggtatcgacgaaactccgagaggatgcgtttgggttgatgaaagaaatggttgagctcccagtggagacgaaacagaagaataatagtcccatgccttaccatggttgggttggaccatgcaagcaggtttctgtgttgtatgaaggctttggagttggagatgcctccaactatgactctgttaaaagttttgctcaacttatgt

SEQ ID NO: 22188 - DNA, 370 bp, Gossypium hirsutum
  Clone ID: LIB3272-009-P1-K1-B2
cggaaaccggccatggctgccgccgctaatccccgctctttctactcgggttccaatcctcctcaccccaaccgctttgttttctcagccgatcctcctcccaaaatctcactcactcccgatcaattcaactactgctctgaggctctcaaattgttctcccaaaagctccagatgcccgacgaaatcaaccgcgagttctcgcacttacaggcaaataggattacaccttcggagatgatgaggagatgcacagtgggttttaacggtgctaatttggacaagaatcgatactctgatgtcataccatgtactttaaaaagtttattttttttccaaatcgacacgaacagggtagttcttaattcat

SEQ ID NO: 22189 - DNA, 349 bp, Gossypium hirsutum
  Clone ID: LIB3272-009-P1-K1-B3
ggagcattattaggagttgggattgtcaattgtggtggtaagaatgattgcgacgctgcactggctctattgagtgattatattagtaaagaggattctaacatccgaattgatgcataaattaggcgtggaaaattgcatatgctggtgcccagaatgagcagattcgtagcagcttgactctgatacttaatgatgcaaaggctccccttgatgtgatagcattcactgaaatgtgctcgggtttgacatacgtaggtgcaccaactgatgagggtgcacatcttccatgagtactctaatggaccgatattagtcagagtttgtggagccccctatttcgatcttt

SEQ ID NO: 22190 - DNA, 391 bp, Gossypium hirsutum
  Clone ID: LIB3272-009-P1-K1-B4
ctagaagaggctgatcttcactccatttcgaacactttagacaggctagttggggaaaatcgacgccaatggccatcagagacaccgtgaaaagggcggagcagctggtggagacgtcgatgaaagggaacgacgcctcccatgatgcctcgcacgtgtggagggtcagagaccttgccctctccctcgcacgagaggaaggcctctcctccaaccctgactccatggaaatcgtggagctagctgcacttcttcatgatgtaggtgattacaaatacttgagggatccgtctgaggagaagctagttgagaattttctagaggaagaaggcatagctgagagcaaaaagataaagatattaagcatcataaagggaatgggttttaaaga

SEQ ID NO: 22191 - DNA, 401 bp, Gossypium hirsutum
  unsure (1)..(401): unsure at all n locations
  Clone ID: LIB3272-009-P1-K1-B6
atacacaaatgattttagacagttgaaaggagcacatattcatataccacactcgcatctgctgatatgccattgggctttaaactaacctattttgattctactgataatctgcatcatttgggcttatttgccccctatgaggcgaaaagtgttgtaattctatctctgccaaaggcattttcccccattttaggggtaggaacgcagcttgtgcgatacacagagcgcaggtgttgtcataaagagaggcaccgttgtcatattcgccagagacttggggagaccgtctagatttgcgcatgagacaacacgggccgagaaaacacangtgtttgcaatcataatagagtggtcggatcctacaaacattagggtagcatttgaaggagccctctcac

SEQ ID NO: 22192 - DNA, 400 bp, Gossypium hirsutum
  Clone ID: LIB3272-009-P1-K1-B7
attacgtggagagcctttttttgtgtagcgattctcaattagtcttttttttaaacctaacagtttttttcaaaagtttataatggggtaaggggagggtcacatcaaccctggtgtcattggccatttccacttttgcaaggcgaccaattccggtcatttgatctacaagcctggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactttatcaagaacatgattaccggtacc

SEQ ID NO: 22193 - DNA, 380 bp, Gossypium hirsutum
  Clone ID: LIB3272-009-P1-K1-B8
gaggaatccaaattgttcatcgtgtaattaaggtccatgaaaggcaagatactggtgaagttgatgccctcaccaaaggagacatcaattatggcgatgacaggcttttatatgctcaaggtcagcaatggcttgatcggcaccatatcatgtgcagagctgtgcggttcttgccttatgttggctggattaccataatcatgactgaaaaaccaattatcaagtatattctgattgcagcattgaggttgcttgtgataacttctaaagactgagcagcatttatgaagggtgggccaaatctacaaggaaatcctcctacaattgccaacgcttctaccctctccttggcatcggtcatttcttgcttttttatacac

SEQ ID NO: 22194 - DNA, 301 bp, Gossypium hirsutum
  Clone ID: LIB3272-009-P1-K1-B9
gtccaactgatcgctaacctaaaacccacaaagggagggggtggattaacacaggtcgactggtgggcatggaagacgaaatccgctagggagtggctaacatcttacctgcataataaactagccgttagaatggatggcgcttaagtgcgccacctataccaacacgtcgacgcctgggccaggcccagatgacgtaggagggcagcggccatcgctgaaaaccacggggcgcgagccctttcgtggacggcgtatgggcacatacaggtgatgggggcatatatacaaatgagaacct

SEQ ID NO: 22195 - DNA, 404 bp, Gossypium hirsutum
  Clone ID: LIB3272-009-P1-K1-C10
ccgacactccacagcgcagcaatgggtgaggaagtaaaggctttggttcctgagtcactgttgaagaagaacaagaggaatgaagaatgggagcttgccaaaaagcaggagctcgaagccgcgaagaataagaaagtcgagaaccggaagttgattttcaacagggctaagcaatatgcaaaggagtacgaggctcaggaaaaagagttgattcaattgaagcgggaggcgaagttgaaaggaggattctatgttgatccagaagctaagcttttgttcattgttagaatccgcggtatcaatgccatgcacccaaggaccagaaagatcttgcagctcctacgtttgagacagattttcaatggtgtttttcttaaagtgaacaaggcaacaatgaacatgct

SEQ ID NO: 22196 - DNA, 333 bp, Gossypium hirsutum
  Clone ID: LIB3272-009-P1-K1-C11
cggacgcgtgggctcatgtcctttatttccgccgttcctgaatctcaacgccctgctttattccagtcgctgttgctcgaagcttgtgggagaacagtgaaccctgtgaacggagccgtggggcttttgtggaccggaaactggcacgtttgccaagcggcggtggaaaccgtcctgcgaggaggatctctacgttccatgcctgaactcatgtctccgacgccagcatccgacaaaacgttcgaagcccacttccccggccttgtggaattggcgggggccatcaccgattttaacctccacctgtggattttaaaattcaggatccagggt

SEQ ID NO: 22197 - DNA, 411 bp, Gossypium hirsutum
  Clone ID: LIB3272-009-P1-K1-C2
caacgctctccttctgtttctggtcaagccaatctcaaaagactccccttttagctcacagctcctctcttgagtactataatgggtaaggagaaggttcacatcaacattgtggtcattggccatgtcgactctgggaagtctacaaccactggtcattgatctacaaacttggggggattgacaagcgcgtgatttagagggttgagaaagaggctgctgagataaacaaaaggtcatttaagtatgcatgggtgctcgacaagctttaggccgagcgtgaacgtggtattaccatcgatattgccctctggaagtttgagactaccaaatactactgtactgtcattgatgcccctggacatcgtgacttcatcaagaacatgattactggtacctcacaggctgact

SEQ ID NO: 22198 - DNA, 402 bp, Gossypium hirsutum
  Clone ID: LIB3272-009-P1-K1-C4
gtcgtacggcccgttgatcaatctctcggaagcttctaatcatatgggtcatttcgtccagcttctcgttttcgtccatcgctctactcccgttcagtataaattgtccaaaggcggagaaataatcaggacagacattcaggtgggcgatgacactcgaccctttttctccgtatctttatggaagaaagaattgcggtctattgttgctgctggcgacatcgttctattacgaaatgtcaagattacaacatttcgagatgttttcgaggccagaactgttgactggtcatctttactccgtctagtccacccttaccagtcccttgtttcaaagagtgcaattgaattagtagcagaatgtagaatggggattgtggttaaagaaaagctttccaaggt

SEQ ID NO: 22199 - DNA, 396 bp, Gossypium hirsutum
  Clone ID: LIB3272-009-P1-K1-C5
attgctgcacgataacactcttctctcatatccatactttgaaagaaaaaaacgttatctcaaagcgaaaatcctcccaaaactggattaagaagagcagataaaacctgatgaaccccaagagcaccttcatcttggctggtctgctacttacagcttcactaactgcagcagctaggccagactcatttgaagctttatcatctgaggaaaagggcaacaaaggcagctgctaaccaggcaaccaatacaacataggttgtggtggcaacactggtgggatgggcggattatacaggccagggcctgggattggattgccagggtttgaaaaagggtggggacatcagatcgtaggcggtggctatggagctggcttcggaggtcctaccggag

SEQ ID NO: 22200 - DNA, 404 bp, Gossypium hirsutum
  Clone ID: LIB3272-009-P1-K1-C6
gagaaaaggaaaatggaagggataaagcaccaaatggttaaagtgaatggcataaacattcacatagctgaaaaaggtgaaggtccagtcatccttttcctccatggcttccctgagctttggtattcatggcgtcaccaaatcctcgctttatcttccatgggttaccgagccgttgctcccgatttgagaggctacggcgactcggatgctcccgactcagtcgagagttacacttgtttccacataatcggcgatttagtggagctgatagacgtactggatccggatgtaggcaaggtgtttgttgttgggcatgactggggagcttacatggcttggttattgtgtctgtttaggcctgataaagtgaaagcattggtgaatttgagtgtgccgttttt

SEQ ID NO: 22201 - DNA, 411 bp, Gossypium hirsutum
  Clone ID: LIB3272-009-P1-K1-C7
ctttactttaaaaggcatgacgggcaagcagtaacttgcgaagacttctttgctgccatgaaagatgcaaatggtgtggattttgctaacttcttgctatgtcaagaagtacccccaactcctgggcaacctgttaaagaaccgatgttcattccagtagctgttggtctactggactcaagtggaaaggacatgattctatcttctgtgtatcacaatgggacattgcagtctgttgcaagcaacaatcaaccagtcctcagcactgttcttcgagtaactaagaaagaagaagaatttgtgttttgtgatatattcgagcggccaattccatctctactgcgaggttatagtgctcctgtccgtcttgaatctgatctctccgacagtgacctatttttccttctcgct

SEQ ID NO: 22202 - DNA, 412 bp, Gossypium hirsutum
  Clone ID: LIB3272-009-P1-K1-C8
gggacacacagctgaaacagataaacatcaaaatgggttcccaaaaacacgtctttcttttgttatcagtgcttttgattctcaattcccttctcttttccggtgccgatgaagatcactattacgaatttattttgcaagaaacagagattacgaagctatgcagcacaaaaaccatattgacagtgaacggcagttttccagggcctcaaattcgggttcgaagaggcgacactgtttatgtcaatgtgcacaatcaaggaagatctgctgtttccttcgattggcaaggggttgaggatccggttgatggttcaaacgagttgatccagcctggtaaaaacttcacttacgagatcgaattagacgatgaaatcggaactttatggtggcatgcaaggagtgcttgggc

SEQ ID NO: 22203 - DNA, 410 bp, Gossypium hirsutum
  Clone ID: LIB3272-009-P1-K1-C9
aaaatatctcaaatctcctcctcctcctcagaaatcttagtatcatcaccatggcctcaaatcccaaggtcttctttgacatgactatcggtggtcagcccgctggtcggattgtgatggagcttttcgcagattgcactcctcgcactgctgagaacttccgtgccctctgtaccggcgagaaaggcgtcggccgcagcggtaagcccctccactacaaaggctcctctttccatcgtgtgatccctaactttatgtgccaaggaggtgacttcacggccggaaacggtaccggaggtgaatccatctacggatccaagttcgctgacgagaacttcatcaagaagcacactggtcccggtattctctcaatggctaacgctggtcccggaactaacggatctcagttc

SEQ ID NO: 22204 - DNA, 400 bp, Gossypium hirsutum
  Clone ID: LIB3272-009-P1-K1-D10
tctttagacagggtttcagggtctggttttcaatctaagaaagagtatttgtttggaaggatcgatatgcaactcaagcttgttgctggcaactcagctggcactgtcactgcttattatctgtcatctcaagggccaacccatgatgagatagactttgaattcttagggaatctgagcggtgacccttacattttacacaccaatgtctttacacaaggcaaaggcaacagagaacaacagttctatctttggtttgaccctacaagaaacttccacacctattccatcatttggaaaccccaacacatcattttcttggtggataacacccccattagagtcttcaaaaatgctgaatccattggtgtaccattccccaagagccaacccatgagga

SEQ ID NO: 22205 - DNA, 400 bp, Gossypium hirsutum
  Clone ID: LIB3272-009-P1-K1-D11
cagaaacgaccggcagagaaataaaaatgggaggctgggcaatcgcagtgcatggtggtgctggtgtagacccaaatctccctaatgaaaggcaagaggaagctaaaagactcctcaatcgttgccttgatattggaatctctgctcttcgttctaacctctccgccattgacgtcgttgaacttgtcgtgagggaattggaaacggatcctttgtttaattccgggcgtggatcggcacttacggagaaagggacggtggaaatggaagctagtattatggatggaccgaagagacgatgcggtgctgtttcgggtttaacgacagtgaagaatccgatatctcttgctcgacttgttatggataaaacaccacattcgtatttgggttttgccggcgc

SEQ ID NO: 22206 - DNA, 400 bp, Gossypium hirsutum
  Clone ID: LIB3272-009-P1-K1-D12
ttgaagaggaaaaggcaggaataaagactgatgcttttttcgaaacatgtgggcccaatgtatatgctgtggatgatctaaccactttttctctgaagacatacaatgaattgagaagggtggaacacgttcaccatgcccggaaatgagctgaacaggcgggaaaggctatcaaggcaagagcggaagggacatcagttgacgaatatgactacctaccgtacttctattcacgttcctttgatctatcatggcgattctatgatgacaatgtaggagatacagcacttttcagagacagcatccctaaatcaccaaaggcgaagttcggatcttactggatcaaagatgggaaggtggctggagctttattagaaggcggcactggcaaagaaaacca

SEQ ID NO: 22207 - DNA, 376 bp, Gossypium hirsutum
  Clone ID: LIB3272-009-P1-K1-D2
ggcttcatgtgaacggcactcgcacatgggttagtcgatcctaagagacgggggaagcccccacgacagcccgtccagacccagcttctaaagggaatagtattaaaattcctgaaccgtatcgcggcagctgacggcaacctttgggagtccgtaaacgtcggctgcggccatacgaagagttatcttttctagttaacggcctgcccaccctggaaacagctcaaccggaggtgggagacaacggccggaagagcaccttacgtcgcgtggtgttcggtgcgccccacaccgcccttgaaaatgcacaggaccgagtgccgtccgagcccgcacgtactcataaccgtatcatgtacccaagtgaacaccctct

SEQ ID NO: 22208 - DNA, 398 bp, Gossypium hirsutum
  Clone ID: LIB3272-009-P1-K1-D4
cttcttttttatacagggttttaggttctgtttttcaatctaagaaagctcgggggggggtttctaaattcctacacctcttcttttcacaaatcacttggcacctttcaccgcttattatccgtcatctcaagggccaacccatgatgagatagactttgaattcttagggaatctgagcggtgacccttacattttacacaccaatgtctttacacaaggcaaaggcaacagagaacaacagttctatctttggtttgaccctacaagaaacttccacacctattccatcatttggaaaccccaacacatcattttcttggtggataacacccccattagagtcttcaaaaatgctgaatccattggtgtaccattccccaagagccaacccatga

SEQ ID NO: 22209 - DNA, 405 bp, Gossypium hirsutum
  Clone ID: LIB3272-009-P1-K1-D5
gaaaatatcacaaatcttcttctccttctcagaaatcttagtatcatcactatggcctcaaatcccaaggtcttctttgacatgacgatcggtggtcagcccgctggtcggattgtgatggagcttttcgcagattgcactcctcgcactgcggagaacttccgtgccctctgtactggcgagaaaggcgtcggccgcagcggtaagcccctccactacaaaagctcttctttccatcgtgtgatccctaactttatgtgccaaggaggtgacttcaccgccggaaacggtaccggaggtgaatccatctacggatcaaagttcgctgacgagaacttcatcaagaagcacactggtcccggtattctctcaatggctaacgctggaccgggaactaacggatct

SEQ ID NO: 22210 - DNA, 405 bp, Gossypium hirsutum
  Clone ID: LIB3272-009-P1-K1-D6
aattggatgcattatacaaatcgcttgcagaacagtacacttggtcatctgcagttaagaggataccgcttgattttctgcaaggagacaagttccgtgaagcaccaattagttatattaagcctcttctaacgaagggggttccatctttattctcagatctttctcctttgtatgatcaccctggcaaggcagatatgttggagcaacttattcttgagttggagcattcaattaggattaatgggagatatcctgataggacagagaaggagcccccttcaacacttttgtggattttgttctttttggctcaacattatgacagaagaggacagtatgatgttgctatttcaaagattgatgaggctatacagcacactccaaccgtaattgatttgtact

SEQ ID NO: 22211 - DNA, 390 bp, Gossypium hirsutum
  Clone ID: LIB3272-009-P1-K1-D7
aaatattataacatcggggatattgaaaccagacatgaatgctgcaggggtgaacatttcagctgggcggtccgatgcactaggcccaacagtgtatggtacttataccagccaagtatactctaacatcattgcaaggacttgaatgtcttgagcacatggtcgcggccttcgacggttaatgaaggccgctaacccagattggactccagcagctatcaaatcagctgttatgactacagcttatacggaatacaaaaacgcgcagaaaatgcaagatattgtaacggcgaaaccatccaccccgttcgaccatggtgctagacatgtggatcctgtttcagcgcttaatccagggcttgtgtatgatttgacagcggaagattatct

SEQ ID NO: 22212 - DNA, 411 bp, Gossypium hirsutum
  Clone ID: LIB3272-009-P1-K1-D8
gtctctctcttcatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgaaggttgttgacattgttgacactttcaggcttcaggagcaaccccctttcgacaagaagcagtttgtcgtgttcatcaagaagttcatcaagaacttgacaccaaaactggatgcgaaaaagcaagagtccttcaagaaaaacattgagggagcat

SEQ ID NO: 22213 - DNA, 411 bp, Gossypium hirsutum
  Clone ID: LIB3272-009-P1-K1-D9
gaaaaaagaaaaaaagtcatttctttcatcttaaaaagacagcgaggaagccacgaagataatagagtgattttcaatctccattttaagggtgtggaacaatgggtgctggaggcagaatgtcggttccaacgagtccaaaaaaacccgaattcaactcactgaagcgagttccatactcaaagccacccttcactctgagtgaaatcaagaaagccatcccaccacactgtttccagcgctccgttttacgctcattctcatatctcctttacgactttatattggcctctcttttctaccatgtggccaccaattacttccctaaccttcctcaggctctctccaacgtggcttggcctctttattgggccatgcaaggttgcattttgaccggcgtttgggtcatag

SEQ ID NO: 22214 - DNA, 401 bp, Gossypium hirsutum
  Clone ID: LIB3272-009-P1-K1-E11
gtcagctcatgttcatggtattggacactagcaatgatgtggcttgggtcccatgctccggctgcaacgggtgctcagccaccactttctcacccaacacttcttccacctatggttcgttagattgcggtttgccccaatgcgcccaggtccgtgggctgtcgtgcccggctacggggtctgcggcttgctcttttaaccaatcctacggtggagattcatcattttcggccaacttggttcgagattccttaggattagccaatgacattgtcccagattttgctttcggatgtataaacgtcatctctggtggatcagtaccaccgcaaggactgttgggtttgggtcggggacccatgtcacttatttcacaatccggggccctctactctggtgtt

SEQ ID NO: 22215 - DNA, 404 bp, Gossypium hirsutum
  Clone ID: LIB3272-009-P1-K1-E12
attcctgcaaattcccttcttttcccctccacccaagcctaaaaaatcatggcgacagctcaaatcagcaaaaaacgaaagttcgtcgctgatggagttttcttcgcggaactcaacgaggtattgaccagggaactggctgaggatggatactctggagtcgaagtcagagttactcctatgcgtaccgagatcatcatcagagccacccgcacccaaaacgttctcggtgaaaaaggtaggaggattagggagcttacctcagtggttcagaagcgattcaagttcccagaaaacagcgtcgagctttacgctgagaaggtcaacaacagaggcctttgcgctattgcccaggccgagtctcttcgctacaagctactcggaggtcttgccgttcgcagggc

SEQ ID NO: 22216 - DNA, 411 bp, Gossypium hirsutum
  Clone ID: LIB3272-009-P1-K1-E3
gcgatcggaaggactacttgaagcttgctgttaaaacaccgtaattttccagatgaagcgtgtaagatggaatgaggaaaatctgggggaaattgaagcaaataaacccgtaaggcagaaaataactgaacccaagacgccgtaccaccgcatgattgatgacgatgggtctttgtctcccagaggacgtagtttcaatgattgtgtcattgatgtggatgctgaggaattatgctctgctttgaaagatgtggcttcctcaagtagaaaaacaactgggcaatcaggtggttggacttcttctgaggatgaggctgatcctatggatcatgatgaagaagatcggaatagtaagagttttaaggagcaaaggaaagcacactatgatgagtttttgaaaataaaggaact

SEQ ID NO: 22217 - DNA, 272 bp, Gossypium hirsutum
  Clone ID: LIB3272-009-P1-K1-E4
tcgatcgtaaggactacttgaatcttgcttttaaaacaccgtatttttccagatggggcttttaatatgtaatgaggaaaatctgcattaaatttaatcaaatatacccgcaaggcataaaataacttaacccaagacgccttaccacctcatgattgattacaatgggtcattgcctcccataggacgtattatcaattattgtttcattaatgtggtttcagattaattatacctcttcttataaagtaattttcattctttagtaaaaa

SEQ ID NO: 22218 - DNA, 405 bp, Gossypium hirsutum
  Clone ID: LIB3272-009-P1-K1-E5
attctattttgtttctatcaggataataaagaaacttgtcagtccatcaccatgatacttccatccaagtttcaagatgaaactgaaaaaagtgacaaatcttcaccacctttggatgtttcggttgcattccctcaagcaactccagcatctgtttttcctccgtctgtttctgattattatcgatttgatgatctattgagtcctgaggagaagactctccgaatgaaagtaagagagtttatggaaaaagaagtagctcctataatggcggagtattgggagaaggcagagtttccattccaaattcttccaaagcttgctgatcttggaattgcaggctttaataccgagggttatggatcccctggtctctccatcactactagtgctattgcaaatgca

SEQ ID NO: 22219 - DNA, 400 bp, Gossypium hirsutum
  Clone ID: LIB3272-009-P1-K1-E6
tgctcctccacgctcctctctacgcttctctacgaccttttcctcaacactttctcttccgatccttcgcttcgagccgccgccgtcgccgatctccgtgcggctcgcgttcgggatcccgcttgcgtttccttctctcattgcctacttaattataaaggattcttggcatgccaggctcatcgagttgcacacaagttatggactcagtcacgtaggccgctagcattggcattacattctcgaatctccgatgttttcgccgttgatatacatccggcagcaaagatcgggaaagggatcttgttgatcatgccaccggtgtggtgatcggagaaaccgcggttgttggcaacaatgtgtcaattttgcatcacgttaccctcggtgggaccgggaa

SEQ ID NO: 22220 - DNA, 392 bp, Gossypium hirsutum
  Clone ID: LIB3272-009-P1-K1-E7
gtttgctctgtatattgaaattttctttctcgattttctctttagccaaaaaagatgcagatcttcgtcaagactctaaccggcaagacgatcactctcgaggtcgagagctccgacacgatcgacaacgtgaagaccaaaatccaagataaggaaggcatccctccagaccagcagcgtctgatcttcgccggaaaacagcttgaggacggccggaccttggccgattacaacatccaaaaggagtcaactctccacctcgtcctccgtttgcgcggtgggatgcaaatcttcgtgaaaaccttgaccggcaagacaatcactctcgaggtcgagagctccgacacgatcgacaacgttaaggcgaagatccaagacaaggaaggcatccc

SEQ ID NO: 22221 - DNA, 395 bp, Gossypium hirsutum
  Clone ID: LIB3272-009-P1-K1-E8
ggcgttctaatttttccttcttcattcggccaatctccatagccccttattctcatattcttgcttcaatttgagcagtggtgcaggggagccatggagaacctcgaggactctgttttcaatttcgaaacaccgtccctactttgattgcgacgaagaagacgggtctcgactactaagcctgttgcaggtatgaatggagctagctggatgatggcgcacgtggggctggcacggaggcagcagcggtgttggaggctactgaaagttgctgcggcgcaagtgacctaggttttctgccgaaaatttcattggtgttttgggcttgggatattttgggctgtttgggttagttgggttaggtttaggtttgggcttgtaatgggtattggatc

SEQ ID NO: 22222 - DNA, 407 bp, Gossypium hirsutum
  Clone ID: LIB3272-009-P1-K1-E9
cggcatatcagcacttgtctgaaggttttggatatgactggcttgaagctttcagcattgaatcaaataaagatactgaccactatatcaacaatcgatgacttgaattatcctgagaagacacagacatattatattgtcaatgcgccatatatattttcggcatgttggaaggctgtaaaacctctcttgcaagaaaggacaaagaggaaaattcaggtgcttcaaggttctggaaaggatgagttgctgaaaataatggattattcatcccttccacatttttgtagaaaagaaggttctggatcaacacgtcacagcagcaatggaactggagataattgtttctcgttggatcacacctaccatcaacagctttacacttacataaagcatcaagctacaca

SEQ ID NO: 22223 - DNA, 148 bp, Gossypium hirsutum
  Clone ID: LIB3272-009-P1-K1-F1
catcatttatattctccttctccttcccttttcttactattctaaactttgatggtactatattgatgagaaaacaaattctcacctctacatcttttttctaccctcgtagttctttaaaaaaacaataactgcaaaagctcctatc

SEQ ID NO: 22224 - DNA, 402 bp, Gossypium hirsutum
  Clone ID: LIB3272-009-P1-K1-F10
atcaaaagaaaaggcaaaggcgagggtctattttcttcacaaactacaatggcttccgagtctttagtaaccaagaggctagatggtaaggtggcactgataactggtggtgccagtggtttaggagagtgttcagccaggctatttctcaaacatggagccaaggttctgattgctgatattcaagacgaattgggccactccctttgcaaagagcttggaactgaaaacttcagctatgtccattgtgatgtaacatgcgaatctgatgtcgaaaatgccgtaaacttagcggtctccaagtatggaaaactcgatatcatgttcaacaatgcaggccttattggtgatggtgaagtcagagtgacagacgccagcactgacaacttcaagagagtgttc

SEQ ID NO: 22225 - DNA, 295 bp, Gossypium hirsutum
  Clone ID: LIB3272-009-P1-K1-F11
caagttttgaggtagaaaagaagagaccatggcaagagggcgaaccattctgacttgtctcatgtggcttttactcgttttctccattactttgtgtgcaagtgcaactgccggtgctcgtctaggaacatcccaacaagttgtttatccacaagtatgctgcggtgatgattgctgttagttatgttagcatgagatttaaggttgaatcattatgtgtatcatcttttttcccctttgttgaatgtaatgtaattgtaccaaaaagaaaatgaaagcaagcatcatccaattt

SEQ ID NO: 22226 - DNA, 409 bp, Gossypium hirsutum
  Clone ID: LIB3272-009-P1-K1-F2
cggacgcgtgggtcaacttcctggatcgttgagggtaaggatgtggaatggggaggttctcaaggtccaaaaaccctcagtcttaagatcagctggaaattgaaagatggatggagtagccgtttcccaagatacaatatctatgttgagaaactaaagaaacaagcagtgagaccccaaggaagaaagctagagatccctgctctagcaccacccaatgctcggaatggcaaaactgaagtcgcaggggagtaccttggagaatcacaagttgaagccttctatgtatctgactttatcatcccttctgccatttcaagcctcaagtatattattcaaccatgtgattctggtggtgctagccaagttcttgatgatgccccattttttcaatttaatgttgaaggtc

SEQ ID NO: 22227 - DNA, 404 bp, Gossypium hirsutum
  Clone ID: LIB3272-009-P1-K1-F3
ccaaaggaccctctctcgctggctgcgtttctattttctggaaactttcacggtagttacacgtgttcgcaatttatcgtccggtcacttcccgcgtgaagaccttcccgactcgggacttgctatcatcttcaaaaacttcctaagactcttcttcttgaacggcctcattcaacggctttaaccaccaaagtgatgaaaatgaatattatgccctccttctcagacagtaaacaccgacggagtccccgaggagaggctctcctcccacaaaagcagggctaccgagtactcgagactcccgaagccggctttgatggggcttcaacttcaggagccattttcaacctctcgaccacagttgtgggagccggtatcatggcgctcccagccaccgtcaatca

SEQ ID NO: 22228 - DNA, 375 bp, Gossypium hirsutum
  Clone ID: LIB3272-009-P1-K1-F4
gaggggaaggaaggaaggaaggataagtttttatccaatggaatcttatacgggggcacatctcaattttgtttattatccgttcacttccctcttgaataccttccctactcgtgacttgctatcatcttcaaaaactttctaagactattactcttgaaccgactcatttatacgtttttaaccaccaatttgttataaattaaatattatcccctccttttcatactgttaacacaaactgagtcctctaggagaggctctccttcaactaaagcagggctacctgtttctataaactcccgtatccgttttttatggttctttaatttaaagatgccattttcaatttctctatcacagtttttttatgct

SEQ ID NO: 22229 - DNA, 408 bp, Gossypium hirsutum
  Clone ID: LIB3272-009-P1-K1-F5
tgagaggccaaaacaacggtggtgtaagggaatttgcttcgccagataggggtgcgcacgataagagagttggtggtaacaaccataacaataacaaccaccaccaccaccatcaccaccatcaccacaacaacaaatcagcggcatcttcggatatgacccatgacagcaaaaaaggaggctcatcttcaggaagcggtgaggcagctccacccatcgtttggccaccaaaatttgtgattgctttaactaataaagagaaagaagaagatttcatggccattaaaggatctaagctgccgcagagacccaaaaaacgagcgaaatttattcaacgtaccctcaacctggtaagtccgggggcatggctatgcgatttaacacttgaacgatacgaggtcagggagt

SEQ ID NO: 22230 - DNA, 406 bp, Gossypium hirsutum
  Clone ID: LIB3272-009-P1-K1-F6
tattcccaaacatgtctaaagcctgcttgcttttgtttctcgttggagtggtggtttttatcatcactccttctctagctaaccaacatcatgataatgagcttcccaaggggaagcctttcccaggtgagaagcaaccacaacacaagccattccctgaacaccgaccgccaatacacagtggacctggcggtaaaggacaggagccaccacatggggaaaaacctcctcatagaaacttattgagtgtggaagttgagggcacacataaacctccacgacattcaggtggtaaacctccaagacactcggggggtaaacctccacatgttgaggggttccctaccgataaagcacccatgaagccattccctggtgaaaaaccatccaagggtaagggaaaggg

SEQ ID NO: 22231 - DNA, 407 bp, Gossypium hirsutum
  Clone ID: LIB3272-009-P1-K1-F7
acaatgtcggtctcacttcaagctgcagctaccctgatgcaaccaatcaaggttgctgcaccatcaaggaccaatgtgctgctcaggtcctcccagagcgtttctaaggccttcggtttggagcctgttggtgctaggctcacctgctctttgcaaactgacctcaaggacttggctcagacgtgtgttgatgctaccaagctcgctggtttcgctcttgctacatctgctcttgttgtctcgggagcaagcgctgaaggagttccaaagcggctaacctacgatgaaatccaaagcaagacatacatggaagtcaaaggaacaggaactgctaaccagtgcccaaccatcgatggtggtgtcgactcttttgccttcaagcctggcaaatactacgccaagaagtt

SEQ ID NO: 22232 - DNA, 395 bp, Gossypium hirsutum
  Clone ID: LIB3272-009-P1-K1-F8
gcaactctgacgcaactgctatttattttttgtggttttgagcagcagcttggatttggaagaatggtgagggtgagcgttttgaatgatgcactcaagagcatgtacaatgcagagaagaggggcaaacgacaggtcatgatccgaccgtcctcgaaggtgatcattaagttccttttggtcatgcagaaacatggttatattggggagttcgagtatgttgatgatcatagatctggtaaaattgtggttgaattgaatggtaggctgaacaagtgtggtgtgatcagtcctcgttatgatgtctgtgataaggagattgaagtgtgtactgctcgcgtgctttcttcaagacagttggcttatattgtgctcacaacatcatctggaattat

SEQ ID NO: 22233 - DNA, 408 bp, Gossypium hirsutum
  Clone ID: LIB3272-009-P1-K1-F9
cgattttctattttgttttctctccctccaattaagatgcagatcttcgttaagaccctgaccggcaagaccatcaccctcgaagtcgagagttccgacacgatcgacaacgttaaggcgaaaatccaagacaaggaagggatcccaccagaccaacaacgtctcatcttcgccggaaaacagctcgaagatggccggaccttggccgattacaacatccagaaggagtccaccctccatctcgtcctccgtctacgtggtggcatgcagatcttcgtcaaaaccctgaccggcaagaccataactttggaagtcgaaagctctgacaccattgacaacgtcaaggcaaagatccaagacaaggaaggcatcccaccagaccagcaaaggctcatatttgccgggaaa

SEQ ID NO: 22234 - DNA, 273 bp, Gossypium hirsutum
  Clone ID: LIB3272-009-P1-K1-G1
catagaggaggaaaaaaaaatcaaatccccactattttgtctatataaatgtctcgaatttcaacttggttgatcaccagttcaattcaggaactcataactcctcaaaattcttcttcaatggcgtctcgagttcttgttttggcttcaattcttattttctcttgttttgcagagacatgctatggggcgatcttattcttatacctttaaagaacacttgttgctactgcttcttatatgacatggtcttttttaagccctgttagacat

SEQ ID NO: 22235 - DNA, 401 bp, Gossypium hirsutum
  Clone ID: LIB3272-009-P1-K1-G10
gtcatttaggtggaatggaggttctggctctagaactggcaatacatcaagttctaatatatctggggatagagatgctgtaccacatgagggacatcaatcgagaagcatggctaggaacctgttagatcatcctatgtttgttcgtgcacctgagttgagaaatttggttcggaatccaatgaatcgagatgtaaatagtggaaatttaagtgttcctggaaattttgcttcgacatctcgtggtggctcaagttctggtgccaatgcatcttccgttcccacatgggctcctcagctgaatcacccttctcaatatccgcggagattgtcgggacttgttcgtcgacagttgatgtcttcccttggcccagagtctggtggcccgggaaatcatcctt

SEQ ID NO: 22236 - DNA, 395 bp, Gossypium hirsutum
  Clone ID: LIB3272-009-P1-K1-G11
ctcctccatcaaagaagaagcccaacaatgccgccgaagttcgacccaacccaagtcgtcgacgtcttcgtccgcgtcaccggtggtgaggtcggagcagccagttccctcgctccaaagattggtccgttgggcctctctcccaaaaagatcggtgaagacatcgccaaagaaactgccaaagaatggaagggtctccgcgtaactgtcaaactcaccgtccagaaccgtcaggcgaaagtcactgtggtcccgtcggcggcggctcttgtaatcaaggcgttaaaggagccagagagggataggaaaaagaccaagaacatcaagcacaacgggaacattaacctcgacgacgtcatcgaaattgccaaggtaatgaggccgaggtcgatggc

SEQ ID NO: 22237 - DNA, 402 bp, Gossypium hirsutum
  Clone ID: LIB3272-009-P1-K1-G12
gtagctttggaagcatggacttcatagctactatcctgtttctagctcttgtcatctcctccaccaaagctttggacccttgcggccctcagccagatgactcggaccttttggtcatcccaatctatggcaaatgttcaccattcaacccacccaaacctgactcatcgttcaacacagtcatgaacatggcatcaaaagacccagcaagggtcaagtacttgtcgagccttgtagcccaaaagaccactgcggttcccattgcttcaggccaacaagtcctaaacattggcaactatatcgtccgggtaaagattggcactccgggtcagctcatgttcatggtattggacactagcaatgatgtggcttgggtcccatgctccggctgcaacgggtgct

SEQ ID NO: 22238 - DNA, 394 bp, Gossypium hirsutum
  Clone ID: LIB3272-009-P1-K1-G3
actaaaggcaattgtactgtctccctatcacgtaaactttcacttgtatttatggagagaaatatatttggtagagcccgaggacgtaagcaaaatttgctgaacctcgttaaaattctagtgcaatgtattttttgatctgcatatttggcaagtgtcattgtagtgatttattgagctatcaaattacgatagagggatattctacctaggaaagatctggcatgtaagcaatactggtgatccacctatctttcctgggaattgaacttagtgtgatctttcagaacaataatgctactctttcacacgctgacgcacatcaataaagtacaagaactactatgcacaatcttgaagtcgggggagcagaatgcactgccactcatagtac

SEQ ID NO: 22239 - DNA, 189 bp, Gossypium hirsutum
  Clone ID: LIB3272-009-P1-K1-G4
acttaatgcaattgttctctctaactatctgtaaactttcacttgaattaatggggagaaatatattgggtagatcccgatcacataacctaaattggcctaacctcgttcaaattctaatgctattaatttaatgatctaaatatattgcaagtctcattatagtgatttattgagcgatctatttac

SEQ ID NO: 22240 - DNA, 405 bp, Gossypium hirsutum
  Clone ID: LIB3272-009-P1-K1-G5
tccaaatcgaaatttaaggccaaaaagacacaagggttactaattaaattaatcttcagcgaatatgttggtttatcaggatcttctcacaggtgatgagctcctctcggactctttcccatacaaagaaatcgagaatggaatgctatgggaagtcgagggaaagtgggttgttcaaggagctgtcaatgtagatattggggcgaacccttctgcagaaggtgctgatgatgatgaaggtgttgacgatcaagccgtcaaggttgtggacatcgtcgacactttcagacttcaggagcaacctgcttttgacaagaagcagtttgtgaccttcatgaagaggtacatcaagaacttgacacccaaattagagcctgaaaagcaagagtctttcaagaagaacat

SEQ ID NO: 22241 - DNA, 406 bp, Gossypium hirsutum
  Clone ID: LIB3272-009-P1-K1-G6
attgaaccttgtggagtgtagtcagtctttcggtacccatcatggcacaaatcacaccatcatctgatcttgatttcgttgatgatttttactactcggcactctttgatgaagacgaacatgaaatctttccaccatctgacgacaagtatgccgaggagttgcagtttcaagaggctctcatgtcatccaccgtcttttccaaaatgggtaacaatgacatctgcaacccatgcatcgcccatgcttcatcacccctgttaatccaagccgtgcctctgcctgagttactggagatggaaacagaggaaaccggtgaatcctccttaagcttctgcgagatttgcgccgaaaggaaagaaaacgatcagatgttcactacgcaaagctgcaaccactcttactg

SEQ ID NO: 22242 - DNA, 405 bp, Gossypium hirsutum
  Clone ID: LIB3272-009-P1-K1-G7
atcttatctaatacacccactgtagaaaaaaagagagaagtttgatcagacggtgaaaatgggtggccttgaaactgatagaacaacaacaggatgggctgccagagatccttgaggagtattgtctaattacacttacactcttaggagcactggtcctgaggatgttttcgttgagggtatgtgctgtggaatctgccacaccgatcttcataaagccaaaaatgatcttggtatgtcaaactacccaatgggtcctgggcatgaagcgattggtgaggtgctgcaagttgcatcacatttaagcaggttcacagttgttgatattgatgacgttgcttgtcttgttcggcgcgggatatacttctgaccatgcgacttagcaaatgaacaatactgtccaaa

SEQ ID NO: 22243 - DNA, 392 bp, Gossypium hirsutum
  Clone ID: LIB3272-009-P1-K1-G9
aaagcacgctcttcttccttgtgtaagcggcgccggcaagaagctaaggccagtccacctcggatctctcgtctctgccttccatcgacaacaatctatcttacatgtttcacttcttctttcatcaaagattttgatggcgtcaaaattgcagcagttgcaatctcaggcgtgccaagcttcaaagtttgtggcgaagcacggaactgcttactacaagcagttgttggagcagaacaagcaatacattcaagagccgccgacagtggagaagtgcaacgagttggctaagcaactcttttacactcgccttgctagtatcccaggtcgtacagagtcattctggaaggagctcgattatgtcaagcaactattgaagaacaggaaagagc

SEQ ID NO: 22244 - DNA, 124 bp, Gossypium hirsutum
  Clone ID: LIB3272-009-P1-K1-H1
ctcactcctccatcttcaataatttcttccgttgatctttgttagagattagctttttaattctccattatgggatcgatcatgatctttccacaatcgtatttacatggttcaactctttttt

SEQ ID NO: 22245 - DNA, 403 bp, Gossypium hirsutum
  Clone ID: LIB3272-009-P1-K1-H10
tcatatctctacttttcctctcgatttcccgagctaattggaagagtcttgaaggtaaaaaccgaagaaacaaaggctctctctctttgtgaatccaatcaaatcgaagatgttgagagtggcaacgaggcggctcacttcttattcgtctgcgtggaggtcgcaccaggccacctccgctatcgcctctcgtcctttcatcgacggcgccgattcttctgattgtctcagatccaattcctcctcctcctcctcttccttttccttctctttcgcttctcaattccttcttcccaccagaggttttgcttctgagtcactcaccccaaaaagtgaccacagtgtgattcctgatgttccagcaacagtggctgccattaagaaccccagttctaaaatagtt

SEQ ID NO: 22246 - DNA, 402 bp, Gossypium hirsutum
  Clone ID: LIB3272-009-P1-K1-H11
aaattttataacttggaacctagacacccatggctactgtttctcaattgaataactttccatgcaagaccttcttaataaccccacaaaacagtaactttacctcaaaacttccggttctgcctctaaactctacaaaaccaactcagaattcgatcaagaaatctcaatttttgacccagaaatcagtccagccaaggcctgttttccaggtccgtgcttcggacgccgacgacgaatggggcccggacaaggaggagccagttgtaatcgagagtcctggagtggccgtggcggaagagaagaagcctgacgatgcgggggaaatagagagcttgaagaaagctttggtggattcgttttatgggacggatcgtggcttgaaagctagcagtgagacca

SEQ ID NO: 22247 - DNA, 314 bp, Gossypium hirsutum
  Clone ID: LIB3272-009-P1-K1-H12
ctttaaatggtcaagaccttcaaagctaagcccccggagtaaggcaacaatcgaatggataatcccatcatcttcctcaccgggagtatacagaataagacatttcggtgcttcaaaagggcttatgggatcaattcggcatttcactggttcatcaagtgcttttgtagtggcatgagaaaattaaaggtcaaagccatttatacatgatatggcacagcgtcttcaaagtttaattatttttatgctatttatgtaatgaattgtctttaggttataagttcaaacacggtcgaatccaacaatgttcctat

SEQ ID NO: 22248 - DNA, 350 bp, Gossypium hirsutum
  Clone ID: LIB3272-009-P1-K1-H2
gatggatcaatgcaatgctactgtttattgagcaaatctatcagcactctctgcgagagatgaaatcgccctgcttggacgacctacatggcaagtgcccgtaggccgaacagatgcactatcatgcagtctaagcgctctctgcatcgaaattccatcaccatatgctaacctgacagctctaacctacttggtcgctgccaaaggcctaagcacacgagacctgaccgccctatccggtgccacacaatcggcctggctcgatgcaccactttccgcggtcgtatctacaacgacaccaatatcgaagcgtattgagcagacaccatgacggtccaactgccctgctt

SEQ ID NO: 22249 - DNA, 194 bp, Gossypium hirsutum
  Clone ID: LIB3272-009-P1-K1-H3
gtttcttttagcttacagcttccattgtttttcagtagtgaagagctaaaaaagaagggaaaccaatggaggggaaagaagaagatgttagattgggagcgaacaagttctcagagaggcaacctattgggacagcagcccagtcccaagatgataaggattacactgggccacccccagcacctttgtttgag

SEQ ID NO: 22250 - DNA, 305 bp, Gossypium hirsutum
  Clone ID: LIB3272-009-P1-K1-H4
aatgatggacaaaaccctgtcatgtgtgttgtcagttggccttggttggagatagctcttatttattttcctttctttttgctgtcttgaatctgccctgcttttttcaccgtatgccattaaagaggttctgctagttgtttatggaggtctgcatcaaacgtcatggattttagggatattttgcaaaccttcatggtgtcttgattggtggaaattagggattcggtttgatatactgcatacatagaatcacggttttgttggtgggatgttgacacccatgttgctgctcatgtctcagg

SEQ ID NO: 22251 - DNA, 365 bp, Gossypium hirsutum
  Clone ID: LIB3272-009-P1-K1-H5
atttcttttttttaaggaacaggccaaaatatgtttaatggcgcggttgtcgttataaaacccggtgctcgagccctggcatagcgtgcgcttgatcaaagctctgctgttggatcttataaccaaatgaaaactccggacgcttacatggaacacggtaccatgtccacgagaacaagacatttgctacaacatcctaagagaccactaaagcccagctgaccatgaccaacacgatggctacgcaagagactggattagtaaactcgaaccactcgctgcgggtgaccttgctgtcggtagcccagagactttcctccaggtctcaagaacagacataagccttgagtcatgatcacaaggga

SEQ ID NO: 22252 - DNA, 405 bp, Gossypium hirsutum
  Clone ID: LIB3272-009-P1-K1-H6
gggagcccaaggaggagaatactaaccttggacctgctgttcgagagggtgagcatgtttttggggtggctcacatttttgcttcattcaatgatacatttattcacgtgactgatttgtctggaagggaaacaatggttcgaatcactggcggtatgaaggtgaaagctgatagggatgagtcttccccttatgcagccatgcttgcagcacaagatgtttctcaacgctgcaaggagttgggtattactgcccttcatataaagctccgagctactggaggaaacaagacgaagacccctggtcctggtgctcagtctgcacttagagcccttgctcgttcaggcatgaaaattggtcgaatagaggatgttactcccattcccactgatagtactcgtagaa

SEQ ID NO: 22253 - DNA, 402 bp, Gossypium hirsutum
  Clone ID: LIB3272-009-P1-K1-H7
atttgctcaccttttctatcagtttagtcttcgttcctacatttgttctttattttctttaccagaaacggagtgctgcatggatttgagagcattgaaatcgagtgtaagagaactgaccatgcaaaacacccaccatgttttcgatgattccttggtcatgaatgttatgaacggcgccgttgctggtgaagatttctccatcgattgcttccttgatttcaataacggagaatttgaagaaggttccgttgaagaagaagaaaaaaactctgtttctacttcatatcaacaacgtgttgcagatgatgatagtaactctaattccaccagttttacactctccgtaccggatgatgaaatagcagggcttgaatgggtgtctcactttgtggacgagtc

SEQ ID NO: 22254 - DNA, 407 bp, Gossypium hirsutum
  Clone ID: LIB3272-009-P1-K1-H8
atagctttccttccaatcaaatactaatccctttgtttttttgttctccctctctttaaaatttgatttttacatagcacgaaaattaaaaagttatggcggaagaagaagaaacagagctgagcgatgatcaaaagaaaggaatcgccaaatggttcctcgtaaacgctcccgctggagaaatccaatatgtctccagagatttaaaattggttttgaatgatgatgatgtgtataatgaggcagcatcggaggcgtttcccgtttacaacaaatgtcacctcatttccctcaaaatgcctggtggattcggtgatgtgttggttacatcatatggggagcttcaggataacgagtacctagaccccaagactgcccaagttgccatagtcgatcatgtcaaacag

SEQ ID NO: 22255 - DNA, 406 bp, Gossypium hirsutum
  Clone ID: LIB3272-009-P1-K1-H9
ttataatccttctttttaaatactcgtctttaaaaacaaaaattgtgaaacatgcataatccactttttcttgtgcttactgtaatattctccagcctggtggttcagccagtaatgggagcaaagggtttcagtgtggagcttattcatcgtgattcgccaatatctcctttctataatgcttctctcacctcatcacagatcctaagaaaaaatgccctccattccctggaccgtctcagacacttccaatccatgattgatcaaagcgccatccaatctgcagtgactccaaatgggggtatttatctgatgaaactctgctttggaaccccgccagttgactacatggccgttgcagacactggaagcgaccttatatggatacaatgtgttccatgtcttc

SEQ ID NO: 22256 - DNA, 397 bp, Gossypium hirsutum
  Clone ID: LIB3272-010-P1-K1-A10
cggacgcgtgggctgagctccatggtgacaaaaggagcaaaacaatgacttctcttcatgaagcttgtgagaaatggggcttctttcaggttgataaccatggagttgataagaagttaatggagaaggtgaaagagatggtgaatgattactatgatgagaatttgaaagaaaagttttatgaatcggagatgactaaaagtttgaacaagaatgagaaaatctccgacatggattgggaaagtactttcttcatttgccaccatccaaattctaacatcaatcaaatcccaaacataactaagcaactatgtgaaacaatggaggaatacatagcacaactgattaaactagctgaaaccctatcggagctgatatgcgaaaatctaggactaga

SEQ ID NO: 22257 - DNA, 398 bp, Gossypium hirsutum
  unsure (1)..(398): unsure at all n locations
  Clone ID: LIB3272-010-P1-K1-A11
aaaaccttactttatttagggttggggttttgctccttctgagtttctctctgaataccaaaaatatttccaaattgaagatgatgcaacaaccagcacaagctatggtaccaccaccaatggctccaccaccttctatggcgggtgctccacagacccaacaacagtaccaatatcagcaaccacctccggctccggttcctcagacacaaccaccttacatgatgatgaacatgatgcagccgcctcagagtcatcctccacctatgtggcccccacaacaaggttcggctggngtaccagctcaacaacagccagcgggtcaaccggctaacgcagatgaggttcggactttgtggatcggagatttgcagtattatatggatgagaattatctc

SEQ ID NO: 22258 - DNA, 296 bp, Gossypium hirsutum
  Clone ID: LIB3272-010-P1-K1-A12
aaggtgtcctggagttcattgattatgcttacactgtgtttgggtttacttatgacctaaaattatctacgaggccagagaaataccttggagatttggaaacatggaacagagctgaagctgctcttacagaggctttgaaccagtctgggaagccatggcagataaatgaaggagatggggcattttatggtccgaagatcgatattagtgtatctgatgcattgaacaggaaatttcagtgcgcaacattgcagtttgactttcaacttcctgagcgctttaagttggagtac

SEQ ID NO: 22259 - DNA, 102 bp, Gossypium hirsutum
  unsure (1)..(102): unsure at all n locations
  Clone ID: LIB3272-010-P1-K1-A2
nnctctccttccttctccactccctcggtcaattcttcctccagagcccacaaaactttaaccaaccctaatctaggctttttggcctcagtttcgagatcc

SEQ ID NO: 22260 - DNA, 392 bp, Gossypium hirsutum
  Clone ID: LIB3272-010-P1-K1-A3
tcgatattatctattttagttccgacaaaagaaaacgaaaaaaaagaagaagaaatacaatcgttttctttttgaagtcgggttttagtttttggggtgaaaaaaatgttgggagtatttagcagtgcgatagtgtctccgccggacgagctggtggcggccggttgccgaactccatcacctaagataacggcggacgctctggtgaaacggttccttgagacgaactcctccggcgtgtccatgcacatcggagaccatgtccaattcgcttattctcaccataaagagtcttctttacagcccagatcatttgctgtgaaagacgaaatcttctgcttgtttgagggagcccttgataacttggggagtttaaagcagcaatatggtct

SEQ ID NO: 22261 - DNA, 323 bp, Gossypium hirsutum
  Clone ID: LIB3272-010-P1-K1-A4
cttccttcgccgtctactgctcttgttacctccacatcaagtcggacagagtggatcttttaaagtttcacattcaccctaccttgatcttcttagtaaggttctagtgaaagcattcctgttggtacctgaaagattgtgtactataccttatcgttgctaatctatattatactcttttatatgcctttatctatactgacttttaaatctttattcttacttttttatatttttctattgactatattaactttctatatttcttgttccttttcgaattttaccttatgatatcatttttttttttatctatttcttat

SEQ ID NO: 22262 - DNA, 387 bp, Gossypium hirsutum
  Clone ID: LIB3272-010-P1-K1-A5
tttcatctttcaatcatggcttgtattcagtatctactctccattccattcttagttttctttgttgctcctggtttagcccaacagtctttccgccccaaggccctggtctttccagtctctaaagacccctcctcacttcaatacctcaccactattaaccaaaggccaccctttgttcctatacgcgttgtggtcgatctctgaggcgcctacttgtgggttgattgtgaacgggcttatgtttcatcgactcacctgcctgtcaggtgcggttcagcccactgctcgctggctggagccactgtgtgcggagattgtgacgagggaccaaggtcagggtgcagcaacagtacatgtgctgaccgaccctgcaacaccggcact

SEQ ID NO: 22263 - DNA, 320 bp, Gossypium hirsutum
  Clone ID: LIB3272-010-P1-K1-A6
ttctattcagttttgtaagagctatggctaaggacattgaggttggtggtgagttccaggccaagtactaccatgatcctccacccgctccattggtagacgctcaggagttagccaagtggtctttttacagggctgtcatagctgagttcattgccactctcctctttctctacatcactgtcttgactgtgatcggttacaagacccagaccgaccttgctaagggcggtgaagattgtggaggcgttgtcattctcggcattgcttgggcttttggtggcatgatttttatccttgtctactgcactgccagtttt

SEQ ID NO: 22264 - DNA, 124 bp, Gossypium hirsutum
  Clone ID: LIB3272-010-P1-K1-A7
ttctctccttccttctccactccctttgtcaattctttctccatagcccacagggctttaaccaaccttaatctaggctttttggcctcagtttcgagatccttgaggtctcttatagcaacca

SEQ ID NO: 22265 - DNA, 381 bp, Gossypium hirsutum
  unsure (1)..(381): unsure at all n locations
  Clone ID: LIB3272-010-P1-K1-A8
caaacgtncgaaataatctactaatggtctaggtcgaggatgcgtacttaattagacatgctgccacacactttccatcgtgtaacctcctatcaggccaagcttccttcccatcattcgaagcttaaatcctcaaatttatctatccaatccattggttgtcatttcttcggcgattctctctcaccctaggtatcttttcaacgttttcctgtcattctattttagcctggggtatccacaggcaaaaaaaacacacgctatagtaggaagagagttttcgggagaaagaaaccctatgttttctatggcgtttctggtttttgcgattttggaaattttttgtttaaccggagactcattttaggatgtttgggttaa

SEQ ID NO: 22266 - DNA, 347 bp, Gossypium hirsutum
  Clone ID: LIB3272-010-P1-K1-A9
gctcttcgtagtctcccaaatatctttcctttgtcttatcgaatatgatgcaacaaccagcagctggaggcgtggctccgccaccttccatggcggccgatcagtctcagactcatcagtaccagcaacaaccgcagtcgcagccctggatgatgatgtctcaacaacagcagggtggtcaaccggttcctccacctaccggttggacgccgcaacctgttcctccgcccactcagatgcagcagtactccgccggttctgctgctgctggctccggtgagaatcgatctctttggatcggtgatcttcagccggggatggatgagaattacctcatcaatatcttt

SEQ ID NO: 22267 - DNA, 393 bp, Gossypium hirsutum
  Clone ID: LIB3272-010-P1-K1-B1
aaagaaacgaaagtcgtcttaccattctgtgcctctgcctgagtttttatagcttttatgtatttactgttattactatctttcctagttcggaaagcgttttcttttactttattgatgaagtaatctcaggatgaagacaataagagattgtgttttttaaccactcgtagttttcagttctttctgttccggcgatttacgagcggtgctgttagctctcctcccattctaagggatcgattattgaatttagaagagaagtagaatgattattggaaggttacgccaatggttaagtctactggtctgtgtgcttgctgttatactactcaaatctgaaggcgctagtgtagggattacttatctgcaggatgccgtagcgaaaggagc

SEQ ID NO: 22268 - DNA, 398 bp, Gossypium hirsutum
  Clone ID: LIB3272-010-P1-K1-B10
caaacatggaaactctcctcttaaaccaaacactatgccgtctcgacctttcccctaaaccaaaacgcccactgtgtattgctcctcagatcttccacttcaaacccaacaaaagctttgccctctttgctgtccaaaatcaagaaagggacttccaagaaacagggaacacactccaagcggacgtcagcgatgaatccttcggtgaagtcagtaaaatcatcggcagcagagcagtccccggcgggaaagccatggagtatttaatagaatggaaagatagtcacgctccttcatgggttccacaagattttatagctaaagatgtggtggcggaatacgaaaccccatggtggacagcggccaaaaaagccgacgacaaggcgttggctgaactt

SEQ ID NO: 22269 - DNA, 385 bp, Gossypium hirsutum
  Clone ID: LIB3272-010-P1-K1-B11
cagccaaggactacaacaatggtggtgaaggtgtatggcccatcctttgcttctccaaagcgagtgattgcatgtcttattgaaaaggagattgaattcgagactgtccctgttgatttgcttaaaggagagcacaaagaccctgaatttctcaagctccagccttttggaacaggtcctgtcactcaagatggagattatgttttatatgaatcccgtgcgatcataagatactatgcaccaaaataccgatcacaagggactgatctactgggaaagacagtagaggaaaggggtcaagaggaaaattggctagaggttgaggcacacaatttcaacccaccaatttacgccttgaccctacatttgatgcatgcttccaaga

SEQ ID NO: 22270 - DNA, 439 bp, Gossypium hirsutum
  Clone ID: LIB3272-010-P1-K1-B12
agcgcccgcaccgcagttccggaatcgccggacgccgcccacgcgttcgattcaacagacccctccccaaaaaaaaacccttgaactttttccgcagtcaaaatgggtatctctcgtggttcgatgcacaagaggcgtgccactggaggtaaaaagaaggcttggaggaagaagagaaagtatgagcttggaaggcaaccagcaaacacaaagctatcaagcaacaagacagttaggaggattagggttcgtggtggaaatgtcaagtggcgtgctctgaggctcgacactggaaactactcgtggggaagtgaggccgtgactcgtaagaccagaattttggatgtggtgtacaatgcatccaacaatgagttggttcgtactcaaactctggttaagagtgctattgttcaagttgatgctgcaccattcaagcagt

SEQ ID NO: 22271 - DNA, 431 bp, Gossypium hirsutum
  Clone ID: LIB3272-010-P1-K1-B2
ccgcaccgcattccggttcgaccgcgagcgtccggccgattctactttagaaattttgatacaagtaaagtaatagaatcttaaagaagaaaaaaaagtgctaaaaaagctagcttttttttttctattgttccttctttactctgggttcttttttcaaagcataaaaacctaatttgtaacagagcagctgcaactatcatcacccatggcggcaccgatctgggtatgggctttttacgtagccctaactctatttccttccgttttgggaaactcagaaggcgatgctctttatactttgagaagaagcctatcggatccggataacgtgctgcagagctgggatcccacccttgttaacccttgtacttggttccacatcacttgcaatcaagataatcgagtcactagagtggatttaggtaatt

SEQ ID NO: 22272 - DNA, 390 bp, Gossypium hirsutum
  Clone ID: LIB3272-010-P1-K1-B3
aaagaacaagactggattctgccatagcctataaaacatgggatcttgaaaacaatatacattaccgcatagacacctgtcccttcatcgtattctatattctactacgactatggcggctcaagccaagttccagcaagagaagcctcggaccaaagatcctcactacttcaagcgcgttaagatctctgtgctcgctctacttaagatggatggccacacccgatcttgtggtaccatagaggtgatggggctgattcaaggcaagaccgaccgctatgctatcattgacatggacgcctttgctttgtctgttgaaggcacttagactagggttaacgctcacgcagatgcctatgagcatatgggcgaacattgccagagcaacaa

SEQ ID NO: 22273 - DNA, 393 bp, Gossypium hirsutum
  Clone ID: LIB3272-010-P1-K1-B4
caccaccattgttgttaaacataatgcagcaccctctaaaacaccaccttaccctaacccttttagcattaacctcactttctcacttcccaccagcttcccccctcaccccatgccgcaccttatgtggcaccaccgccataaactaccctttcagcatcgacgatggctgtggcgccccacaataccgctcaatgctgaactgcacaggtaccgacctgtttttcatgaccacttcggggcggtacaaagtccaatcaatcgactacaacaaacaaaccatggtggtttacgaccctgccatgtcgacatgttccattcttcaaccccaccatgatttcgttatgaccgacgttgaatccgtcgtgataccgccaagttccgacaccattt

SEQ ID NO: 22274 - DNA, 391 bp, Gossypium hirsutum
  Clone ID: LIB3272-010-P1-K1-B5
aatgcatccaacaatgagttggttcgtactcaaactctggttaagagtgctattgttcaagttgatgctgcaccattcaagcagtggtatctccagcactatggtgtcgacattggtcgcaagaaaaaaacagcagccaagaaagaaggagaggaaggtgaaactggcactgaggaggtgaagaagagcaaccatgtcttgaggaagatggagaaacgtcaacagaatcgcaagctagatccacatatcgaggatcaattcgcaagtggtcgtttgttggcttgtatctcttcaaggcctggtcagtgtggccgtgctgatgggtatatcttggaaggcaaagagctggaattctacatgaagaagatccagagaaagaaggggaagggag

SEQ ID NO: 22275 - DNA, 367 bp, Gossypium hirsutum
  Clone ID: LIB3272-010-P1-K1-B7
gtttcaattatgaaaattcatttattacttaccctttttctagttctatttgcttctttcctttcttcatctaattgctatactttctatgttgactgggttttgcaccctaaagagaagtacaatgagtgggctggtaaaatgaggtttcaagtgaatgacactatcatttttaaatatgaaaaaggatcagactcggttctcttggttcaaaaagattattatgataagtgtgaaagggaggaacccttgattgaaatgaacaatggaagctccgagtttaagtatcctcattccggtccattttatttcattagtgggaaagaggggcattgccaaaagggtcagaaaatgatcactggtgtta

SEQ ID NO: 22276 - DNA, 296 bp, Gossypium hirsutum
  Clone ID: LIB3272-010-P1-K1-B8
cacctccactgcagcaggagcagagggaaaaaggataaaagcatcgtcgtgttctcgcttcttcaactctgtctctacgtctctgaacctcctcctttcgttcttttcttattcagtattgtaaaagatggccgatgctgaggatattcaacccctcgtctgtgacaatggaactggaatggtgaaggctggttttgctggtgatgatgctcccagggctgtttttcccagtattgttggtcgaccccgacacactggtgtcatggttgggatgggtcagaaggatgcctatgtag

SEQ ID NO: 22277 - DNA, 373 bp, Gossypium hirsutum
  unsure (1)..(373): unsure at all n locations
  Clone ID: LIB3272-010-P1-K1-B9
cgaagtcgtagctttggaagcatggacttcatagctactatcctgtttctagctcttgtcatctcctccaccaaagctttggacccttgcggccctcagccagatgactcggaccttttggtcatcccaatctatggcaaatgttcaccattcaacccacccaaacctgactcatcgttcaacacagtcatgaacatggcatcaaaagacccagcaagggtcaagtacttgtcgagccttgtagcccaaaagaccactgcggttcccattgcttcaggccaacaagtcctaaacattggcaactatatcgtccgggtaaagattggcactccgggtcagctcatgttcatggtattggacactagncatgatg

SEQ ID NO: 22278 - DNA, 398 bp, Gossypium hirsutum
  Clone ID: LIB3272-010-P1-K1-C1
gcacctcttcctttgttcctcatcctctgatccgtctcttcccgcattcgtcccgccggatttaacaagttttcaaacgaaaaatgagggaaatccttcacgtacaaggcgggcaatgcgggaaccagatcggatccaagttctgggaagtggtttgcgacgagcacggcattgaccctaccggacgctataccggaaactccagtctacaattggagcgcgttaacgtttactacaatgaggcttcttgtggaaggtttgtcccacgcgccgtgctcatggatcttgagcccgggaccatggatagtgtgagaaccgggccttatggtcagatctttaggcccgataactttgtcttcggccaatctggagcttgtaataattgggctaaggggcat

SEQ ID NO: 22279 - DNA, 388 bp, Gossypium hirsutum
  Clone ID: LIB3272-010-P1-K1-C11
ggaaaacaagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaagatatgcgatgaaagagtcgtcgtcgtcggagacaagggcttattcttcagcttgggcgcctgac

SEQ ID NO: 22280 - DNA, 387 bp, Gossypium hirsutum
  Clone ID: LIB3272-010-P1-K1-C12
cagaagattcttctgtcagtttttgttctgctgtggcatctcggttgaattcagttatccttcctttgcttgacatgcggatgctgttggtcattcctcttattgcttattcaggattacagcaagcttttgtatgggctagttacaccaaggacattgtaaacccaactcttggagaggctggtgtgggtggtgcaatggcagtttatggtgcttttgatgcaatttgttccctggcggctggtcgactcacatctggcctcagatcaattactgtcatagtttgtgggggagctttttttcaggcattgatattcctgtggcttttgctaaaatacagtgcaactagtggagtgcttggcgtaatataccctcttctcatggcgg

SEQ ID NO: 22281 - DNA, 297 bp, Gossypium hirsutum
  Clone ID: LIB3272-010-P1-K1-C2
gaccgaacaagcaagctgctgcaactatagaaagaaacacatctccaatggagcccattgaggtctgtgactaccaaccgcccaggatattctccgatttaaccgcgacaaataaaaagcactataaatcaactcatgtttggacagtcgctaaaaaggctgaaactggatggagctctcgtggccacgacctacagtggaaacgggtacgatgttaaagtaaagatcgaaaatgcgcgtaagcaaaagtctaatgtctttgacaaggctattcacgttggctcagatgatcttttt

SEQ ID NO: 22282 - DNA, 386 bp, Gossypium hirsutum
  Clone ID: LIB3272-010-P1-K1-C4
ctcctttgagctaacaacgctcttcacgctgtgtagaaatgccgttcaaaaggtacgttgagatcgggagagtcgctctcgttaactacagcaaagactacggcaagctcgtcgtcatcgtcgatgttgttgaccagaacagagctctagttgatgccccagatatggtgaggggccaaatgaactttaagaggcttcaattgactgatttcaaaattgacattcctcgtgttccaaagaagaagacactgattgaagcaatggaaaaagctgatgttaaaaacaagtgggagaatagctcatggggtaaaaagctgattgttcaaaagaagagagcatctctcaatgacttcgacagattcaagatcatgttggccaagatcaag

SEQ ID NO: 22283 - DNA, 386 bp, Gossypium hirsutum
  Clone ID: LIB3272-010-P1-K1-C5
acaaattttggttaaaactttgactgggaagaccattacattggaggtagagggttcagataccattgacaatgttaaggcaaaaattcaggacagggagggaatccccccagaccaacagaggctgatttttgctggtaagcaactggaggatggccgtaccctggctgactataacatccagaaggagtccaccctccacttggtgcttcgtcttcgtggtggtatgcagatttttgtgaagacacttaccgggaagaccatcaccctggaagttgagagctctgacacaatcgataatgttaaggccaaaattcaagataaggaaggtatccctccagaccagcagaggctgatatttgctggaaagcagctagaggatggga

SEQ ID NO: 22284 - DNA, 396 bp, Gossypium hirsutum
  Clone ID: LIB3272-010-P1-K1-C6
aaaggtattcgggagccgaaacactgctcggaaacgccgcatgcgcaggcctggccgtgatgataataattttatccaccggacacatctctggggctcatcttaacccttccctcaccattgcatttgccgcctgccgtcatttcccctggactcaggttccagcctacatagcagctcaagtttcggcctcaatttgcgcttctttcgctctaaagggagtcttccatcccttcatgtctggtggcgttactgtcccctccgtcagccatggacaagctttcgcactcgagttcctcattacttttaatcttctcttcgtcgtcaccgccgttgccaccgacacccgtgccgtgggagagctggctggaatagctgttggggcgactgtaatgc

SEQ ID NO: 22285 - DNA, 269 bp, Gossypium hirsutum
  Clone ID: LIB3272-010-P1-K1-C7
gagctttttctcagctctctctctctctctctcatcttttacatggcatctgaagccagcctcctccttcaaaaacagctcaaagatctttgtaagaatccggttgatgggttctcggctggattggtcgatgagaacaatatctttgaatggagtgtaacaattattggacctcctgatactctttatgaagggggatttttcaatgctatcatgagttttccaccaaattatccaaacagccctccaacagtcaaatttacatcaga

SEQ ID NO: 22286 - DNA, 305 bp, Gossypium hirsutum
  Clone ID: LIB3272-010-P1-K1-C8
gttaattttcagaacatatttcagaggttcactgcaaagtatgggcataacatgttctttgtcatttatgatcaacaggtcactctccctcttctttgcttcgaaatttttcagatttttatacacatcagggtttctcacgttaaactaagctcaaaaaaggggggatactgttgaccagactgacatttatacaacgttccttcattcatgtacaaaaccataatcttaaaccctgttctttaatgtcttaaagacccaccttctcagtcctttcttttgaccgatcagttttaccggctttt

SEQ ID NO: 22287 - DNA, 360 bp, Gossypium hirsutum
  Clone ID: LIB3272-010-P1-K1-C9
ctttcttttccctttcttttcctctctctttctttgtctccaaacagtcaaatgtcagctgcctatttccctcatcttcctcttcctcttcctccattttgtttcctcttctaaccgccatctctcatctctgtaaacaagggaaaacagaaaccctaactctaacgcagagcatcaagcggcgccggcagctcagccatgaagaagaacattcttattttggcgacatcctcgcttttgctctttaatttcttgctctctttcgccatcgaagatgacatcgcctgtcttgaaggactgaaaaactcccttaccggcgccgactcccctctttccacatggagcttcagcaaccgctca

SEQ ID NO: 22288 - DNA, 399 bp, Gossypium hirsutum
  Clone ID: LIB3272-010-P1-K1-D1
gtttttctttgtcatcagcacagggactttgatggcagtcacagtgcttgtttacatccaagatgaagttggtcgaagttggggttatggaatctgttcagcttcaatgttcattgcactcttgatattcttttcgggaacaaaacgataccgatacaagaaatgttcgggaagccccattgtacatatttgccaagttgtttctgctgcatctgggaaaaagacggctaaactcccttctgatatttccttgttgtatgaagatctccctgaggcatcacgaatccatcacacggatcagtttcgcttcctggacaaggcatctgttgtgacagaagatgattacagacaaggttccttcatgatgaacccttggaagctttgttcagttacaagggt

SEQ ID NO: 22289 - DNA, 390 bp, Gossypium hirsutum
  Clone ID: LIB3272-010-P1-K1-D10
aacatagcagccatggcagtccgtatgcttcttgggttaggtgtcctgctactctgccttgcaaaggtttcatctgatctgaaggcagaagaagttataaccaatgtcggtgaggtgggttctttggttaccagaggcggaaacagaagactgatgctagagattgattgtggaggattatgcaagaaaagatgcagtcaacactcgaggccaaacagatgcaacagggcgtgtgggacttgctgcttgaggtgcaagtgcgtgccaccggggacttcagggaacagggaggtctgcgggacctgctatactggcatgaccacccatggaaacgttgccaagtgcccttaacctttacgtcgcccaatatgtgttgcagccatcaagggg

SEQ ID NO: 22290 - DNA, 388 bp, Gossypium hirsutum
  Clone ID: LIB3272-010-P1-K1-D11
ctcaattccctttcacttaaaaccaacatcaactcttcttcttcttatgctttcaagactctcagtttctccagtaacctctctcacaatctcttctccaaagggaatctgtcttttagtacagtgactccgaaaccaatacccgatggtgctgatgcagttgtccaagttgaggacactgaacaggttaaagctccttctgaaacaaagtatgtaaagatattggtgcaaactagtaaaggtgttgatattcgtcaagtgggatgtgacattcagaaagatgcagtagttctaaaatctggagaaagattaggtgcttcagaagtgggactacttgctacagttggtgttactatggtgaaggtgcagcctacaccaacaattgctg

SEQ ID NO: 22291 - DNA, 212 bp, Gossypium hirsutum
  Clone ID: LIB3272-010-P1-K1-D12
gcggaactaatgggtcaagccggtgtgttaggttatgaggaacttatatatgggttggatactagcacactcaatgctgctgacaaatgcgcttggccataacaccagcctattgattgggccaaaactcgagcaactgggctaccaatggcatactttgcaatcgaccgaacgatcataagtctatatcacccttgctgctaacactgtta

SEQ ID NO: 22292 - DNA, 392 bp, Gossypium hirsutum
  Clone ID: LIB3272-010-P1-K1-D2
ttgttataaactttgatccaatccgtactagggaacgagatattctaaggcactttgagccatatgggaaggttcttcatgttcgcattaggcgaaactttgcgtttgtacagattgcaacacaagacgatgctaccaaagctcttgaggctacacaaaggagcacagtactacacagagtcgggtctgttgaatatgctttaagggatgatgatgagagggataacagattctatagtcctaaaagaggaggttacgatagacgtagagatagtccatatggggaggcctcaagtcctgtataccataagcgacaaagtgctgattatggtagagctcgtagtcctgtttatgaacgttataatggctctgcttatgacagacgcaaaagt

SEQ ID NO: 22293 - DNA, 349 bp, Gossypium hirsutum
  Clone ID: LIB3272-010-P1-K1-D3
ggaccgtcgaggaccaaatgctgctcactcattgcgggtttggctgatctcgatgctgctgtttgcctttgcactgatattaaagctaatgtgaagggggacaacctaaacgttcctgattacattgcctgatgctcctcaattcctagcagaaaagcaaatgcctgctggttacaaatgtgcttaagcaaagggtgcgagcatcttttacgtgatcatttcttttctggacgaaataaatttggtgcatagatatgtcagggcttagataaaacgtgttaggacttttaccttaaccaatactgaaattttatgtatttatacaatacttgtcatgtacagaagaaag

SEQ ID NO: 22294 - DNA, 120 bp, Gossypium hirsutum
  Clone ID: LIB3272-010-P1-K1-D4
ctcaagtgtcttgaaatgagacagagccatatgggagccggatgtggctatggctatggctctgtctcatctcaagtgtcttgaaatttctataatatataatgttgagtggattttctt

SEQ ID NO: 22295 - DNA, 392 bp, Gossypium hirsutum
  Clone ID: LIB3272-010-P1-K1-D5
tttcttgttccttccttcgccgtctattgcttttagttgcctcgatttcaagtgaatcagaatgggtaaggaaaagactcacattaacattgtggtcatcggccacgtcgattctgggaaatcaaccaccactggccacctgatttacaagcttggtggtattgacaagcgtgtgattgaaaggttcgagaaagaagctgctgagatgaacaagaggtcattcaagtatgcttgggtgcttgacaagctcaaggctgagcgtgagcgtggtatcaccattgatattgccttgtggaaatttgagaccaccaaatactactgcactgtgattgatgcacctggacaccgtgactttatcaagaatatgattactggtacgtcacaggctgact

SEQ ID NO: 22296 - DNA, 397 bp, Gossypium hirsutum
  Clone ID: LIB3272-010-P1-K1-D6
attctttatttccagttttcttctgcttattccttttaacttaacccctttgtatttctaacacacactttttcgaggcctacatactttgaaccatagctgtagaaaaaaaccgtacttttcttggaaaccgaacacctatgattaatttatacacagacagtggccaagaaaaaaaatgcaccaccagcggctgaatctacaggaacaagccttgatgcaccaaggttttattgaacagcagtatgtctattatcgaggcatattagctactgctgagatagagccaattcccagtggaaatgtgcctgctggttttgctacacgcacttgccgaagcgagtatctgggaaatatctatacacaagtgactgaaccactacttaaggaggttttt

SEQ ID NO: 22297 - DNA, 357 bp, Gossypium hirsutum
  Clone ID: LIB3272-010-P1-K1-D7
gcttgtggctgtcagaataactcaactgaatctgggagttgtgtaagcgaaaggtcttcacttttagcttcagctgttccgggcaaatctaccaatgcaccacctttgcttcagtgtacgagccatatgtgtccagttcgaattcactggcatgttaagctcaactacaaggaatactggcgtgtgaagatcacgatcaccaatttcaattacgcattgaactacagtgagtggaatctagttgtgcaacaccccaactttgacaatcttacacaacttttcagcttcaattacaaaccattaactccttatgctggcttaaatgatactgccatgttatggggacttaagttttat

SEQ ID NO: 22298 - DNA, 322 bp, Gossypium hirsutum
  Clone ID: LIB3272-010-P1-K1-D8
gtttaactaaaaagttaaaggagcaacagctgtgacgaagtattttttcaatggagaaggatctttacaagagcaacaactgtgattaggacgttgcatgtgttgctataaaaaacgttgttatattgagtggtgaaagtttttataaagggcatgatctttcaatcttaaatgtcactaaaacgcattaccttttgtaaaccgatcaccaagaggtgaccgatttgaaaatgcagagcatcactattcaccaccaatactacagagcttgagcatgctattacctcaaccaagctgttgtgttgagccacggtaaccaatg

SEQ ID NO: 22299 - DNA, 389 bp, Gossypium hirsutum
  Clone ID: LIB3272-010-P1-K1-D9
tgaagatggtggctttgttcctgacatatccagtgtaagagaaggattggatattgtccgagaagctattggcagaacagggtataatgacaaaataaagataggaattggtgttgcagctactgaattttgcataggtacaaagtatgatttagaattcaaatctccaaataaatctgggcaaaatttcaagtcaggagaggatgattcagatgtacaaagacctttgcattgattacccaattgcttctattgaagatccctttgacaaggaagattgggaacacagcaaacgtttttgcagtcttggactatgtcaggtggtgggggatgacttattgatgtcaaatccaaagcgcattgagagagcaatacatgaatctgcttgc

SEQ ID NO: 22300 - DNA, 247 bp, Gossypium hirsutum
  Clone ID: LIB3272-010-P1-K1-E1
gtttattatcgatgtgaaaccgtattaaagatctcattcatgacatcgaagcgctctgtcatatgaagcccagcttctgatcttgcatgcatgaaaaacaaacaaaaatgcctggagagcactcattgctggataatatagcggcgtgcaagccaaactggctgagaaacatgagatgggtgacgacataagacctctgatgacatgaagatgaaccctgggaggaatgtgccacgtgtggaaacac

SEQ ID NO: 22301 - DNA, 388 bp, Gossypium hirsutum
  Clone ID: LIB3272-010-P1-K1-E10
cttgagctcagtcctcatatgaaaattaaggtgtgggtttataaaaaaacacaagaggagaagttttctactctgaagaaatactcagaaaaagcaccagcaagtaataagcttgcaacacatcaagtcaaggtttcttatgagtacaaaagtgttgatggctccagtactttagttataccaccagagcaaaggattaaaggctaccgttatggacctcaagtagttcctatatcaactgctgaatgggatgctgtcaagttcaaaccagaaaagggtataaaggttctgggatttactgatgcttcaaaaataaagcgacactgctacatgaaagatgtttatctttttattgctgaaccgggcaatacaagagccactcttgctg

SEQ ID NO: 22302 - DNA, 387 bp, Gossypium hirsutum
  Clone ID: LIB3272-010-P1-K1-E11
gtttacagtatcgcggtgattgaaggttaacctctggtttgagggtctccaagaccaaaagatgagtcttgcatgcctggtgtgccacagtgtggaaagtccgtcacactctttccggagttactctgtttcaagctcagataacgagggaagatgttcagctgttgctaactgcttagcaaggaagacatctctaccatctgcaagaccagctataacaacgacctccaaagtggccccacaaccaaattttcaaaacagcgttggaatggcaggtccgccacgtctggtgcgtagtcgtgctgttaggagggatcttgtgagagactggaactttgaagaggttgtgatggaacgctagtttgcttagtatgaggtgcagggggc

SEQ ID NO: 22303 - DNA, 390 bp, Gossypium hirsutum
  Clone ID: LIB3272-010-P1-K1-E12
acggcagctggtactctctccttgcgtgtgcagcaactggatgttcgatgtgaaacaaaaaccaaggataacgtgtttgttaacgtggttgcttcaattcaataccgagccttagctgaaaaggcacaagatgctttctataaactcagcaacactagagcccagattcaatcctatgtctttgatgttattagggcaagtgttccgaagttggagctggatgcagtatttgaacagaagaatgatatagcgagagctgtggaagaggaacttgaaaaggccatgtcacattatgggtacgagattgttcagactcttattgtggatattgaaccagatgagcatgtgaagagggcaatgaatgagattaatgcagcggcaagaatgagg

SEQ ID NO: 22304 - DNA, 399 bp, Gossypium hirsutum
  Clone ID: LIB3272-010-P1-K1-E2
tgggaatcctgaacgccaaaaacttattgatgagatacatgaatatatgttaagcaagacaccccctgtccctcaactcagcccttcacaggccttggaagagcaccctactaacagtgacggagaagctcaggctaatcaacaggattccgctaccatggttgctgggaatgggctaccgaacccagtagtaggtgacagggctgtcgaagaagagcctctggttctggccaatgctaatccaggtactgctgaaatgggagtgagggctgcaagagagattcctgcccgggaatcaagtaatcatccactgcaaaggccagagatgagggttcaaagatctgccgatgaccgcttgtttacatgggctgccgttggacttactatagcaattttggg

SEQ ID NO: 22305 - DNA, 393 bp, Gossypium hirsutum
  Clone ID: LIB3272-010-P1-K1-E3
gcagcctccttttttaaaagtcattgttttagcggcgattgctccaaccttcaattttatcagcgaaaccccatcgccttcctctcccctgaaaccctttctatctctcattttagcaatggctcaagtggtggccactagatccatccatgctaacttcttcagcaaggcctccggatcccttcaggacccagtggagaagcttaagcctgcgtccttcgcttccaaagtactcttacctgaccacaggaagagcaacgccgtcgtgcttactaggaactctaggattactgctaagagagccgcacgtgccgagcctgaacttattcccgtttcacctgaggatgtacctaagagggaggagcaatatgagcagttaagggggattcagca

SEQ ID NO: 22306 - DNA, 392 bp, Gossypium hirsutum
  Clone ID: LIB3272-010-P1-K1-E4
ggaggaactgaaaaggttgctagctctattggaccaactaaaaagcgaaaactgctcaatgacggtaatgattacctgccgttgcttacagacgctgctatttcagtaaatcctagcagatgttctgagtatgtggatgatgcagattctagctgtgccaatatggaatcctcttcaagtaataagagactgagaatcgaaaaaattcaagagaccgtgagtgttctacgaagcttaattccaaatggggaaggcaaagatgcaatcatggttcttggtgaagctattgattacttgaaatcccttaaactcaaagccaaaaccttgggacttaatgctctatgatgttgccaacgccattgccactcttcttatttgtgttagcggtagca

SEQ ID NO: 22307 - DNA, 393 bp, Gossypium hirsutum
  Clone ID: LIB3272-010-P1-K1-E5
gctcttcgtagtctcccaaatatctttcctttgtcttatcgaatatgatgcaacaaccagcagctggaggcgtggctccgccaccttccatggcggccgatcagtctcagactcatcagtaccagcaacaaccgcagtcgcagccctggatgatgatgtctcaacaacagcagggtggtcaaccggttcctccacctaccggttggacgccgcaacctgttcctccgcccactcagatgcagcagtactccgccggttctgctgctgctggctccggtgagattcgatctctttggatcggtgatcttcagccgtggatggatgagaattacctcatcaatatctttgctcaaactggagaggtggtttcggctaaggtgattaggaataagc

SEQ ID NO: 22308 - DNA, 407 bp, Gossypium hirsutum
  Clone ID: LIB3272-010-P1-K1-E6
acgcgtccgaggcagatacgccagatggcactctctcctggctgcagtgcagcacctgtctgttcggcgtgacttgtgaagagctcccagcttggttgtgccacaatgtcccccggtcgtgaacgtgcccgtgttatcttgaccaacttcaatggcatttcatccaccacccgttatgccaatgccatgggcttcatggttgacgagcctgaagcaggctgtgctgagatgatgaagatgtatcaggaggatgaggaggatgtctagtgtgttggtttggatttatttgcatatgaaatatgatgttgtctgctatttgttatgtgaattgctccgttatttctacgtttagaggacttctataacttatttttcttacaaattctattaccaattatataaaccta

SEQ ID NO: 22309 - DNA, 302 bp, Gossypium hirsutum
  Clone ID: LIB3272-010-P1-K1-E7
caaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctattgatgttgacattggtgccaatccttcaaccgaagatgctgatgaggattaaggtgttgctgaccaatcttggaaggttgcccacatttgttgactctatgaagctttttgagcaggctttttgttgacacgaatacaatttttt

SEQ ID NO: 22310 - DNA, 387 bp, Gossypium hirsutum
  Clone ID: LIB3272-010-P1-K1-E8
atttgataccggtggactcatcgggaacgtattgcttggcgtttgcccccacgacgtacactttgtctataattgggaacgtacaacagcaagggacacgtgtgagcttcgatttggctaataataaggtcgtgttctctgctcataaatgttaagacagtaaataaatagcttattggtgataatttactaatttacctatccatttcttctctggctaaagaaggtgaagaatataccgaagttggtttgtttgtaatatgtatggcaattttatatttaggttgaatttgtaccatttagccgtacttttttacattgtggaaataaattccaaagaatggagaagcagtgcggaccttggcggttaatgaatttaacccgcct

SEQ ID NO: 22311 - DNA, 385 bp, Gossypium hirsutum
  Clone ID: LIB3272-010-P1-K1-E9
caaaaagaagggctaataaacgcagctttgatctcattccctcccctccacaaaaagaaaaagaaattcatcaaaatcgattgaaaatctgagggaatgagaaccaattgctgccatgtttcgtttgcttttgttctcaagttattgaattctctccaaggtttcgttggagtatccattattctctattcaatatggatgttggatcagtggagccatcacgtcccaatatctcctcctcctcctccttcagcgccgtctccggtttcttctgtttccaattcgatcctcttcaattcgggaccggagatgggagaacaagcagctagggttttcgacgattttgctgtcggtttggtttccgggttggacaatgatgtccggt

SEQ ID NO: 22312 - DNA, 397 bp, Gossypium hirsutum
  Clone ID: LIB3272-010-P1-K1-F1
gtttctctttgcgcctttcttctctcagccgcagcactgatattgcaggtaagtcatggttaagcataacaatgtcgtgccaaatgggcacttcaagaaacactggcagaactatgtgaagacttggttcaatcagccagcacgaaaggctagaagacgaattgccaggcaaaagaaggctgtgaggatctttccaaggccaactgctggaccccttcgccctattgtccatggccagactttgaagtataacatgaagttgagagctggaaagggtttcaccctcgaagagcttaaggctgctggtatttcaaagaaacttgcaccgaccattggtatcgctgttgatcaccgccgtaagaacaaatcacttgaaggtcttcaagccaatgttcag

SEQ ID NO: 22313 - DNA, 392 bp, Gossypium hirsutum
  Clone ID: LIB3272-010-P1-K1-F10
atccaaaaaaaaacactcatccctttctataccgctcaaccctgaaccgtacaaaagaaaaaaaaagagtagcagtaccggtttcaccagctatgggtatcgacttggtcgccggcggcaggagcaagaagacgaagagaactgctcccaagtctgatgatatatatctcaagctccttgtcaagctttaccgttttctggtaagaaggactggcagcaaattcaatgcggtgatcttgaagcggctatttatgagcaaaaccaacaagcctcctttatctctttctaggttgattcaattcatgaagggcaaggaggataagattgctgtggtagtcggggctgtcaccgatgacattcgtgtgtatgaagttcctgcgctgaaggttact

SEQ ID NO: 22314 - DNA, 386 bp, Gossypium hirsutum
  Clone ID: LIB3272-010-P1-K1-F11
cttccgcctaccatcgtccctcttcgctctttcatctctgcaaatcagttttttttccttctcttctcttatcagttctcacccaccaacgtgtccgctagtgttttccggatctgacccgtatcccttgtcggatcgtatcggcacaggtactgcacccaaattaccgagtccggggaacgaaggtcactgccactgtccaatccgaaaatggcgtcgagactagcgatgctaaaacattccgccgccaccgactacggttcttttttaggtctgaggagatggattcatgcttcagcgctccctccacccttgggcgctccaatcggtcatcccccaccatcacaatcgttggttttccccgagtctgatcaaaccccagaaag

SEQ ID NO: 22315 - DNA, 386 bp, Gossypium hirsutum
  Clone ID: LIB3272-010-P1-K1-F12
aaataaacaagttgccatcttgtcctgcacccctactgctttcccactcccccaaaaaaggcaaggggagcgtaaccaaacctcccccaacaatgttggtctcaacctcaggcctgctcctccccgtgtgcttgttgtttcttctaatatttggcactgtcaccgctactgaccacatcgtgggtgctaacaaaggctggaaccctggcatcaactacaccctttgggccaacaatcagaccttctacgtcggagacctcatctcgtttaggtaccaaaagacacaatacaatgtgtttgaagtgaaccaaactgggtatgactcctgcacaacggaaggagcagtagggaactggagcagcggcaaggattttatacctctcaac

SEQ ID NO: 22316 - DNA, 394 bp, Gossypium hirsutum
  Clone ID: LIB3272-010-P1-K1-F2
ggaaaaaagggtgttaaagaccaaaggccaaagccatttttttttcttttggtttctgggaagagaccagtttgggcaaagatggtgaagaattggaaaaaggctttgattttggtgctgtttacagtctgcattctggggtttaagccaagatgtgttaatggcgaaacagatcaagcagatgcttctgctctaggggttatgtataccagcttaaattcaccacagcagctaacaggttggactgctagcaatggtgatccatgtgggcagtcctggaaaggtgttacttgctcgaacaaacgcgtcactgaaattaaactgtcaaatcttggactttccgggtcggtgggttacagctttcaaagtttgacatcattgaaagaattggact

SEQ ID NO: 22317 - DNA, 392 bp, Gossypium hirsutum
  Clone ID: LIB3272-010-P1-K1-F3
ttttcccatcctggctgttaagctcttccccacagaatttctcttttcaagtttcctttttcatttcgatgatgaagaaagcggagctagtgttcctcccagcgcctggaatcggccatttggtatccgcagttgaagtggctaagcttttagtggatctcaatgccaacctctccatctctgttctcaccatcaagcaaccccttaactataaagccaccgcctacatcgactatctcaacgccggcactatcaccaccaccaccacccgcatcaaattcatcgacctccatcaatctgatgcagacatggataggcttaagtttgtggggagtttagttcaaacccacggaccacttgtgaaagaggccgtcgccaaaatagttgagcac

SEQ ID NO: 22318 - DNA, 449 bp, Gossypium hirsutum
  Clone ID: LIB3272-010-P1-K1-F4
gctggaacgacccgcaggtagccgtgtccggaatcgaccggactgcgacccacacaaaaccaccatccctgtctatacggcgcacgttagcgtcttacagcagcgaaccatcgcaagccttctctatggccgcttcctatcgaccgccgccaccgtcagctattgatctcgacctcaccgtcgtctcagccaagcatctaaagaacgtcaactggcgaaacggcgatctcaaaccctacgctgtcttctgggtcgatccagaccgccgtctctcgacccgttcggacgatgccggatcgacccgaccggtatggaacgagcgtttcactcttcccctttcctcctctctagacgacgtcgttttaaccctcgagatttttcactccaagccatcggaaacaccgaagccgttagtcgccactctccgtgtcgaactcaaagaattaccc

SEQ ID NO: 22319 - DNA, 261 bp, Gossypium hirsutum
  Clone ID: LIB3272-010-P1-K1-F5
ctcagaaaaaaattgagtgtcagtttgaaagtgttcttcagatatggctatgaaacaagttgctaattctgctatcaaagcaattgccaattctgggtcatcctctcttcttaccagacaactgcatgcttctccagggagcaaaaagattgtgggggtgttttacaaggccaatgagtactttacgaagaatcccaactttgttggttgtgtggagggagccttggggttgcgccaatggctcgaatcacaggggcatca

SEQ ID NO: 22320 - DNA, 391 bp, Gossypium hirsutum
  Clone ID: LIB3272-010-P1-K1-F6
atttttcctgcattttctccctcgccaaacagaaatcttagttcatttctagacgcagggaacgatggagaaagcgatcaaccgacagcaagttttgcttcaacaccttaatccttcagcttcttctttttcgtcgcaccaaaacaactctgccctctctgcatcggcttgtttagctggagatagcgctgcttatcaaagaactaatgtatttggagatgatgtggtgatagtagcagcatataggaccgcgctttgcaaatccaagcgagggggtttcaaggatacttatcctgatgatttacttgcacctgttttaagggcagtgatagagaaaacaaatttgaatcctagtgaagttggggatattgttgtgggaacggtcttggca

SEQ ID NO: 22321 - DNA, 389 bp, Gossypium hirsutum
  Clone ID: LIB3272-010-P1-K1-F7
ggaaaacaagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaagatatgcgatgaaagagtcgtcgtcgtcggagacaagggcttattcttcagcttgggcgcctgacc

SEQ ID NO: 22322 - DNA, 378 bp, Gossypium hirsutum
  Clone ID: LIB3272-010-P1-K1-F8
tctcccgctccttctcgctgcgatttcgtcttcaagatctcagttctcaaatcgtagcgctcttttctatcaagccatggctctgatcttgcatgcaggaaaaacaaacaaaaatgcctttaaggcactcattgctgcaaaatataggggggtgcaggtcaaaatggttgagaattttgagatgggtgtgtcaaataagactcctgagttcatcaagatgaaccctttggggaaggttcctgtgttggaaacactgagggtcccgtatttgagagccatgccaatgctcggtatggtgctcgctcaaagggtaacaaccctatatgtggttctacattgattgattatggtcatatcgagcaatggattgattttgca

SEQ ID NO: 22323 - DNA, 391 bp, Gossypium hirsutum
  Clone ID: LIB3272-010-P1-K1-F9
tttcccttttttttccccacacctttttttaaacccatttgctaaaaatgcactgggttcttccagtgttgcttgccgttatcggagttactgcactgctcgttgtaactccggtaagtgggtaccgtccatggccgtacttaaaacccaacagctccgacttaatgttcggaggctctaagaaatttgagggctcatcggagtttatccatatgagatatcatatgggtccagtccttactgctaatatcaccatccacccaatctggtacggccggtggcagaaatcccagaagaaaatcatccgtgagttcatcaactcgatctccgccgttgattccaaacacccttcggtggctgggtggtggaagaccgtacagctttacaccga

SEQ ID NO: 22324 - DNA, 395 bp, Gossypium hirsutum
  Clone ID: LIB3272-010-P1-K1-G1
caaagctgttgttcctccatctgaaacttttaggtttgtcaacgaaggggaatttgggccttttattgttgaatatggtgcagattaccgtgtcataagcatagctaatgcccccttccagcttgcgttttataacaccacgcctaatgccttcacccttgcgttacgcatggctacaacacgttccgagtcgctcttccgatgggtttgggaggccaacagggggaaccctgttcgcgagaacgccacgttctctctcgggactgacgggaaccttgtcttggctgatgccgatggtcggattgcttggcaaagtaacactgccaacaaagctgtggtagggttccaattgttggctaatggtaacatggtgttacacgattccaatggcgagt

SEQ ID NO: 22325 - DNA, 244 bp, Gossypium hirsutum
  Clone ID: LIB3272-010-P1-K1-G10
gcctctccattggatgctactgcaggcaacctgcatgtctgatgaacaataggatgcattgcttatctcggccttacacacagacgtgtggtcgcaggaatagaaggtttgcagacagattaagtgttccttgaaccttcaaatagcctgcttgtacaagaaaaagttaccctgaaacaggtgccgtcttgaacataatgcaaatcattgggagagtcttgattgattaatatgttgtagcaac

SEQ ID NO: 22326 - DNA, 366 bp, Gossypium hirsutum
  Clone ID: LIB3272-010-P1-K1-G11
ttcaaattagacatgctaaaatactgggaaaatactattatagtttaagaaacgaatctcataactttaggggaaaacatggaggaaattaattagttataccatactgcccgaggtgtgacttacccgatgtggggatattttagatagtgaaccggaaccggtgacggaaccacatcctaacattgttggacccagaaatgcaagaagaaccgccagagttttggctgaccctgacgatcaaccaggcgtctgaaaacggccgaaaacgtcagaagcttgatctcgatctccatcgcccgcgtgatgatcgtgactgcgataacactgctgagagctccactactaacaagcggaacggagatc

SEQ ID NO: 22327 - DNA, 370 bp, Gossypium hirsutum
  Clone ID: LIB3272-010-P1-K1-G12
gtttcacttgaattccaaaggagcaacagctttgacaagttttcttcaatgggaaggagctttgcaagagcatcaaccgtgattaggacgttgcatgtgttgctgtaaaaaaagttgttatattgagtggtgaaagttattataaagggcaagatcttttgattttgaatgtcactacatcgtattaccttttgtaaacccatcacggagaggtgaccgattttgatacgcagaacatcactattcacccccaatactacagagctttatcatgttattaccacaaccaagctgttgtgttgatccacggttaccaatgtgaaacaacatggtccatagacaacaactggctctgttgatctaagctatt

SEQ ID NO: 22328 - DNA, 398 bp, Gossypium hirsutum
  unsure (1)..(398): unsure at all n locations
  Clone ID: LIB3272-010-P1-K1-G2
ttcaaagcaaaaatcccagcatcatccatagctgtaagaaaatttgaaaaaaaaaaaaaccagacatggaagccactgctgtttatagcagcaaaggaagtccatttcttttttcctctaggattacaactaaaaaatcatttaaatcatcacaaaatgctgcaactttctcaccttttctcattcaatccatggctactcagaaaccattgccttcagttgccaaaactgttggttctagaaagggctcgaactcgaccgtttttccgctcggcgagccagggccaaggaacagcacagtggtgacacaaccagtgaagctactgacaaatgtagagaaactgaaactggtnnccaaagcagagaaagcagggctactatccgcggcagagaagttc

SEQ ID NO: 22329 - DNA, 324 bp, Gossypium hirsutum
  Clone ID: LIB3272-010-P1-K1-G3
ctcaaagatatcactgcaagaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaaaagtcactctcggcacctgaacagccaggcacttgccccaaagatgcactgaaactaggcgttgggctgatttgttgggctcaaggcgcgttgttgttggaccgtcaaggaccaaatgctgttttttaatttcgggtttggctgatctcgatgctgttgtt

SEQ ID NO: 22330 - DNA, 125 bp, Gossypium hirsutum
  Clone ID: LIB3272-010-P1-K1-G4
attgttttttcccttcccccatccaaaatactatttagcacccacctattttccaacgcacgatgacttgttgttttcttataatatttggcactgccaccgctactgagatctgccatttaaca

SEQ ID NO: 22331 - DNA, 391 bp, Gossypium hirsutum
  Clone ID: LIB3272-010-P1-K1-G7
cagactctatctggtttttagggcttttctaacttttctgattattttttgataatccagagttcaatcatctaaaagaagccctaaaatctttgaatcaggtctgagcttgtggtttgttaggcctctttgatcaaactaagtttcatgtctgatcttgacgttcaaattcctactgccttcgatccctttgctgatgcaaatgctgaggactcaggtgcgggtgcaaaggagtatgtgcatattcgtattcagcagaggaatggtcgcaaaagcctgacaactgtccaggggttgaataaagaattcagctataacaagatacttaaagacctgaagaaggagttttgctgcaatgggaccgtggtccaggaccctgaattaggacagg

SEQ ID NO: 22332 - DNA, 419 bp, Gossypium hirsutum
  unsure (1)..(419): unsure at all n locations
  Clone ID: LIB3272-010-P1-K1-G8
cgcaggtaccggtaccccgggcgcgccccgcgcccccgcaaattcctttttttccccccccacccaggcctaaaaaatcatggcgacggctcaaatcagcaaaaaacgaaggttcgtcgctnatgganttttcttcgcggaactcaacgaggtattgaccagggaactggctgaggatggatactctggagtcgaagtcagagttactcctatgcgtaccgagatcatcatcagagccacccgcacccaaaacgttctcggtgaaaaaggtgggaggattagggagcttacctcagtggttcagaagcgattcaagttcccagaaaacagcgtctagctttacgctgagaaggtcaacaacagaggcctttgcgctattgcccaggccgagtctcttcgctacaagctactcggaggtc

SEQ ID NO: 22333 - DNA, 388 bp, Gossypium hirsutum
  unsure (1)..(388): unsure at all n locations
  Clone ID: LIB3272-010-P1-K1-G9
gaaaatcatgtgaatcagacatttccattgtcgcattgatcactaaaatccaatccacggagcccatcgaatttccctatcaattatcaagccaccctttttggagatagaaaataatactaattatctgtttttagcgtttcatagaaacagaattatgatatcttagctactcttctttttctttttttccccttacgattaagctagcttaaccctagcttttctgttaattttaatttttttttggcctaaaaccaagatgggattctagatctttttctttttatttccttttgatttgttttaattctattacgtgatcgaaaattatgatgtatatgaattgttggagcgngtgatttggtgttcagtgtctcaaaatgat

SEQ ID NO: 22334 - DNA, 388 bp, Gossypium hirsutum
  Clone ID: LIB3272-010-P1-K1-H1
ttttatttaggtttttttttctctgtggtttctctctcctctttctctctccagaaaaaaggcaaaaaaaaaaaccctaaagagctattttacacccccaaacttcatggatgacgatgcgttgaatatgcgtaattggggttactacgaaccgtcgtttaaaggacatctcggtctgcagctaatgtcgagcatggttgaacgggatgcaaagtcttttattcccggccgtgatcccaatctcatgattactaccaataccacctttcaccagcgggaccctgttgtttccgaggcacatatccccatgaataatgttagggatagttggattgctgacagaaagaagcttttcaacatgttcccggccaccacttctaattacgcc

SEQ ID NO: 22335 - DNA, 385 bp, Gossypium hirsutum
  Clone ID: LIB3272-010-P1-K1-H10
gatctttgctgcaaccttgggtgtctcaccatgttgtctctggcacttctatcatccttaagatccagaaacatcagcataaattcttggatgctctcttttctgggttgtcttgtatagtttctgtgcccttttacactgcgtttcttcctttgcttttctggagtgggcatgggaaactggctaggcagatgaccctgttgatggctctctgcgattatttagggaactgcataaaggatgtggtatcagctcctagaccaaattgcccacctgttagaaggataacagctaccaaagatgaagaagaaaatgctttggagtatgggttgccttcttctcatactctgaatacagtgtgcttatcaggattccttgtatgcta

SEQ ID NO: 22336 - DNA, 386 bp, Gossypium hirsutum
  Clone ID: LIB3272-010-P1-K1-H11
gaagaaatagatatccaaaattggaggtatggggcaaatgaagaagtttgggtttgtgttgttggtgttaagtgcgtcagtagtagagcaaatagaggggaaagggtatgagaagccgctcaactgtggccaccttgaatgtgctccatacacacttattcatagccagcctgaattcgagattagaagttattcaaaggctacgtgggtggctactacccccatctcctctccctcctacacatttgctgtttcaattggcttcaaaattctctttgcttacatccggggcaacaatgatgcagcagtgaaaatgaatatgacagcaccagttttggttaatatacatccaaggacaggacatctccagaattcaacctatgtag

SEQ ID NO: 22337 - DNA, 386 bp, Gossypium hirsutum
  Clone ID: LIB3272-010-P1-K1-H12
gtcggccatggcggatgcccttttgacatccatgtgggttttcagcatgccctttcttaagattctcactttcgaaattgcagctttcctcggccttcgacccttccctttggctgctttcttcatcaccaccctcttggtcagccttatgatgtttatcttcaccatcatcggcaacgctctcggcggcgccaccttcaatcccacggcctccgtcgctttctacgccgctggcctcaggaaagactggtctgccctttccatggcagtgcgttttcccttccaggccgtcggtggagtggtgggcgtgaagacagttttgggggttcttccaagggaatataaagaaaccatcaaaggaccttctttgaaagtagatatacaga

SEQ ID NO: 22338 - DNA, 386 bp, Gossypium hirsutum
  Clone ID: LIB3272-010-P1-K1-H2
aaaaaaatatacacttttcgtaaggcaaagacgggccatggaggtggaagagctagagaagagaaagtccagaaagattacgtcttcttctccttcttcagctcttataaataaccttgatgatggctgccttatgcatattttcagcttcttgtctcccattccagatcggtataacaccgccctcgtttgccacagatggtgttatttggcgtgtcaccctcgactgtggctgcgagtagatagatctgttcaggatttttctgaacctggtgttttccccaatattgaagaagctgtgtctgcagccagacctggcgacactattctaattgcagctggcggcagtcatcttgcctctaatattcagattaaaaaacctctct

SEQ ID NO: 22339 - DNA, 395 bp, Gossypium hirsutum
  Clone ID: LIB3272-010-P1-K1-H4
aaaaaacctctccacattgcttttgagaccagcttcatctttgcgtgtgcaagccaagcaaggggataatctaatttgctcccttaagggctcccctgtaacatcatcatcatcatctgctctgagttttcttcccagaaaacatggaagggctttgggtgtttatgcatccataggaaccaacaatcatgcacttacaggggtagtgttccagccttttgaagaggtgaaaaaggaggaacttgatatcccaatcgctcctcatctttcgctggctcgccagaaatttgctgatgcctgtgaagccgccatcaatgagcaaatcaatgtggaatacaacgtttcctatgtgtaccactcgttgtatgcttacttcgacagagacaacgttgcgc

SEQ ID NO: 22340 - DNA, 396 bp, Gossypium hirsutum
  Clone ID: LIB3272-010-P1-K1-H5
gtctctcccgctccttctcgctgcgatttcgtcttcaagatctcagttctcaaatcgtagcgctcttttctatcaagccatggctctggtcttgcatgcaggaaaaacaaacaaaaatgcctttaaggcactcattgctgcagaatatagtggtgtgcaggtcaaaatggttgagaattttgagatgggtgtgtcaaataagactcctgagttcatcaagatgaaccctttggggaaggttcctgtgttggaaacacctgagggtcctgtatttgagagcaatgccattgctcgttatgttgctcgctcaaaggttaacaaccctatatgtggttctacattgattgattatggtcatatcgagcaatggattgattttgcagccatggaaattga

SEQ ID NO: 22341 - DNA, 384 bp, Gossypium hirsutum
  Clone ID: LIB3272-010-P1-K1-H6
aagttttggtttttgatttgatcatctatctcggccgcgagacaaggatgaatttagtggaaggtttactgactcaaatccaggggctatcaagcaccgcctccgatgttttatccctacaaaatgtgcttaatcaagctgatgagtcgctccatgccgagtccactcggttgttgccttttctcgaccaactcgacccttccaaacactctctcggttacctctatttcctagaggcttgcactgctggtccagttacaacagaatcagctagttcatttgtgttagtcattgccagatttatcagttcatgtgttgctgagcaaatacgcttggctcctgataagtttatatctgtttgtaagaggttcaaggaccaagttc

SEQ ID NO: 22342 - DNA, 397 bp, Gossypium hirsutum
  Clone ID: LIB3272-010-P1-K1-H8
aggatatcactgcagggaaaaaaaaaaaaacccagacatggcttccaacactgttgcatccgctgctcttcttcttaccttgaacttgttgttcttcactttggttagctctacctacgtgccttgcccaccaccaccaaagagccacaagcctacccacaagagcccaccctcggcacctaaacagccagccacttgccccaaagatacactgaaactaggtgtttgtgctgatttgttgggctcggtgcgcgttgttgttggaccgtcgaggaccaaatgctgctcactcatttcgggtttggctgatctcgatgctgctgtttgcctttgcactgctattaaagctaatgtgttgggggttaacctaaacgttcctgtttcattgtctttgctc

SEQ ID NO: 22343 - DNA, 112 bp, Gossypium hirsutum
  Clone ID: LIB3272-011-P1-K1-A1
caaaaacatagcagccatggcagtccgtatgcttcttgggttaggtgtcctgctactctgccttgcaaaggtttcatctgatcttgaagcagaagaagttttaaccaatgtc

SEQ ID NO: 22344 - DNA, 376 bp, Gossypium hirsutum
  Clone ID: LIB3272-011-P1-K1-A10
tgtaagtctcgtttctctttttcctttccccctttaaaaaccgccttttaagcgctttgctttctctctctttttatggatgggatcatctcctttccttctccttcatgaaggtttagatttgaagactgtttttgatttccattagcatgcgaattaggccttttcgttataatccatcgcctgaaatatctgttatcgaatacgcttctactttgtgttgtttcctgattttgattctagtgataacaactggaaattttgaatgcttgagctgtaatatgggatatttgaattcggttttgcaatcttcaagtcaggttcatgttgaatatggacccggtcagcggcggaggccttagccagaatggaaagt

SEQ ID NO: 22345 - DNA, 408 bp, Gossypium hirsutum
  Clone ID: LIB3272-011-P1-K1-A11
aaatgactttctctctctttttctctattgtctggtcttcttctcggcaagctcccccgtcagagaacccaagggttctccggcctccagtagtggagcacggtggccggtatactaaaaactttatttgaaatttttttgtttcttttatttcgtttctgttttcatttctttttcggtctttttgttcggtctctggcgtagctccgttaccggagaaccgtcctgtctccggcgctggagctccttcacggtggactcaatataaaaaagaaataaaacaagccactatttaaaccccgcactcttctttcttttaaaaagaaaaagccgacatcgtcaaactctttttcttccttatttctcttcttcgagtgaataccttcgaaagggcctctttcttcgctt

SEQ ID NO: 22346 - DNA, 407 bp, Gossypium hirsutum
  Clone ID: LIB3272-011-P1-K1-A12
tattgttccttccttcgccgtctactgctcttgtgacctcgatttcaagtgaaacagaatgggtaaggaaaagactcacattaacattgtggtcattggccatgtcgattccggaaaatcgaccaccactggccacctgatctacaagcttggtggtattgacaagcgtgtgattgaaaggtttgagaaagaagctgctgagatgaacaagaggtcattcaagtatgcttgggtgcttgacaagctcaaggctgaacgtgagcgtggtatcaccattgatattgccttgtggaaatttgagaccaccaaatactactgcactgtgattgatgcgcctggacaccgtgactttatcaagaacatgattactggtacctcgcaggctgactgtgctgttttgattattg

SEQ ID NO: 22347 - DNA, 413 bp, Gossypium hirsutum
  Clone ID: LIB3272-011-P1-K1-A2
attcacatgaaaaaactctgataaattcccataagagctccacaaaaaagatttcatattcactcaataggaatctcctaaaatccaagtttctctatcccccccccttttttctttcatttaagctcaaggatttgtgttctttagtttactagtaacctgttactggtttagtaagaaccctggatttcagctctttacattctgttgtttatttctaggattttgcaaaaaaataaaaaaaaatgggttgtagagtatttgaattgctggtctgggtttctttaattttgtgtttagcatgtctggttagaggatttacacctgcagataattaccttattgattgtggatcatttactaatactaccgcgggtcatcgagttttcatggctgataatttagcctcaaag

SEQ ID NO: 22348 - DNA, 415 bp, Gossypium hirsutum
  Clone ID: LIB3272-011-P1-K1-A3
gtctattgctttttgttacctcgatttcaagtgaatcagaatgggtaaggaaaagactcacattaacattgtggttatcggccacgtcgattctgggaaatcaaccaccactggccacctgatttacaagcttggtggtattgacaagcgtgtgattgaaaggttcgagaaagaagctgctgagatgaacaagaggtcattcaagtatgcttgggtgcttgacaagctcaaggctgagcgtgagcgtggtatcaccattgatattgccttgtggaaatttgagaccacgaaatactactgcactgtgattgatgcacctggacaccgtgactttatcaagaatatgattactggtacgtcacaggctgactgtgctgttttgattattgattccaccactggtggttttgaggct

SEQ ID NO: 22349 - DNA, 265 bp, Gossypium hirsutum
  Clone ID: LIB3272-011-P1-K1-A4
atccccctttaaaaaccgccttttaagcgctgggctatctctctttttttatggatgggatcatctcctttccttctccttcatgaaggtttagatttgaagaccgcttttgatttccttttgcatgccaataaagccttttcgctataaacacatccccgaaatatctcgtatcgaaaacgcttctactttgtggcgttttctgaatttgattctatggataacaactgggaattttgaatgccttggccgtaatatgggatat

SEQ ID NO: 22350 - DNA, 412 bp, Gossypium hirsutum
  Clone ID: LIB3272-011-P1-K1-A5
ccacaaacaaaaaaagtgtctcatttttagcaaagttacagtcgtcctcatcgaacaactatggcagccatcaaagtccacggaagccctatgtccactgctacacagagggttcttgcatgccttcacgagaaaggtactgattttcagtttgttcccataaacatggctgccggtgaacataaatccgaaaactacctttccctcaatccattcggtcaagttccagcttttgaagacggggacttaaagctcttcgagtcaagagcaatcacccattacattgctcatgaatacagcgacaaagggacccaactcttaatccctggctctaacaaggatatggctgtcttagaattatggaaggaagtggaagcccaccagttcgattctccatcttcaaaaatagcct

SEQ ID NO: 22351 - DNA, 412 bp, Gossypium hirsutum
  Clone ID: LIB3272-011-P1-K1-A6
acaagaaaaaaaaacaagtgatctgataaattgaagactttatttctgttaacatccattatgagtactgctggtcaagtcatccgttgcaaagctgcggtagcatgggagtcggggaagccactgtcaatagaggaagtggaagtggcaccaccgcagaaggatgaagtccgtattaagatactcttcacttctttatgtcacaccgatgtctacttctgggatgctaagggacaaaaccctctgtttcctcgcatactaggtcatgaagctggagggattgtggagagtgtaggtgagggggtgactgatctaaagccaggtgatcatgttctccccatcttcacgggggaatgcaaggagtgtccccatttgcttgtcaaaagaaagtaacatgtgtgatcttctcaga

SEQ ID NO: 22352 - DNA, 264 bp, Gossypium hirsutum
  Clone ID: LIB3272-011-P1-K1-A8
aataatttctttcggtgatctttggtagagattagctttttaatttttcattatgggaaagatcaagatcggtatcaatggatttggaaggatcgggcgtttggttgcgagagttgctctacaaagcgatgatattgagctcgctggtgttaacgatcctttcatcaccactggatacatgacctacatgtttaagtacgacagggttcacggtcaatgggagcattattagctctaagtgaaggactcaaagacccttctttt

SEQ ID NO: 22353 - DNA, 262 bp, Gossypium hirsutum
  unsure (1)..(262): unsure at all n locations
  Clone ID: LIB3272-011-P1-K1-A9
gaangnaaggggcgacccacgccacccgtctatatcatattcttacctgcatttcaagtgactagctaagctacagtggaagttgtggggcatcacaactagctttttgcacgctcgctataataatagacgtcaaatatacttaccataaattcatatacattccaatcactggtgggatttgccaggcgttgaattgaaaggttcaagaaagaactctttttattactaaaagttccttcacgcttgcttttttgctgca

SEQ ID NO: 22354 - DNA, 407 bp, Gossypium hirsutum
  Clone ID: LIB3272-011-P1-K1-B1
gaaaacaagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaagatatgcgatgaaagagtcgtcgtcgtcggagacaagggcttattcttcagcttgggcgcctgaccctgttacggggtattaccg

SEQ ID NO: 22355 - DNA, 406 bp, Gossypium hirsutum
  Clone ID: LIB3272-011-P1-K1-B10
atggcagttcattgcaattccgctcccttgtcttgcaaaacttggagaaacagaggccccacactcttacccgcccgtctctgctcacttcctcaaaccccatttagcttccgttcagatgcattaaagctctcaacttgcaggtgggataaggtggcttctgctgttgcttctgaagaaagtgcagttggatcaagctcttctgggactgatgtattcaaccttacttacctagaggggaatagttggctgtgggatataagtggggtgagagttttggttgatccaatattggtgggtaacttggattttggtattccatggctctatgatgctgccaagaaatttttgaagaatttcgagcttactgtccctcctcaaggtgattggttacttataacacaaa

SEQ ID NO: 22356 - DNA, 403 bp, Gossypium hirsutum
  Clone ID: LIB3272-011-P1-K1-B11
gcaaagttgatttcttgcctgaagaatcattccaaaattggaacacctacctatctgcactctcacaaatatattcccgattcaatgaccgccttctaagccgctcggatgatgcaaacgagataacacaacttcgtaaacaaagtgaaaatgacatgaaacgttgcctcacttggtgggatcttacctggtttggatttgggtcggttattggagcaggcatcttcgtgctcactggccaagaagctcatcatcatgctgggcccggcattgtcttgtcctatgttgcctcaagtatttcagcaatgctttctgtattttgctatactgagtttgcagtagagaaccctggggcaggggggtcatttgcttatttaagaattgagttaggagattttggtgc

SEQ ID NO: 22357 - DNA, 413 bp, Gossypium hirsutum
  Clone ID: LIB3272-011-P1-K1-B2
aaagcattcgactttgcaaacagaaggggcgtcaaagaaatgtcttctctgcctctacggtaacgctatattactcatacaaattgcgaagcaaaaccaagaaatccctcacatacaaaaatgggtgattcaaaggtcgaaaccatctccagattagctcaatggaggatcgacaactttagtccttgttcttacaaaaaatccgaccccttcaaggtcggtctttggaactggcacttgtctatagagaagaatcgatatatgtatattcgattatttcctgagccatctcgtgtgtctaaggagcagcctccttatgctaaattcatactcaggatctctaatgttggtgctaatcgtagactttatatctccccagttcatgatagaccgctgcgaacgtgtgatgactt

SEQ ID NO: 22358 - DNA, 410 bp, Gossypium hirsutum
  Clone ID: LIB3272-011-P1-K1-B3
gtttcgagtttttttctttttaagactttcccaattctgatctcagccgttgagacatggctactgctgtcccagccgttagagctgtcaacagactgccgctgaagtcgaatggccgtggtccaactccaagctcaatattcttggggaaaagtgtgaagaagggtacctcaaaggtcaaccagaacaaggtttttcccaagaatttcaaggttgttagtgaatatgatgagtcaaagcaaacctcaaaagacaggtgggtgggactcgtctatgatgaatctgatgaccaacaggatattaccagaggaaagggaatggtggacactctcttccaggctcctgtgggaactggaactcaccatgctatcatgagctcctatgactacatcagtcaaggtcttcgcacg

SEQ ID NO: 22359 - DNA, 413 bp, Gossypium hirsutum
  Clone ID: LIB3272-011-P1-K1-B6
catacatgcccatttctcaaaaaaaaaaaaaaaaaaaaaaaaaaatttcccagaagattgattccctggaagggggattattggtgtgttttgtaatggatcaagatttggttgaaacagagaaaagaaggaagagagaaataaatatagaccctggtttgcagtggagccaatggcaactccttgattcgattcttcctacaggtgggtttgctcattcctttggtcttgaggcagcaattcaggcacgtttagtctcaggccctgatgatctccaaaattttgtcatacatttgttagagaatactgggagtttactcctcccttttgtttactccgcaactatgaaccctactttagacaactgccagaaacttgacagaatcttggatgcaactttaagcaatgaagtc

SEQ ID NO: 22360 - DNA, 109 bp, Gossypium hirsutum
  Clone ID: LIB3272-011-P1-K1-B7
ctaataataacgttatatattatataaatcctatacgtcctttttaccgtacgactccatatataagcaagtaaaaataaatatggctcgctctagtcctttctttaac

SEQ ID NO: 22361 - DNA, 281 bp, Gossypium hirsutum
  Clone ID: LIB3272-011-P1-K1-B8
acaagttccattgtttatcagagcaagaaaaaaaagggaaaatggaagggaaagaagaagatgttagactggaagctaacaagttctcagaaaggcaacctattgggacagcagctcagtcccaagatgataaggattacactgagccacccccagcacctttttttgagccaagagagtagactacatggtcgttacaccgagctgaaatcgctgagttcgttgctacttccctattcttgaacatctacgtgtcgaccgtgatggattttttaagacaa

SEQ ID NO: 22362 - DNA, 410 bp, Gossypium hirsutum
  Clone ID: LIB3272-011-P1-K1-B9
cgaagtcgtagctttggaagcatggacttcatagctactatcctgtttctagctcttgtcatctcctccaccaaagctttggacccttgcggccctcagccagatgactcggaccttttggtcatcccaatctatggcaaatgttcaccattcaacccacccaaacctgactcatcgttcaacacagtcatgaacatggcatcaaaagacccagcaagggtcaagtacttgtcgagccttgtagcccaaaagaccactgcggttcccattgcttcaggccaacaagtcctaaacattggcaactatatcgtccgggtaaagattggcactccgggtcagctcatgttcatggtattggacactagcaatgatgtggcttgggtcccatgctccggctgcaacgggtgctc

SEQ ID NO: 22363 - DNA, 207 bp, Gossypium hirsutum
  Clone ID: LIB3272-011-P1-K1-C1
ctcaacattcccattttcaatctccagctcccaaggtaaatatgccgatcagaaacatagcggttggccggcccgaagaggctactcaccccgatgctctcaaggctgctttggctgagttcatctcaaccttgatcttcgttttcgctggatcgggctcaggaatggcctttaacaagttgactgacaacggagcaaccaccccgg

SEQ ID NO: 22364 - DNA, 347 bp, Gossypium hirsutum
  Clone ID: LIB3272-011-P1-K1-C10
tggcacaccgcctttcaagtcctctctaccgccgccgcctctcttcttcatttagcaccgccaccaaagacaaagttcctcttctttacaaaagcccagagatcaacgaagacaacggaaatgaagccgtgacactccaagtcctttcatggggcaggggagcatcaggccaactaggtggtggctttgaagaaatcagtaattacccttcttttgtagccattctttctttaccgcgggctttctttttccttttcttaactcttgtgcttaatccttaaccaaaattaaaaggttcaatactttttcttggttgggttattttgctgggttgtctattttgtttt

SEQ ID NO: 22365 - DNA, 409 bp, Gossypium hirsutum
  Clone ID: LIB3272-011-P1-K1-C11
atttcttttcgatggaatcgattagatcgccctattggtgctacagatgtaatcgattcatccggatccgggttcgatctccccatgattcgctcaactgccccgactgtggcggaggattcatcgaagaaattgaaacaccctcgcgatctcccatccaccaccgtttccctgtcgctgccatgtattccgacacgccaagccctgcgctcagcccaagccccaccgccactcctcattttcgccgaactcgtcggaacgctggcgatcgctcccctttcaatcccgttgtggtcctccgtggacccacctccgaatccgacggcatagttaccgaaagagggaacagaaatttcgagctttattacgatgatggctctggctcgggtcttcgtcccttacctgctag

SEQ ID NO: 22366 - DNA, 409 bp, Gossypium hirsutum
  Clone ID: LIB3272-011-P1-K1-C12
cacaagaaccaaacacggtttctctattattttcttgtcttacttatggccgtcgttaaggctttcattgcttcacttctcatctctcttctccttctccaacttgttgctgctgatcaactggtgacaagtgccagcaagcgcaagggaactgccccccctgcgaaaattgactgcggcggggcttgtgcggcgaggtgccgattatcatcgaggccacacctatgcaagagggcatgcgggacatgttgcgcacgctgcaactgtgttccaccggggacagccggtaaccaagaaatgtgtccttgctatgctagcttgaccacccacggtggccgacgcaagtgcccttgagtgttaatcgacaatcggaacgaatctttctcttttgatgttgttatgaaattaa

SEQ ID NO: 22367 - DNA, 419 bp, Gossypium hirsutum
  Clone ID: LIB3272-011-P1-K1-C3
gaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggtgaaaataatg

SEQ ID NO: 22368 - DNA, 411 bp, Gossypium hirsutum
  unsure (1)..(411): unsure at all n locations
  Clone ID: LIB3272-011-P1-K1-C4
cgccatcctcggatcttattgaaatccctgcggtatcattcgacatcagcatcggtaatgctgatagttacattaaagagttccggagcaggatgccatcgacccggtacgatgcggtatgtagcggcagtcaaccggagcatgactgttcagtttgcctgactaggttcgagccagaatcagagattaaccgcttgtcctgcggtcatctgtttcacaaggtatgcttggaaaagtggttgaactattggaatgtcacatgccctctttgcaggaacgctctgctgcccgaagacgatccggcctacttttggtgagcgtgcggagattttcgaattttccatgtacagcgcgtttattgtacaggtattttaaatgaaacgatgccgncctcggattagcgttaagcgg

SEQ ID NO: 22369 - DNA, 411 bp, Gossypium hirsutum
  Clone ID: LIB3272-011-P1-K1-C6
gaagacagagaggtctcctcacaaccaccgtaatgggtcgtgtcattcgagctcaacgtaagggtgccggttcggtcttcaaggcccatacccaccaccggaagggtcccgcccgtttccgcagcctcgacttcggtgaacggaacggttaccttaaaggtgtcgtcaccgacgtcattcacgaccctggacgtggggctccgttagcccgcgtcgttttccgccaccctttccgttacaagaaacagaaggaattgttcgtcgccgccgagggtatgtacaccggacagttcgtgtattgtggtaagaaagctacccttgtggttggaaatgtgttgccccttagatctatccctgaaggagctgtcgtttgcaacgttgagcaccatgttggtgaccgtggggttttcg

SEQ ID NO: 22370 - DNA, 94 bp, Gossypium hirsutum
  Clone ID: LIB3272-011-P1-K1-C9
cttcatttttctatcattttcattcttcagcattttcatttacgagggagtttaatcaccaaaaacctcattgtcatttgaacatttccctttt

SEQ ID NO: 22371 - DNA, 382 bp, Gossypium hirsutum
  Clone ID: LIB3272-011-P1-K1-D1
ctaagatatcactgcaaggaaaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaagagcccaccctcggcacctaaacagccagccacttgccccaaagatacactgaaactaggtgtttgtgctgatttgttgggctcggtgcgcgttgttgttggaccgtcgaggaccaaatgctgctcactcatttcgggtttggctgatctcgatgctgcttgttgcctttgcactgctattaaagctaatgtgttgggggttaacctaaacgttcctg

SEQ ID NO: 22372 - DNA, 378 bp, Gossypium hirsutum
  Clone ID: LIB3272-011-P1-K1-D10
attctcttctcctccaagcttcttcttctttttctcctctctagttttcatcttccttgtattattctcccattttcagtttttattgttataaggtttatatcgataaaaagaaaaaagaaaaaacaacacttaaaaaggtgatggctggtcgtttcgatgaaaacccgttcgctgaaaaaagagaaagaaaaagttaatcctttcttcgatccagctgtgagagggaaaggcatctggccaagctaaaattggggggaggcttattttaaaagaatgttccagggcctcaatttgcttaaacttaaaaattttaacaattacttcctgaaccggttggtttaattattggcaataaggcaccattgacatttcttt

SEQ ID NO: 22373 - DNA, 408 bp, Gossypium hirsutum
  Clone ID: LIB3272-011-P1-K1-D11
caaaaatgatgatcggagaaccaacacgaccaaatcccaccgttaaaatcccggcgtgggacccactcaatgatccgacgtctaattattcttccgttaattataactgcaatgcgccgtccagtccttgtcccgtcgattacctctcatcgctccaccgttacctcccgtcaaacgatttcgagtcgtccgactctctgagtgaggattcggattttcctgttgacgcgttctcgtgtgaccatttccgtatgtatgagttcaaagtgaggaggtgtgctcgtggcaggtcacatgactggactgagtgtccgtacgctcaccccggggagaaagcccggaggagagacccgaggaagtttcattactcgggtacagcttgccctgatttccgtaaaggaatctgca

SEQ ID NO: 22374 - DNA, 405 bp, Gossypium hirsutum
  Clone ID: LIB3272-011-P1-K1-D12
attttctgtcagatttcttttttctctctcaaaaatctctcaaatccaatactctccgctcctctgatcttttcttcgacttggtttatgagctcgaaggagaaacccactcttggcggtacgcggattaagacccgcaaacggaatattgctgcacccctggacccttcagcatttgctgatgcagtagtccagatctatttggataatgctggtgacctggaacttgttgccaggagcattgaatcttcagatcttaacttctcaagatacggtgacaccttctttgaggttgtttttgctggaggccgcacacaacctggcacacttaaacctgatgaaggggagtgccacccttactctatcatagagtgtgaggctaaacgtgatgccattttactatct

SEQ ID NO: 22375 - DNA, 415 bp, Gossypium hirsutum
  Clone ID: LIB3272-011-P1-K1-D2
tccatctcaaagttcaaggatcttgaagaggtggtacaaagggcaaatgcatcttcatatggattggctgccggagttttcactcagaatatcgaaaccgccaacaccttgactcgagcattgcgagtcgggacggtatggattaactgctacgacatatttgatgctgcagtcccatttggcgggttcaagatgagtggtcaaggaagagagaaagggatttatggcctttcaagttacttgcaagtcaaggcagttgtcactcctttgaagaacccagcatggttgtaatgtttgtttgtttgttttcttacaaattgccatgaatctaaacttgaactaataagctgccagttttttaaattttgaatgatcagcgtatggtaggatcattcctgaactgataatttgctca

SEQ ID NO: 22376 - DNA, 320 bp, Gossypium hirsutum
  Clone ID: LIB3272-011-P1-K1-D4
acagaaaatagacaacagtctctggtgagaagtaacacttacgtatgatgtaggcgctccggacgtagaacttaacgtggtctacgcccggtgaagaagataaacacgcaccccacccttgtgcaccaaagatgaggcttcatcaatggccatgccgacgagtccgacgccacctgggacaccatcgacgccggtgtcggctcgtagggacaacgtgtggaggagcgtgttcaatccaggtagcaaccttgcaaccaaaggtattggcgctgaagttttttacaagccttaagtcagctcttcaacaagaaatgtgtggc

SEQ ID NO: 22377 - DNA, 111 bp, Gossypium hirsutum
  Clone ID: LIB3272-011-P1-K1-D7
gacaaagaataaaagggctcataccatagcgccaagtgtgtgcgtccaaacccatttgatatgcatcgcatagctattaaacaggggcttttatccccgccggatctgcag

SEQ ID NO: 22378 - DNA, 408 bp, Gossypium hirsutum
  Clone ID: LIB3272-011-P1-K1-D8
ggcgccgtcacaaaatgtcgtcaacggagtctctcatcctccaactccatgaaatctctgccgttaaattcggtaacttcaagctgaaatctgggatcttctcccctatctacatagacctgcgtctcatcgtctcttacccttccctcctccaccaaatctcccactccctcctctcctctctccctccccaaacacactgtaacctgatatgcggtgtcccttacactgccctccctatagccacctgcatctctctcgacacctgcatccccatgctcatgcgccgcatagaagtgaaagactactgaactgccaagttcatcgaatgtgtttacgaaaagggtcaagcttgtttggtggtggaagacctcgttacgtccggtgcatcggttctcgaaacggcgg

SEQ ID NO: 22379 - DNA, 408 bp, Gossypium hirsutum
  Clone ID: LIB3272-011-P1-K1-D9
cttgttttactcaaaaagatccctctccaacaatggcttctaatcccaaggtcttcttcgacatgaccgtcggtggccaaccagctggtcggattgtgatggagctctttgccgattgcactccccggactgctgagaacttccgtgctctctgcaccggcgagaaaggggtaggccgtagcggcaaacctctccactacaaaggctcatccttccaccgggtgatccccaatttcatgtgtcaaggaggcgactttaccgccggaaacggtaccggaggtgaatccatctatggagccaagttcgcggacgagaacttcatcaagaagcacacgggacctggcatcctttccatggcgaacgctggacccggaacaaacggatctcaattcttcatctgcacgacca

SEQ ID NO: 22380 - DNA, 337 bp, Gossypium hirsutum
  unsure (1)..(337): unsure at all n locations
  Clone ID: LIB3272-011-P1-K1-E1
gtctcaatccattcacgattttctttttcttttttcttttaattatcacattattattaacacaatcatcagttggtttttccttaaaaatttaaattaacctggccggaaaggccgtcgcctttttaccggggaaaattcaaccccctaactaacctttctacctcagaaattggttggccggaattgcgcatggacacagaatntgctctcggtatcatattttgggctctgagaagaggggagcgcttgtgtgctttagaagaatagcagaatgggatgtgttggatcgacgccggccaaaggagacgggaatgcgaaaaagattcgagagcca

SEQ ID NO: 22381 - DNA, 406 bp, Gossypium hirsutum
  Clone ID: LIB3272-011-P1-K1-E10
catctgccatcaatttgctttgaagatcatgttggctatttttcacaaggcatttgctaatccaccagaggagctgaatagtccagcttctcataaatctactaagaagcctaaacagcctgaagaaaccctaaatgatttcctatctcatcaccctcacaacactttctccatgagctttggcaacgctgctgttttggcttatgtccgccatgaacgtgctgcttcagttcatcagaggttgttttgtgggtttgatgacatatactgccttttcttagggagcttgaacaatctatttatgctgaatagacagtatggtctttccaaagggagcaatgaggcgatgtttgtgattgaagcatataggacactaagggattgcagctgatggctctgtggtcat

SEQ ID NO: 22382 - DNA, 405 bp, Gossypium hirsutum
  Clone ID: LIB3272-011-P1-K1-E12
ctttttccttttccctctttcgagtccgtgcttttttctagggtttgttctttgatctaactaacgcagattattaagaaaatgtcaagtgctttagagatgtcgctagacgatctcatcaagcgcagccgtaagtctggatccggaaacttccggggtcgaggccgtggatccacggcgggacccgcccgccgcattcctaaccgccgagcgaaccgctccgcaccctataccgctgctaaggcgccggagacgacttggcagcacgatatgtattcggataagggagcagcgttgcaaggacaagcaggtcgggccttcccattagaaaactgggacgaagctttatattctctaaatttagattatgggggtttccaatgacgccatcaaggagttattttc

SEQ ID NO: 22383 - DNA, 414 bp, Gossypium hirsutum
  Clone ID: LIB3272-011-P1-K1-E2
ctttcttctctctgagtagtttctttgcttcactgaattgttctcttgattcaaacactagggtttgatcgataattttattcatattttcctttacttcgattgcaattattcagatcttcaaaatccgagttattttctttcatttaatctgaaattggttggattttccttttaattttgaaatttaatctaagaaagaaggggaaaaaatgccggcagtttacggatccagattgacaactttcgaggattcagagaaagagagcgaatacggttatgttcgtaaggtgtctggaccagtcgtcgttgctgatggaatggctggtgctgctatgtatgaattagtccgtgttggacatgataatctaattggtgaaattattcggttggaaggagactctgctacaatct

SEQ ID NO: 22384 - DNA, 396 bp, Gossypium hirsutum
  Clone ID: LIB3272-011-P1-K1-E3
gtcaacaatggacattgcaatcataagagaagtattctctgaaattgtttctgcagctgaggttctgggaagaaaggatgatgctcttattggaaaagtccgcgaagctctggcgaagttaccaccaacaaaaattgctagagatggttccattatggaatgggcagtagattttcaggacccggaggtgcattaccggcatgtatcacacctttttggcctgattgcagggcacacgattactgttgaaaagacttcagacctttgtgaaggtgttgattttaccctctttaaaagaggggtggagggtccaggatggtcaacaacatggaaaactgctttgtgggcacgtcttcataatagtgaacatgcttatcgcatggtcaagcatttaat

SEQ ID NO: 22385 - DNA, 364 bp, Gossypium hirsutum
  Clone ID: LIB3272-011-P1-K1-E4
ccttccttcgccgtctattgctttttgttacctcgatttcaagtgaatcagaatgggtaaggaaaagactcacattaacattgtggttatcggccacgtcgattctgggaaatcaaccaccactggccacctgatttacaagcttggtggtattgacaagcgtgtgattgaaaggttcgagaaagaagctgctgagatgaacaagaggtcattcaagtatgcttgggtgcttgacaagctcaaggctgagcgtgagcgtggtatcaccattgatattgccttggggaaatttgagaccacgaaatactactgcactgtgattgatgcacctggacaccgcgactttatcaagaatatgattact

SEQ ID NO: 22386 - DNA, 104 bp, Gossypium hirsutum
  unsure (1)..(104): unsure at all n locations
  Clone ID: LIB3272-011-P1-K1-E5
gaagtacttcgttttcattactcgtgcaaataaacaatccggttgcgtgnaaaaaaatggggtttttaatattttttttaatttttaaatttattaataatata

SEQ ID NO: 22387 - DNA, 412 bp, Gossypium hirsutum
  Clone ID: LIB3272-011-P1-K1-E6
atggatagttgagagacacacctcaaaaaggatctagaaaagagaatatctcatccttttattttcatttcgtcttcttttcagctcaaattcatcatcgaaattacttgtagttatcaaaatggggacaataggcaaaactactacggccgctctttttctttgtcttcttctgtttcctattgtcttttccacgcctaatgacagattggttagaattggactcaaaaagagaaagattgaccgaaacaatcggatggctgcacaccttgaatccaaggagggaaaggcatctgaagcttttcttagaaagtatcgtcttcatgggaacttgggggaatcagaggacattgatattgtggcactaaagaactacatggatgctcagtactttggtgaggatggtattggc

SEQ ID NO: 22388 - DNA, 151 bp, Gossypium hirsutum
  Clone ID: LIB3272-011-P1-K1-E7
tcgggagagcagtggcaaatttcatttgggtcttttagtaattcatgctttataattgacacgataataaacgccattgccgacacccgatttctaggttactttttttttttttgctctactagtgagagggagagagggaggcgatggc

SEQ ID NO: 22389 - DNA, 286 bp, Gossypium hirsutum
  Clone ID: LIB3272-011-P1-K1-E9
aaaatatctcaaatctcctcctcctcctcggaaatcttagtatcatcaccatggcctcaaatcccaagggcttctttgacatgactatcggtggtcagcccgctggtcggattgtgatggagcttttcgcagattgcactcctcgcactgctgagaacttccgtgccctctgtaccggcgagaaaggcgtctgccgcagcggtaagccccttcactacaaaagctcctctttccatcgggtgatccctaactttatgtgccaaggaggtgacttcaccgccggaaa

SEQ ID NO: 22390 - DNA, 409 bp, Gossypium hirsutum
  Clone ID: LIB3272-011-P1-K1-F1
gcggattaggactttcgttcttcttgctctttaatgtttacgccaccagtttctactctggatctcgacttgttgagagtggcgatgccacattctcggatgtttttcaagttttctttgctttgacaatggcaactgttggcatttctcaatcaagcacccttgctcctgactccagcaaagccagggccgctgctgcttcaatattcgcaattatcgaccgtgagtctaagatagacccgagtgaccagtccgggacaacattagaaaacatgaagggtgatatcgaactttctcatgtcagtttcaagtatccattaagaccagacattcaaaatttccaagacttgagtttatctatcccagcttgcaagactgttgcattggtaggagaaagcgggagtgggaa

SEQ ID NO: 22391 - DNA, 389 bp, Gossypium hirsutum
  Clone ID: LIB3272-011-P1-K1-F10
caagaaccaaacacggtttctctattattttcttgtcttacttatggccgtcgttaaggctttcattgcttcacttctcatctctcttccttctccaacttgttgctgctgatcaactggtgacaagtgccagcaagcgcaagggaactgccccccctgcgaaaattgactgcggcggggcttgtgcggcgaggtgccgattatcatcgaggccacacctatgcaagagggcatgcgggacatgttgcgcacgctgcaactgtgttccacccgggacagcccgtaaccaaaaaatgtgtccttgctatgctagcttgaccacccacgggggccgacgcaagtgcccttgagtgttaatcgacaatcggaacgaatctttctcttttgat

SEQ ID NO: 22392 - DNA, 409 bp, Gossypium hirsutum
  Clone ID: LIB3272-011-P1-K1-F11
ctagaagatgctcggtggcacagccgagaagatgtaaggaaggcattgagatttgccgaatacaagaaggcgcaaagattggctgcagctaaggtagatcagatgatcaaaggagttaaaaagcgatggagttcatcggcaggttatcttgcgaaaagtggggaattcgctcccatgtttgttccgggaccgttcgcgatcacccatcatctcatctcggcctgggctaatcaagatccaccaaccggcgccaaagctcaaatgaaaaaaccgcctagcggttttgttttgaaactatagccgtgccaattctcttccgaaagctgcagaagatccgccgtatgcctcgttctagtgcgtctgttaaaaggcaagtttatccttctatcctttcagataagaaagcaat

SEQ ID NO: 22393 - DNA, 409 bp, Gossypium hirsutum
  Clone ID: LIB3272-011-P1-K1-F12
cttcttcttcttcttcttcttcaaacaagcaaaaaaacaagaggaaaaaaatgggtggagaaagaaaggtctacactttggctgaggtttctcaacacaaccatgctaaagactgttggcttgtcattgagggcaaggtatttgatgtgactaaattcttggaggaccaccctggtggtgatgatgtcttgctgtcttccacagggaaggatgcaactgatgattttgaagatgttggtcatagtagcagtgctcgagcaatgatggatgagttttatgtgggtgacatcgatacatcgaccatcccctctaagaggaagtacactcctccaaagcagcctcactacgaacaagacaagacctcagaatttgtcataaagcttctccaattccttgttcccctgctaat

SEQ ID NO: 22394 - DNA, 99 bp, Gossypium hirsutum
  Clone ID: LIB3272-011-P1-K1-F2
gcaaaggaaaaaaaggaaagggcaaaaaatggctgtgcaattcaatcccatggcttctcaaactaagaaacttccttcatatgcccttccacccatggc

SEQ ID NO: 22395 - DNA, 301 bp, Gossypium hirsutum
  Clone ID: LIB3272-011-P1-K1-F3
ctgagtttgaagcttcaagtgctaaaatctagggatttgcgggtggagaagacgagagcccatctctctgcttcaaagctcctgtccaggtagaattctcttcttcccttgcgttgtgttctttgctgttcaatcgccatggcttcaaagcggattttgaaagaactcaaggatttgcagaaagatccacccacttcttgcagggctgctccagtacctgaagacatgtttaattggcaagcaacaatcatgggaccttcagatagcccttatgctggaggtctgtttttagttactatcc

SEQ ID NO: 22396 - DNA, 200 bp, Gossypium hirsutum
  Clone ID: LIB3272-011-P1-K1-F4
ctttttccttttccctctttcgagtccgtgcttttttctagggttcgttctttgagcggacttacgcagattattaagaaaatgtcaagtgctttagagatgttgctagacgatctcaacaagcgcagccgtaagtctggatccggaaactcccggggtcgaggccgttgattcacggcgggacccgcccgtcgaaattt

SEQ ID NO: 22397 - DNA, 400 bp, Gossypium hirsutum
  Clone ID: LIB3272-011-P1-K1-F5
gcagaaacgaccggcagagaaataaaaatgggaggctgggcaatcgcagtgcatggtggtgctggtgtagacccaaatctccctaatgaaaggcaagaggaagctaaaagactcctcaatcgttgccttgatattggaatctctgctcttcgttctaacctctccgccattgacgtcgttgaacttgtcgtgagggaattggaaacggatcctttgtttaattccgggcgtggatcggcacttacagagaaagggacggtggaaatggaagctagtattatggatggaccgaagagacgatgcggtgctgttttgggtttaactacagtgaagaatccgatattttttgctcgacttgttatggataaaacaccatatttctttttggtttttgccggct

SEQ ID NO: 22398 - DNA, 372 bp, Gossypium hirsutum
  Clone ID: LIB3272-011-P1-K1-F6
gaataaaaaatccttgaataaaattatcaagtaataagttttaagtataacaaaatttgagaaacaccaaaggaaaattcataaaagagcatccagcataagttcattttaggtgccaaacttaaaaactacaaaatctaagacacttgacatgctccaaatatcaaatagatgactatcataacagtcatcatcggctttaagccactggcggaagttcaatctcggtcggcacgggtgcttccaccttgataacttcatcatccttgggagggtggatggtgacaagatccggaagtggagttgttgggccttgcttaccctttggatcccagtcaagcatgatcttcaccttgatgcccagtactccct

SEQ ID NO: 22399 - DNA, 183 bp, Gossypium hirsutum
  Clone ID: LIB3272-011-P1-K1-F9
gatgatggctatcaaaagccaccattgctgcttcagatttatctttttgatattacgattactcctacagcttgattgtgtaaaaggcgttctccagttcaactactatgcccaaaggtgccccgatgctgaagagatcatccaacaacaagtctttaagctgtacaacaaacatggtaacac

SEQ ID NO: 22400 - DNA, 311 bp, Gossypium hirsutum
  Clone ID: LIB3272-011-P1-K1-G1
tcgcgcgatgctgagtactctacatctgcggctgctggcgcttctgctccatcgcagccttctgccgctaagaagggcggaaaaggtaagatcactgatgagttcactggtgctggagccatcggtcaggtttgtcaagtaatcggtgccggcgtcgatgttagattctatgaaggcttgccttcgattttgactgcgcttgaagtgatggaccactcgatccggcttgtgttggaagtggctcaccacttgggtgaaaacatggttaggaccattgcttttgatggaacggtgggactcttcagagggca

SEQ ID NO: 22401 - DNA, 405 bp, Gossypium hirsutum
  Clone ID: LIB3272-011-P1-K1-G10
caaaatccccgtaggggacccattcaacgatccgacggctagctttcactccgttaactttaactacaacaatgcagtcagtagtccttgccccgtcgattacctcgggtctctccaccgttacctaccgtcaaacgactacgagtccgattcgctgagtgatgattcggacttacctgttgatgcattctcatgcgaccatttccggatgtacgagttcaaggtgaggaggtgtgctcgtggaaggtcacatgactggactgagtgtccgtacgctcaccctggtgagaaggcccgaagaagggacccgagaaaggtccattactctggaactggttggcccgatttttgcaagggaagctgtaagaaaggcgattcatgtgaattcgctcacggcgtttttga

SEQ ID NO: 22402 - DNA, 410 bp, Gossypium hirsutum
  Clone ID: LIB3272-011-P1-K1-G11
ctaaaaacaaaactgaaaatgtcttgctgcggaggaaactgtggctgcagctctggttgcaagtgtggcaatggctgtggaggatgcaagatgttccctgacataatagagaagactacaactgagactattgttcttggtgtgacaactcagaaaatgcactttgagggatctgagatgggagttggggttgagaatggatgcaagtgtggagacaactgcacttgcaacccttgcaattgtaaataagagggggggaaaatgaacaacaaagagaagcagagaggcctttgtctttttaactaaataaattctattactttagtatgtatcagcaaatcttcatgaggatttggttcttaattatgtgtaatgtgggcttttctgctatgtcagaatgtattatgata

SEQ ID NO: 22403 - DNA, 386 bp, Gossypium hirsutum
  unsure (1)..(386): unsure at all n locations
  Clone ID: LIB3272-011-P1-K1-G12
gcacgaggtaggtgccctagggatgccctcaaattaggtgtatgtgccaatgtgcttaacttagtcaatgtcaccgttggttcacccccggtgatgccatgttgttcccttcttaatggtcttgtggacctcgaagccgctgcttgcctttgcaccgctatcagagctaacatcttaggcatcaaccttaacatcccagtttcccttagcttgcttctcaacgtttgctcaaggaatgttcctactggtttccaatgctaagtcaacattgttcctacattctttctcatctttcttatggngtttgtgtttgtatttgtgtttgtgtttggattttaaaaattatgattcagtatttacggtacatcaatgttatcattagttac

SEQ ID NO: 22404 - DNA, 282 bp, Gossypium hirsutum
  Clone ID: LIB3272-011-P1-K1-G2
gcgagatcaatagcgctaaaagcagtgaataccgccagtttatggggtctaaatcggagtcgtttcgggggtttgcccaaggtccaaaccgtgagggcattgtcgacagtcatgtctccgccgtccaaggcagtcgtctacgagcaccacggtccacccgacttcgtcaccagaatgatagagctacccccagtagaagggcaggagaatcaagtttgtgttaaaatgttggctgctcccattaacccctctgatattaaccgtattgaaggagtatattct

SEQ ID NO: 22405 - DNA, 409 bp, Gossypium hirsutum
  Clone ID: LIB3272-011-P1-K1-G3
gaaaaaaataacaataaagacgacaaagacaagcagttcaaattacacgaagaaaacggagaatcagagcttactattctacatatatgatccccacccctaccctcaccaacgctctcaattttactattttgcatttttattccttcttctatttcttaccaaagaaaaaaaattctttttttttcttcggtaaagaaaagtattttatttaattttctggggtttttgattcatacccatttcaggttttccatcgacttgcaataaaggaccttgaggaagtaaccaagcatatgattttactcttttgatgcgtgaagatggattacaaagtgcaagtcggagtccaatcccaccttgaaatggaccactagatgataggacaatggaagatctcgatgacgag

SEQ ID NO: 22406 - DNA, 411 bp, Gossypium hirsutum
  Clone ID: LIB3272-011-P1-K1-G5
cgaaaatttcttaatttcctcgcaagccaaacagattttacctcttatctccgaatcatctcatctatggctcgtaccaagcaaacagctaggaaatcaaccggaggaaaagctccgaggaagcagctagctacaaaggccgcgcgtaagtccgctccggcgaccggtggagtgaagaagcctcaccgtttcaggccaggaactgttgctttgagagagatccgtaagtatcagaagagcactgaactgttgatcaggaagcttcctttccagaggttggtgagggaaatcgcgcaagatttcaagaccgatctgaggttccaaagcagcgccgtcgctgctctttaagaagcggcggaggcttatcttgtcggactgtgtgaagacactaatttgtgtgcaattcatgct

SEQ ID NO: 22407 - DNA, 61 bp, Gossypium hirsutum
  Clone ID: LIB3272-011-P1-K1-G8
aaatatcagaagggattgaatatcggtgatgttgggcgctttaaggagaaaagttgcgatt

SEQ ID NO: 22408 - DNA, 416 bp, Gossypium hirsutum
  Clone ID: LIB3272-011-P1-K1-H1
ccttctgcttagcttaaaaaatcttgaatccgtactctcctacttccctcgttatcgtcaatggcttcggacaagaagattaagatcgggattaacggatttggaagaatcggacgtttggttgccagagttgctcttcagaggaacgatgttgaactcgtcgccgttaacgatcccttcatttccaccgattatatgacatacatgttcaaatacgacagcgttcacggtcaatggaagcaccatgatcttaaggtcaaagactctaaaaccctcctcttcggcgaaaaacccgtcactgttttcggaatcaggaaccctgaggagattccatgggctgaagccggggctgagttcgttgttgagtcaactggagtgttcactgacaaagacaaggctgctgctcacttgaaggg

SEQ ID NO: 22409 - DNA, 410 bp, Gossypium hirsutum
  unsure (1)..(410): unsure at all n locations
  Clone ID: LIB3272-011-P1-K1-H10
tcgcccacgcgtncgcccacgcgttcgcccacgcgtncgaaaaggaggagaaaatttttggaggaaaactcaaacaatggcagttgcaccccatatggcgaaactgagcttttttcctctaaaccgacctgggtttttctctcagctttcctgcaacaaattccttcatatataaaaaaacaaaaaccttacagagaaccaatgtggagctgggtacaatgggtcaagggacctaacaaaacccctgtgtattttaggggtggggttctcttttgggtcccgggaagatgatagtgtttccaaaaccccgggttataacccagttgttgtttactccaagagttggtgcccgttttcgttcgaggtgaaatcttttgtcaagaaacttggtgtggagcctttggttattg

SEQ ID NO: 22410 - DNA, 416 bp, Gossypium hirsutum
  Clone ID: LIB3272-011-P1-K1-H2
gcggcttctgcttctatttactattttctcactctcctactcctttgtgccatcccttttaccttctccgagctcgttaaagagcagcctctggtgttgaagtaccacaatgggccactcttgaaggggaagatcaccgttaatctcatctggtacgggaagttctccccaacccagcgctccataatcgtcgatttcatcaactctttgagctctgccgtcaaacccaagattccgtcggcgtcgttttggtggaaaacgacggagaaatacaagtccggttcctccactttggtcgtgggcaaacaaatcctcctcgaaaattacccgctcggtaaaatccttaagaacccacacttgccagcgttggccgggaaattcaacggcgtaggtacggttagcgttatcctcacggc

SEQ ID NO: 22411 - DNA, 415 bp, Gossypium hirsutum
  Clone ID: LIB3272-011-P1-K1-H3
cttttcactgctcttaacggaaatagggaaacggtggaaaccctttttttttaattgtcctccaaacaaaccctaagtcggattcggataaaccgaagagagcaagatagagccagtcgttgatggggtattgaatcgctgagttgaaccggtcggaagaagatccaagttagagttgtagacgaactcaattctatatctaatagatgggcgcggcgggttcgaagctcgagaaagctttgggtgaccagttcccggaaggcgaacgatattttggtctcgaaaactttggcaacacttgctattgtaacagcgttttgcaggcactttatttttgtgtaccatttcgcgaacagctgctagaatattattcaagtaataaaaatggtgttgatgctgaagataatctgctgac

SEQ ID NO: 22412 - DNA, 215 bp, Gossypium hirsutum
  Clone ID: LIB3272-011-P1-K1-H5
agaagaccctggtagtttcactagttcgttcatgcgtggcgaaaaggaagattatatgttgggggtgaaatttatttggtagttttataaatttttatatttaaattatttttattttaaaccgacctgggtttttttcttagttttcctgcaacaaattccttcatattcaaagaaacaaagcctccacagcaaccagctggagcttggttaaa

SEQ ID NO: 22413 - DNA, 408 bp, Gossypium hirsutum
  Clone ID: LIB3272-011-P1-K1-H6
ccgttatccgtctccgcctctcttcccaagtatattacataaaatattatgaattaaagcaaatccccaatttccccctcatcccaatcctcaccaaaccctacaacgaaaaccctaattcagattttgctttaattctgatttgctggtccgtaattctattcaaaagaaagacccctatatattgcatttccccaatttattacgttttaatttttaagagaaattgagaagggaatggaaggtataccacacccaataccgagaacggtggaagaggtcttcaacgacttcaagggtagacgctctggcttgattaaggctctcacaactgatgttgacaagttctaccaacagtgtgatcctgagaaggagaacttatgcctatatggacttccaaatgaaacc

SEQ ID NO: 22414 - DNA, 407 bp, Gossypium hirsutum
  Clone ID: LIB3272-011-P1-K1-H7
ggaaaacaagaaaagcagagccgcatcactttttgctagctaagctactgtgggagttattgttcttcagaacagcttctgcagtagctaataatatcgttatatattatataaattttatacatcctttttaccctacaactccatatataagcaagtaaaaataaatatggctcgctctgtttcttcctttaagctccttggtgcttctatttttgatggtctttatgtctccatatcaaggagaggttactcgggtgcaccgccggcggcagtgacggctagctttggtaggcctggggcgatggggaaagtggaacgaagagatgcgatgaaagagtcgtcgtcgtcggagacaagggcttattcttcagcttgggcgcctgaccctgttacggggtattacc

SEQ ID NO: 22415 - DNA, 295 bp, Gossypium hirsutum
  Clone ID: LIB3272-011-P1-K1-H8
cattcttgtatcgcaatctctgggacggatcaagccaaactgaaaccagcactgccgaagaaacgctactcttcactacagccgtcaacaccatgcggtggccggcggtgaaaagtggggggctgggggtggttgcgatgacatacgtggcggtagactatttacgcatcctatccccaacgtggcacgagcgttttcaacccgtactctggtctttactagccctcgtcgccgtcacgcgcatccccttttaccggcactggagcgccgagtttcgagctggcatctctttcct

SEQ ID NO: 22416 - DNA, 404 bp, Gossypium hirsutum
  Clone ID: LIB3272-011-P1-K1-H9
cccacgcgtccgagatgaccactccggtttgcccattcgtgaaagcggctcgaccggacgataatggttcggccaaaaaatccaccgtcggcggcagcgaagcaacaaggaaagattccggtgactccgccaccgtgtctccgaaatgcccttttggttacgattccaataattttaagctcggtcctctcagttgtatgatctgtcaagcacttctctttgactgcaccaaatgtatcccttgttctcatctcttttgcaaagggtgtatatctcggtttaaggattgtccactatgtggagctgacatagagaaactggaagctgacaccaatcttcaaagcatggttgatcgatttatcgaagggcatgctaggatcaaaagggcacatgttggcgttaat

SEQ ID NO: 22417 - DNA, 319 bp, Gossypium hirsutum
  Clone ID: LIB3272-012-P1-K1-A1
ggctcctctgtctttcctcctctttaactctacgtgataaactctttcccctgcgaaatctcaaaccctaaaataaaaaaaatctcaatttccccatagggatttcacatttcttaaatatttaatcacatattctttcctttttttattctattgttttctgggaaattgtaattagtttttgatttgggatggcgatgctggtggaagatattttacaatcggtggagatctggttgaagctgataaagaaacccccaccttacgccgacccgaatttggacccggttttattagttccgggtattgacggcttgat

SEQ ID NO: 22418 - DNA, 376 bp, Gossypium hirsutum
  Clone ID: LIB3272-012-P1-K1-A10
gcaaggaaaaaaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaagagcccaccctcggcacctaaacagccagccacttgccccaaagatacactgaaactaggtgtttgtgctgatttgttgggctcggtgcgcgttgttgttggaccgtcgaggaccaaatgctgctcactcatttcgggtttggctgatctcgatgctgctgtttgcctttgcactgctattaaagctaatgtgttgggggttaacctaaacgttcctggttc

SEQ ID NO: 22419 - DNA, 408 bp, Gossypium hirsutum
  Clone ID: LIB3272-012-P1-K1-A11
aaaaaaggcagatagataggttgaactccctttttcttcccttagaaccaaactgtgaccgaccttcactttctggctaccatgacggccaaggattgcggcaaccatggaaaaggccggcggcagcgcatacgaaggctctttggatgccttctagtgttcctccttatcggtctcatcacaatctttatcatatgggcaatcctccgccccgcaaaaccccgcttcatcctccaagacaccaccgtctatgctttcaacgcctgcactcccaatttcctcacttctaatttccaagtcaccgtatccacgcgaaaccccaatgacagaatcgggatttactacgacaggctcgtcatctacgccacctacaggaaccaacaaaccacccttaggacagcttttcct

SEQ ID NO: 22420 - DNA, 400 bp, Gossypium hirsutum
  Clone ID: LIB3272-012-P1-K1-A12
cttctttcctcctagcccaaaaaaaaaaaaccctctttcctttctctcgttctttttcccgttcaatcatgtcttgcttcattagcaaatatgccgatgagttggctaaaaacgctgcttacattggaacccctggaaagggtatccttgctgctgatgaatccactggcaccatcggcaagcgtctttcaagcattaatgtagagaatgttgaagataacaggcgtgctctccgtgagctcctattcacaactccaggagctcttcagtacctcagtggtgttattctctttgaggaaaccctttatcaaaaaaccgcttcgggcaagcccttcgttgatgttttgaaggaaggtggtgtcctccctggcatcaaggacgacaagggtaccgttgagct

SEQ ID NO: 22421 - DNA, 216 bp, Gossypium hirsutum
  Clone ID: LIB3272-012-P1-K1-A2
ggctactctggcttttcttacttctaactgtacgtgggaaactctttcccctgcgaaatctcaaaccctaaaataaaaaacatgtcgattttcccatagggatttcacatttcttaaatatttaatcacatattctgtcctttttgtattctattttattctgggaaagtgtaatcagtttttgatttgggatggcgatgttgttggaagatattt

SEQ ID NO: 22422 - DNA, 406 bp, Gossypium hirsutum
  Clone ID: LIB3272-012-P1-K1-A3
gttcccaaagtggatgagctttgacatggctttgctagtcccaaacttacttgaaatcaccatatggaattgtattaaatgcatacatctcccgttgttcagtcggcttcccaagcttaaggtgctcaggcttgaagtgataactgctgtcgaatacattgaagatagcagtgccgagtcttcatctttctcattcaagggaaatccaatgaatagaggaagagaaggtaaagaattcttcccttgcctagaagaattagtgttttttgacttgcgaaatctgaagggatggtggggggaagcccctcctgttaccaattataatcatggcgcagcagcatcaccacagaggccattgcagaagaaggaatcaatgccctcattccctcgtctttcaaaattaaaa

SEQ ID NO: 22423 - DNA, 401 bp, Gossypium hirsutum
  Clone ID: LIB3272-012-P1-K1-A4
gttcccaaagtggatgagctttgacatggctttgctagtcccaaacttacttgaaatcgccatatggaattgtattaaatgcatacatctcccgttgttcagtcggcttcccaagcttaaggtgctcaggcttgaagtgataactgctgtcgaatacattgaagatagcagtgccgagtcttcatctttctcattcaagggaaatccaatgaatagaggaagagaaggtaaagaattcttcccttgcctagaagaattagtgttttttgacttgcgaaatctgaagggatggtggggggaagcccctttctgtaccaattattatcatggcgcagcagcatcaccacagaggccattgcaaaagaaggaatcaatgcccctattccctcgtctttcaaaat

SEQ ID NO: 22424 - DNA, 407 bp, Gossypium hirsutum
  Clone ID: LIB3272-012-P1-K1-A5
cagtactaggcaactaatgttaatgtcgttcctttcctcccttctataactaaaacaataacacctcaaatttctcaacccccaaaattgttgcacggtgtgcagtattcattctcatagatagcatttgagtattgaggaactcatttcttcatatccccatccgcaatgcatcgcaatgatggcgtttgtttcacctcctcttctttcaaaatccctgtcccttctccctcccaaaccctagcctctcccctctccagagctcgtcactcccttttccaactccttcactccctcaggaatcgctccctccctcctaccacatccactcactctcccctactatgctgtgcgtctctctctctaacagcccagacctacgaccttcttaatgcgcctctgctatg

SEQ ID NO: 22425 - DNA, 414 bp, Gossypium hirsutum
  Clone ID: LIB3272-012-P1-K1-A6
ataaccttgagattatcaatttgaagccttcttcgaatttcctcattcaagatgcaaattttcgtcaagaccctcaccggaaagaccatcacattggaggtggagagttctgatactattgacaatgtaaaggccaagattcaggacaaggaaggcatccccccagaccagcaaaggttgatcttcgctggtaagcaacttgaggatggccgcacgttggctgattacaacatccagaaggagtccacactccacttagtgcttcgcctccgtggaggaatgcaaatttttgttaagactttgactgggaagaccattacattggagggtgggaggttcagataccattgataatgttaaggcaaaaattcaggacaaggagggaattcccccagaccaacagaggctgatttt

SEQ ID NO: 22426 - DNA, 405 bp, Gossypium hirsutum
  Clone ID: LIB3272-012-P1-K1-A8
caaaaaacggagtagatctagttctctttgtagatctgatttttttttctccgatcaacggtgaaaagttccttttttttcatggcgatgatgacctgccgttccttgttgcttttacttttgatctcactttttgtttcttttggtttcgccgagatccgtttcacggagatccgatccgatgtccgacccataatacctttcgatgagttcgggttcactcacaacggtcgccttgaactcaacctctctcagatcgatctctccgacaagaacaagaacctcgacttgaacaaaatcggattcttcctctgcacgcgcgacacgtggttccacgtgcttgaacaactcaacgaccaccatgtcacgtgtgctctcgattccgaactcgtcaaggtcgtcttc

SEQ ID NO: 22427 - DNA, 310 bp, Gossypium hirsutum
  Clone ID: LIB3272-012-P1-K1-A9
aaaaaaaaaagaataatggagttgaacatggatgtggatttggtttatgtaccagaaactgtatctgagtttttgaaacaagcttcaaagatcaaaaatgggtttcaaagattatgtaagattagtgattatgttagaagattggaagatgagatgaagaaaattgatgccttcaaacgcgagcttcctctttgcatgcttctcttgaaagatggtattttatttgtttattttttttcaatactttccgggattaaatttgatatttttaatgggattttagcgattaagagaaaaaagagagagcgtg

SEQ ID NO: 22428 - DNA, 334 bp, Gossypium hirsutum
  Clone ID: LIB3272-012-P1-K1-B10
gggggacgaaagttatggctccatccttgatgtttagggctacatttatgacgcggaggtctaccgatcacacaaaggtgagtggtgtggagcaactatgagacttgaagcttaactgtcctatcctttaagatccaatcgaaagacacgtcaataaactccccactgctgcatgggaagctgcactgaattctagattttataattacacgcataagcgagtacaagcaccttgttggagctaaaccaacacctaagaaagaactcttgggcgtcacctattgtaacttatgacaaactgctcaagttaggcaacttcttttgatgctagaac

SEQ ID NO: 22429 - DNA, 409 bp, Gossypium hirsutum
  Clone ID: LIB3272-012-P1-K1-B11
ctgagatgaagaagattctgcttgctattgctgatggattgggatcttgccctatccagatggttcttgaggatgatgaccaaagttttctgaagaaagctgctgatcttgaggctgctaagctcgatccaaaccatgctcaagcctcctgaatgatgctcccaggttgctgaacttgaatttatgcttttgtattttcctaatcttttgcagctactttagcttgttggtatttggatccatccaagtatatatgaataaaagggttaacgctacgtttagccctcgagctttaggcgaatgtgaaatgcgtacttaaacttgaatttcatgatacatttcatccaacccttaattcggttaaaagtatgaacttatatgggtagcgtaagggtgagttgttgagatt

SEQ ID NO: 22430 - DNA, 380 bp, Gossypium hirsutum
  Clone ID: LIB3272-012-P1-K1-B12
gaaaaaaacaattatggcaagcaaagaacccgaacacgagcacagagaagatgaagaagctcctgccgccgaggatgaagacactggagctcaagtcgcccctattgtcaagttagaggaagtcgctgtcagtacaggcgaggaaaatgaagatccgatcctcgatctgaagtcgaagctgtatcgatttgataaagaagggaatcaatggaaagagagaggtgctggtactgtgaagctgttgaagcacaaagagacaggaaaagttcgccttgttatgaggcaatctaagactctcaagatctgcgccaatcatctagtgttgccgacaatgacggtgcaggagcacgctgggaatgataaatcgtgctttatgcacg

SEQ ID NO: 22431 - DNA, 415 bp, Gossypium hirsutum
  Clone ID: LIB3272-012-P1-K1-B2
attgttaatgctatttgtgatgatgatgatatcagagctatatcatttgttggttctaatactgctggcatgcacatatatggaagagcttctgctaaaggaaaacgtgtgcagtccaatatgggggccaaaaatcatggcattgtcatgcctgatgcaaacaaggatgctacactaaatgctctacttgctgctggttttggtgctgcgggacaaaggtgcatggcacttagcacaatagtctttgttggtgactctgaatcatggttgaatgacctggttgaacgtgccaaaggtcttaaagttaatgctggaattgaacccaatgcagaccttggtccagtgattagcaaacaggctaaagaacgaatatgcaggttagttcaatctggagttgagcgtggtgcaaaactac

SEQ ID NO: 22432 - DNA, 384 bp, Gossypium hirsutum
  Clone ID: LIB3272-012-P1-K1-B3
gctgtggaagcatggacttgagaggtactattcggagcttagctattggttgctgctacaacacacggcgggtgcatatatggaatgggattatcggacacggaaaacttggggcattgccaagagtggggccaatatgttaaggggttggcctaccttatgcacacaagggtgctacactggatgcagtacttgctagagcatctgacgctgcgtgacagacgtggctcgcactgaggacaataaaaattcttggggactattgatgatggttcaatgacctacttataagtgcataaggtcttaaagttaacggtggaattgaacctaatgcataccttgatgcagagtttagcaaacaggttcaagaccgaatatacaggt

SEQ ID NO: 22433 - DNA, 256 bp, Gossypium hirsutum
  Clone ID: LIB3272-012-P1-K1-B4
gaacggactagaaaaggcgccaggcgcaaggaagctaattggcggcatacctcgcggatgcactgtcgaccgacctttatcttatcagaagggttcccgtgagagcatgcttgtcgccacattaaagaggaccaactatgcctgagcgtgccgaaagcagaggaaactgttggggaggctcgcatacactcttgcgtgcaaatcgttcgattgacttgggtattggggcgaatgaatactcgaaccgtttagtagc

SEQ ID NO: 22434 - DNA, 97 bp, Gossypium hirsutum
  Clone ID: LIB3272-012-P1-K1-B5
aaaatcttttatcttaataatcggtagtatttcttataaagagtgtagtgtgcttaactttaagctaaagcagaaaattcactaaattaccactttt

SEQ ID NO: 22435 - DNA, 413 bp, Gossypium hirsutum
  Clone ID: LIB3272-012-P1-K1-B7
cggacgcgtgggcgccaccaccaccactcttaaagatcgacctttgggccatccgttctgggtacagccggataatcaaagcccactcccgccacttcctagctctctcactcctcttcctcctccctttctctttcttcttatccatctaccccttcatcgccattgaatcctacctcagcttccttcagcaagatccctccatcttccccactaaaatctttatcctaaatgtcctttacaccatccccatctctatcttctccctgttggccaccggttccatcacttatagcattttccacggcttttacggtcgacccatcaagcttttatccgctattaaggcggctttcacttccttcttccctctcttctcgacttgccttgtaacccagcttatcgtttctggg

SEQ ID NO: 22436 - DNA, 230 bp, Gossypium hirsutum
  Clone ID: LIB3272-012-P1-K1-B9
gtcttaattctggcgaaggagaacatggtttctgcacgatgaagaatgtctaacagatgtagccttataagctcttaattagagtgacattagaatagcccttctgggagtgtctctctatgtatcaactttataggggggtcgctccctgcacttatagagctatacatatattgtatataaggtttacatgatctatgtccggtaactaaataggattatgattactg

SEQ ID NO: 22437 - DNA, 414 bp, Gossypium hirsutum
  Clone ID: LIB3272-012-P1-K1-C1
gtactcactcaacattcccatttccaatctccagctcccaaggtaaatatgccgatcagaaacatagcggttggccggcccgaagaggctactcaccccgatgctctcaaggctgctttggctgagttcatctcaaccttgatcttcgttttcgctggatcgggctcaggaatggcctttaacaagttgactgacaacggagcaaccaccccggctggtctcgtagccgccgctctagctcatggcttcggtcttttcgtcgctgtctccgttggcgccaacatctcaggtggccacgtcaaccctgccgtcaccttcggtgcttttgttggcgggaacatcactctcttgcgcggcattctttactggatcgcccaactcctaggctcaaccgtcgcttgcctgttgcttaag

SEQ ID NO: 22438 - DNA, 400 bp, Gossypium hirsutum
  Clone ID: LIB3272-012-P1-K1-C10
gcaaagttgaaagaaaagagtgataagcatggtgcctgacaacaataggaatgaggttgaggattataagttaactgttcaagtccctgaaactgcccatcaagttagcactgattcatggctccaggccggttttgtcttgacaactggtgttaacagtgtatttgtgttgggatattctgggacaatcatggtccctcttggttggataggaggcatagtcggtttgcttttagccaccgtgctgtcgctgaacgccaacatgcttgttgccaagctccatgaacatgggggaaagaggcatatcagatacagagatcttgcagcacaaatatacggtaggagagcctatactattacatgggcaatgcaatatatcaatctggtcatgattaacatt

SEQ ID NO: 22439 - DNA, 409 bp, Gossypium hirsutum
  Clone ID: LIB3272-012-P1-K1-C11
agctgcaccacggagaagagagaaaaactgaaaaaggggaaaaaaagcgtcgtcgatattgcttcttcttcttatttttcttcttccctctctctctttctcagaagctcctctttcgttcttttgttcactaagtattgcaaaagatggccgacagcgaggatattcaacccctcgtctgtgataatggaactggaatggagaaggccggcttacgctggagatgatgctccaagggcagtttttcccagtatcgttggtcgtccccgacacactgctgttatcggtgtgatgggtcagaacgatgcctatgtaggagatgcagcacactctaaaagaggtatccttacttcgaaatatcctattgcgcatggtattgtcagcaactgtgatgatatggaaaagatct

SEQ ID NO: 22440 - DNA, 414 bp, Gossypium hirsutum
  Clone ID: LIB3272-012-P1-K1-C2
ggaaatgttgatattggttggctgtgaatccaagtaaaaaagagtatatggggggtggaagtggacgtctcgtggacggtgttcgtcgctggtttcaacgtcgccatttgattccttcttcttcgaatcaacaaaataataacattatcatcgatcatcatgatacttcttcttcatcctctactactctaaccctcactcaaaaacaatcacaataatcaacagctgatattgtcgttcaggattttgatttttcttccttgaggcttgttaaagttcctaagcgtcattactttcctgtttcttccatggattctcacaaaaagggtgcacttgaaaaggaattttttacacagtatggagaggcaagtcgatatcaagttcaggaggtcattggaaagggaagttatgggg

SEQ ID NO: 22441 - DNA, 412 bp, Gossypium hirsutum
  Clone ID: LIB3272-012-P1-K1-C3
ctgaaaaagaaaaagaagggatgggagttttaggcaaagtggtggatgggattctattgctaacattcgtgtccatgtcggtggtgccagcgtgcttggacgcccaggtacttttgcctaaagcgcttttccccgatgtgctgggtcgtgtatattcatggtatacgaccacataccaagattatttgctgttggatgagcctcattttttcatggcacttatgaaattggagcttgttttagtattgccgcttgctatacttaacacttatggcttgttgacctccaagccctggttcaacaccacctgcctcatcttcggttctgctcttgttacctccacgacagctatggtgggagacatgctgggatccgacaaaccatcagcaggtaaactggcgtcgatgtactc

SEQ ID NO: 22442 - DNA, 409 bp, Gossypium hirsutum
  Clone ID: LIB3272-012-P1-K1-C4
cgaaagctcatctctctctctctctctctctctagatttcaccccttaggtttctctttccacacagagacagagagagaatcagaggagcttaatcgagatttgatattcctcaccacagatggatcagatattgaacaaggtgggctcctattggctcggccagaaggccaacaaggagatcgattccgtcggcgacgacctcaactcattatccaccagtattgaagggggagccaaatggttggttaataaaatcaaaggaaaaatgcaaaagccgttgccagagctgttaagagagtataacctgccaataggaatcttccctcgtgatgccacaaattatgaattcaatgaagagactgggaagctcactgtttttattccagcaatatgtgaagtgggatac

SEQ ID NO: 22443 - DNA, 398 bp, Gossypium hirsutum
  Clone ID: LIB3272-012-P1-K1-C5
aaaaaaaggaaaagaaaatcaaagttatttttctttcaattgagcccttcatttttctctcattttctttcttcccaaacaacaaattttaaagaaaatgccaacagatacaagcaaacccatgaaattagaacgatacaatagctatattcgtaaagtccatacgacgaagttgttggatgcttcatctaaatgtctatttcgtgttacccttcttatcgctttagttgtgatcttgtttttgaccattaattaccctccactttacgataatacccacagtgcacctcaccatcatgaccgtcatagctttctttcaactttacttgtctccggttcttacctcgttggaggtgcggcgtgggagaaacaagttcgtcactcttagactacacgta

SEQ ID NO: 22444 - DNA, 404 bp, Gossypium hirsutum
  Clone ID: LIB3272-012-P1-K1-C6
cacagcttctatcaacaccgctgacgtcgcgtcgttatattctacctcaccgccatcggccgacgtcctcccttcttctttcataattcatatcacatctcaaatcctgattattttccctttaatttatacccttttcgtgtttatatacttgcaagttcgtatttgggtaaattcaatttcaagctaattctttttaaataaaaggaggaaaaacagattttatagtgaaaatcatgaaggtcgtacaccgagacctagttcccaatggccctggcagcgtcaagatgataccagtggattcagaggatctctggtttgcttacaatttgatagctactggggattgggttatggctcgaactgtcaggaaagttctaagggagacagccggtggaagagat

SEQ ID NO: 22445 - DNA, 412 bp, Gossypium hirsutum
  Clone ID: LIB3272-012-P1-K1-C7
gttttgaaaaacaccatctttcttgtgaattctgcaacctttggagtaacttaagaagaaatgggggaaaagagtttaattgccaaggatgtcaccgaattgatcggtaacacgccactggtatatctcaacaatgttgtagatggatgtgtggctaaaattgctgccaagttggaggcaatggaaccctgctccagtgtcaaggacaggattggatatagtatgattgcagatgcagaggagaagggtctcattgtaccaggcgagagtgtgctgatcgagccaactagtggtaataccggaatagggttggcattcatggcagctgctaagggttacagactcataattacgatgccttcttcaatgagtttagaaagaagaatggtcctccgagcttttggagctgagc

SEQ ID NO: 22446 - DNA, 413 bp, Gossypium hirsutum
  Clone ID: LIB3272-012-P1-K1-D1
cagcagttctccttcgccgttccagtcccctcccatgtccgaccagatgacgacgaaatgaggacgctctccgacgaatctcgcaacggtacaagcgtgtggcgtgcgcggagtgttgaacgtgggacggtgtggagactgccgaacgtggggcatgtggcgctgctaattgttgctagggtttttgctgttttaggccaattgggccctgtaattgggtttagcttggcccaagttttattgggtttgggcccaggtatatttgggcttgtacagatgtccctctttgctcgttgtcgcgtaactggaacagagtaaagactaaaagtccaattgtgctcggtcttactaagccttgacttcttcggtgcttttcttctttaaatagtctcattccttcctattgcatcttc

SEQ ID NO: 22447 - DNA, 400 bp, Gossypium hirsutum
  Clone ID: LIB3272-012-P1-K1-D10
ggaaaatggacccaactgcaccctccgcgtcggtcgtcggcggcggtggcggcggcggaggagggccggcacctttccttatgaaaacattcgacatggtggacgactcatcgaccgacgacattgtttcatggagctctaacaaaaagagctttgtggtttggaaccctcctgattttgctcgccttttgcttcccacttatttcaagcacaataatttctccagcttcatcaggcagcttaatacctatgggttccggaagattgatcccgaacgatgggaatttgccaatgaagatttcgtgaaagatcaaaggcatcttcttaagaatattcatcgaagaaaacctattcacagccatagtaatccacagggttctttgatagatcatgaaagagc

SEQ ID NO: 22448 - DNA, 409 bp, Gossypium hirsutum
  Clone ID: LIB3272-012-P1-K1-D11
gcgaacatggcgataggagttaaggccttgcacttgtcctttgtgcctcatgccctcgcgattgccggcgctgttatggtattggtttggtgcattcacttcaggggtggattagcttgggaatcttctaacaaaaatctcatctttaatctccatcctgtattgatgttgattggcttcattatcttaggaggtgaagccattatgagctacaagtcattgccactgaagaaggaagttaagaaagtcatacatcttgtgctccatgccactgctctgattctaggcattattggaatctatacggcattcaagaatcataatgagagttcaatacctaatctctacagcgtgcattcttggcttgggattggaatcattaccctttatggcattcagtggatatatg

SEQ ID NO: 22449 - DNA, 407 bp, Gossypium hirsutum
  Clone ID: LIB3272-012-P1-K1-D12
ggagtttgccgaggaactgttcgaagctttggctcgcagaagagggataacatcatcggcagtaaacaaagctcagctaagggaattttgggaacaaattactgatcaagctttgatgctagattgcaaactttctttgacatggttgacaaagatgctgatggaaggatcacagaagaagaggtgaaagagattatcacattgagtgctagtgctaacaagctgtcaaaaatccaagaatgtgctgaggagtatgcagccttaatcatggaagaactggataaagacaaccttgggtacattgagatatacaatttggaaacactactactgcaagctccaagccaatcaaccaacttagtgacgggcagccgcattttaagcaagttattgagtgaaaaattggt

SEQ ID NO: 22450 - DNA, 404 bp, Gossypium hirsutum
  Clone ID: LIB3272-012-P1-K1-D2
ggaatttgcatatttacctaaaaaaaaaaaccatacatagatgcacccggtaaacaaagactagaaattatttaaaaggccatcaaagggcacaatccttcacgtaaaaccagaaaacccacattaaggaagacctcaaggcttagaacccaccacgaagacgaagaacaaggtgaagaggggactccttttgaatattgtaatcagccaaagtccttccattttccagctgtttcccagcaaaaatcaacctttgctgatctggtggaattccttctttgtcctgaatcttcgctttcacgttatcaatcgtatccgagctctccacttttaaagtaatggtcttaccggtcaaagtcttgacgaagatctgcatccccccagaccagcaacgtattattttt

SEQ ID NO: 22451 - DNA, 413 bp, Gossypium hirsutum
  Clone ID: LIB3272-012-P1-K1-D3
tgggaactttgtactctgtgaggagaaccaatgcgttgcttgcccgtcaccaaacggattactcgggtggagccggaattgtcagccgaagaaggtgaattgtgggccgaatggtttcagctacttcaagctagaacgagtgtaccatttcatgagccagtacaatgaaagagacgggataaaggagagtgattgtgggaggaaatgcacctctcattgcaagtgtttggggtacttttaccacagggaaacatacaaatgttggaccgctcatgagttgaaaacccttgctcaagcctctaactcttcccatgttggttacataaaggcacccaacaagtgatgggaatcctatgaagtatttgtactttttcctctgattttgcagattctttgatgtctgctaataagta

SEQ ID NO: 22452 - DNA, 228 bp, Gossypium hirsutum
  Clone ID: LIB3272-012-P1-K1-D5
attttattataccagaccggtgaagcccttccttcattacgtacagcgcgagcttggagggggaattggggtaaaattcctgaaccttgacactttttctgacttgcaacttatagggagtccttagacatttttaaattctctgagaagtgttaacttttctgtttaacggcctgtctactcttgaaactgtttagtcggagttagggttcatcgtttttaatagct

SEQ ID NO: 22453 - DNA, 391 bp, Gossypium hirsutum
  Clone ID: LIB3272-012-P1-K1-D6
tttctttcaatgcgtcaaggatttggtgccgcttcccgatcagccgtgttcggtggcatcttgcttgctttgatcgaaggagctggtatcatgttgaataaagttctcagtcaaccgcagatgcctattatgatagatgagccagcacccaatgtagcaggaatgcctggatatccgatgggacaattgccaaaccaagcgcctgcatcaattgagagtttgagacgcgactcgccaccgccgcctccacaacagtcctcatctaactcttcctcttcatggtttggaggactttttggtggaaagaagcaggaaccggcaacaggtagtggaagtaaaactgaggttttggagagcttcgatgctcctccggtgccgtctttcgaataca

SEQ ID NO: 22454 - DNA, 413 bp, Gossypium hirsutum
  Clone ID: LIB3272-012-P1-K1-D7
tttccaatccaatatttcaaatccctttaatcttcttgatcaataaaaccaccccacccagattgttggttagctatcccatcaaatcatctatcatcaatttcctaacgtttcctttttggtttattgccgtctcccacaaatctaatctaagttgttttaaagaaagaaaatgagctggtggtgggctggtgctatcggagctgctaagaagaaatttgaggaagatgaagcaccgaaaagcctcaagagcgttgggctgatcattggagtcaccggcatagttggcaatagcttggctgaaatcctccctttatccgacactcccggcggcccatggaaagtatacggggtggctcgtcggcccagacccaactggaacgccaaccatccaatccagtacattcaatgcg

SEQ ID NO: 22455 - DNA, 410 bp, Gossypium hirsutum
  Clone ID: LIB3272-012-P1-K1-D8
cttaaatcccctcgcttctcctgctcagcctctgcttcaaccacaatggctaaacaagttttggtgccgatcgccaacgggacggagccgatggaagcggtgattacgatcgacgtgattaggagatcgggagctgacgttacggtggcttccgtcgagaaagagcttcgcgttgacgcttgccacggtgttaaaattgttgctgatgctctcgtcgctgattgtaagaacaccgttttcgatcttatcgcgcttcctggaggcatgcctggtgctagcaactttaaagattgtggagttcttgaaagtcttgtgaaaaagcaggctgcagatgggcggctttatgctgccgtgtgtgcttcacctgctgttgcgcttggttcatggggtctattgaagggactgaaagc

SEQ ID NO: 22456 - DNA, 413 bp, Gossypium hirsutum
  Clone ID: LIB3272-012-P1-K1-D9
ttgaaatatagtatttgcactcattagcctgtccctcatggaatcccatcttgagaaacaaaatggagatgtgcttcaacaatctttcaaagagatgatatctactctccctaaagagaatcgttggggttttcttgaagattattatcaatatcaaggtttttggatctccccgtcttttctacaaggagcgttgtcagctcaacaacaattccaagctcaacccactgatgtcatcctttgtagctctctaagaacaggcacaggctggttaaaatccctcactttcgccactattacaagaacttcatacaatgattccaccacccctttacttcacacgctgcctcatgatgttgtgcctttcttggagttcgatcattcccagttttctgctaatctacatcttggaa

SEQ ID NO: 22457 - DNA, 415 bp, Gossypium hirsutum
  Clone ID: LIB3272-012-P1-K1-E1
cacggagagaatgttgatggagttctcgtcaatgatgatccgagtgagcctaccatggctgagaaacttgcaagtttaaatttaatagaaaatggaaaaaatgaaaccaatgaaaaccaagaaagaaaagaaccctctactcatggtaagcctcccatcgcggattcagttatggttctgcttaagcaggcactccgtgctgacgatcatgcacttctgttagattgcttatacactcaagatgagaaggttattgcaaattcagtctcccaattaaatccatctgatgttctcaagcttttacaatctcttgtatctataactcaatcaaggggtgcagtattggcatgtgcgcttccttggataaaaagtttacttcttcatcacgctagtggaattatgtcccaggaatcct

SEQ ID NO: 22458 - DNA, 391 bp, Gossypium hirsutum
  Clone ID: LIB3272-012-P1-K1-E12
gtgtgaatctcaatgtgaacaatggagtaatgtatgtgaaggtgatgacagatgagcagttggagactctccggaagcaaattgctgtttatgcctctatctgtgagcaacttgttgagatgcacaagaatctcactgcccagcaagatcttacaggtgggagactgggaaatctgtattgtgacccattaatgacatcgggcgggcacaaaataagtgcgagacaacggtggacaccaaccgctgtgcaacttcaaatactggaacgtatatttgatgaaggaactggaactccaagcaagcaaaagatcaaagagataacctcagaactaagtcagcatggccccatttctgaaaccaatgtgtataactggtttcaaaacagacgagc

SEQ ID NO: 22459 - DNA, 412 bp, Gossypium hirsutum
  Clone ID: LIB3272-012-P1-K1-E2
cggttctggtcttggatctttgttgttggagcgcttgtcggtggattatggaaagaaatcaaagctcgggttcaccatctatccttctcctcaggtctcaactgcagttgtggagccttacaatagtgttctgtccactcattcccttcttgagcacacagatgtggccgtgctcttggacaatgaagcaatttacgacatatgccggagatccctcgatatcgagaggccaacttacaccaatttgaacaggctgatttctcaaaccatatcgtccttgacgacttctttaaggtttgatggagccattaatgtagacattacagagttccaaaccaatcttgtgccatatcctcggatccatttcatgctctcttcttatgcgcctgttatctcagctgagaaagcatac

SEQ ID NO: 22460 - DNA, 411 bp, Gossypium hirsutum
  Clone ID: LIB3272-012-P1-K1-E3
ctgattttctctttctaaaaaacgcagcggtgagcgaccggcgagaaaccaaatctcgccggaatttcgctctcttgatcgccggaaatttcatttcctttttcttttcacctctccggaatcaagctgccccaaagagagcggatatatatatatttgaatttcgggtatgattttgtaatcatgtttttgtagaagaaaacaaagagaaaaaggagaacaaagatcttctctctcttttggatatggcgattaaatggagccttgagtgataaattttgagcttttagtttttgagattttctgggtgttgaagctgtacaatgccatctgagatcatggatcaaaagaatgcatcggcatcatcccatttttcggaagacgtttgtttcccagctgagagacaaattg

SEQ ID NO: 22461 - DNA, 75 bp, Gossypium hirsutum
  Clone ID: LIB3272-012-P1-K1-E4
attttattttttctttttttaattccccacactgttttcaaaacccattctctagaagggcccaatgacttatct

SEQ ID NO: 22462 - DNA, 370 bp, Gossypium hirsutum
  Clone ID: LIB3272-012-P1-K1-E5
gcatcattatccttctatttcttctctcttttcacaaaccaaatcaactcttttctctaattcaggcagtggcagctcatggttgcaacataatcccttgcatcgtgatgcgagcagtggtgttggatcgaggcagggtccaatatattcagtttctcgcacgaaacctgcagaagttgcctccgtagaggacctcttcgagttcatatgctctggtcctcttgtcgacaaaatgggactgacccaggaaaaggtggcagagtctattgacaagtggttgttttatggctcgaagctttgtcgattgtttcagctggatgaactttaccttactactcctcagaaagcaaggttttatcactactacata

SEQ ID NO: 22463 - DNA, 414 bp, Gossypium hirsutum
  Clone ID: LIB3272-012-P1-K1-E7
aaatttctcgcatctttgtttgttcataaaataatagtatagttttcttagaaaaaccagagtgaaagaaaaaaaaaagaagtaaaagaaaaatggctttggcaagcttggtgagaagaaaggcataccttttgtctagaaacctgtcgaattcgcccgcagatgcgttgaaatactctttttcactcagcaatttctcgaggggtttcgcttcaggatctgaagagaacgacgtcgtcgtcatcggcggcggacccggcggctacgtggcagctatcaaggctgcacagctaggtctcaaaacaacctgtatcgagaagcgtggtaccctcggtggtacttgccttaacgttggttgcatcccatctaaggcgcttcttcattcatcccacatgtaccatgaagctacgcatt

SEQ ID NO: 22464 - DNA, 411 bp, Gossypium hirsutum
  Clone ID: LIB3272-012-P1-K1-E8
atttccccctcatggccgccgctgatgtcgagttccggtgcttcgtcggagggctcgcatgggccaccgacgaccgggccctcgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacatcaccgtcaacgaagcccaatcgcgcagaagtggaggcggtggcggaggatttggaggaggaaacggtggttacagccgcggtggaggcggcggcggatatggtggtcgccaaggaggatatggtggcggacgccgtgaaggtggatacggaaatggtggagggt

SEQ ID NO: 22465 - DNA, 412 bp, Gossypium hirsutum
  Clone ID: LIB3272-012-P1-K1-E9
cgaaaatctcaatttccatgaaagttctggggacacctcgtcccttaccccttgctttagataccaacgactctcgtgttctctctcatacacactcttctccatcagtactctcatccacgaaacattctcacaagctttccaaatccatggctacttgtatcgacacctcaagaacaaccgagccttcccgagtttcccagcgtccaaacaggtctcaacctgatgaaatccattacaagtatgtaaaattctgcagacccacttttactgaccatgtttcaagcataccctttagcgaaaaccacacaaatggcattcaccaccagaaaattgctgatttatcttttgaagaagaaggagaagtagcagagattggttctttatggctgaaaatgaacgaagaggcaag

SEQ ID NO: 22466 - DNA, 267 bp, Gossypium hirsutum
  Clone ID: LIB3272-012-P1-K1-F1
caaacaaaagcagccccttcttccaatcccactgtcgttgatgatccttacaagcgcctcgaaatcattcttaaccccaatggctcgcttacgcgcaaccctaataggtttcccaacacttcagccatacctgatccggacccaactgtcccggttttctttaaagatatcactatcaaccaaacgacacacacattgtctcgtgtgttttttctctggcagaaaccgtttggttggtacaaggtctcttttatagaatattaccat

SEQ ID NO: 22467 - DNA, 410 bp, Gossypium hirsutum
  Clone ID: LIB3272-012-P1-K1-F11
gcgaaggagaaatctttaagctaagcttattcgtgagtgaaagcaatagaaaacaaaagaaagaatctcaagtttcctcttcctccacgactctctctctgtgtttttttctttatttgggtgcttctctccatcaaagttggagctttggataattggatatattgaaaatggcaagtttgaatcttggtcctgttttgcctgcaaagtcaaggctctctctgtttgaacataatggatctctttttgtttctagaagaaaacccaagaagaagaaccaagctattgtccctgtagcgaggttatttgggccagcaatattcgaagcatcgaagctaaaggttttgtttttaggagttgatgaaaagaagcacccaaggaagctacccagagcttatacccttacacac

SEQ ID NO: 22468 - DNA, 73 bp, Gossypium hirsutum
  Clone ID: LIB3272-012-P1-K1-F12
aaaaaaaaaaaaaaaaaaaaaaaaaaaaaaaaaaaaaaaaaaaaaaaaaaaaaaaagaaaaaaaaaaaaaaaa

SEQ ID NO: 22469 - DNA, 408 bp, Gossypium hirsutum
  Clone ID: LIB3272-012-P1-K1-F2
aaaaatcttcaatgtttttcccttcttctatttcaaatctaaattttcgattcttcttgattcatcttttgttttaatttttcttctttaaatacttttctaagcagtttaacagtatagcacgactgttaattgtttaatctcttgctattttgagaattttattgtgaattttttcctttggattgctcttgaagttttctgttttttccgagatttctcgtttaaactggggaagttgcaggagtatttctaggttctgcaagatttgaagcaaaattcgtttctaacgatggctacggaggaccaaattgaaagtacagcatcacctactgctctcaaatccggtgtgtgctgttccataggcagtggacaatctgagacattgactcaattgcaggagttata

SEQ ID NO: 22470 - DNA, 401 bp, Gossypium hirsutum
  Clone ID: LIB3272-012-P1-K1-F3
aatgaacggtgcgtctgtagacgaaaataactgtacccaaagtgaggaaatgctgctccatgaagctctccgccgtttgatttcgacgatcatctaccccgatggatcgtcatcgccaccagctccgcttctgcagcggatcaagatctctgtttccgagaatgggcctcgccttggggaagcctctagaaacactagccgtactgttatacggtggactcgtagtggcagcccccttcgtgctcttcttgtcatctctgttgggtccattgcttttcttaccttgacaggattgcttgtgtttatgcttttctttctagctgcaactgtcaatgccgtcatcatctcttccctcattgctttggctgctgcaggaggcttcttggctcttttctttggct

SEQ ID NO: 22471 - DNA, 392 bp, Gossypium hirsutum
  Clone ID: LIB3272-012-P1-K1-F4
cttaacgttaactattccctcgtcatggaaccaccgccgccgccactgcctccgcccaactccacctctaatcaaatgtgaaagcggaggagtgccactaacaaagcaagctcaccgcttcttctcttcattaacatccacggctgccgtcgacgaccccgccaccgctaaccggttgataaagaaattcgtagcgtcatctccaaagtcaatagctttgaacgccctctctcatcttctctctccccgtaattctcaccctcacctctccgccattgccttccctgtaagtccgccttgtatactaaaataagtgaagcatcatggtacaattggaacccaaagctagttgcagatttagttccattgcttgatatacaaggtaagcacga

SEQ ID NO: 22472 - DNA, 394 bp, Gossypium hirsutum
  Clone ID: LIB3272-012-P1-K1-F5
cttcacttcttttcattttccttcagacttcaccaaagtgagaaaatgacttccccgttttccttgccttgaattctccatctttctactttaaaacccaaagccccaaaagagtttttaattttcttttcttataaccctcaaaaaaaatttcttattggagagagcttttgataggatatgaatatggaggcaagagttggggtggtggtagaaggagggcaaagggctttaaattcagcccacggagctgttgtagatgctggggctagaaagtttttacagcagcagcagcaacaacaacatgagcattcttcaaagcagggcttgaatccgcagattgggactgttcaacagcttcttgctggtggtattgctggtgcttttagcaaga

SEQ ID NO: 22473 - DNA, 413 bp, Gossypium hirsutum
  Clone ID: LIB3272-012-P1-K1-F6
caaagagcaggaaaacaagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaagatatgcgatgaaagagtcgtcgtcgtcggagacaagggcttattcttcagcttgggcgcctgaccctgttacggggtatt

SEQ ID NO: 22474 - DNA, 308 bp, Gossypium hirsutum
  Clone ID: LIB3272-012-P1-K1-F7
caaagagcaggaaaacaagaaaagcagatccgcatcactttttgctagctaagctactgtgggagttattgttcttcagaacagcttctgcagtagctaataataacgttatatattatataaattttatacatcctttttaccctacgacttcatatataagcaagtaaaaataaatatggctcgctctgtttcttcctttaagtgccttggtgcttctgtttttgatgctctttatgtctccatatcaaggagaggttacttaggtgcaccgtcggctgcagtgacggctagcttttggtaggcct

SEQ ID NO: 22475 - DNA, 409 bp, Gossypium hirsutum
  Clone ID: LIB3272-012-P1-K1-F8
cttcgaagtcgtagctttggaagcatggacttcatagctactatcctgtttctagctcttgtcatctcctccaccaaagctttggacccttgcggccctcagccagatgactcggaccttttggtcatcccaatctatggcaaatgttcaccattcaacccacccaaacctgactcatcgttcaacacagtcatgaacatggcatcaaaagacccagcaagggtcaagtacttgtcgagccttgtagcccaaaagaccactgcggttcccattgcttcaggccaacaagtcctaaacattggcaactatatcgtccgggtaaagattggcactccgggtcagctcatgttcatggtattggacactagcaatgatgtggcttgggtcccatgctccggctgcaacgggt

SEQ ID NO: 22476 - DNA, 357 bp, Gossypium hirsutum
  Clone ID: LIB3272-012-P1-K1-F9
gacactactagacttgtagaaatgcaagggctcgtcttgttgccggtactcctttgcgccacctaccatatcgctctttccgcgaccaacgttacggtggcggacgggctgttagataatggtaactttgagcaagccccgaatgcctcaaacatgaagggcacggttgttgtggggcgttatgcaataccaggatgggtaaacgaagggtttgtggaatacataaagtccgggcaaaagcaaggggacatgttgctggtggtgcctgagggagcctatgcagtcaggttggggaacgaggcttcaatcaagcaggagataaaggtggcgaaagggatgtattactccatcaccttc

SEQ ID NO: 22477 - DNA, 52 bp, Gossypium hirsutum
  unsure (1)..(52): unsure at all n locations
  Clone ID: LIB3272-012-P1-K1-G1
ctttttggttatatcatataaatgattttaatctttntatttgacagaaatg

SEQ ID NO: 22478 - DNA, 408 bp, Gossypium hirsutum
  Clone ID: LIB3272-012-P1-K1-G10
ctctcactcaattatccatttattcttttctttcaactcaaagtcccaagtagtattagaatcatgggtgttgtcacttataactatgactctacctcccctgtcgctcccgccaggcttttcaaggccttcgttcttgaagctgacaaggtctggcccatagctgcccctcatgcaatcaagagtattgaggttgaagctaatcctggccctggaagtatcgtaaagatcaactttgttgaaggccttccattccaatatatgaagcaccagattggaggacatgatgaaaacaaattttcatacagttacagtttgattgaaggtgggcctttgggggacaagcttgagaaaatcaactacgagaataagtttgaggcagctgtaggtggaggaagtgtgtgcaag

SEQ ID NO: 22479 - DNA, 408 bp, Gossypium hirsutum
  Clone ID: LIB3272-012-P1-K1-G11
ggagccggaaagctgttgttgtccatgtcccatatagattgaggaaagctttccgcaaggttcatgttaagcttgtgagggaacttgaaaagaagttcagtggcaaggatgtgattcttattgccacccggaggatattaaggcctccaaagaaaggttctgcagttcagaggccacgcagccgcacattgactgctgtacatgaggcaatgctagaagatgttgtcttacctgctgagattgttgggaagcgcactagatatagaattgatggatcaaagataatgaaggtgtatttggaccccaaggaacgaaataacacagagtacaagcttgagacgttttctgcagtttaccggaagcttgctggaaaggatgtcgtgtttgagttcccagtgatggaggcat

SEQ ID NO: 22480 - DNA, 410 bp, Gossypium hirsutum
  Clone ID: LIB3272-012-P1-K1-G12
cttctttcaaccgcgcctaataaccgctcggatttttctcagacgtgaaaaaaatggggctgtctttcaccaagctattcagccggctatttgccaaaaaggagatgcgtatactgatggttgggcttgatgctgctggtaaaaccaccattctttacaagctgaagttgggagagattgtcactaccattcccaccatcggtttcaatgttgagaccgttgaatacaagaacatcagcttcactgtttgggatgttggtggccaggacaagatccgaccattgtggagacactatttccaaaacatgcaaggacttattttcgtggttgatagcaatgatcgtgaccgtgtggttgaagctagagatgagttgcacaggatgttgaatgaggatgagttgagggatgct

SEQ ID NO: 22481 - DNA, 288 bp, Gossypium hirsutum
  Clone ID: LIB3272-012-P1-K1-G2
aactatctcaaatctcctccttctactcagaaagcttagtattatcaccatggcctcaaattccaaggtcttctttgacatgactatcggggcgtagcccgctggtcggattgagatggatcttttcgcagattgcactactagcactgctgataacttacgtgccctctgtaccggcaagaaaggcagtaggcgcagcggtaagccactccactacaaaggctgctgtctacattgagtgatccctaactttatgtagccacggaggtgacttcacggacggaaacg

SEQ ID NO: 22482 - DNA, 374 bp, Gossypium hirsutum
  Clone ID: LIB3272-012-P1-K1-G3
caagaatggattctgccatagcccagaaaacatgggaactagaaaacaatatacttaccgtcgagacacctgacccttcatcggattctatattctactacgacgaggcggctcaagccaagttccagcaagagaagccttgggccaatgatcctcactacttcaagcgcgttaagatctctgcgctcgctctccttaagatggttgtccacgcccgatctggtggtaccatagaggtgatggggctgatgcaaggcaagaccgacggcgatgctatcattgtcatggacgcctttgctttgcctgttgaaggcactgagactagggttaacgctcaggcggatgcctatgagtatatggtcgattattcccag

SEQ ID NO: 22483 - DNA, 412 bp, Gossypium hirsutum
  Clone ID: LIB3272-012-P1-K1-G4
gggagtttaaagcagcaatatggtctggcaaagtcggcaaatgaagtgattttggtcattgaagcttacaaggcccttcgtgaccgagcaccttatcctccaaaccatgtggttggccatctaattgggagctttgctttcattgtctttgacaaatccacctccactttgtttgtggcttctgatcaatttggtaaggttcctctctattggggaatcaccgccgacggatatgtggcctttgctgataatgctgaattgctgaaaggtgcctgtggcaaatctcttgcttcttttcctcaaggctgtttctactccacagcagtaggaggattaagaagctatgagaatcctaagaacaagatcactgcagtgcctgctgaagaagaggagatatggggtgctaaattca

SEQ ID NO: 22484 - DNA, 413 bp, Gossypium hirsutum
  Clone ID: LIB3272-012-P1-K1-G5
gttttctctcatgggaactttactttcaagccatggtttctccttgttccttctttggaccttcactttatacggtctctgtttatccttctctccgatcgacaattacctcatcaacagcggtgcctccctcgattccgttgtagacaaccgtcgattcatctccgactcgtcgaattcacccgattcccatctctcttctggtcggaccttttcgctctgtgccggaactctccttcctggtctgcctcaaatctaccacaccgctagggtttttaattcgccgtcgaaatacgtcttcaatgtcaaagatccagggacgcacatggtacgtctccatttccatcgattcaattcatcgagattggatctgggtaactctcgatttcacgttttggttaatgggttagtag

SEQ ID NO: 22485 - DNA, 302 bp, Gossypium hirsutum
  Clone ID: LIB3272-012-P1-K1-G6
gttaaatgctactgaatccttagttgagagcatagccaaattgaaaacagcgtgttgggcatgaaagatatacggtatcatggctatccgacgtctgcgatcgacaattacctcatcaacagcgttgccttcctcgattctggtaaaaacaaccttctattcatcttcgactcgtcgaattcacccgattcccatctcttttctggtctgaccttttcgctctttgccggaactctccttcctggtctgcctcaaatctaccacaccgctagggtttttaattctccgtcgaaatacgtttt

SEQ ID NO: 22486 - DNA, 400 bp, Gossypium hirsutum
  Clone ID: LIB3272-012-P1-K1-G7
cccagaattacttaaacaacaatggctacctatgaaggtaaagttttcactgaagaacaagaagctttggtggtcaagtcatggactgtaatgaagaagaatgcagctgaattgggtcttaaattcttcttgaagatatttgagattgcaccatcagccaagaaactattctcattcttgagagactcaaatgttccattggagcaaaacacaaagctgaagccccatgccatgtctgtctttgtcatgacatgtgaatctgcagttcaactgcgtaaagcaggcaaagttacagtgagggaatcaaatttgaagaaattagggagctaccccattttaagtattgggtaagttgatgaacattttgaggtaacaaaatttgctcttttggagaccataa

SEQ ID NO: 22487 - DNA, 228 bp, Gossypium hirsutum
  Clone ID: LIB3272-012-P1-K1-H1
ccttaatcgaatagagaaataactgtgagaggaaaatggggaaacagcctgataagaggggtgcggctgacaacaaagacgtttgtaagctatttattggaaagcacaaccttactttaccaattactttatttttttagacttgggggtcattacaaaatcacagttctacattttttactaaattttttgaaaagtattagctgtgacatctacggcaaatggttt

SEQ ID NO: 22488 - DNA, 410 bp, Gossypium hirsutum
  Clone ID: LIB3272-012-P1-K1-H10
atcagccccgccgctaatccatctcgaacgtgaataacagtggctggagaagcgcataatgtgcctccaccaccgtcgcggtttcaaccagacccacaaggatctgtcaaccttcgaccggaggagccaacgtcgaccaaatcgacaccaaaacagtacgtggtggtgtacagaggtggtacggttgtgtcgacgtggaggcgtgagcgatggtagtgctggaggatgctggaggctgctgcggcgccaaacaaatgaggctagggttagggttcccaagaactgtcaaaggattgggcctatcgggctctattagttgtggggccattgagtattgggctaggattaatttggtttttaggtttctatttgggtttgggtttgaaattgggttatgtaatttggacttg

SEQ ID NO: 22489 - DNA, 350 bp, Gossypium hirsutum
  Clone ID: LIB3272-012-P1-K1-H11
cgaagaactacaaagttcttatggatgagtttcatcatgtatctactgcttttttggaactcgaaaaaggttatcaggaggcaattgaggatattacgaaaagaatgggtgcaggaatggcaaaatttatttgcaaagaggttgaaacagtcggtgattatgatgaatattgtcactatgtagcaggactcgtggggttaggtctttccaaacttttccatgcatgcggtacagaagatttggctcctgatactctctccaattcaatgggtttatttcttcagaaaacagatataattccgagattattctcgggatatcaatgagataccacaagtcgcgtatgtttt

SEQ ID NO: 22490 - DNA, 411 bp, Gossypium hirsutum
  Clone ID: LIB3272-012-P1-K1-H3
cgcctccaagagaagacagagaggtctcctcacaaccaccgtaatgggtcgtgtcattcgagctcaacgtaagggtgccggttcggtcttcaaggcccataccaaccaccggaagggtcccgcccgtttccgcagcctcgacttcggtgaacggaacggttacctcaaaggtgtcgtcaccgacgtcattcacgaccctggccgtggcgctccgttagcccgcgtcgttttccgccaccctttccgttacaagaaacagaaggaattgtttcgtcgccgccgagggtatgtacaccggacagttcgtgtattgtggtaagaaagctacccttatggtttgaaatgtgttgccccttagatctatccctgaaagagctgtcggttgcaacgttgagcaccatgttggtgacc

SEQ ID NO: 22491 - DNA, 144 bp, Gossypium hirsutum
  Clone ID: LIB3272-012-P1-K1-H4
tctttctattgctctccttagagtaaatctctctcgcatttctttgtatagatccatgggtgctcagcctccatgtcccgctcaaatcttacaattccataccaaccaatgcattttttctttccgtttccttatccttttctt

SEQ ID NO: 22492 - DNA, 269 bp, Gossypium hirsutum
  Clone ID: LIB3272-012-P1-K1-H5
gacaaaggcaacttgctacacgtgcataaagagagtcgtctctggcctattatgctgtggatctataagcctatatgagatttggaaacgagagctggagcgaactgttaactatgcttgtgcttgaaacaaataatcatcttgttgattcaagatctgctggatatgcggctcaagaatctgaacattgagattgcctagtagatgcagggtgatcaggatccaattcatcgaatctggatgctcatgatgatagaactcatggcgtt

SEQ ID NO: 22493 - DNA, 410 bp, Gossypium hirsutum
  Clone ID: LIB3272-012-P1-K1-H6
ccgcattttcgtaagtgagcgacgctgttcaagcttaaagagagaagggcatcatggtagactcgctgaagaagaacagcatggaagagaatttgattcccaaattgggagaacgaggagaaaagtaatcggcggctaagttgggctgctctcgttgaagatataaaaagggtgggttaccttgcagggcctatggtagccgtgactttatcacagtacctattgcaagttatatcaacgatgatggtgggtcatctgggtgagcttgctctctctagctctgccattgccatatctctcgccggagtcaccggttttagtcttcttctaggaatggcatgtgcattggaaacgctgtgtggacaagcttatggtgcacaacaataccgaaaattgggaatccataccta

SEQ ID NO: 22494 - DNA, 398 bp, Gossypium hirsutum
  Clone ID: LIB3272-012-P1-K1-H9
ccaaatcgttcgtctcttaattctggttggatatcgaagatgtcaggaagaggaaagggtggcaagggtcttggcaagggaggagctaagcgccaccgtaaggtcctccgcgacaacatccagggcatcacaaagccggcaattcgacgccttgcccgtaggggaggagtgaagcgtatcagcggcttaatctacgaggaaacccgtggagttctcaagatcttcttggagaacgtcattcgcgatgcggtaacatacaccgaacacgccaggagaaagacggtgactgccatggatgtggtttatgcactgaagaggcagggtaggactttgtatggatttggcggttagatgatttagggtctagattttaaaatagaggaaaaattgtaggactc

SEQ ID NO: 22495 - DNA, 362 bp, Gossypium hirsutum
  Clone ID: LIB3272-013-P1-K1-A1
gaagcattttataactgtccaaaacctgtcttttctttttcttttgtttatggtggcttttaaaattgctagagtgatacttcaaacttaaggatttgttagtgcaaagctgggatttgggtggatgggtctttcaagtcacaataattgagtgtgagatgaagctggcatagccatcattaatcacgcattcgaaagaggaatcactcatttagatacacccgacatgtgtggacccaaaactaaccaaattttggttggaaaggcattgaagcatttgccacgagagaaggtacagttggctacaaaattcagtgttgaaagcatgggtccaggtggtccagttatcaatggcactcctg

SEQ ID NO: 22496 - DNA, 390 bp, Gossypium hirsutum
  Clone ID: LIB3272-013-P1-K1-A11
gtcaatattgagagagagtgagaaagatgggagagacagacaaagacagggaacaggctgagcatggatggatctaccaactgattctgttgtttctccgcccatgcactgcctcttccctggctctgcctcctccatttttttcctccctctttttttatttaactttttcaccttatcccattttggaattattattatgactgtaatttagatccaggttcatgataggtaccttttaacaaggtaattgtggtgacttttgttgagccccaatggccccagctcttttttcttcattttctctctattcttttcaatccaagtatagagattattcgttttactggtaatggaaatttgcattttgattctccaaccatttccagg

SEQ ID NO: 22497 - DNA, 387 bp, Gossypium hirsutum
  Clone ID: LIB3272-013-P1-K1-A12
tcttgttactggtggtgctgggttcattggcactcatacagtggtacagctactcaatgaaggttttaaagtgtcaattattgacaatcttgataactctgttattgaggctgttgatagggttaaggaattagtgggtcctgagctctctaagaaactccagttcaacttgggtgatttgaggaacagggatgacttggataagcttttctctaagacaaagtttgatgctgtcatccattttgctggccttaaggctgttggggagagtgtcggtaaccctcgtcggtattttgacaataatttgattggcactatcaatctgtatgagatcatggccaaatataattgcaaaaagatggtattctcatcttccgcaactgtgta

SEQ ID NO: 22498 - DNA, 398 bp, Gossypium hirsutum
  Clone ID: LIB3272-013-P1-K1-A2
tgagaatccaatatacttgttcacttatcagaggatgggagctcatttcttctcgccggagcattttccttcattcactgagtattgtccgaagcctgcgtcaaccagaattacatccagacgatttaccctccgatgaggcacaatctactgaatcggtacaaacgagttcggatccaaacatccacttgcagacagcttagcatgagagtgagagaacatagttacgtgtatattgtattcttgtcagctctaaattattgaatggggagaagattgtactattggactttctgtatacatctaagcaaatatttcctttttgctaaaggaccttataatagattggtgttcatgggtttttgaccccaataattaggggtctctttctagggatt

SEQ ID NO: 22499 - DNA, 394 bp, Gossypium hirsutum
  Clone ID: LIB3272-013-P1-K1-A3
gcgtcgcgtgggttcatcgttggagtccaaaccaaggccatgccttcattcgcacatcaaagcactgggcgagtcttcccttgcctgcgttctttccccttccactcccgcccaagttcttcatgtttacgacactgttttacacggtttctccggtaagctttcccccacggacgccctcaatctccaaacgcttccccatattctcgccgttatgcccgaacaagtccggcgcctgcacaccacgcgctcttcttacttgcttggactgcaaaccactgacagcgccggccttttgaaagaatccgactttgggtcggatcttgtcatcggagtacttgacacgggtgtctggcccgaacgtcaaagcttcaacgaccgtgatttggggcct

SEQ ID NO: 22500 - DNA, 399 bp, Gossypium hirsutum
  Clone ID: LIB3272-013-P1-K1-A5
tagcagttcaattaaaagcaccaaattcctcaaaatgattcgcccaaaaccctaatttgaaaccgtctcccttttattttacctatcagaaatgattcatggtagcgatgatgatgcagcagccgcagcatgcgacaccgccgaatcctcctcttccttccgactcttcacttagatcccctacctcaactcccactcaatcccctctccctctccgcccacgccagccccttgagcatgtcgcggttccaatctccgccgctcatccttccggtgagcctctcgtaaccatggggaccgccgcactttcactcgccagagttaggctatccgatatttccccctatgatggtgccccttctggttcctatgtgagggccgaggaggctttttcgggtt

SEQ ID NO: 22501 - DNA, 387 bp, Gossypium hirsutum
  Clone ID: LIB3272-013-P1-K1-A6
cttgcattaagtctcaaagatatcactgcaagaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaaaagcccaccctcggcacctgaacagccaggcacttgccccagagatgcactgaaactaggcgtttgtgctgatttgttgggctcagtgcgcgttgttgttggaccgtcgaggaccaaatgctgctctctcatttcgggtttggctgatctcgatgctgctgtttgcctttgcactgctattaaagctaatgtgttgggggttaacctaaacg

SEQ ID NO: 22502 - DNA, 379 bp, Gossypium hirsutum
  Clone ID: LIB3272-013-P1-K1-A7
gaagcattttataactgtccaaaacctgtcttttctttttcttttttttttgtcaagttcaaaatgtgtagggttaattcgacaagtatagcatttcttagtgttttgctgttttgtttttcgagctttgaggtgacgtatagtgctagggaaggcaaacagtggaggaagcagagcatagctggtggtttccgccgtctaatggcgaagggaggaagctctgacgtcgtagccgacgccactaccacctttaatgtgttggactacggtgccaaaggtgatggacgcacagatgactccaaggcattcgaagcagcatgggctgatgcttgtaaagttgaggcatcaacagtgatggttccatcgggttcaatattcc

SEQ ID NO: 22503 - DNA, 372 bp, Gossypium hirsutum
  Clone ID: LIB3272-013-P1-K1-A8
gccccacgcgtgcgggataaaacccagaggattccaaccctatggctttcatatttttcagcacagtatgagaaactaaggcgagcatcttatgaacggggttgtttcagggtagacatccacaacattccttttggattgatgcacgaaatgaagcatgttgtgcgatcattgcttgaccttcccatccaaatcatatcaaacaactgtcctataatttgccggagatggtattgggctcccagtactaaaaaccctctctatgaagctttgggtgtgtattatatagcactgctcccatgctgttcatacattaagctctcagttggatgcctcttcttcacaaagagacacagttgcgatgtatgctaa

SEQ ID NO: 22504 - DNA, 379 bp, Gossypium hirsutum
  Clone ID: LIB3272-013-P1-K1-A9
gaagcattttataactgtccaaaacctgtcttttctttttcttttttttttgtcaagttcaaaatgtgtagggttaattcgacaagtatagcatttcttagtgttttgctgttttgtttttcgagctttgaggtgacgtatagtgctagggaaggcaaacagtggaggaagcagagcatagctggtggtttccgccgtctaatggcgaagggaggaagctctgacgtcgtagccgacgccactaccacctttaatgtgttggactacggtgccaaaggtgatggacgcacagatgactccaaggcattcgaagcagcatgggctgatgcttgtaaagttgaggcatcaacagggatggttccatcgggttcaatattcc

SEQ ID NO: 22505 - DNA, 396 bp, Gossypium hirsutum
  Clone ID: LIB3272-013-P1-K1-B1
acgcgcccactcgtacggatctctttgacactctattttaatttatgtcacctgtcacgggggctagtgatgctggcgctgatgatgatgatgacaaggcaggctataggaatgaaccttatgacctacgatccaaattcctgattttggtcaaggttctgcagcttgattctagtgcttgtagggacggccgttggcggtgtgtcaccctatactataaagtggaaccggcgtttcttggtgctgggaacacaactcgccggtggggttattttttggacagccacgatacatgtcttgagcgatgcgaatgaaacttttgctgacttgacgagtagagaacaccctttcggctttatggtggcatgcgctggatatatgtggactatgctagct

SEQ ID NO: 22506 - DNA, 318 bp, Gossypium hirsutum
  Clone ID: LIB3272-013-P1-K1-B10
caactgtcctgtcgcttgttcttcttttgcaacttctcgttgcgttgagttgagttgggtttttttttttcttgattaaatgaaccaatgaaggggtaaaaagaggggccaaaccatgttttgcttaattcttaaaggtggttcttttttggttttggttacctcattgggttcggctcttaattctgatgggctttctcttcttgctctcaaggcagctggggaatctgatccaactcgatgtcttgaaaggtggtcccagtctgatgccaccccatgtcactggttaggaatcggttgtactcggaaaccagtcac

SEQ ID NO: 22507 - DNA, 391 bp, Gossypium hirsutum
  Clone ID: LIB3272-013-P1-K1-B11
cactgctgttggatatggcacagagaaaggtaaagactattggattgtaaagaactcatggggaagcagctggggagaagcaggctatctcaggatggcaaggaatgtggccaataccgtaactggcaaatgtgggatcgcgatggaagcctcttatccgatcaaaacaggtgaaaatccccccaatcccggaccgtctccaccatctcctataaaacctccgaccgtgtgcgatagttattattcctgtcccgagagcaatacctgctgctgcatatacgagtactataactactgctttgcttggggatgctgcccactcgaggctgccacttgctgcgaagatcgctacagctgctgccctcatgactaccctgtgtgcaacatacat

SEQ ID NO: 22508 - DNA, 369 bp, Gossypium hirsutum
  Clone ID: LIB3272-013-P1-K1-B12
acggcatatacaatttagacaacagttgtgtctcacatcctcgatgaatgcggtcaaatccttgccaagcctttcttttatcttactaaccctttctagctgaccccatgcagccacatttgatataagaatcaactgcccttacaccgcttggtctgacgtatcttcgtgtggtgtcttgagacttgaccaacgtgaagcatgatatatcactgtaacctctgggaccacacaagcccgcatttgtgctcgaaccaaatgcggtttcgttgcctacgataaaggcttatgctagacaagctaccgcggtggagctctcgtatggtggggatacggttcaattcccaacacactagtcgaatacgcagt

SEQ ID NO: 22509 - DNA, 383 bp, Gossypium hirsutum
  Clone ID: LIB3272-013-P1-K1-B3
gcagtctctcccgctccttctcgctgcgatttcgtcttcaagatctcagttctcaaatcgtagcgctcttttctatcaagccatggctctgatcttgcatgcaggaaaaacaaacaaaaatgcctttaaggcactcattgctgcagaatatagtggtgtgcaggtcaaaatggttgagaattttgagatgggtgtgtcaaataagactcctgagttcatcaagatgaaccctttggggaaggttcctgtgttggaaacacctgagggtccggtatttgagagcaatgccattgctcgttatgttgctcgctcaaaggttaacaaccctatatgtggctctacattgattgattatggtcatatcgagcaatggattgattttg

SEQ ID NO: 22510 - DNA, 383 bp, Gossypium hirsutum
  Clone ID: LIB3272-013-P1-K1-B4
gacggggaacaaaaacaaacaaactatgaccatgggtgctgcagacaagagggaggaagtgattcaagcatggtacatggatgatagtgatgaagatcagaggcttccccatcaccgtgaacctaaggaatatgtatccttggataaactttctgagcttggagtactcagctggcgattggatgctgataactatgaaaatgatgaagagttgaagaaaattcgtgaagaacgaggttactcctacatggacttctgtgaggtttgccctgagaagcttccaaattatgaggagaagataaaaaatttctttgaagaacatcttcatactgatgaggagatccgttactgtgtggcaggaagtggttattttgatgtacggg

SEQ ID NO: 22511 - DNA, 396 bp, Gossypium hirsutum
  Clone ID: LIB3272-013-P1-K1-B6
cagctagaaaaattagagaaactaaaagaaagaaagaaatgggaagctcgtcgaaggaggagacggcgaccgacggcgatacgtcgagcggagatacccctccttccaattccaatctcttctctgagggtgaacgtgtcctcgcctatcacggccctcgtatctacgaagccaaggttcaaaaagcggagcttcggaagaaagaatggaaatactttgttcattaccttggttggaataaaaattgggacgaatgggtaggtgccgatcggctgatgaagctgactgaagagaatgtcatgaagcagcaagcccttgacaaaaaacagggtgttgataaaagttcaaagtctggacgatcaagtcagtccaagccaaaaagctctgctgatgcaa

SEQ ID NO: 22512 - DNA, 390 bp, Gossypium hirsutum
  Clone ID: LIB3272-013-P1-K1-B7
gtacagtatatacatcccagttcagttcagttcaattctctccgattctatgctccccagtcaagaagaacaagaagatggagagaactctaacccactcattaatcgctgttgtaatctcttcctttgtcgccattcgatcctacagaaggaagtctctcgatttatctggagctcttgccggatttctcgtcatgactattcatttcgttgccggatacaggttcggggcaatgttacttgtctttttcttcacttcatcgatgcttaccaaagttggagaagacaagaagcggcgagttgatgctgattttaaggaaggtggacaaagaaactggatacaagttttatacaatagtggtattgcagcagttttgtctgttcttattg

SEQ ID NO: 22513 - DNA, 151 bp, Gossypium hirsutum
  Clone ID: LIB3272-013-P1-K1-B8
attaagtctcaaagatatcactgcaagaaaaaaaaaaaaccagacatggcttccaacactgttgcatccgctgctcttcttcttaccttgaactggttgttcttcactttggttagctctacctacgtgccttgcccaccaccaccaagga

SEQ ID NO: 22514 - DNA, 392 bp, Gossypium hirsutum
  Clone ID: LIB3272-013-P1-K1-B9
ctcttttccttgtcaccaaaaaacatctttctggtcaattcaatcctccttttttctattcaaccataatgtcttgcttcattagcaaatacgccgatgagttggctaaaaacgctgcttacattggcacccctggaaagggtatccttgctgctgatgaatccaccggcaccattggcaagcgtctttcaagcattaatgtagaaaatattgaagaaaacaggcgtgctctccgtgagctcctcttcactgctccaggagctcttcagtacctcagtggtgttattctcttcgaggaaaccctttatcaaaaaaccgcttcgggcaagcccttcgttgatgttttgaatgaaggtggtgtcctccctggcatcaaggtcgacaagggtacc

SEQ ID NO: 22515 - DNA, 398 bp, Gossypium hirsutum
  Clone ID: LIB3272-013-P1-K1-C1
atggggtgcctgttatcgacgccagaggttgcaggaggagctcgaagaaggccgagaaatattggtgaagttgtagtttttgttcctggactgaaaactcctaggccccttgatttcgcacagccacttggtgatggactatccaagagcttggttgaacgtctatcggcgttgagaacacgtatagaggtcatggcaggtcaagaagcacctatgactactaaaccgagaagaacatccacacaacacggtggttcaacgttgactgatttgcaacatgctctcgaggattatctgccggtcttgttggggctagttgaaaatggtaactggctaaaacataacttgcggttctgttggataaatcaggaagatgatgtggaggaaactaccatgtc

SEQ ID NO: 22516 - DNA, 387 bp, Gossypium hirsutum
  Clone ID: LIB3272-013-P1-K1-C10
catagatataataagcacctccccgtaagcaaaccacaaaggaaagcttggagagagacccaaaaacaatgtctaaggaagttagtgaagaaggacagggtcgtaaggactatgtggaccctccaccggcacctctgattgacatggctgaactcaagtcatggtctttttacagagccctcatagctgagttcatagccactctcctcttcctctatgtcactgttgctactgtaattggtcacaagaaacaacaagatgcatgtgatggtgttggtctcttgggtattgcatgggctttcggtggcatgatctttatccttgtttactgcactgccggtatctcaggtggacacattaaccctgcggtgacttttgggttgtttt

SEQ ID NO: 22517 - DNA, 385 bp, Gossypium hirsutum
  Clone ID: LIB3272-013-P1-K1-C11
ttttgctctcagatatggaaactcaaccttcttccgataatggttatgccgggaacaacactagttctgaagaaaatttaaaaaggcagaaagaaattgatgcatggctgccaattacatcatcaaggaatgcgaaatggtggtattcagctttccacaatgtgacagcaatggttggagctggtgtcctcagtctcccctatgcattatcagaacttgggtggggacctggtgtggctatcctagtcctatcatggatcataactctctatactctatggcaaatggtcgagatgcacgagatggttcccggaaaacgtttcgaccgataccatgaactcggccaatacgcctttggcgaaaaactcggtctctacattgtggt

SEQ ID NO: 22518 - DNA, 380 bp, Gossypium hirsutum
  Clone ID: LIB3272-013-P1-K1-C2
aaactgaagctgccaaagctcgagaattcaaaccgaaacaaaaaagaaaaagagctcttaaacccccaaaatacctaaaaagaaatggctctgaaattcaaccccatcacttttcaatctcagaaactcccttcatttgctcttccaccaatggctggccttaggtctcccaagtttttcatggcctctactcttcgttctggttccaaagaggtcgatctcaagaagcctttcatgcctcctagcgaggtgcatgttcaggtcacacactcgatgccccctcagaagattgagatcttcaaatctttggaggactgggctgagaacaacattctaacttacctcaaaccagttgagaaatgttggcaaccccaagattt

SEQ ID NO: 22519 - DNA, 393 bp, Gossypium hirsutum
  Clone ID: LIB3272-013-P1-K1-C3
cgagctttctgttttggctaaaccaagactatagcttgttccatactgttggtgggtctgtttgtttccaaagataacctcactgcattttctctgtttgcttttttccaatggatgttttctagcttcttttcttttggagttaacataatagttaatacagtacggtggaagtgagtgaggcccttacaattgatttacagaatggaactgtgcttcggttggttcttacttgtggcttcgattcctgcgatttttgctcaagatattagtcatggatcgattgtagttgatggaactatgactgttgctcaaactgatgataacttcgtctgtgctacgatcgactggtggcctcatgataagtgtaattacgaccagtgtccatggcac

SEQ ID NO: 22520 - DNA, 435 bp, Gossypium hirsutum
  Clone ID: LIB3272-013-P1-K1-C4
gctggcacgcaccgggccccagattcccggttcgacgccacgccccccgcgggcgtgggcgtatacatgaggaaaatcatgggtgccaaagttctcttcttgtttgctttgctttccttttcagctgtgtcggcatttgcacaggatgaggaagaccaaggtcttgttatgaacttctacaaggattcttgtcctcaggctgaagacattatcaaggagcaagttaggctactgtacaagcgacacaaaaacactgttttttcttggctgagaaacattgtccatgactgtgctgtccagtcatgtgatgcttcactgctgctggactccacatgaaggatcttgtctgagaaggagacagacaggagctctggcctaaggaatttcaggtacattgagaccatcatagaagctgtacaaagggaatgtcctgga

SEQ ID NO: 22521 - DNA, 397 bp, Gossypium hirsutum
  Clone ID: LIB3272-013-P1-K1-C5
agtttgaaattgtatctttggaagcatggacttcatagctactatcctgtttgtagctcgtgtgatctcctcccccaaagctttagacccttgcagatctaaagcagatgactggctccttttgctcatcccaatctatggcaaatgttcaccattcaacccacccaaacctgacttatggttcaacacagtcttgaacatggcatcataagacccaacaagggtcaagtgcttgtagagccttctatcccaaaacaccactggaggtcccattgctttacgccaacaagtactaaatattggcaactatgtgcgtcgagtaaagattggcactactgtcatgtcatgttcataggatgggacactaacaatgatgtgacttgcgtcccatgctccg

SEQ ID NO: 22522 - DNA, 388 bp, Gossypium hirsutum
  Clone ID: LIB3272-013-P1-K1-C6
gtttctctctcctctttctctctccagaaaaaaggaaaaaaaaaccctaaagagctattttacacccccaaacttcatggatgacgatgcgttgaatatgcgtaattggggttactacgaaccgtcgtttaaaggacatctcggtctgcagctaatgtcgagcatggttgaacgggatgcaaagtcttttattcccggccgtgatcccaatctcatgattactaccaataccacctttcaccagcgggaccccattgtttccgaggcacatatccccatgaattatgttagggatagttggattgctgacagagataagtttttcaacatgttccctgccaccactcctaattacgccgttctcccggaaacgtcggcagctcattca

SEQ ID NO: 22523 - DNA, 392 bp, Gossypium hirsutum
  Clone ID: LIB3272-013-P1-K1-C7
cggacgcgtgggttcgagggttataggattggctaccgcagaaccaaattgatcaatcgaagtttcatctctctttcttctatcctgcaaaccctatagaaatttcctcaaggtgtgcagtgattttacgagaatgtctcgggtctatgttgggaatttggatcctcgggtcactgagagggatctcgaagacgagtttaggatttttggcgttctccgcagtgtatgggtagctcgaaggcctcctgggtatgcgtttattgagtttgatgatcgcagggatgctattgatgcaattcgtgaactggatggaaaaaatggttggcgtgtggaactttctcataattcaaaaggtggtggaggccgtggtgggcgccgtggtgggggtgagg

SEQ ID NO: 22524 - DNA, 364 bp, Gossypium hirsutum
  Clone ID: LIB3272-013-P1-K1-C8
cagaatcagagtgtaaaaaaggaaggaaaaaaaggctaaaagaatgtttttgcgaatgatatcgcggccgttgttggctaaggtgaaggagacaacggggatcgtcggattagacgttgtacctaacgcaagggaagtccttatcggtctctacaacaagactctgaaggagatccaggccgtacctgaagacgagggttaccgtaaggccgttgagagcttcacgcgccaccgtctgaaggtttgccaagaggaagaagattgggaaatgattgagaagcgccttggatgtggccaggtcgaggagctcatcgaggaagcgcgtgacgagctcactcttatcggaaaaatgatcgagtgggat

SEQ ID NO: 22525 - DNA, 392 bp, Gossypium hirsutum
  Clone ID: LIB3272-013-P1-K1-C9
ttcactaatggcgattcccaaacgaaaccctattttcctgtctgtaatctttgtttcgctcctcgcaatcgcctccgctaaagtattcttcgaagaacgttttgatgagggatgggaaagtcggtgggtaaaatctgactggaaaaaggatgagaacatggctggggagtggaattacacttctggaaaatggaatggagatcctaatgacaaaggtattcaaactagtgaagactacaggttctatgctatttcagctgagttcccagaagtcaacaacaaagataagactctagtcttccaattttctgtcaagcatgagcaaaagcttgattgtggtggtggctacatgaagttgctcagcggtgacattgaccagaaaaaatttggtg

SEQ ID NO: 22526 - DNA, 399 bp, Gossypium hirsutum
  Clone ID: LIB3272-013-P1-K1-D1
cacggtttctctattattttcttgtcttacttatggccgtcgttaaggctttcattgcttcacttctcatctctcttctccttctccaacttgttgctgctgatcaactggtgacaagtgccagcaagcgcatgggaactgccccccctgcgaaaattgactgcggcggggcttgtgcggcgaggtgccgattatcatcgaggccacacctatgcaagagggcatgcgggtcatgttgcgcacgctgcatctgtgttccaccggggacagccggtaaccaagaaatgtgtccttgctatgctagcttgaccacccacggtggccgacgcaagtgcccttgagtgttaatcgacaatcgggacgaatctttctcttttgatgctgatatgaaattaataa

SEQ ID NO: 22527 - DNA, 389 bp, Gossypium hirsutum
  Clone ID: LIB3272-013-P1-K1-D10
cccacgcgtccgcccacgcgtccgcccaaattcccattttgaccatgcctaatgatgatataacacatcctacaccagatcttactggttatattactgaagggcagatctacattgatagacaacttcacaatcgacagatatacccaccaattaatgtactcccttcactctctcgattaatgaagagtgctattggtgaggggatgactcgtagagatcatgctgatgtgtccaaccagctctatgcaaattatgctatcggaaaagatgttcaagcaatgaaagctgtggttggagaggaagcactttcttctgaggatctgctttatctggagttcctagacaaatttgagagaaaattcgtgactcaaggtgcttatgatact

SEQ ID NO: 22528 - DNA, 374 bp, Gossypium hirsutum
  Clone ID: LIB3272-013-P1-K1-D11
acccgttctccaagggtttctggtagtgatctatgtctgctgaatcttcctaatggcctgtaacgatgaaaacgagcctttgctatcaggattagcgactccaagaactcaaaagactaatggggatggaccaaagaagagaaggtttcgacgtgttaggagtgctccttttgcagattttgttccgactgatggtaatagagaagctgcagttccacgttccgggtccattttcgggagacttaatccgagtcttaagaaggtagctctatttttgacgttatacatgggtttaggcaccatttgcttttatacaaccaggacccaaatcaaaggggacaaaacaaatggaattcttgatgctctttattttt

SEQ ID NO: 22529 - DNA, 350 bp, Gossypium hirsutum
  Clone ID: LIB3272-013-P1-K1-D12
aatcttaaaaaggaataaaaaatccttgaataaaattatcaagtaataagttttaagtataacaaaatttgagaaacaccaaaggaaaattcataaaagagcatccagcataagttcattttaggtgccaaacttaaaaactacaaaatctaagacacttgacatgctccaaaaatcaaatagatgactatcataacagtcatcatcggctttaagccactggcggaagttcaatctcggtcggcacgggtgcttccaccttgataacttcatcatccttgggagggtggatggtgacaagatccggaagtggagttgttgggccttgcttaccctttggatcccagtca

SEQ ID NO: 22530 - DNA, 399 bp, Gossypium hirsutum
  Clone ID: LIB3272-013-P1-K1-D2
gccgccatcacccaaaaaatccccccaaaaggaactaggcttgagccatgctttcttgcaatgcgcagaccttatccttccatggctaacccctcaagaactggctaatgtctccctcacctgcacaacccttcaccgagcagcccagtccatcactctctaccgctcccttgacgcttcaagatcctttgaaaactttcccatcccatttcacaacaccgtcgatcaatacccttatgcctatttcttctataccccttctcaaataatcccttcttcttctttttctttaaaccgccaattttggggacccaactcgccgcaaactctggtccttcccgagtcgggcttgttggatgctgaaatgggttgtgctcttgactcaatggatccactcgg

SEQ ID NO: 22531 - DNA, 381 bp, Gossypium hirsutum
  Clone ID: LIB3272-013-P1-K1-D3
cggacgcgtgggttctcatactaagtttctactcgatttccgagatttagagaactaacaaaaaaccacttccttttaggattatcccatttggttttttatgatcctctcttttagagtcgaaagctactccaagaaacagcactgtgttccagtttgggggcgccaccagaattgatctgctcactcagttgcaatgacaatatttagaggtggcattggcagatttagtggtggagttagagctgcagttttcttcttgtggatcgttatcttgttcttttcccagttaggtttgcattttgctgttcataataataacagtaataaagacgccagtaccagcagtggtagtcatcagtcattcacgtttcatccccc

SEQ ID NO: 22532 - DNA, 396 bp, Gossypium hirsutum
  Clone ID: LIB3272-013-P1-K1-D4
gtgaagcctataccaaacttatcaaaagatggcttgggtgctgcatttcctttcttttatatagaacctaaaaagtatgagtcagttctgagaaagtacttccctgaggaaaagggtccaataaccaacattgaccccataggaaattctcctgttattgttgggaaagattctctcaaaaaaattgctccgacttggatgaatgtgtcattggcaatgaagaaagatcctgaaacagataaagcttttggttgggtgctagaaatgtatgcttatgctgtttcctctgccttgcatggtgtgggtaacatcctgtacaaagatttcatgatccaacctccttgggatacagaaataggtaacaagttcatcattcattacacatatggatgcgac

SEQ ID NO: 22533 - DNA, 345 bp, Gossypium hirsutum
  Clone ID: LIB3272-013-P1-K1-D5
ggaaaacaccattttggtttcagtttgaggcaaccattttataatttgactggccagagagttggaaccatgtttttagtaaggcttgcacaaccatctactgcgtcggtacaaatacgatctctattcatactgatagcagtgatagcccggcatgggcattccattgtttggtctgctaatcataacctgttatgtatggatcttacagaagaagagctacaaaaagcaccgcttgttctctacatagagcgatacattattagcttggaatctgggaaggtcgtagcctacaagatagtgttcttgcaaatagagattacttgcaaattcaaggcagatcac

SEQ ID NO: 22534 - DNA, 395 bp, Gossypium hirsutum
  Clone ID: LIB3272-013-P1-K1-D6
gaaacttacaacttcaccatgaacaaaagcaagctccagctgcaactttgtgcagggatatttactttaagcatcctctccaatggtgcttatggtagtgacaaaatctttgacataactcacaaaatcacttctcagttgccaacttttggatcacagaagggtcttggtcaattcatttggcttctttccagcatcaaaaatgggtccacagtgaatgtgtcggagttcaaattgggaacccacactggcactcacgttgatgctcctagtcacttctttcagaagtactatgaacaaggatttgatgtttcaacccttagccttcaaactcttaatggtcctgttctagtagttgatgttcaaagaaataagaacattactgctgaagttat

SEQ ID NO: 22535 - DNA, 357 bp, Gossypium hirsutum
  Clone ID: LIB3272-013-P1-K1-D7
attttattgtgcttctctctcagatcttgaaaatgtatacatcaatgaagaagatccacaaagataaggatgttgaaccaacagaatttgaggaatcagttgcccaggcattctttgatttggagaataccaaccaggatctgaaaagtgacctcaaggatctttacattaattcagcagtccaaattgatgtgtctgggagccggaaagctgttgttatccatgtcccctaccgattgaggaaagctttccgcatggttcatgttcagcttgtgagggagcttgaaaagaagttcagtggaaaggatgtgattcttattgccacccggaggatattgaggcccccaaagaaaggtt

SEQ ID NO: 22536 - DNA, 392 bp, Gossypium hirsutum
  Clone ID: LIB3272-013-P1-K1-D8
ctttattttctctgttcatcagtttctttttatctcttcgaattttcattacagaccctgatcctaaactctcaatcatgtcttccaagcaaggtggcaaagcaaagcctttgaagcaacctaaatctgagaagaaagaatatgacgagcatgatttggctaacattcagaaaaagaaagaagaagagaaggcccttagagagctgagagcaaaggcatcacaaaagggatcatttggtggttctggtcttaagaagagtggcaagaaatgaggttcttaaaaacctgagctaaaccgaacttattgagtcatgtcttgggattaaaacatctattatgctgatgtctcttgtttcaattgtgatagttgggatgatttgatggtctagttt

SEQ ID NO: 22537 - DNA, 389 bp, Gossypium hirsutum
  Clone ID: LIB3272-013-P1-K1-E1
attttcctctcctttttcgtgtttttactcttaattttgctttttgttttggattgtctgttctgaatcagagaaaaccctacctttttttttctcttttatttctttgaattggaacgatcaaaagaaggaatgggttctgaaggatcgagggttgttgtgccaaggaatttcagattgcttgaagagcttgagagaggtgaaaagggaattggggatggaactgttagttatggaatggatgatgctgatgatatttacatgcagtcatggactgggactattattggcccgcctaacactgttcatgagggacgcatctaccagttgaaactattctgtggcctggattatccagataatccaccaagtgtgaggtttcaaacccg

SEQ ID NO: 22538 - DNA, 390 bp, Gossypium hirsutum
  Clone ID: LIB3272-013-P1-K1-E10
aagaagctcaagtatgctgaagatgtttcttctgccatagtatttggaagagagcttgtgaactcaccagccaatgtacttacccccgctgcactagcagaagaggcttcgaaaattgcttcctcgtacagcgatgttatatctgcaaacatcttgaccgcagagcaatgcaaggagctgaagatgggatcttacctgggagttgctgcagcatctgataatcccccttatttcatccatttgtgctacaaacccctgagtggacctattaaagccaagttagcattagttggaaaaggattgacttttgacagtggtggctacaatatcaagactggacctggttgctcaattgatgttatgaagatagacatgggaggttctgcagca

SEQ ID NO: 22539 - DNA, 389 bp, Gossypium hirsutum
  Clone ID: LIB3272-013-P1-K1-E11
atcacctggtccgataccaatggttgggttacaggactcttcagctgtctttccagttgaaactgatgattcgttaactacggtgggtgaggaaatatgggatccaaagctgaatagttgcagagtttcatcccaagcagaccaattggcttcattcactcagcaagatccatgcagtcttaattctggtggggtaagggatttgtctgatgacagcaacaatcaaagtgggatatatagtagctgtcttaacattgatgttagcaatggttgcagcactgtgattgatccttttgtttccagtgccattctagatgagttttgctcattgaaagatgctgattttcaaaacccttcatattgtttggtcgggaactttggttcttgtc

SEQ ID NO: 22540 - DNA, 371 bp, Gossypium hirsutum
  Clone ID: LIB3272-013-P1-K1-E12
tgcaattaaaatcccagaattacttaaacaacaatggctacctatgaaggtaaagttttcactgaacaacaagaagctttggtggtcaagtcatggactgttatgaagaagaatgcacctgaattgggtcttaaattcttcttgaagatatttgagattgcaccatcagccaagaaactattctcattcttgagagactcaaatgttccattggagcaaaacacatagctgaagccccctgccctgtctgtctttgtcatgacatgtgaatctgcagtacaactgcgtaaagcacagcaaagttacagtgagggaatgagatttgaagaaattaggagctacccatcttaagtatggagcaggtgatgaac

SEQ ID NO: 22541 - DNA, 396 bp, Gossypium hirsutum
  Clone ID: LIB3272-013-P1-K1-E2
gcaagccattaaggttttgagaaaagatcaaaatggattcaaaaagatcagcttccacagccctccttttagccctcaacattctcttcttttccctagtcagtgctaattgtggatcttgttcttcttctggctctaacccaaggccaactcccacccctactccatctgcacgaggtaggtgccctagggatgccctcaaattaggtgtatgtgccaatgtgcttaacttagtcaatgtcaccgttggttcacccccggtgatgccatgttgttcccttctcaacggtcttgtggacctcgaagccgctgcttgcctttgcaccgctatcagagctaacatcttaggcatcaaccttaacatcccagtttcccttagcttgcttctcaacgttt

SEQ ID NO: 22542 - DNA, 372 bp, Gossypium hirsutum
  Clone ID: LIB3272-013-P1-K1-E3
gagagactgatgcatttatgggtgcccgcaaagaccttgaaatggaaattggcgctgagaagaccttgctagcacaaaagatgatgatatacaagtgctatcgttgcagcaagcgtggtgatacggccactaacatgcttgaattgatgataaaatctccgaggccaacccgagctaaaccgacccttgttgcttacgctgtgctggacgggaccgattgtgtcatgctcactgctgagagtgctgctggagcctctccagagctcgccgtgaagatcatggctcgtatttgtattgagagccaatcttgcattggctatcgagcattgctcatagaactgatccgatcgactgcacttgaaatgagttcac

SEQ ID NO: 22543 - DNA, 397 bp, Gossypium hirsutum
  Clone ID: LIB3272-013-P1-K1-E4
agcgagagtttcttcttcttcttcttcttcttcttcgctcctgtagaaagtttatttgctcttcaacaataaaaaaaataaaaaaagctttcctacagcagcgctcaagtttttatcaatccagagtttgaatttgaattgaacaaatcaatattaagataagagaaatggctcgctctctctccaacgctaagcttttctctacttttgttgtcgatggaatctctaacgttatctccagacgaggatatgcggcggcatcacaaggaattgtgtcgagtggaataagaggaggagcgggaaggagcgctgctacggtggccaagaaaacaggggaagagatgtctcgcggagctaaagagaaggtttcgtgggttcccgaccctgttaccggatg

SEQ ID NO: 22544 - DNA, 317 bp, Gossypium hirsutum
  Clone ID: LIB3272-013-P1-K1-E5
cggccctcataaatcattatcctttcgaaactcatggttaaagctttgattcccaggtttttgattttaaaaaatggatcaggcaagaggccgtgcaatagcgatggcagagggggcggcggcgggcctctgcttgtagctgagtcacttcaagtggcttcaagcaccaacgattactgttgggggaaccgttggtggggcctttaacgtgggtgttgggacaaaaaatatcctttttagggctggtgttccccttcgatccaaatccagcccatcattcgccattgtgggagtggtaaccaggggggttgccattt

SEQ ID NO: 22545 - DNA, 396 bp, Gossypium hirsutum
  Clone ID: LIB3272-013-P1-K1-E6
gagatttgaagctatctttttcgccatcttgctgtttgtggcaaccatggaagctgatggaaaacgaatgaccctggagaaggagccagagccaagtaatcatcagctgggtcgaaaggtcgacgtcggagctaaagatggtatagatctaaccgccgtcgacggtgccggagaagatgactccgatgtggcccttttggcttcccagaacaaagttacgacagaatcacgtcaccatttcttcccaaacgaaagcaacccttatagacacaatagaccttgaaactgatgatcaccttgcaaattgctaagcaatttggtttgagctttaccaaataaaactggaaattaacatgttagaataacctaaaagcatatatgtatatgtatatgcat

SEQ ID NO: 22546 - DNA, 370 bp, Gossypium hirsutum
  Clone ID: LIB3272-013-P1-K1-E7
gctcagtgctcacattttctcgcattttatttaattgtctggtctgccctcaaagcccaaaaccctaacaatggcagccgtcgccgaccgtcctgtggtttcggtgcaaaccatatagtccgatatggctaccgacgctacgcctactgatcctctcgctgatgtcatgaaagcctcgatccgaccagacatcgtcaccttcgtccacgataacatttccaagaacagccggcagccttacgctgtctccaagcgtgctggtcaccagacctcacctgaatgcgtggggaactggccgagccgtctaccgtatcccgcgtgttgctggtggtggctctcaccgtgctggccaaggagcttttgggaacat

SEQ ID NO: 22547 - DNA, 386 bp, Gossypium hirsutum
  Clone ID: LIB3272-013-P1-K1-E9
gcttcaaccaaatcgaagctagggttttgcagggagctttaaaacgacaatgacgaccgtcgttcccacctccgaagaagatcccgtcctccccgtcgtccgattcacggccgacctctcttgggctgatgccggtcctgaggttgcggaaccgctagtgacgaggctttgtatggaagcgcaagagtgtatggtgatgggaagatggttggatttggcttctttaatgcttacttctgctgagttggtctttcccaaggtctctgataaagatctcgagtgtatcttcactgttatctgcaatctagcctcaaagctcgaaaatccagatgatgaacttgagatggcaaagctcatatctacaaaaatcagtcaacaaccaaatg

SEQ ID NO: 22548 - DNA, 239 bp, Gossypium hirsutum
  Clone ID: LIB3272-013-P1-K1-F1
gcaagccaaagcgtccagattcttacaggtagacgccggtacctgttgcttccttagcatgtcattggcatagctgtgttttggagcagatgtgtgagcatcaatttatgtacttggtttggtgttttatagtactttgcaactttagttgtatttggcacccttatcattgtggaaagaagacttgggagatgaaatgaatttggaactggttgtgattgttggtggattgtgaatgt

SEQ ID NO: 22549 - DNA, 390 bp, Gossypium hirsutum
  Clone ID: LIB3272-013-P1-K1-F11
gcattcttgaaatcaaaggcagagtcagacttgaagcattcgagaagttcctccaagagcttccattgtctcggagtcgtgctgttatggttattcatatcgtttgcaaggagggatcgtccgagagcgaacggcagagcctggtcgagacggctgattcatatatttcagacgggagagctggtcttgctgagcctgcttgcggggtcgaactttattgttgcccacccgatgcaaaaacacttgaaatgctcaccaaggtactttcaaaggaccaaattcaagctcttaatgcgttagataatggtctaattggtgttgttgtatggagaagaactcaattaacatcaccgaactcaacttcacaccataaacacatctcgaaaaagc

SEQ ID NO: 22550 - DNA, 396 bp, Gossypium hirsutum
  Clone ID: LIB3272-013-P1-K1-F2
cttttggctatttaaaaagtccaccaaacaggtctttccttcacccccaccttctctccctctcttcttaggtctgctgtatcttagttcttgattaattagccaatcacagcagccatgtctctcctcaatgatctcatcaacctcaacctcagcgacaccactgaaaagatcatagccgaatacatatggatcggtggatctggtatggatctgagaagcaaagcaaggactttgcctggaccagtgacggacccttcaaaactcccgaagtggaactacgatggttccagtaccaatcaagcacctggagatgacagtgaggtcattctttatcctcaagctatattcaaggatccatttagaaaaggaaacaacatcttggtgatgtgcgat

SEQ ID NO: 22551 - DNA, 396 bp, Gossypium hirsutum
  Clone ID: LIB3272-013-P1-K1-F3
attatcttaaagcctgccatataatcatataaccaggctccgtcgtggtactcttcggccaccacaatgccgaaaatcgccttgggaacaagccaagaggctgctcagcctgactgcatcaaagcccttgtggtcgagtttatcaccactttcctcttcgtattcgttggagtaggagctgccatggccgccgatgagtcgggggcaaatgcgctggtgggattgtttgctgtggcggtggctcatgcccttgtcgtcggcgttatgatatcggccggacacatatcaggcggccatcttaacccagccgtcacgcttgggttgctattcggtggtcacatcacggtggtccgtgcgatcctctactggatcgatcagttgttggcatcttcagct

SEQ ID NO: 22552 - DNA, 405 bp, Gossypium hirsutum
  Clone ID: LIB3272-013-P1-K1-F4
gccatcgcagtccagcttgtcctttgtatctcatagatgtttatcttctggcgtcaacttcttaaatgtttatacccactgctaggtttcattacctgaaaggcggagcatagtctgggcccaagaaaaaagaattccgcctttcttctgttggccgcgccagctgattagatgttacaattatggttggactcgtccccaaaccgtattcatttgcttttgccctttctgttgtttgtttgttggaccagattcttagccgtgcgcttggaggaaaaacagggcgggccgtttcgggttgggacattggagttacgacaattcatttatcatcgtcctcatcgaagttcttttgatcacttgagatccccaccactcttcccatcatatagtgccaccgagatg

SEQ ID NO: 22553 - DNA, 358 bp, Gossypium hirsutum
  Clone ID: LIB3272-013-P1-K1-F5
gatataataagcacctgcccgtaagcaaaccacaaaggaaagcttggagagagacccaaaaacaatgtctaaggaaggcagtgaagaacgacagggtcgtacggactttgtggaccctgcaccgacacctttgattgacatggctgtactcacgcaatgggctttttacagagccctcatagctgagttcatagccactctcctgttactatatgtcactgttgctactgttattggtcacaagaaacaacaagatgcatgtgatggtgcaagtctattgggtattgcaaggactttccgtggcatgaactttatccttgtttactgcactgtcgtcctcttaagtgaacacattaac

SEQ ID NO: 22554 - DNA, 399 bp, Gossypium hirsutum
  Clone ID: LIB3272-013-P1-K1-F6
aaagatgtcaactgggaagaaagctctggtggccttaatttatggaaatggagtttgactggtattggagccatctgctcttttggtgttgctgctgctaccttttgcatcatcatttttggaactcaacaaaggcacaaacaacaacaactgaaccaaaaactgttgttccaacgttacagtgatgacaagaggatgaagcaagtggttcatcacacaaccaaactcaatgaagcaatttcagtggtgagaggagtaccaatcaccagagctcaaataacattcgggggttactatgatggtatttaaagcaatattgcctggagaaatctggaccactcgtctgctgttattctccaagtgtcaaggatttactatgccagttctatacaagaattt

SEQ ID NO: 22555 - DNA, 387 bp, Gossypium hirsutum
  Clone ID: LIB3272-013-P1-K1-F7
gacaaactgaagatcccatacccctcaatcccttttctcaaccgctccaaatcgccgccatggccggtggccggcgtcacgcgacggagttcccggtctgcgcagttgaagcatattcagagggcctgaacttttggaaggggagtcgaggagaaaacaagacctttggcccctctcgagccgaatccgacgacggcaaaggaccatcgccggccagtccaagggccgattcagatggagcaggtacacggcactggtgcagatgggacgtgcggcgatgggacaagggcggtggcaacaggtcctagcatgcggcgccctagggttaggttttttaatttttgctgaaattgttttaagttaggccatggttggtttgggtctggg

SEQ ID NO: 22556 - DNA, 392 bp, Gossypium hirsutum
  Clone ID: LIB3272-013-P1-K1-F8
gaaaaaattgagtgtcagtttgaaagtgttcttcagatatggctatgaaacaagttgctaattctgctatcaaagcaattgccaattctgggtcatcctctcttcttaccagacaactccatgcttctccagggagcaaaaagattgttggggtgttttacaaggccaacgagtactttacgaagaatcccaactttgttggttgtgtggagggagccttggggttgcgcccatggctggaatcacaggggcatcagtatattgttaccgacgacaaagaaggaccggactgcgaacttgaaaagcatatccctgatctccatgtgctcatatcgaccccattccacccggcttacgttacggctgagaggatcaagaaagccaaaaacttg

SEQ ID NO: 22557 - DNA, 398 bp, Gossypium hirsutum
  Clone ID: LIB3272-013-P1-K1-G1
ccttcacccacttccagaatcaagcgtttaagggtttgtttcttcccgaatcgccaagtagaagcaagcatacaagaacgaggagtttggtataggcattaggtaccagattcactcaatttgtacagcctgtatttcagaggtgcataaatatcatccagactcaacaattggctaagaaacaatcgacattgaaatcgatttggcataccttagcttcctttcctgcatcaagctacctccgtcctccatcgatccacctgcggtctacctctggtcctccacccagttccagttccagaaaatcaagggtttgtttattcccgaatcgccaacaaattcgtatttaaggtgaaaaattatcaaatttgacaggatgagcatgaggtagcagatac

SEQ ID NO: 22558 - DNA, 390 bp, Gossypium hirsutum
  Clone ID: LIB3272-013-P1-K1-G10
gcgaacatggcgataggagttaaggccttgcacttgtcctttgtgcctcatgccctcgcgattgccggcgctgttatggtattggtttggtgcattcacttcaggggtggattagcttgggaatcttctaacaaaaatctcatctttaatctccatcctgtattgatgttgattggcttcattatcttaggaggtgaagccattatgagctacaagtcattgccactgaagaaggaagttaagaaagtcatacatcttgtgctccatgccactgctctgattctaggcattattggaatctatacggcattcaagaatcataatgagagttcaatacctaatctctacagcgtgcattcttggcttgggattggaatcattaccctttat

SEQ ID NO: 22559 - DNA, 393 bp, Gossypium hirsutum
  Clone ID: LIB3272-013-P1-K1-G11
aagaattacccaaaactcaatcccatgatcctgtcccaccttcacatgatgagatggatcagttacaggaacgtaattgtagtagctccttttctcctgcttctctagatcctccatcctcaggtcagaagttcgtatctcccatggcaaaagtttgtatttgctgctccaaagaattacccaaaactcaatcccatgatcctgtgccaccttcacatgttgagatggatcagttacgggatcgtaattgtagcagctccctttctcctgcttctctagatcctacatcctcaggtcaaaagtttgtatctcccatagcaaaggaaaatcatgaccaggagagtctgcagagcaaccattctccgttacctagctctcatcaattcgcacatg

SEQ ID NO: 22560 - DNA, 364 bp, Gossypium hirsutum
  Clone ID: LIB3272-013-P1-K1-G12
ataatatcgtgtatcgtcacggagaaatctgcgcccttcacgtcttcacagctaaaagatgccggccggagaactccggtgtgcttcttcgatctcttggccgcagatttgtcaagcaacggacacccccatggaggaagacgaggcgtggctgtgggcgcaaattaaagccgaggcacgccgcgacgccgagtgggaaccggctctagatagctacctatactccacgatcctatctcactcctctatcgagcgctccctcgccttccaccttggcaacaagctgtgctgctccacgctactctgtacgcttctctacgaccttttgctcaacactttctgttgcgatccttaggttcgagcc

SEQ ID NO: 22561 - DNA, 199 bp, Gossypium hirsutum
  Clone ID: LIB3272-013-P1-K1-G2
attttgttttcccttttttttccccacacctttttttaaacccatttgctaaaaatgcactgggttcttccagtgttgcttgccgttatcggagttactgcactgctcgttgtaactccggtaagtgggtaccgttcattgccgtacttaaaacccaacagctccgacttaatgttcggaggctctaaaaaatttgggg

SEQ ID NO: 22562 - DNA, 300 bp, Gossypium hirsutum
  Clone ID: LIB3272-013-P1-K1-G3
atggcggctaccactgcaaatacatcattactcaagccttctcctttagcttcctcctccaaatcttcaatacctatttccaaatccgtcctccactttcgaacaatccctcgaaagctcacgccgccacgttccctctccgtttccagctctctttcacaatcaaattccacccccggatccaccgtcttcttcgtcgccccaacgaaggcccctacccatgatttcatttcccgttatgcccccgacgagcctcgaaaaggcgccgatatcctctttgaagcccctgaacgcgaaggg

SEQ ID NO: 22563 - DNA, 394 bp, Gossypium hirsutum
  Clone ID: LIB3272-013-P1-K1-G4
acggcataaattgttttctttgaactcaaagtcccctgtagcattagggccatgggcgtcgtgacttacaactatgactctacctgccctgtcgctcccgcctggcttttaagggcacttcgttcttgaagctgacaaggtctgatccatagctgcccctcatgcaatctagagtttggaggttgtatcttatgctggccctccatgtatcagctaacgatcaacttggctgtgagcactgcattccaatatatagatacatcatatgctccaggccgatgaaatcattctatgcttcattgacagctatactgcatgcaagactcatagtgacaggccaatacctaatctctacagcattcattctggggttgctattggaatcattaccctg

SEQ ID NO: 22564 - DNA, 394 bp, Gossypium hirsutum
  Clone ID: LIB3272-013-P1-K1-G5
gcggcgaacatggcgataggagttcaggccttgcacttgccctttgtgcctcatgccctcgcgattgccggcgctgttatggtattggtttggtgcattcacttcaggggtggattagcttgggaatcttctaacaaaaatctcatctttaatctccatcctgtattgatgttgattggcttcattatcttaggaggtgaagccattatgagctacaagtcattgccactgaagaaggaagttaagaaagtcatacatcttgtgctccatgccactgctctgattctaggcattattggaatctatacggcattcaagaatcataatgagagttcaatacctaatctctacagcgtgcattcttggcttgggattggaatcattaccctttatg

SEQ ID NO: 22565 - DNA, 400 bp, Gossypium hirsutum
  Clone ID: LIB3272-013-P1-K1-G6
cttctcttctccaccaatccaaaaaaaccaaagatgcagtacaaaaacctgggcagatcaggcttaaaggtgagtcaactatcgtatggagcatgggttagtttcggtaaccagctcgatgttaaagaagcaaagtcacttctccagtgttgtaaagacaacggagtcaactttttcgacaacgccgaggtttatgccaatggtcgagccgaggagatcatgggtcaggctattagggaacttgggtggaaacgatcggatatcgtggtttctaccaagatcttttggggtggtcctgggccaaatgataagggtttgtctagaaaacatattgtggaaagaaccaaggcgtccttgaagaggcttgatatggattatgttgatgtgctctattgtcata

SEQ ID NO: 22566 - DNA, 326 bp, Gossypium hirsutum
  Clone ID: LIB3272-013-P1-K1-G8
taaaaaacagggcatttccattaaaccaacaacaacatctaaaatccaaccacccagagttaaccaaaagagaaattggtcaccaaagtctacatggtttacttttccatgtttgaacatgttaggaaactgccccaagagatgaaaagggagctgtctctgccgggggagtgaatgtaactctttggggtggcagaaacactaccagaagaagttcttgggaaaatgggagcaccaccaaaaacagatgcccctatcataacaccacatgtgctgtcgggggcagatggtgtgctatttgggtttccaactagatttgggatgat

SEQ ID NO: 22567 - DNA, 334 bp, Gossypium hirsutum
  Clone ID: LIB3272-013-P1-K1-G9
gtggtggccgttcgataaaagatctatacaccttttcgtttaaggaaaccgattggaaatcgaaccaagctctcgatgagatgaataaacggttcttggacttgacattactcgaccttctcaggacccatgatgggaagagggactatcatggcggacaaacaaagcaacatgtgctgtgactgtaccgtaaggactcctggcattattattacttgatcatcccatatgtgattgactatgcccatcctttacttgaaaagctagcctcggggggatacaatcacaggtttgagaaaactgatcatgacttgtgtgatatcgacgaaggatg

SEQ ID NO: 22568 - DNA, 392 bp, Gossypium hirsutum
  Clone ID: LIB3272-013-P1-K1-H1
cgaggagttcattatttacaccggccagggccaacacttcaggatcttggttttttcattcttccagagcgtgggcatgataaaggctatatcagcgagacagcgttcacctgtgtctctttatcatttgtattgtggactttgcatcctttcatcttcaagaccaaaaagatctacacagttcttgtttggtgcagggtgctagcatttttagttgcttctcagattctccgaatcattacattctattctactcagcttcctggtcctaattatcactgccgagagggttcaaagcttgccaggttgccgaaaccggagagtgtgctagaagtcctcttaattaattttcctcgaggtgtaatatatggttgtggtgacttgattttttc

SEQ ID NO: 22569 - DNA, 378 bp, Gossypium hirsutum
  Clone ID: LIB3272-013-P1-K1-H10
gctgtctccactttctcttgaatcaaaacctgccaattttgctttctataaaaaaggttaattttatttactttttgttttttgttttgttcgattttcaaaataaaaatggcaacagcagcagcagcgacaaagacaatttctcagatttcttgtttctcttcaatcaaccggagatttcagctctatcatcgttcaacttttcgtccggttactcgctcaaagtcatttgttgttacaagtgttgatgggcatggtgctgaaactactggcaatcaacctaaaactacgccaagctatattgctggagaatcaaaagcatttatagaagatatgcctaggacatacccaaatgcagaagagcatgttcctgaaaat

SEQ ID NO: 22570 - DNA, 252 bp, Gossypium hirsutum
  Clone ID: LIB3272-013-P1-K1-H11
gaaggactaattcaaagccttaagacatataagccatttcagactcggaatgaggagtaatccttgcttaaaggttaggttttatgaaatacttaacattgttcaataagacagagtttgcagtaaatgtaatttattgttgtcttcacttatgtattccatatgcaaatctgcttgttgtagtgtggctccttttgaaagagaatagagtaaccaattttaatttgatacaatttgatccgtttatttctt

SEQ ID NO: 22571 - DNA, 361 bp, Gossypium hirsutum
  Clone ID: LIB3272-013-P1-K1-H12
gcgacatgagctacttaaccatttcccaaatctcctccctcctcttctttagcgttcttttcatttccgctcatgcagcgcgctttgaaatccgcactgagtgctcctacaccgtctgggcagcagcctctcctggaggtggccgtcgcctagaccctctgcaaagccggaccatcgatgtgcctgctggcactgctatggctcgtatttggggtcgaaccaattgcaatttccatgccagtggtaggggtcattgccaaaccggtgattgtggtggacttcctccatgcataggttggggtgtaccttcaaacaccctggctgaatatgcactttaccaatttggaaacatgggtttcta

SEQ ID NO: 22572 - DNA, 394 bp, Gossypium hirsutum
  Clone ID: LIB3272-013-P1-K1-H2
cttcgaagtggtgagctatggaagcatggacttgatagctactatcctgtttatagcttttggcatctagtgcaccaaagctttggacccttgcggacctgacccagacgactcggtccttggggtcatcccaatctatggcaaatgttcaccattcagcccagccaaagctgactcatcggtcaacacaatactgaacatggcatcaaaagacccagctggggtcacgtacttgtcgagccttgtagcccaaaagaccactgcggttaccattgattcaggccaacaagtcctaaacattggctactatatcgttcgggtaaagattggcactccgggtcaactcatgctcatggtattggacactaacaatgatgtggcttgggtcccatgc

SEQ ID NO: 22573 - DNA, 336 bp, Gossypium hirsutum
  Clone ID: LIB3272-013-P1-K1-H3
gtcaagctcaagcctttctcttgggtccctcccccaaaacaaacactcttttcaactccaccaccatctttaaccctgaccaacctcatccccaaatcttcccattttttgttccctataaaattttgatcacttaaattgttttttttccaaattttggggggttaaagatgagttcgagttccgatttggtgggttttgttgaatcggtattgggagtgtcgttagagggtttggtaacggattctatgatagtgatcgcgacgacgtcgttagcggggattctggggcttttgttgtttttctggaagaaatcgggttccgaaccgagccgtg

SEQ ID NO: 22574 - DNA, 269 bp, Gossypium hirsutum
  Clone ID: LIB3272-013-P1-K1-H4
tttttcttgcgtcaaagcatgggcctttccctttttattaggaaggcgcggtctgtcgacttataacccgtttggcgagcccagtctgagcggtcatatgtgcacatcttggtggtggtaccaaaacaatatatgagatcttttgaggccgtagaatgaaacggttacatgtgatctgtccttgctcatcggttagtccatcctctcagacagaggaagtccgtgctacaagtcgttctgggcgtgctgctgaagggaatcgggttaaa

SEQ ID NO: 22575 - DNA, 367 bp, Gossypium hirsutum
  Clone ID: LIB3272-013-P1-K1-H5
gaaggtctcactttctgtcgtatcacaacctggccattttactcgtctataagaagggctaatcttatttactgtttgggttttgtgttaggcgattcccaaaacaaaaagggcgacagctgcagcggggacaaaaacaatttctcacatttgttgtttctcttcaatcaaccggagatttcagctctattatcgttcaacttttcgtccggctactcgctcaaagtcattcgttgttacaagtgttgctgggcatggtgctgaaactactggcaatcaacctaaaactacgccaagctctattgctcgagaatcaaaatcctttatagaagatatgcctaggacatacccaaatgcagaagagcgt

SEQ ID NO: 22576 - DNA, 397 bp, Gossypium hirsutum
  Clone ID: LIB3272-013-P1-K1-H6
gcttgggcacgagaagaaagagaaatgaagttggaccaaaattacacatcacaaaattgatgtcaatcagaagagaatcatccatgagaaaatgcattcaacagcatattcttcagctacttcaattttccaccgccttagcactgtagcttcttcaaagctccctcttttaccttccctctctctatatcgccatgtccagaattttgagatttgcaaatattaggaaagctgtggaatctgctatttcgaaccagaggtcgaaccgttcgggatttaggaagtatgcgacagtggtttctgtcgggttgcatttgccacagtatagagtgttctcccattataggttcaacagtggaggaaaggctccaatcttgttgcagaatacaaaggaagg

SEQ ID NO: 22577 - DNA, 375 bp, Gossypium hirsutum
  Clone ID: LIB3272-013-P1-K1-H7
ccgagatatatattcccaaacatgtctaaagcctgcttgcttttgtttctcgttggagtggtggtttttatcatcactccttctctagctaaccaacatcatgataatgagcttcccaaggggaagcctttcccaggtgagaagcaaccacaacacaagccattccctgaacaccgaccgccaatacacagtggacctggcggtaaaggacaggagccaccacatggggaaaaacctcctcatagaaacttattgagtgtggaagttgagggcacacataaacctccacgacattcaggtggtaaacctccaagacactcggggggtaaacctccacatgttgaggggttccctaccgataaagcacccatgaag

SEQ ID NO: 22578 - DNA, 389 bp, Gossypium hirsutum
  Clone ID: LIB3272-013-P1-K1-H9
gtccgacactcctttcctcattcttcggaactcgttcttcctttccgaccagcgacaacgatcatcgtgatatcccaattctaccctcaccgaaccccccaaattctccgctagctcatagaaaacttgtccgggattttttttcctttttttgttcttttttctttggggatggctgaatccgacaatgaatcgggggggcataacaacagcggaggaaacgctcacagcgaaacgtcggcgcgtgagcaagacaggttcttgccgatcgcaaacgtaagcaggatcatgaaaaaggcgttgccggcaaacgctaagatctccaaagacgctaaagaaacggtccaggaatgcgtctccgagttcatcagtttcatcacgggagaagc

SEQ ID NO: 22579 - DNA, 402 bp, Gossypium hirsutum
  Clone ID: LIB3272-014-P1-K1-A1
ataccacccaaacatcgtcgtcttctacactcttctctggtaagttcatcgaaagatcaaatcaagatccctgccaaaatgaacgacgctgatgtatccaagcagatccagcagatggtgagattcatccgccaggaagcggaggaaaaggctaacgagatctctgtttccgctgaagaggagttcaacatcgaaaagcttcaattggtggaagcggagaagaagaagattaggcaggagtacgagaagaaggagaagcaagttgaaatccgaaagaaaattgagtattcgatgcagcttaatgcatctaggatcaaggtccttcaggctcaagatgatgtggttaatgctatgaaagaatcagcatgcaaagaccttctcaatgtgagccatgatcaccat

SEQ ID NO: 22580 - DNA, 411 bp, Gossypium hirsutum
  Clone ID: LIB3272-014-P1-K1-A10
ctcagccgtaagtatttccaacagctcatctccgccgttgggtactgccattctcgtgggatattccaccgtgatttgaaacctgaaaatctcctcctcgacgacaacgggaacttgaaggtttcagatttcggtctcagcgccgtaactgaacagatccgagccgacggcatgctgcacaccttgtgtgggaccccagcttacgtcgcaccggagatcttgtcaaagaagggatacgatggagctaaggtggacgtgtggtcatgcggcgtcatcctcttcgtgatgaacgccggttacttgccttttaatgatcccaatctcatggctatgtacaggaagatatacaacggtgagtttcgttgtcctaaatggatgtccagcgatatgaaacggttcatttctcgactc

SEQ ID NO: 22581 - DNA, 411 bp, Gossypium hirsutum
  Clone ID: LIB3272-014-P1-K1-A11
gttgttcttcactttggttagctctacctacgtgccttgcccaccaccaccaaagagccacaagcctacccacaagagcccaccctcggcacctaaacagccagccacttgccccaaagatacactgaaactaggtgtttgtgctgatttgttgggctcggtgcgcgttgttgttggaccgtcgaggaccaaatgctgctcactcatttcgggtttggctgatctcgatgctgctgtttgcctttgcactgctattaaagctaatgtgttgggggttaacctaaacgttcctgtttcattgtctttgctcctcaattcctgcgaaaagcaaatgcctgctggttacaaatgtgcttaagcaatgtttgggtttttcttttacgtgttctttttttttctgggcgtgttaaa

SEQ ID NO: 22582 - DNA, 414 bp, Gossypium hirsutum
  Clone ID: LIB3272-014-P1-K1-A12
tattgatcaacaccgcgaaagtttgctgacttgggagaagttacagtatcctttcaagatggtggaactgcacaacaattgcgatttcacgatgatacctacacctaaagccccaaatggtgctaatggacaaccatcgcctgatgataatctggtcaattcctcaagcttgatgttgactggaccaaagaaaagaaatctggaagctgaaggagaaggcatcaagaaacagagccggccccggctaacggttgaatcatcaaatttggtagaagagaatacggaagagcgtattcagagatacaatgaggggactccaaaaaacaaggacaaaactgcactttcggaagctagagtacaaggtattgccattaatgatgttattcctattgatcaagacaatggaagtttgct

SEQ ID NO: 22583 - DNA, 403 bp, Gossypium hirsutum
  Clone ID: LIB3272-014-P1-K1-A2
gcgattatctgtgctcatggtgcgtgcagctgcagatgatgtccgctttcttctatacatctaccacatgatgatgaagaaactgaatgaacgatccttgtggcaccttgcagttcgtggagctctatattgccgatgtttctgcatcaacgataataactatgccgattggccatctattcctcctattccagataacttgatggtggagggggatgctcctgaagaagaaatactttcaattctggatgttccgcaagggaagatgggacgtgtcattggaagaaaaggggttgccatattgtcaattaaggagtcttgcaatgcggaaattcattttgggggtgccaagggcccaccggacaaggtattcatcttagggcccgtgaggcatgtgaggaaa

SEQ ID NO: 22584 - DNA, 417 bp, Gossypium hirsutum
  Clone ID: LIB3272-014-P1-K1-A4
cttgttggtggcggtaaaattttattgtttgtggaaagaacaaagattcgaagatgagtaagcttcagagtgatgcgcttagagaagctatttcaaccattgtagctcagtcaaaggagaaacagcgcaaatttactgagaccattgaactccagattggtctgaaaaactatgatcctcaaaaagacaagcgattcagtggatctgtgaagctgcctcatattcctcgccccaagatgaagatttgcatgcttggagatgctcaacacgttgaagaggcagagaagataggtttggattatatggacgtggaagcattgaagaaactgaacaagaataagaagttggtgaagaagcttgcgaagaagtatcatgcctttttggcttctgaatctgtcatcaagcaaatcccacgtg

SEQ ID NO: 22585 - DNA, 415 bp, Gossypium hirsutum
  Clone ID: LIB3272-014-P1-K1-A5
ccaagacaaagcttcatattatcttttttagttccgacaaaagaaaacgaaaaaaaagaagaagaaatacaatcgttttctttttgaagtcgggttttagtttttggggtgaaaaaaatgttgggagtatttagcagtgcgatagtgtctccgccggacgagctggtggcggccggttgccgaactccatcacctaagataacggcggacgctctggtgaaacggttccttgagacgaactcctccggcgtgtccatgcacatcggagaccatgtccaattcgcttattctcaccataaagagtctcctttacagcccagatcatttgctgtgaaagacgaaatcttctgcttgtttgagggagcccttgataacttggggagtttaaagcagcaatatggtctggcaaagtcag

SEQ ID NO: 22586 - DNA, 415 bp, Gossypium hirsutum
  Clone ID: LIB3272-014-P1-K1-A6
aaaaagcttatcaagcaacagaagaaggttttttgtctctcgttaccagacaatggcctatgaacccacaaattgctgctgttggatcctgctgcctggccggtgttatctgtggtggaaccctttatgttgccaacctcggtgattcccgtgctgttctagggagagctgtgaaagccacaggaaaggttctagccgttcagctctcagctgagcataatgcgtgtatagaatctgtgagacaggagctgcaatcattacacccggatgactcgcaaattgtagttttgaagcacaatgtgtggcgtgtaaaaggtctcatacagatatccaaatctattggtgatgtatatttaaaaaaggctgagttcaacagggagcctttgtaccctagattccgcctccgtgaaccttt

SEQ ID NO: 22587 - DNA, 435 bp, Gossypium hirsutum
  Clone ID: LIB3272-014-P1-K1-A7
gactggccgactccgacccacgcgtacgccccctctcctgtttgtgctctgtttttctcttctgagttgttttctgatttagggtttagccactctgggtatttattatttcatctaaagaaacacttttggggattaaagtgggtagtttattattattactttttggacggatttaaaacggtatatatatagggggtatttattttgattttttgaatggcccggttgattcttccttgcaaaagttcgtgtttggcaaggaccagtcttttgggttaaaaggagtgtctgttcagtgaagagtatatctgggtataggtgtttctcggctctagaggccacgcatagaaaaaattacaggtttgcacattcttcgccttatagggcaagagaaaccagcagaaggctgatttgttcagttgcaacggaacc

SEQ ID NO: 22588 - DNA, 403 bp, Gossypium hirsutum
  Clone ID: LIB3272-014-P1-K1-A9
attaaaccttctgcttagcttaaaaaatcttgaatctgcactctcctacttccctcgttatcgtcaatggcttcggacaagaagattaagatcgggattaacggatttggaagaatcggacgtttagttgccagagttgctcttcagaggaacgatgttgaactcgtcgccgttaacgatcccttcatttccaccgattacatgacatacatgttcaaatacgacagcgttcacggtcaatggaagcaccatgatcttaaggtcaaagactctaaaaccctcctgttcggcgaaaaacccgtcactgttttcggaatcaggaaccctgaggagattccatgggctgaagccggggctgagttcgttgttgagtcaactggagtgttcactgacaaagacaagg

SEQ ID NO: 22589 - DNA, 408 bp, Gossypium hirsutum
  Clone ID: LIB3272-014-P1-K1-B1
gtcgctctctgtagccgccgcctgcgtctctctcttcatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgaaggttgttgacattgttgacactttcaggcttcaggagcaaccccctttcgacaagaagcagtttgtcgtgttcatcaagaagttcatcaagaacttgacaccaaaactggatgcggaaaagcaagag

SEQ ID NO: 22590 - DNA, 410 bp, Gossypium hirsutum
  Clone ID: LIB3272-014-P1-K1-B10
aacttgcacaacctctaaagtttgcagttgggtttaacagaagagggactgaagagagccaaatgaaaacttcgaaagatgtatcaaagaattctgatatgtctgtattattggaccgcaacaaatgctttggtgccgtggctgctgccgttaaaggcattgtttcagattcagttgtggatctgaaatctcctgagctatctattcttgttgagttgcttcccctttctggagtgcctaatggatcgctattggttggtgtgtcagttttaccccaaaacctggttagtactaagccaagactctgcattaagccactggtttgcgataaaaatgggaagaaggcaagttaaagcaggtaacttatgaagcgagttacgccatgattggtgtggagggctgaatccccc

SEQ ID NO: 22591 - DNA, 207 bp, Gossypium hirsutum
  Clone ID: LIB3272-014-P1-K1-B12
ggttttctttcgccgctcttaatcacaaaaagctttgaagaaaaagcgtttgggggtgcaaaacattgggccgaagaaaggtgggaaggtgggtgttcccccccaaaaaaaacaaaaaaaggttgtgaatcccttgtttgggaagcgtccaaaacaaatccgcattgggggggctttaccttctaaaaaagaattgcatcgattttt

SEQ ID NO: 22592 - DNA, 404 bp, Gossypium hirsutum
  Clone ID: LIB3272-014-P1-K1-B2
gaaagattttttggggataatgtcatggtgtcagtagcaacacaacaagcttcaaacccggttcacacggttgctaatagtttgagtcttcctggcttacaattgatcacaaaaaaactagaattgcctgtaaagattgtttttccaaggaatttgctcggtggtgcatcccctggtgggaattcagctgacttcatgatgcttggtcttggtgatatggccattcctgccatgcttctagcattagtcctctgttttgatcatcgaaagactagggaaactgtaaatcttttagatttacattcatcgaaggggcacaaatacatatggtatgcccttcctggctatgctgttggattagtaactgcgcttgcagccggcattttgactcactcgccccaacc

SEQ ID NO: 22593 - DNA, 414 bp, Gossypium hirsutum
  Clone ID: LIB3272-014-P1-K1-B3
agttgacaagcttgctttcactggatcaactgaaacgggaaaaattgtccttgagttggctgcaaaaagcaaccttaagcccataacattggagctcggaggaaaatcgccttttattgtttgcaaggatgctgatgtcgacaaggcggttgagcttgcccactttgctttgttcttcaatcaaggacaatgttgctgtgctggctctcgtacatacgtacatgagagtgtgtatgatgaatttttagagaaggcaaaggcacgtgcattgaaacgtagtgttggcgatccatttgtagcaggcattgaacaaggtcctcagattgattcagaacagtttgaaaagatcatgaggtacataagatcaggtgttgaaagtggagcaactctagaaaccggaggggagaggatagg

SEQ ID NO: 22594 - DNA, 413 bp, Gossypium hirsutum
  Clone ID: LIB3272-014-P1-K1-B4
ttccactccaaaaaactgtagctatggctaacaatttcctatatttttgcctcttctgtagcttagttgtattaactcattcagctcctgaggaggctctggtcactcaactccctggcttttctggcacttttccttcaaatcactactctgggtatgtgaatgtcgatcaaaatcatggcaagaacatgttttactattttgtggaatctgaaaggaatccgtcagaggatccactggttctttggctcaatggtggacctggatgttccagctttgacggctttgtttacgagcacgggcctttcaattttgaagcagcaaaggcaaatgagagtttgccccaactacatctcaatccctatagttggtccaaggtctctaacattatatatttagattctccagtcggt

SEQ ID NO: 22595 - DNA, 417 bp, Gossypium hirsutum
  Clone ID: LIB3272-014-P1-K1-B5
gaagattatggagaagagagagaggaatgaacggcctagtgatttagatgaagttcttgtcaagtatcaagtggcgcttgccgatgggactattgtagcaaaaacccctgaagaaggatatgagttttacgtgaaagatggtcatctttttccagcattgacaaaagcaattgtaacaatgaaaaggggagagaaggtcaagctaattgttcaaccgaagtatgcttttggagataaggggaaggaggctactgatgggttcccaagtatcccaccaaattcagttttgaacgttgaactggaattgatctctttcaagcctgttatcgatgttacaggagattctaaggtattcaaaaaaattctgaaagagggagaaggtgctcttgtagcaaatgaaggtgctgcagtaactat

SEQ ID NO: 22596 - DNA, 414 bp, Gossypium hirsutum
  Clone ID: LIB3272-014-P1-K1-B6
atcaatttgctttgaagatcatgttggctatttttcacaaggcatttgctaatccaccagaggagctgaatagtccagcttctcataaatctactaagaagcctaaacagcctgaagaaaccctaaatgatttcctatctcatcaccctcacaacactttctccatgagctttggcaacgctgctgttttggcttatgtccgccatgaacgtgctgcttcagttcatcagaggttgttttgtgggtttgatgacatatactgccttttcttagggagcttgaacaatctatttatgctgaatagacagtatggtctttccaaagggagcaatgaggcgatgtttgtgattgaagcatataggacactaagggataggggtccataccctgctgatcaggttgttaaggatcttg

SEQ ID NO: 22597 - DNA, 409 bp, Gossypium hirsutum
  Clone ID: LIB3272-014-P1-K1-B7
acgaaatggcggaaacatgcgacttcctcgcgacaaagagatgtgcagtggtgagtggaggaaacaagggaattggattggaaatatgtaagcagttggcttccaaaggtgtcaccgtggtgttaactgccagagatgagaaaagggggcttcaagctcttgacaagctcaaggaatctggtctttctcataatctggttttccaccagctcgatgtcactaaccctcttagcgttgcttctcttgctgctttcatcaacacccaattcgggaaacttgatatcttagtcaataatgcagcaattgctggagccaatgtgaactatgagattttaactaccgctgttgaaaaagcgagtgattggccagtaggggaggaagtgtggaatgagattattacaagtgaaac

SEQ ID NO: 22598 - DNA, 409 bp, Gossypium hirsutum
  Clone ID: LIB3272-014-P1-K1-B8
gtgtacttcggtggtcggattaagtaccaagatggtggggcgagtcgtgaggttggtcctgataatgtgtacgattcagctcggttgattcgaagcaagaatgcttccatccctaatgtaaacctcacttgggaatttccagtgagtgaggattataagtatcttgttaggatgcatttttgtgatattgctagtatatcccttggattgttgtatttcaatgtttatgtcaatgaacatttggcatataaagatttggatctctcggttgttacgaattacatgctggcttctccgttttatgctgattttgtggttgatgctggtcgttccggggtcattaccgtaagcgttggaccttctagcaagagcatggggtatacggttgatgcgattctaaacggagtgg

SEQ ID NO: 22599 - DNA, 317 bp, Gossypium hirsutum
  Clone ID: LIB3272-014-P1-K1-B9
ggataaaacccagagtattccaaccattgatctttcagattttccagcacagtatgagaaactaaggcgatcatctgaagaatggggttgtttcagggtagtcaaccacaacatcccttttgaattgatgcaggaaatgaagcaagttgtgagatcattgcttgacctccccatccaaatcaagcaaaacaacgtcgatgtcattgccggcagtggttattgggctcccagtcctaaaaaccctctttatgaagctttgggtctctatgatatggcctgctcccaagctgttcataccttctgctctcagttggatg

SEQ ID NO: 22600 - DNA, 409 bp, Gossypium hirsutum
  Clone ID: LIB3272-014-P1-K1-C1
attagctactccttctcacgactctgcttcaaccacgatggctaaacacgtattggtgccggttgcgaatgggacggaaccaatggaagctgcgattacgatgcgatgtcataaggagatcgggcgctgaactcatggtggcttccgtcgagaaagagcttatcagttgatgcttgccacggggttaacatagtcggtgatgctctggattgtgattgaaaggacaccgggtttgatctaatggtactatctggaggcatgcatggtgctaccaactttaaaggttgcgcaagtctggaaagtgctgggaagaagcaagctgcagaccgacgtctatatgctgacgtgtgtgctatacctgcattagcgctaggttcatggggtctgacgaacggactgaaagctactt

SEQ ID NO: 22601 - DNA, 130 bp, Gossypium hirsutum
  Clone ID: LIB3272-014-P1-K1-C10
accgaacgaatccgggccgcccacgcgtacggtttttacgccgtcttaatcacagaagctttaaaaataacgttggggggcaaaattgtgcctaaaaaggtcaaatgtggctttccccccatgaaaaaca

SEQ ID NO: 22602 - DNA, 309 bp, Gossypium hirsutum
  Clone ID: LIB3272-014-P1-K1-C2
cgtacgcgtggatgctttgaagaaaaatgaagcgatgcatgcgtaagtatgtacaacttcagactgtaaacctgggaatggatgattaaattacatctagtgggcgtgcgggtccttgatactcgaataacggtagatgttctagcactaaatcttcaaacctacgcaccactattggtagggatgtattgattagatataaggtcgagccacgcttacggcgtcgatctgatgattcatgatagactcgacagagcgcactgcctctgtgccttcgtctcatcaatgaaagaactgacctatcttctt

SEQ ID NO: 22603 - DNA, 416 bp, Gossypium hirsutum
  Clone ID: LIB3272-014-P1-K1-C3
tccgttctatttatccttaccaaacaggttgagtgtgcaggaaaagaagcatttacttggagcgggggtggtgcaatctttacaagtggaagcccatttgacccctttgaatatgatggcaaagttttggtgcctggccaggcaaacaatgcatatattttccctggatttggctcgggtgtaataatttccggtgcgattcgtgttcacgatgacatgcttttagcagcctcgtatgctttggatttgcaagtgacggacgaacactacgagaagggattgatctacccaccattttccgatatcagaaagatatcagccaatatcgcagctaaggttgccgccaaggcatatgaactcggtctggcttctcaccttcctcagccgaaggatctggttaaatatgcagagagctg

SEQ ID NO: 22604 - DNA, 285 bp, Gossypium hirsutum
  Clone ID: LIB3272-014-P1-K1-C4
aaatatgtggaagcttgggcgccgctcggaactgagcttgctgaattcgcgggagcacgggggaaagaaattcacactaaagaaatggtcgggggcttatcattgttaacgcaagggctctactgctggaggggctaaaattgctagtacttaaggtgctggagccatgtcttctcctgatgctgcagcggttgggcgtagccctcattatgagccgctttcttggctgaaaacttaattgtgacatgtacgccatgcggctgaacattgttgaggccctaagaa

SEQ ID NO: 22605 - DNA, 260 bp, Gossypium hirsutum
  Clone ID: LIB3272-014-P1-K1-C5
caaatatcaggcggggagggatttgttcctcaacgccaaagcggtgcgcctacgcgggcatcatgacaagtatctcgtcgccgaggaagacgaacaatacgtttcacaagaacgcaacggatgcttcaaaagcgcttgatggaccgacaatttcgtccctgggtcaaaaaacattttccgtttaaaaagcttttacaacaagattttaaccgcctccaaccagccctttttacttgggatgaccgggccaaaggggatta

SEQ ID NO: 22606 - DNA, 413 bp, Gossypium hirsutum
  Clone ID: LIB3272-014-P1-K1-C7
gcagcctatttacaaagcaattaattcttgtaatatagtatttgcactcattagcctgtccctcatggaatcccatcttgagaaacaaaatggagatgtgcttcaaaaatctttcaaagagatgatttctactctccctaaaaagagttgttggggttttcctgaagatcaatatcaatatcaaagtttttggttcagcccaccttttctacaaggagcattgtcggctcaacaacaattccaagctcagccaactgatatcatcctttgtagctttccaagaacaggcacagcctggttaaaatccctcactttcgccactattacaagaacttcatacaatgattccaccacccctttactttccaagatgcctcatgatgttgtgccttacatggagtttgatcatgccc

SEQ ID NO: 22607 - DNA, 404 bp, Gossypium hirsutum
  Clone ID: LIB3272-014-P1-K1-C8
taatgatctcacgaagctggttcagcactgcaggaaacttcagcgtctctggatactggattgtattggagacaaaggactcggagttgtagcttcaacttgtaaagaattgcaggaattgagggttttcccatcggatccatttgatgccggaaatgctgcagtgacagaggaaggtttggtccttatatcatcaggatgtcctaagctcaactcattgctgtatttctgtcatcagatgacgaatgctgccctcatcactgtagccaagaattgcacaaattttatccgtttcaggttgtgcatccttgaccccgtaaaagctgaccctgtaaccaatcagccattggatgaaggttttggggcaattgtccggtctaacaagagtctgaagcggttatcac

SEQ ID NO: 22608 - DNA, 395 bp, Gossypium hirsutum
  Clone ID: LIB3272-014-P1-K1-C9
caatgggtgcggagattgtttcgatggaccaaggccagggtgcaacaacaatacatgtgctgtcggacccggcaacaccgtcactaacaccgccggtcctggtgaggttgcacaagatgttgtctctctgcaatcaactgatgggaggaatcctggcagagtggtaaccgtgcctagattccttttcgcttgtgcaccaacttccctgcttcaaggccttgctaacggtgttgtgggaatggctggtttcggtaggtatagaattgggcttccttcgcaattctctgctgctttcagtttccgaaggaaattcgccatttgtctctcgtctgccaatggtgttattttcttcggtgatggtccatatgtgttcctccctggagttgatgcattat

SEQ ID NO: 22609 - DNA, 339 bp, Gossypium hirsutum
  Clone ID: LIB3272-014-P1-K1-D1
gccttttgccaaaggcatgccaagaagcaataaaataactgttgtaggtggtgtgatcaacatgaaggccttgtatttcatacccagttcaatttgctggtaaacttacgtgtttaccaataaactattcccttaatagtaacatgatcccctgtttttgtgatcatgcaactttttcaaagatgctagcactgggttttggaggtcaactgctttactttgatattcgaattatggataaaacaaggatgctgcacaagttgtattaaacgccggctattattaagcgtgtaatgcaaatgtgactatatcattcgcctctccttcacaaagagacac

SEQ ID NO: 22610 - DNA, 324 bp, Gossypium hirsutum
  Clone ID: LIB3272-014-P1-K1-D10
gtcaaaaacaaaaatttcatggctcggaaattcttcgtcggtggcaactggaaatgcaatgggacaactgaggaggttaaaaagatcgttacaacattgaatgaagctgaagttccttctgaggatgttgtggaggttgttgtgagccctccatttgtttttcttacctttgtgaaaagtctgttgcggtctgatttccatgttgctgctcagaactgttgggttcgcaaaggtggtgcttttaccggagaaattagtgctgagatgcttgttaatctgagcattccatgggttatcatcggtcactctgaaagaagggctctt

SEQ ID NO: 22611 - DNA, 381 bp, Gossypium hirsutum
  Clone ID: LIB3272-014-P1-K1-D11
cggaactcgactctctcgatcccactcttctagaactctcttgattccagtgtttttccctgcacttccgatccactgaatcaatttccatactcaccggaaatggcagccgttacagcagctcagccgcgctcttccaagacagagtcgtacgttgacaacaagcgcaaagaagacatccgccaagccaacatcaaagcagctcgagccgttgccgacgccgttcgaactagcttaggtcctaaaggtatggacaaaatgatctcgaccgccaacggcgaagtcatcataaccaacgacggcgccactatcttgaacaagatggaagtcctccagcccgccgctaaaatgctcgtagacttatctaaatcgcaagattct

SEQ ID NO: 22612 - DNA, 411 bp, Gossypium hirsutum
  unsure (1)..(411): unsure at all n locations
  Clone ID: LIB3272-014-P1-K1-D12
gcgttctcacaccccgacggttggattttgatcagacggtaatcatgccgatcagaaacatagccgttggccggcctgaagaagctactcatccagatgctcttaaggagctttagctgaattcatatcaacgttaatctttggttttgctggatctgggtcaagcatggcttttaataagctgaccgacggcggtgcaacaactncggctggtctcgttgcccgctctctagctcacggattttgcgcttttcgtcgctgtctcagtcggtgctaacatctgccgtggccatgtgaatcccgccgttacattcggtgctttcgttggcgggaacattactctnttacgtggtatcctttattggattgctcaactccttggctcaaccgtcgcttgcctgttacttaagt

SEQ ID NO: 22613 - DNA, 410 bp, Gossypium hirsutum
  Clone ID: LIB3272-014-P1-K1-D2
gccgcctgcgtctctctcttcatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctattgatgttgacattggtgccaatccttcagccgaagatgctgatgaggatgaaggtgttgatgaccaatctgtgaaggttgttgacattgttgacactttcaggcttcaggagcaaccccctttcgacaagaagcagtttgtcgtgttcatgaagaagttcatcaagaacttgacaccgaaactggatgcggaaaagcaagagtccttcaagaaaaacatt

SEQ ID NO: 22614 - DNA, 417 bp, Gossypium hirsutum
  Clone ID: LIB3272-014-P1-K1-D3
tttgttttctctccctccaattaagatgcagatcttcgttaagaccctgaccggcaagaccatcaccctcgaagtcgagagttccgacacgatcgacaacgttaaggcgaaaatccaagacaaggaagggatcccaccagaccaacaacgtctcatcttcgccggaaaacagctcgaagatggccggaccttggccgattacaacatccagaaggagtccaccctccatctcgtcctccgtctacgtggtggcatgcagatcttcgtcaaaaccctgaccggcaagaccataactttggaagtcgaaagctctgacaccattgacaacgtcaaggcaaagatccaagacaaggaaggcatcccaccagaccagcaaaggctcatatttgccggaaaacaactcgaggacggtcgcac

SEQ ID NO: 22615 - DNA, 415 bp, Gossypium hirsutum
  Clone ID: LIB3272-014-P1-K1-D4
cgtttttaaagacaaccctaacagatgattattcggaagagagctcttacaatgttgtggtgtcagctgaaggaagcattggtacaaacgactacaaagtaatgtaacataatgttgcgaaatcccagatagcatctttagtggcagatgttttctccaacacagcagtggcagaaaacaaggttgtggaagtttttactagcccatcggcaccatcgaagagtgtagacgagcttttcagtgctattcctgaggatggaagaaggaaggcgtatgcaaaagccaccgtacggtctaaagctgaagaagaggcagtattagcagctgtgaaagctcgtgaggcggccgaagcagcgaagaagctagaagtggaagtgaagaagctttcagagcaagaagcgaacgcagctaacct

SEQ ID NO: 22616 - DNA, 416 bp, Gossypium hirsutum
  Clone ID: LIB3272-014-P1-K1-D5
gttccgagaaaagaccgccaagatctctgtcacaatcacaggctgaaagttcttacaaataaactccgatcaagccacttctgaaattcagatattttgtgaggtatcaggatgaaagcactcattcttggcggtggatttggaacacgattgagaccgttgactcttagcgtcccaaagcctttggtggattttgctaacaaacccatgatactgcatcagattgaagctctcaaagctattggagttactgaagttgttctggccatcaattaccagccagaggttatgttaaatttcctaaatgaatttgagaaaaagcttggcattaaaatcacctgctcacaggagactgaaccacttggcacagctggtcctattgctctggctagagacaagttgatcgatggctctgg

SEQ ID NO: 22617 - DNA, 412 bp, Gossypium hirsutum
  Clone ID: LIB3272-014-P1-K1-D6
gagaagctgatgaagcgcccgatacggttactggggacattgtattcgtcctgcaacagaaagatcatcctaaatttaaacgaaagggtgatgacttatttgtagagcatacattggcacttactgaggccctttgtggctttcagttcatactgactcacttagatggcagacaacttctgattaaaacccaacctggggaagtcgttaagcctgatcaattcaaagcaataaacgatgaaggaatgccgatttatcagaggccatttatgagaggtaaactgtacattcagttcactgttgacttccctgactcgttgaccccggaccagtgcaaggcactagaggctgtgcttcctcccaaggcatcggttcagctgactgacatggagctggatgagtgcgaggaaac

SEQ ID NO: 22618 - DNA, 352 bp, Gossypium hirsutum
  Clone ID: LIB3272-014-P1-K1-D7
ctcatatctaatccccaatttctctcttctgctctaggttccttcctgttctcttaggattcttgtggtctgttcaaagcgtcatggcatcgaagcggattttgaaggaactcaaggatttgcaaaaggatccacccacttcttgcagtgcaggtcctgtagctgaagacatgtttcattggcaagcaacactcatgggcccttccgatagcccttatgcgggaggtgtatttttagttagtattcattttcctccagattatcctttcaagccccctaaggttgcatttaggaccaaggttttccatccaaacatcaatagcaatgggagcatttgtcttgatatcctaaa

SEQ ID NO: 22619 - DNA, 413 bp, Gossypium hirsutum
  Clone ID: LIB3272-014-P1-K1-D8
cgtggttatagatagggagcaaggcgggagggaaacgctggaggagaatgggattaaacttcatgcactttttactttaactgagatggtcaaggttttaagagctaaagggaagctggaggaagagatggaaagtttggttatgaagtttttggaggagaataagaaagtacccgtgcctaaggttgagaaagtgaggattaagtgtctggggtatcaagaaagggctaagatttctaagaatccaactgggaaaaagctgtttgagattatggttaagaaagagagtaatctctgtttggcggctgatgttgccactgctgctgagttgcttgatattgctgagaaggttggacctgaaatttgcctattgaagacccatgttgacatattccctgatttcactccagagt

SEQ ID NO: 22620 - DNA, 267 bp, Gossypium hirsutum
  Clone ID: LIB3272-014-P1-K1-D9
aactcaaaacacctatattgttgaatgcacatttcatactaatcactactgcggctttacttctacctgcttggctgcttactcaatgcatatgactaaatttaatgcccttcaattgtccctgctatatattgagacgatgaatattgcaaaatactatgaccactctattgaatccttactgggggaggctactgatatgatacacggatgtttttaaggctatcttaagattacaatctgtgagacgggcctaaacagacaggg

SEQ ID NO: 22621 - DNA, 409 bp, Gossypium hirsutum
  Clone ID: LIB3272-014-P1-K1-E1
gttttaagctatttagtttctaaatttagttatggcgtatctatttcaagttaaaattcattactagaagccgggttttcctttttaggttggtgcagatgatgggaaagttctgaatcagatcattgattcattgacatctatagctaatccaactgaaaatcatggaaccccaagtcaacaactgaataagatttccctcaaagttggtaagctccaggagactgggatgaagaaagactccgaatccgaccccaaaaggaagaagtcggtgcttatactcggcgccggccgtgtttgtcaaccggcttgcgagctgttagcctcaataggaaccgcttcttcttgccaatggtataaaagttgcgtccaaaatgattccgaagagcagatggacgttcatgttatt

SEQ ID NO: 22622 - DNA, 414 bp, Gossypium hirsutum
  Clone ID: LIB3272-014-P1-K1-E10
gtgccacatcgccagttcccatggtaggatatctatcaatcaaagaaacattggtttttgtttgtgtttaaatttcggatctttgcaaaagaaaggagaaagaagaaatgcttgcagttttcgacaaatcggttgccaagagcccagatgctcttaatgctccagataaccctcaggctgtatctgctctcaaagatggcttcttacctaatcactttgcctctgtttatcccggttgtgtctccatcagtctcggctcttctggggttatggcttattctcttgaaaaacagaacccacttctccccagactgtttgcggttgtggatgacatattctgcttgtttcaaggccacattgagaatatagccgttcttaagcaacaatatggcttgaacaaaacagcaaatgagg

SEQ ID NO: 22623 - DNA, 296 bp, Gossypium hirsutum
  Clone ID: LIB3272-014-P1-K1-E11
gtaaaggagctggctggaaggttaataggaggacttaatttgttgcctaaagatgctattaatgctgcctgacattagcatctgctgttcaaacatgcatgagggtagaaacataatcctcgtttctagtgctaggggaacctaggactggcattcaggaggtggcacaccctgctctgtactatactcttgcacttgctgcatctacaaggctggtataactgttatttgtatcaccgaccactatgaacgacaccgtaaatacttgactgactagaggttcaagaagcacaacg

SEQ ID NO: 22624 - DNA, 389 bp, Gossypium hirsutum
  Clone ID: LIB3272-014-P1-K1-E12
gccttggcatttgctttttctaaattccagcaatctctttactctttgctttcattttcccttaattcagtcacaaaagcatcatcattattatcattgtttaaccactctctttctttttcactcaattctactactaaaattctgggttttgttttctgattcttgattctcagttttcactttgattatcgatctgggtttgtgttttttttttggtcatggaaaaagacaaagcttttatgtctgaagagctgaagaacagaacaacaacacgacaacaacaaccagcttggaacccttgtggttttatgacagaaatgtcaacaaatgagctgaattgtggaacagaacaaggtgggaactattttttcaatccaaattgggat

SEQ ID NO: 22625 - DNA, 399 bp, Gossypium hirsutum
  Clone ID: LIB3272-014-P1-K1-E3
ctcattcactacaacatacttaaaatcatggttcccggtgagttaagaggacttcactacctagcaccagaaaacccgatcctgattgcagccaaccttggcatgatgcaaaactctataccatcttttcatttcaatacatttgaaagcagcctaccgaattcccacatcgtaccatctgcccaggaatttgctgcggtgtcctcaagtatcagcaacacttcaacttcaaatgaggctggggagcagcaggtctatttcatcgacgaaagggaacagcggggaatgatatctaacagagaatctgctcgtaggtcgaggatgcggaaacagaagcacctggatgaactttggtcacaggtgatcaggctccgtaacgagaaccagagtctcctagac

SEQ ID NO: 22626 - DNA, 412 bp, Gossypium hirsutum
  Clone ID: LIB3272-014-P1-K1-E4
aacctcaattcctctctttgaaagtgtacggtttaaacgtatacccagattttaattttgttgatttgggtttaacttgaagagagaaaggaaatcttttcaatggggagtttaggagctcttgtgaaacacccagatgatttttatccattgttgaagctgaaaatggcttcaaggcatgccgagagacagatcccatcagagcctcactgggctttttgtttctctatgcttcacaaagtatctcgtagtttcgctctcgttattcaacagctcgacaccgagcttaaaaacgccgtctgcatattttatttggttcttcgagctcttgatactgttgaggatgacactagtgttgcaacagatatcaaagttcctatccttaaagaattttatcgccatatatatgatc

SEQ ID NO: 22627 - DNA, 415 bp, Gossypium hirsutum
  Clone ID: LIB3272-014-P1-K1-E5
aaatctgctcaagctttgttgagactttgaactgagcttcgctgaattttcgtgatcgtcgagaaagaaaatgatgggaaggaaattcttcgtcggcggaaattggaaatgcaatggaaccactgaggaagtgaataagattgtgagtactttgaatgctggagaggtgccttctccggatgttgttgaggttgtggttagccctccatttttgttccttcctttggtaaaaacttcactgagacctgagttccaagtcgctgcacaaaattgttgggtcaagaaaggaggtgctttcactggtgaagttagtgcggagatgcttgtcaatttgagcattccttgggttattattggtcattctgagaggagacttattttgatggagtcaaatgagttcgttgcggataaggtt

SEQ ID NO: 22628 - DNA, 441 bp, Gossypium hirsutum
  Clone ID: LIB3272-014-P1-K1-E6
gaatgcccgggccggcgccgcccacgcgtacgttttttattctgttttgccttttccttcgcatctgctttgtctaaattcgggcggggtgtatactatttgcttggattaacccttaattcagccacaaaagcataatgcattattatcattggtggaccactctatttgtttttgacttaattatactactaaaattcttggttctgttttctgattcttgattcttaggtttcaatttgattatcgatctggggttgggttttttttttgggcatggaaaaagacaaagcttttatgtctgaagagctgaaaaacagaacaacaacacggcaacgacaaccaggttggtacccttgtggttttatgacagaaatgtcaacaaatgagctgaattgtggaacaaaaccaggtgggaactattgtttcaatccaaattgg

SEQ ID NO: 22629 - DNA, 413 bp, Gossypium hirsutum
  Clone ID: LIB3272-014-P1-K1-E7
ctcaatccttcgaaatcgtagctttggaagcatggacttcatagctactatcctgtttctagctcttgtcatctcctccgccaaagctttagacccttgcggctctcagccagatgactcggaccttttggtcatcccaatctatggcaaatgttcaccattcaacccacccaaacctgactcatggttcaacacagtcatgaacatggcatcaaaagacccagcaagggtcaagtacttgtcgagccttctagcccaaaagaccactgcggttcccattgcttcaggccaacaagtcctaaatattggcaactatgtcgtccgggtaaagattggcactccgggtcagctcatgttcatggtattggacactagcaatgatgtggcttgggtcccatgctccggctgcacca

SEQ ID NO: 22630 - DNA, 412 bp, Gossypium hirsutum
  Clone ID: LIB3272-014-P1-K1-E8
gtttcataaataatcaaaatttacgttaacaaatctgcaagttttctagcagatcgccacaaagggaattttgaaccttgtggggggttgtttttaatagaaatggtgaaccatggggacccaggaaacgtgacgggagccatgccctgatcgaattctcgacgacattggtggtgcttttggcatggctgctggtggaggtgcacacttccacttcttgaaaggcacatataactgccctagtggttctcggttgctcggaagaactcaagcagtgcgtatgaatgccattcgtgtcggcagtagttttgacggttgaagcggtctgtactgcacctttgattgcactatggtatacgtacgacagaaagaagatgcttggaactccattatagtcggtgctcgaacagga

SEQ ID NO: 22631 - DNA, 411 bp, Gossypium hirsutum
  Clone ID: LIB3272-014-P1-K1-E9
gcttacattggatgggataaatcagatggcttatcctcaaacttggttttttcttacagttgccgcaatctgtgtcattacacaattaaattacctcaacaaggccttggatacattcaatgccgagattgtttctcgggtatattatgtcatgttcacaactttgaccattattgctagcgtaatcatgttcaaggattggtcaggtcaaaacgtgagtagtattgcctctgagatttgtggattcatcactgtgctctctggaactatcatactttatgccacgagagaacaggaaccacctactgcgaggggaacagttacatggtatgttagtggggattcgatgaagagtgctgaggatgaacatttaatcactctacgcagttcggagtattacaagccatgaat

SEQ ID NO: 22632 - DNA, 373 bp, Gossypium hirsutum
  Clone ID: LIB3272-014-P1-K1-F1
aaaaaatgagctttcttcaggccttgtcaattttccttttgcttttgttgtatgtagtcgtaggatcagctgagcagtgtggaaggcaagcaggcggtgctctttgccccggtggtctatgttgtagccaatttggctggtgtggcagtactgctgactactgcacagttcctggttgccaaagtcagtgcagcggtagtggccctgcccctgggcctggtgggctaaccaatcttatatcaagagagacctttaatcagatgcttttgcataagaacgatggggcttgtcctgcccgtggcttctatacatatgatgctttcattgctgctgcccgttcttttcctgcatttgctacaactggtgaccaagc

SEQ ID NO: 22633 - DNA, 406 bp, Gossypium hirsutum
  Clone ID: LIB3272-014-P1-K1-F10
cggacgcgtggagggattttttcatttgtttcttcttacgctcgattacctcacgaaaagagaaaatgaccaagtgttacccaactgtgagcgaggaataccagaagtcagttgaaaaggctaagaggaagctcagaggtctcatcgctgagaagaactgtgctccactcatgctccgtctagcgtggcactcagctggaacttttgatgttaagaccaagacaggaggtccattcggaaccatgaagcatcctgctgagctcgcacatgctgctaacaacggccttgatatcgccgtcagacttctcgagccgatcaaggagcagttccctaacctcacctacgctgacttctatcagctcgctggtgtcgtcgccgttgagattactggtggacctgaaattcc

SEQ ID NO: 22634 - DNA, 400 bp, Gossypium hirsutum
  unsure (1)..(400): unsure at all n locations
  Clone ID: LIB3272-014-P1-K1-F11
cagcgcttcataatcgtcgatttcattaactctttgatctgtgccgacaaacccaaaattcgcggggcgtcgttttggtggaaaacgacggagaaatacaagtccggttcctccactttggtcgtgggcaaacaaatcctcctagaaaattacccgctcggcaaaacccttaagaacccacacttgccagcgttggccgggaaattcaacggcggaagtacggttagcgttattctcacggacaaagacgttgacgacgatgggttctgcatgaggtgcgggactcacggatcgaaccgnggtgctcggattcgaggtacttttatatgaggggaaactctgagactcaatagcctggtcaatgcgcctggacatttcaccaggctatttatgggcccca

SEQ ID NO: 22635 - DNA, 412 bp, Gossypium hirsutum
  Clone ID: LIB3272-014-P1-K1-F2
ccctctcccagtctcttttatttctctctctttctttcactgctgttgtttttggttgctacagtactgcattttgctttgggggtcagtgaatgaaaaaggaaaaccaaaaagcatgagcttcagttgagctaccaacaagtttttctatacagcccgacttggcaaagcctttgttttacttctcttcgaagaagccaagggtttcttttttattcttctttctctcttcttcatcattgaagatgcctagacctggtccaagaccttatgtctgtgagagaagagcttggcacagtgatagacaccaacccatgaggggttctctcattcgggaaattttcagagttgtaaatgagattcatagctcagcaacaaagaagaacaaggaatggcaagagaagctccctgt

SEQ ID NO: 22636 - DNA, 414 bp, Gossypium hirsutum
  Clone ID: LIB3272-014-P1-K1-F3
gaagaaatggcttccgcggatagcaatctccttatcctcaatttcctaaccttggcttcattgtccctattctatgccgacaaagctttttgtattcggattccagatcgggcctccaccacgcctcgggaactgtcagatcagtctctgaaaaccgcggtttttgccctcggtagtttctggagatcggaagctgtcttcgggtgcttaaacggtgtcgttcgaactacttctggttatgctggcggatccaaaatcaatcccgaatacagaagcttaggtgaccacgccgagtctgtaatggttgaatatgatcccaaggagattaatttcaggctacttctggaggttttttggtctagccatgacccaagacaggtttttggccaaggtcctgatgtaggtccccagtac

SEQ ID NO: 22637 - DNA, 404 bp, Gossypium hirsutum
  Clone ID: LIB3272-014-P1-K1-F6
gatggctatcaagagccaccattgctgcttcagctttatctttctgttattaccattactcctacagcttcattctgtcaaaggtgatctccagttgaactactatgctcaaagttgccccaatgctgaagagatcatcaaacaacaagtcatcaagctctacaacaaacatggaaacacagctgtttcttgggttcgaaatctcttccatgactgcatggttaagtcatgcgatgcatcgttattgttagagacggtgaatggaattgaatcggaacaaaaatcagataggagttttgggatgagaaatttcaagtacgttaagacaattaaagatgctctggagcaagaatgtccagggacagtttcctgcgctgatatcgtctctctttctgctagagatg

SEQ ID NO: 22638 - DNA, 393 bp, Gossypium hirsutum
  Clone ID: LIB3272-014-P1-K1-F7
ttaccatcttaggtaactaatgttccccgttttaagaattatatcaacttctctatattaatgtttaaaacggggaacattagttacctaagatggtaatgttcccaaaaataaaccagattttttcaatacatcaaaacataggttgctgaaaacataaaatatagcaccagcagaagctgttaaacatcggcaaaatactatcttaatatttgatttagtcgacttcttctatcttaggtccagcaccgctgccaccggtaggtggggcatcctcgtccatgccaccacccatgtcagcccctgcaccttggtacatcttggcaatgataggattgcagatgctctcgagctccttcatcttatcctcgaattcatcagcctcggctagct

SEQ ID NO: 22639 - DNA, 405 bp, Gossypium hirsutum
  Clone ID: LIB3272-014-P1-K1-F8
aatgactttcggggatagcaatctccttatgctaaatttcctaaccttgggtgcgttggccctattctatgccgacaaagctttttgtattcggattccagatcgggcctccaccacgccttgggaactgtcagatcagtctctgaaaaccgcggtttttgccctcggtagtttctggagatcggaagctggcttagggtgcttaaacggtgtcgttcgaactacttctggttatgctggcggatccaaaatgaatcccgaatacagaagcttaggtgaccaccccgagtctgtgatggttgaatatgatcccgaggagattaatttcaggctacttctggaggttttttggtctagccatgacccaagacaggtttttggccaaggtcgctgttgtagtcccca

SEQ ID NO: 22640 - DNA, 413 bp, Gossypium hirsutum
  Clone ID: LIB3272-014-P1-K1-F9
aaagaaaatgggaaaaggaactggaagctttggaaagagaaggaacaagactcacacgctgtgcgttcgatgtggtcgccgaagcttccatctacagaagagccgttgcggtgcttgtggctaccctgccagtcgcatccgaaaatataactggagcatgaaggctattagaagaaagaccaccgggactggccgcatgaggtacctccgacatgttccccgaaggttcaagactggctttagagaaggtactcaagcaactccaaggaagaagggagcagttgctgcttcgtaagttaatttgtgatgttttcgttttgttcagagagattcctgaatttagaaacgataggtttttgggtttctttcaactgtgttactttcttatttttcaccaaatgtctacaaacggg

SEQ ID NO: 22641 - DNA, 414 bp, Gossypium hirsutum
  Clone ID: LIB3272-014-P1-K1-G1
tactcactcaacattcccatttccaatctccagctcccaaggtaaatatgccgatcagaaacatagcagttggccggcccgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaggtggccacgttaaccccgccgtcaccttcggtgctttcgttggcgggaacatcactctcttgcgcggcattctttactggatcgcccaactcctaggctcaaccgtcgcttgcctgttgcttaagt

SEQ ID NO: 22642 - DNA, 414 bp, Gossypium hirsutum
  Clone ID: LIB3272-014-P1-K1-G10
gagaaagcgagagaagaagagaatcgatttttttattcaaaaaaagatatccatggcagagacagcaaacaactctaaacctaaaaactcaagatggtttctcaatggaatgactgcccttgtcaccggtggcactcgaggaattgggcatgctatagtggaagaacttgcagggcttggggcttctgtttacacatgttcaaggaatggagatgagttgaataagtgtttgaaagaatgggaaagcaaaggatttttggttaatgggtcagtttgtgatgcctcgtctaaagaccaaaggctgaaactgatagacaacgttgcctctgttttcaatgggaagcttaacattcttgtcaataatgtgggaacaaacatcagtaagccaacagttgaatacactgcggaagaata

SEQ ID NO: 22643 - DNA, 202 bp, Gossypium hirsutum
  Clone ID: LIB3272-014-P1-K1-G11
cggacgcgtgggttacaccgtgggcggggagaatttcaattgttttaatcagtactttatgggctatcttttatttttggtgtcctggacatgcaatgagtgttgtgtttgctatctaagttgacaagttagcttatgtttaaattggagtttttcagtagatattattaaaatgatagaatttttgctgattgatttgctg

SEQ ID NO: 22644 - DNA, 416 bp, Gossypium hirsutum
  Clone ID: LIB3272-014-P1-K1-G2
atttattcttttctttcaactcaaagtcccaagtagtattagaatcatgggtgttgtcacttataactatgactctacctcccctgtcgctcccgccaggcttttcaaggccttcgttcttgaagctgacaaggtctggcccatagctgcccctcatgcaatcaagagtattgaggttgaagctaatcctggccctggaagtatcgtaaagatcaactttgttgaaggccttccattccaatatatgaagcaccagattggaggacatgatgaaaacaaattttcatacagttacagtttgattgaaggtgggcctttgggggacaagcttgagaaaatcaactacgagaataagtttgaggcagctgtaggtggaggaagtgtgtgcaagagctcgatgaaattttacacttttg

SEQ ID NO: 22645 - DNA, 417 bp, Gossypium hirsutum
  Clone ID: LIB3272-014-P1-K1-G4
gtttcagcgaactgagtcagtacccggaccagttaacgaacgaaagaaagttcaccatggggtcggtccccaatccgggtgagttaaccgagttaactcagcctagtttagatgagttccagcatcaaacatctcttatggcgggctgcactcttatgtggaaagaactctccgatcacataagttcacttgaggcaaatctgatgagacaatcggaggccttgaaacgcaaaatcgaagcactagactcggagaccaagacctcactcgactcactcaagaagagagaactcagcatcgacgacagcgtcaagattgcagtcaaccgagtcgagcttataaaaaaagatgctttgaaaaccttaaacgacgacaatcccgacggagaagttgacaacggagacggccttttgcaaa

SEQ ID NO: 22646 - DNA, 414 bp, Gossypium hirsutum
  Clone ID: LIB3272-014-P1-K1-G5
cggacgcgtgggcggacgcgtgggctccgatccccatccatgtcagaagctgaacaagccaattccccaaagccttctacatatttagaggttttatgcaaaagttccggcaagaaaacccggtttgcagccggcactaacgccggatttgcagtgtcattgataaatagaaagttgggtatcggagctccggttgccttgcatattgaatcctttagagaaggggaggaacccattatttttggccctgatgctgttcttgtgaattatggcaatggttggaatttgcaaactgttaatgaaatggattttcctggcattggaaaaggcaaacatgttcggggatttccgacacagctccctaatggaaagaacgttgatctcactaattctcgcagaatggtttcaaaacca

SEQ ID NO: 22647 - DNA, 361 bp, Gossypium hirsutum
  Clone ID: LIB3272-014-P1-K1-G6
aggccacccgttccgaaaatccggaggaccgagtgccgatcgcgcccggtcgtactcataaccgcatggggttttcaaagtgaacagtctctgttcaatggaacaatgtaagcaagggaagtcggcaaaatggatccgtaacctcacgaaaaggattggctctgagggcttggcacagaggtcccaatccctaacccgtctgctggcggcgcactgtttgagctgctcccgcggcaagagcgggtcttcgtgtgcccgccggtggactgactgggaacggttcccttgggggccttttccgggcgacgaacaaactacttataactggtacggacaaggggaattcgactgtttaattaaa

SEQ ID NO: 22648 - DNA, 413 bp, Gossypium hirsutum
  Clone ID: LIB3272-014-P1-K1-G7
gccggtagaaaaatccagaaagtatgggtcaaatgcagagaaaaggttgttccacacggctgtgacagcttctgactcggtttacaacacttggcagtgtcgagttatgtattactggttcaagaagcataagaatggacccaatttggatatgggcgggtttactaggatcttgcactctggtaaacctgacaactacatgaatgagattcccactttcattgctcagcctttaccagctggaatggatcagggttatatagtcctgaacagaccctgggcatttgtgcaatggcttcaaaaagctgacatcaaagaagattacatactgatggcagagccagaccatattattgtgaagcctataccaaacttatcaaaagatgggttgggtgctgcatttcctttctttt

SEQ ID NO: 22649 - DNA, 409 bp, Gossypium hirsutum
  Clone ID: LIB3272-014-P1-K1-G8
ccaatttctattctttcaattttaagaccaaatcacgagcgactcactctcagactcagctgagttaaaatcgctaaagcgatatggctttgcagctatgggaaacgttgaaggaggcgacaacggcgtatacgggtctatctccggccactttttttacggttctagctctgttatgggctgtttactatgtagcaaagggtctatttgggtcatccgatgatcatatccatcaacggtctacggctttcgaggagcagatggagccgctaccgccaccggttcagctcggcgagattaccgaggaggaacttaagcagtatgatgggtcggattcaaagaaatcactccttatggccatcaagggccagatctatgatgtttctcaaagcagaatgttttatggacc

SEQ ID NO: 22650 - DNA, 404 bp, Gossypium hirsutum
  Clone ID: LIB3272-014-P1-K1-G9
atacaaatacccatttcactaccatcaaaccacatcccacagacatgggtgcccacgaagaagaagccggaggtgaagagtacttgtttaagatcgtgctgatcggtgactcagctgtgggaaaatcgaaccttttgtcacgttttgctaggaacgagttcgacaataactcaaaggcaactattggagtagagttccaaacccaatgcgtggaaattgatgggaaagaagttaaagcagatctgggacaccgctggtcaagaaaggtttcgagctgttacttctgcttactatagaggagctgttggtgctcttattgtttatgatattactaggaggagtagctttgacagcattaaacgttggcttgatgaacttaccactcattgtgatactacattgac

SEQ ID NO: 22651 - DNA, 413 bp, Gossypium hirsutum
  Clone ID: LIB3272-014-P1-K1-H1
attccagttgtcaaaggttgaaggacgaacgacggagaaaccagtgcaaaaatcttctactttattttctttgaaatttattttcattttcgttttgtaatttttttttgttttagactcttagttataaattgaagatattaattttaaaaaatataattgtacagagaaaaaataagcaatctctctcctcttcccgaccatatcgtcatcgacctcttcctgagaacgctgagagctggaaagttaactgagagagttctcaagttgtttatagataccggtaaggacgaggtcttttctcttatacaagcactcaacattcgactcacacttacccctgtccttcctaccagatgttctgagaaattctgagattggtttaatcagtggaacacaaagtacattggact

SEQ ID NO: 22652 - DNA, 380 bp, Gossypium hirsutum
  Clone ID: LIB3272-014-P1-K1-H10
accaacccctctccccctaaaagaaaatcaatacctgcgaattgtcttagctggttcttgtttggttgttgagaaaatgcaagaaagtaaagaccctgggatcaagttgtttggtaagaaaattcatttacctgctgatggagagatttcaactctctctgttgatgaattcgacaaggctcagtgtgggaacagagtagtagatgatgaagactatgaagaatttgatgatgatgatgatgatgatggtggtggtggtgatggtgatgaagaagaagatgaacagaaagacaaaacagagctggattctttagcagaacagattgctgatactggacaagaagatgacaacatccagccgtcaaatagagaggaatcaa

SEQ ID NO: 22653 - DNA, 443 bp, Gossypium hirsutum
  Clone ID: LIB3272-014-P1-K1-H11
cgcagtttcggcctagacccacgcgtccgaccccgtactcggacgccgcacggtcccgtgaagccattgcctgtggaaacggtgacggtggcttgccccgatcaccttgttatcgctgaccttcccgttgccaagagcattggcgccgctatctcgtcctcgctcgtcaagaccgttggtcgtaagtcacgccgccagcttggcgagcgagttcacttctgcgtccgctgcgatttccctatagccatctacggccgcttgagtccttgtgagcatgccttctgcctcgattgtgcaaggagtgattcgatttgctatctcacagttgtgatgaacgtatacagaagattcagacaatcaagataatggaggggatcttcatctgtgcagctcctcactgtcttaaatctttcttgaagacgacgtgatttgaatctcatatc

SEQ ID NO: 22654 - DNA, 414 bp, Gossypium hirsutum
  Clone ID: LIB3272-014-P1-K1-H2
ccgttttgttcctttggatctgtgaggcagccgccggttcctttgaccaccaccaccgccacctctctgtgatcaaccttcactctctttttcaaggaaattaactgaaatggctggaggattaatccaccaggttttaaggaggaaatttcaatcacagtctgctgttcaagctttatcatggttttcatcaaggaaagttaatgacgatgcgggttctgctggtatgaggactgttgcactccttggagctggtgtttcaggtttactaggttttgcaacagtagcatctgctgatgaggcagaacacggtttaagagttgcaaattatccttggcctcacgcaggcatcctcagttcatatgaccatgcttcgattcgtcgcggtcaccaggtttaccagcaagtgtgtgc

SEQ ID NO: 22655 - DNA, 415 bp, Gossypium hirsutum
  Clone ID: LIB3272-014-P1-K1-H3
ctccaacagctactgtcactgccccaagctaccccaaactcgccactgtcgccgttcttcggtctaaagtttttattttaaaccgacacaaaccgagatataagtcctcggttgttacattaagctcaagtttgcgggccaatcctatgttgtcaagcaacagtggttcacagggtttcttgtcttctacaggcgcacggtgtaaggcactttcggccttatcatcaccatttttaggcgaagatgacgatgacttgtggcgtacaacgaatgttttacctctacggtcgagatctctctctttaccaagagcatataaggatgacgtattcaaatttcgctaccctgtaataaccgagaagcctgaatggtggttgaggactttagcctgtgttccatatctattagctttgca

SEQ ID NO: 22656 - DNA, 382 bp, Gossypium hirsutum
  Clone ID: LIB3272-014-P1-K1-H4
ctgagtttgaagcttcaagtgctaaaatctacggatttgcgggtggagaagacgagagcccatctctctgcttcaaagctcctgtccaggtaaaattctcttcttcccttgcgttgagttctttgctgttcaatcgccatggcttcaaagcggattttgaaagaactcaaggatttgcacaaagatccacccacttctgtgcagggctgccccactagctgaagacatgtttcattggccagcaacaatcatgggaccctcagatagcccttatgctggaggtctggttttagacactatccatttccctccagattatcctttcaagcctgctaacgtcgcgtttacgaccaaagtctttcatcccaacatcaacagcaat

SEQ ID NO: 22657 - DNA, 368 bp, Gossypium hirsutum
  Clone ID: LIB3272-014-P1-K1-H5
tgactcaacattcccatttccaatctccagctcccaaggtaaatatgccgatcagaaacatagcggttggccggcccgaagaggctactcaccccgatgctctcaaggctgctttggctgagttcatctcaaccttgatcttcgttttcgctggatcgggctcaggaatggcctttaacaagttgactgacaacggagcaaccaccccggctggtctcgtagccgccgctctagctcatggcttcggtcttttcgtcgctgtctccgttggcgccaacatctcaggtggccacgtcaaccctgccgtcaccttcggtgcttttgttggcgggaacatcactctcttgcgcggcattctttactggatc

SEQ ID NO: 22658 - DNA, 365 bp, Gossypium hirsutum
  Clone ID: LIB3272-014-P1-K1-H7
gtcgctcagaggacaacctttggtatgtttatgcggtaaacatatagcagctgctacctttctttgggatggtctcacttgactgaaaatagcttttaatgctctatgcgccataatccaaattctaacaagaaactgaaccattagagttacattagatagatatatcaatattgataggattctgtgcagaacgtgtcgtcggacaacacaaaaatggagctgacaaatttgcataacacatgttaagggggacttacagtgctaggaatgaacacagctcttgcagaatgctatgatgaaaaacatacggagatctttacttcaaggggggggcgcggtctctacctcaaatttagatattg

SEQ ID NO: 22659 - DNA, 406 bp, Gossypium hirsutum
  unsure (1)..(406): unsure at all n locations
  Clone ID: LIB3272-014-P1-K1-H8
attagatatggttttgaatgtgacataataaataaacacaccgatcttcgtccagaaaacatgaaaaattcggtgggttttgttttaattcttgttttttcatagtttagttccactttttgttgttgttttggggttcagattcaattcaatctgttgctgagttcacccttcaatgttgcttggtatataaagtggctttaggagaggaatcatcaaacatggttcataaactggaagctatccatggcggtggtggatcaattaagttggggactaaagggacaattagttcccttatgacaaaggaactagattccattaaaacaccaaagcaaacaccacctagacacaaatctcangcgattcctgcatgggttgcctgttcttcaacgactctaaaacg

SEQ ID NO: 22660 - DNA, 409 bp, Gossypium hirsutum
  Clone ID: LIB3272-014-P1-K1-H9
aaaaaaacttcatcttctttcttttttctctgggtttgcccagaaaccggcgaggagccagccgtccgccgctgtgtcgtccgccatgccagctaacgtacacgatggccgaaaatcgccccgaggtgcttgtggcggtggacttaatggggcggtgctgcagcaaagacggtggccaggcaagtggtgatgggacagggaggcaacagctagggtttgttgttcttttcgttttaggttttgaattgggctgctgttgagttttgagtttagtaggttttgaggttattggcttagtgagttttggggttttgggcccaaaattggacttgtacaaacataatttgttgagaaaaagtggcttttcagaataagccttttggactacaaaatataaaataaaataaaa

SEQ ID NO: 22661 - DNA, 426 bp, Gossypium hirsutum
  Clone ID: LIB3272-015-P1-K1-A10
caaagcttcatattatcttttttagttccgacaaaagaaaacgaaaaaaaagaagaagaaatacaatcgttttctttttgaagtcgggttttagtttttggggtgaaaaaaatgttgggagtatttagcagtgcgatagtgtctccgccggacgagctggtggcggccggttgccgaactccatcacctaagataacggcggacgctctggtgaaacggttccttgagacgaactcctccggcgtgtccatgcacatcggagaccatgtccaattcgcttattctcaccataaagagtctcctttacagcccagatcatttgctgtgaaagacgaaatcttctgcttgtttgagggagcccttgataacttggggagtttaaagcagcaatatggtctggcaaagtcagcaaatgaagtgatattg

SEQ ID NO: 22662 - DNA, 425 bp, Gossypium hirsutum
  Clone ID: LIB3272-015-P1-K1-A11
cttctcccttttaaaccgctctccttcgccgccgcttaatttcctaaacgccgaaacccccaaccccatttccaacattacaaatggcttccttcaccatttcttcgccgtctaaatcgtcgtcgtttttgtcttcttctttatcttctctcttcactccttcctctcttagccgtaaaagcttcgctttcaatatctctcgttctcctatctgcgctcccaacagtttgaaatgtgaactgcctcaacctgtgaattatgaaaatgggataccaacgatcccagtcctcaatgaaaggatactgcccaagttcgtggaatcaaatcgaatggataaagctgttaacagaaatggtgccaagctcaaattgttttctggcaccgccaatcccgcactttctcaggaaattgcttggtacatgggc

SEQ ID NO: 22663 - DNA, 426 bp, Gossypium hirsutum
  Clone ID: LIB3272-015-P1-K1-A12
gtctttccctccctccctctcagatcaaagcttcaaaatggcatttgtcaaggctcagaaaaccaaagcttactttaagcggtttcaggttccatacaaaagaaggagagagggaaagactgactaccgggctaggattcgcctaatcaatcaagacaagaataagtacaacactccgaagtaccgattcgttgtccgatttagcaacaaagatgtcaccgcacaaatagtttctgctaatattgctggtgatatggttcttgcttctgcttactcacatgagcttccacgatatgggcttgaagtgggtcttacaaactatgccgcagcttattgcactggtttgcttgtggggcgccgcgtgcttaagatgcttgaaatggatgaagagtatcagggcaatgtagaggctactggagaggactt

SEQ ID NO: 22664 - DNA, 157 bp, Gossypium hirsutum
  Clone ID: LIB3272-015-P1-K1-A2
gaagcttttgtagacctggtcaagcgcattttgattaaaggttggttgggcgttggagctcaaaggtgtaccatatgaagcaattgattaagatctgtgcaaccagaacgctttgcctcttcagttttaccctggccaccagaaaattccaggtttt

SEQ ID NO: 22665 - DNA, 393 bp, Gossypium hirsutum
  Clone ID: LIB3272-015-P1-K1-A3
tttgctttgaagatcatgttggctatttttcacaaggcatttgctaatccaccagaggagctgaatagtccagcttctcataaatctactaagaagcctaaacagcctgaagaaaccctaaatgatttcctatctcatcaccctcacaacactttctccatgagctttggcaacgctgctgttttggcttatgtccgccatgaacgtgctgcttcagttcatcagaggttgttttgtgggtttgatgacatatactgccttttcttagggagcttgaacaatctatttatgctgaatagacagtatggtctttccaaagggagcaatgaggcgatgtttgtgattgaagcatataggacactaagggataggggtccataccctgctgatcag

SEQ ID NO: 22666 - DNA, 429 bp, Gossypium hirsutum
  Clone ID: LIB3272-015-P1-K1-A4
tgaattctttccttcactttctcgagaaaaaaaaaatgtcttcaggttgcaattgcggatctagctgcagctgcggatctggctgcaattgcggtgagaactgctcaatgaaccttaaccttggatactcggagaagacaaccagcactcagaccatcatctccggagttgcgccagtgaagatgacctttgagggaccagagatgggcactactgaatcaggacatggatgcagctgtggatcaagctgcaaatgtaatccatgcacctgttgaaaagcttgatgaaagccatagattatgaaaaaagaaagcagcaaaataacaggcctctgtaatgatttattttcaaggatggatgcctgcaaggtctataattatgtctctctctgtcttgtgtaatagaagacttgtttgtggtgaaaataat

SEQ ID NO: 22667 - DNA, 235 bp, Gossypium hirsutum
  Clone ID: LIB3272-015-P1-K1-A5
caacgagctcatgctacggctattcatagagttttgtgagtgttctctctctattttcttttaccttcctgcatcatttgagtttcgacgaatggttgcttattcatgcaatttatccatatttctgggtttcttcgtttgcatttcttcccatggcccctttttttgggcgagaaggtgatcagtcaatgtttgttactttgatatggaccatgaaatttgagtgtttcgtgct

SEQ ID NO: 22668 - DNA, 425 bp, Gossypium hirsutum
  unsure (1)..(425): unsure at all n locations
  Clone ID: LIB3272-015-P1-K1-A6
attgcttctgattggaagaagaatgagcacatgacagaagatatgttctgtcacgaattccatcttgtcgatcttcgagtgatggaaaattgcttgaaggttaccaatggagtggatcatgttttcaacctcgccgctgatatgggtggcatgggcttcatccagtccaaccactcggtcattatgtacaacaacacaatgataagtttcaacatgctcgaggctgctcgaatcagtggagttaagaggtttttttacgcctccagtgcttgtatctatcctgaatttaagcaattggaaactaatgtgagcttgaaagaatccgatgcctggcctgctgagccacaagatgcttacggcttggagaagcttgcaacggatgagttgtgcaagcactacaccaaagacttcngaattgaatgtcg

SEQ ID NO: 22669 - DNA, 195 bp, Gossypium hirsutum
  Clone ID: LIB3272-015-P1-K1-A8
cacccaattcacatttcccaaacccttagtttgacttgatcgccaaaatcctcaaacctacagcttcgtcctttgccgttcgatcaaaactcctttataaaacaaaattgttacgaaagatatcatcgaaaagcttagcgatgccgtcccacggcgatctataccgtgagatcgaacacttaatgcagtgcaagc

SEQ ID NO: 22670 - DNA, 405 bp, Gossypium hirsutum
  Clone ID: LIB3272-015-P1-K1-A9
tgccctcaactcttctccaaactcatcctcatcggcgcttctcccaggtttctcaatgacgaaaattaccacggagggttcgagctaggcgagattgaggaagtattttcagcaatggaagccaattacgaagcttgggtaaacgggtttgccccagtgttggtgggggccgatgtgccgacggcggttcgagagttcagccggacacttttcaacatgagaccggacatatcattgttcgtttcaaggacgatattcaacagtgatctgagaggggaactcgggaaagtgagagtgccgtgttgcgtgatccagacggcgaaagatgtgtcggttccggcatcggtggcggagtatttaaagacccatcttgggggacgaaccacggtggagattttgagaaca

SEQ ID NO: 22671 - DNA, 405 bp, Gossypium hirsutum
  Clone ID: LIB3272-015-P1-K1-B1
ctctctgtagccgccgcctgcgtctctctcttcatctctgtgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgaaggttgttgacattgctgacactttcaggcttcaggagcaaccccctttcgacacgatgcagtgtgtcgtgttcatcaagaagttcatcaagaacttgacaccaaaactggatgcggaaaagcaagagt

SEQ ID NO: 22672 - DNA, 421 bp, Gossypium hirsutum
  Clone ID: LIB3272-015-P1-K1-B10
ggagacctggaaagatagttgataaggccacagctgaacacttattcgaagtgatcaattcgagagaggatgtgttgaggagactgattaggcggtgtgcttacttgaagtatgttgaggcaagattaggcgataggactctgtatgcagatgagattttgaaagatggtttctgcttgaatatgattgacactcctctttgccctttaaaggttgttactaacttgcaagaagctgtttgggatgctgatattgtaattaatggcttgccatcaaccgaaactcgcgtggtgtttgaggaaattagaaggtattggaaagaaagaataacagtgcccataatcatatctctggcaaagggtatagaagctgagttggagcctgaacctcgcataataactcctaccctgatgatcagtcg

SEQ ID NO: 22673 - DNA, 423 bp, Gossypium hirsutum
  Clone ID: LIB3272-015-P1-K1-B11
gtttttccttctataactcacaacacttttttttttctctcaagctcgctaacgttttcagcacacactcaattcatttttcatgagactctacttacatttttataagcatagtaaatcgacttaaactttatcatgccttaccgtctaagattgttcaagctgctgccatcattatcctttgtccttgatttttcatgaaattcggcaggccacgttttctatgaggttgaaagccaattggataaaaattctttggctgcaatttttatgctgaaagtcggtttgttttctaacacagcctatataaagccattgtttccatactacttgcactcattactcatggaatcccactttgattcccatgttgagcaacataacgaagatgagtttcagaaatctttcaaagagatgatttct

SEQ ID NO: 22674 - DNA, 272 bp, Gossypium hirsutum
  Clone ID: LIB3272-015-P1-K1-B12
gcaaaaaggaagtacgtctaaaacagtaacacatttgatacatttttgatcaatttcactgccatggcaactcaaacaccccatatcatcattcatccgagtcctggtatgggtcacctaatcccactcattgagttctctaaacgactcgttcaccaccacagtttaaccatcaccggtcgtattcccaaccgccggttctttaacaccacttaaaaaatcgccgttggatcccttcccgccctcatttattaccttttttttccttccgg

SEQ ID NO: 22675 - DNA, 284 bp, Gossypium hirsutum
  Clone ID: LIB3272-015-P1-K1-B2
atcccaagatcccatcatcttcttcgtcaagcctcgaaagaagatggagagagaagacacgaagtctctaacttcagctttgattcacataacgccagaaaacgatgatttcactctacaacaagcagtgagcagcaatggaattaatgaagtcagaagaaagaaaatatgggatgaagcgaagaaacaagtttggctggcaggtcctctgataggggtgagcctattccagtactgcatacagatgacatcagttatgttggacgacatgctggagagctagc

SEQ ID NO: 22676 - DNA, 311 bp, Gossypium hirsutum
  Clone ID: LIB3272-015-P1-K1-B3
cggacgcgttgttggacatggaggtggttgaagaagctgacaaggctggcatagcatgccgttgtaaagccattagtcctcatcttgatcaactgaccaaactcagtttagactcttaatgatcgaaactgacgaagcgcgtagtttaggaacaaaagagcagattatgtttttagggaccttggcagcgacagatgatagtccaagaaaatctcatgaacatggcctgactatatattctttgatactgccaagagctcaactactttataacccagactagctcaaggctaccctcattctaacctatc

SEQ ID NO: 22677 - DNA, 202 bp, Gossypium hirsutum
  Clone ID: LIB3272-015-P1-K1-B4
gggagccaagattgcaaatgaagtcttatttggtgctttaaaataagttcataagctagtaggaggcctgaaatagggtatcttgaatttagaagctcgagtttcttttggatagagatcaagtatgtatgaactgttaagttgaacatttttttttttgagccttgttaagttgaacatttactcttacatggtgggcctt

SEQ ID NO: 22678 - DNA, 414 bp, Gossypium hirsutum
  Clone ID: LIB3272-015-P1-K1-B5
tttgtttgcaaaagccagcgccctctatttccagctccgtttctccaacagttccgttcccaccgccgcaccgtcgatttccacctgagtttctccgtccatggctgcaacggactctcctctaacgaccaaggtttgtatcattgggagtggccccgccgctcacacggccgctatctacgctgctcgtgctgagctcaagcctattctttttgagggatggatggctaacgatattgcgcctggtggtcagcttaccaccacttccgacgtcgagaacttccctggattcccggatggtatcatgggttcggagcttatggagcggtgccggaaccagtcgcttcggtttggtactactatctttaccgaaactgttgacaaggttgatttttcttcgtctgcgtataagat

SEQ ID NO: 22679 - DNA, 392 bp, Gossypium hirsutum
  unsure (1)..(392): unsure at all n locations
  Clone ID: LIB3272-015-P1-K1-B6
cgatctccttacagttaccgtacacactcacacacacattcactgaatgggtcgagtcatccgagctcaacgtaagggtgctggttccgtattcaaggcccacacccaccaccgtatgggtcctgctcggttccgcagcctaatacttcggtgaacgaaatggctaccttaagggtgttgtgaccgatgtcatccactaccctggtcgntgctctcctttagcccgtgttgtctctcgttaccctttacgttacaagaagcagaaggaacttctcgttgccgcacagggtatgtacactggacagttcctctattgtggtaagaaagctactcttgtggtcggaaatgtattgcctcttagatctatacctgaatgagctgtcgattgcaac

SEQ ID NO: 22680 - DNA, 313 bp, Gossypium hirsutum
  Clone ID: LIB3272-015-P1-K1-B7
gttatctctgagggtgtcttaataaacgccttcgatttactttcggtttccatttacttctttatttctacgtttttgaatttttagtaagcgaaaatgagagagtgcatttcagttcacatcggtcaggctggtatccaagtcggaaatgcctgctgggagctttactgccttgaacatggaatccagcctgatggccagatgccaagtgacaagactgtcggaggaggtgatgatgcttttaacacctttttcagtgaaactggtgctggaaagcacgtccctcgtgctggctttggggatcttgagccta

SEQ ID NO: 22681 - DNA, 427 bp, Gossypium hirsutum
  Clone ID: LIB3272-015-P1-K1-B8
ctactcttaaccatgcaataccaagccccttttctctttcatcgaattctatagaggttcttcaggcttaaccttcaagcagaggaaattgagtcagaaaacaagttccatatggcctggaaatgatcatctccaatctgaaaaaaagtcaagtctggtttattagatggtgaaaagcggagaagaaacattggacagtgtgaccaacaggaggtccattgccatgggtaagcatcaggagggaacaatcatgagcaagaagccagtcaaagcttcagcagttgtggtatcacatgttgatgagaaggaacaatcacatccaggtacaggttctgcagattctgaagttagctccaaatgcattgtttgctcaggaaacaacagttgccagactgttcgtgcaagaacaaaactaatgaacattttg

SEQ ID NO: 22682 - DNA, 417 bp, Gossypium hirsutum
  Clone ID: LIB3272-015-P1-K1-B9
cggttgccccacggggaagagggaaaacctgaaaagggggaaaaaacgcggcggcgtttgcgctccttcttcttctttctccttccccctctctctttctcagaagctcctctttcgttcttttgttcactaagtattgtaaaagatggccgacggtgaggatattcaacccctcgtctgtgataatggaactggaatggtgaaggccggttttgctggtgatgatgctccaagggcagtttttcccagtatcgttggtcgtccccgacacactggtgttatggttgggatgggtcagaaggatgcctatgtaggagatgaagcacaatctaaaagaggtatccttactttgaaatatcctattgagcatggtattgtgagcaactgggatgatatggaaaagatctggcatcatac

SEQ ID NO: 22683 - DNA, 424 bp, Gossypium hirsutum
  Clone ID: LIB3272-015-P1-K1-C10
attttccatgccttgtccaagcggaatcctcctcttcctcatcctaatctccctcccagcttcttcattcgccgtagccgatgacgacaatctatccgcgtaccaagctcttcaacagtacgacttcccagtaggcatccttcccaatggcgtggttgggtacgaattgaacagggaaacgggcgagttttcagcttatttgagtggaacctgcaagtttgacattgattcataccaactcagttacgaatccaccataaaaggagtgatctccccaggcaggataacaaatttgaagggagtgagcgttaagatcctcttcttctggcttaacatcggtgaagtgatacataatggggaccagatggagttctccgttgggattgcgtcggctaacttccctattgacaacttttatgaatct

SEQ ID NO: 22684 - DNA, 405 bp, Gossypium hirsutum
  Clone ID: LIB3272-015-P1-K1-C11
ctcatctacgcaagccccctggcgacatacgaacattgagcacaacgtacaaaatgatcttgggcgctccccaggtcgattaattcatgttgtatctttcatcgtctttggtcatcccaacctacagctcatactcggtgggttggaacagagcataaccggattatcttgctcgcccacattgaccctaaactatcgaggtttgatatcacaggctgcccacccttacttgtaaacgaagtgccagtttctgctagattggctaacccacgtgtatgagattggccttatcttatcaccaggggtgcaatgactctgcatacataccacggctggtttagcctgtaactaatataccgcattcctcgtgcacatctgcaaggacgtctactctttctttaaaac

SEQ ID NO: 22685 - DNA, 425 bp, Gossypium hirsutum
  Clone ID: LIB3272-015-P1-K1-C12
gttttaggctccctttgcagacaattatagctacgagagtttaaactgacccagagcttcaaacttaatcatggggattgcaagggcgcaagatgaagagagtgaaagaagggagtttgaagacttcaggaagactttagttgctttggctgccacggaaagaagcaaagaaaatgacgacttcaaaggcctaacgagttcccatatcgccgaccttgatcttcaactagacaagcttgtttgtgtgaccagtggcgtttctttccttgggcttgccttagttaatcgtcttttgctccgtggatactctgttcgaatccttgtggataaccaagaagatgtagagaagctgagggagatgcaagtttcaggggagatgatgatggcttgtaacaataaaatatcagtggtaatagctaagcaaa

SEQ ID NO: 22686 - DNA, 328 bp, Gossypium hirsutum
  Clone ID: LIB3272-015-P1-K1-C2
gttagtgaatccaccccaagagctgcagagtccagcttcactcacttcatcaatgaagcctaagcttccctttgaaatccttaatggttttgtctcttcaaatcccaccaacgctttttcaatgcgggttggatcttcggcttctttggcttattgtccaacccaacattccttcctccacttataaaaggttgtttagtggagtggatgaaatgcattgcatattcatgggtaatttgaacaatctatgtagcctcttaaggcaatatggtctatcaaggggcaccaatgaagcaatgttcatcattgaggcatataggccccttag

SEQ ID NO: 22687 - DNA, 190 bp, Gossypium hirsutum
  Clone ID: LIB3272-015-P1-K1-C4
gggaccactgttctacacagtacggcagccaggtgaatctcatgagatccggcaccctactaatttgaagctgggtctgaccttggtcattcaagaatcacaagacactgtctttgcaatccgaaagctacctttgacgaaagcataatggtacttcgaagatgttattgcccacaagcacgcaattgca

SEQ ID NO: 22688 - DNA, 322 bp, Gossypium hirsutum
  Clone ID: LIB3272-015-P1-K1-C5
gcacgagccatgaaagggtattgtgataaatttcctgaaccatcacgcgtcggctgacggaatctttagattgtacgaagacttccgagagagcctagcgaagagtcatgtcttatgtttaacggcctgtcaaccctggaaacgggtcatacggaagaagggtccaacgttcagaagagcacctcacgttgcgtggtgtacgctgcgcccccgactggcccttgaaaataccgacgaccgtgtgccgtgcgagcctactcgtactcataaccagatccatgtctacaaggacgtacagactctgacccatggaacaatgtag

SEQ ID NO: 22689 - DNA, 427 bp, Gossypium hirsutum
  Clone ID: LIB3272-015-P1-K1-C6
ctcaattatccatttattcttttctttcaactcaaagtcccaagtagtattagaatcatgggtgttgtcacttataactatgactctacctcccctgtcgctcccgccaggcttttcaaggccttcgttcttgaagctgacaaggtctggcccatagctgcccctcatgcaatcaagagtattgaggttgaagctaatcctggccctggaagtatcgtaaagatcaactttgttgaaggccttccattccaatatatgaagcaccagattggaggacatgatgaaaacaaattttcatacagttacagtttgattgaaggtgggcctttgggggacaagcttgagaaaatcaactacgagaataagtttgaggcaactgtaggtggaggaagtgtgtgcaagagctcgatgaaattttacacttttg

SEQ ID NO: 22690 - DNA, 422 bp, Gossypium hirsutum
  Clone ID: LIB3272-015-P1-K1-C7
aagcaaagcagtaaaaagaaaaagtagcgaaatggctgacgtcgctccgggaaacgccggcggtcaatttggagattttccgacgattcatacacatggaggtcagtttattcagtataatatttttggaaatttgttcgaggtgacgtctaagtatcggcctccgatcatgccgatcggtcgtggagcctacggcatcgtttgctcggtgttgaattcggagacaaacgagatggttgcggtaaagaaaatcgccaacgcttttgataatcacatggatgctaagcgcacgcttcgtgagattaaactccttcgacatttggatcacgaaaacgttattggaatcaaagatgtgattcctccgcctttaaggagggaatttactgattgttacattgcgactgagctcatggataccgatc

SEQ ID NO: 22691 - DNA, 422 bp, Gossypium hirsutum
  Clone ID: LIB3272-015-P1-K1-C8
cccacagtcagttgtttcaccattcaagaactctgttgtagctgagcctgagaagcagaaaaccgagtttttcagtaggaactcgggtggtttgttgtcaaatgggtccgaggttaacaaaaaggaagagaattccattggtgttcttgaggtttatgttcatcaggcaagagatatccataacatctgcatttaccacaagcaggatgtgtatgctaagctttgtctcacctctgaccccgaaagcacggtttccaccaagatcatcaatggtggtgggaggaacccggtgttcaatgataatctacgcctcaatgttcgaactgttgattcctccctcaaaatcgagatattcatgatgagtagagtgaggaattatcttgaagaccagttgttgggatttgcattggtgccactgtctg

SEQ ID NO: 22692 - DNA, 423 bp, Gossypium hirsutum
  Clone ID: LIB3272-015-P1-K1-C9
cttcttcaatctaagcttctcagagacttaaaatggctcgcaagaagatcagagaatacgattccaagagacttctcaaacaacacctcaaacgcgtcgctaatatcgacctccaaatctgttctgctcaggtgactcaatctactgatttcaccgagttaacgaacgaacaaccatggctttcgtccaccagattagttgttaagccggatatgttgtttggtaaacgtgggaagagtggcttggttgctctcaatttggatcttgctgaagttgctgaattcgtcaaagctcgcctcggcactgaggttgaaatgggcggttgcaaagctcctataaccacattcattgttgaaccttttgtaccccatgaacaagagtattacctttcaatagtctctgaaaggcttggttttaccatta

SEQ ID NO: 22693 - DNA, 285 bp, Gossypium hirsutum
  Clone ID: LIB3272-015-P1-K1-D1
tactcctctgtcctatccctctatttactgcgaaaaaaaaattgggacagggggacgaacaaccttgaattcgacgacgcactcaaaccatgtcttacgactatatttgtaagtacataatcattggtgacactggtggaggaaagtcatgtttgctttagcggtgtacagacaagagatcccaaccagttcatgatctaaccatcggtgttgaatttggtgctaggatggtcaccatagatggcaggcccatcaagcttcagatttgggattccggtgggcaag

SEQ ID NO: 22694 - DNA, 422 bp, Gossypium hirsutum
  Clone ID: LIB3272-015-P1-K1-D10
ggtagatcttctttcaaccgcgcctaataaccgctcggatttttctcagacgtgaaaaaaatggggctgtctttcaccaagctattcagccggctatttgccaaaaaggagatgcgtatactgatggttgggcttgatgctgctggtaaaaccaccattctttacaagctgaagttgggagagattgtcactaccattcccaccatcggtttcaatgttgagaccgttgaatacaagaacatcagcttcactgtttgggatgttggtggccaggacaagatccgaccattgtggagacactatttccaaaacatgcaaggacttattttcgtggttgatagcaatgatcgtgaccgtgtggttgaagctagagatgagttgcacaggatgttgaatgaagatgagttgagggatgctgtgct

SEQ ID NO: 22695 - DNA, 425 bp, Gossypium hirsutum
  Clone ID: LIB3272-015-P1-K1-D12
ctaatacacccactgtaaaaaaaagagagaaatctgatcagacggtgaaaatgggtagccttgaaactgagagaacaaccacaggatgggctgccagagatccttcaggagtattgtctccttacacttacactcttaggaacactggtcctgaggatgttttcgttaaggttatgtgctgtggaatctgccacactgatcttcatcaagccaaaaatgatcttggcatgtcaaactacccaatggttcctgggcatgaagtggttggtgaggtgttggaagttgggtcagatgtaagcaagttcagagttggtgatattgttggtgttggttgtcttgttggatgttgcagaaactgccgaccatgcgactcagacaatgaacaatactgtctcaagaagatctggtcgtacaatgatgtttac

SEQ ID NO: 22696 - DNA, 407 bp, Gossypium hirsutum
  unsure (1)..(407): unsure at all n locations
  Clone ID: LIB3272-015-P1-K1-D2
ctctcttactattataatctctcttctgctttgtcgccacgatttcagcttcagatcgcttctatttcttagcttgaagctaatactgcagaatgggcaaggaaaagactcacattaacattgtcgtaattggccatgtcgactctggaaagtcaaccaccactggccacttgatctacaagcttggaggtattgacaagcgtgtcattgaaaggtttgagaaggaagctgccgagatgaacaagaggtcattcaagtatgcttgggtgcttgacaagttgaaggctgagcgtgaacgtggtattaccattgacattgccctgtggaagtttgagaccaccaaatattactgcactgtcatcgatgcccctggacatcgtgactntatcaagaacatgattactggt

SEQ ID NO: 22697 - DNA, 426 bp, Gossypium hirsutum
  Clone ID: LIB3272-015-P1-K1-D4
ataatatatatagcctcggagatcggaccctataagtcgccggataatcatcgacgactgcccgagactccgccggagtcaccggaaaagtacttcttacggtttctacggcgagagaggggatttgaatatattggccgtgttttggttttcgatggcttcggaggatgtgaagactagtgaatcagctgtttcgacgatcgtgaatttagctgaagaagcgaagctcgctagagaaggcgttaaagctcctagttatgctgttcttagtatctgcaagtctctcgttgccggcggcgttgctggtggagtgtcacgaactgccgttgctcctttggaacgtttaaaaatcttacttcaggttcagaatccacatagtgtaaaatacaatggaacaattcaaggcttgaagtacatttggagaac

SEQ ID NO: 22698 - DNA, 428 bp, Gossypium hirsutum
  Clone ID: LIB3272-015-P1-K1-D5
gaaagtttcaatggcaaccctcaaagttccagttcacgttccttctccttctgaggatgctgagcaacttcggaaagcttttgaaggctggggtacgaacgagcaattgattatcgacatattggctcacaggaatgcagcacagcgcaattcaattcggaaagtttatggtgaagcttatggggaagatcttctcaagtgtttggagaaggaacttacaagtgatttcgagcgggctgtgctgctttttacgttggaccctgcagagcgagatgctcatctggctaatgaagctacaaagaagttcacatcaagcaattggattctcatggagatagcttgcagtaggtcttcgcatgaactactcaatgtgaaaaaggcgtatcatgctcgttataagaaatcccttgaagaagatgttgctcacc

SEQ ID NO: 22699 - DNA, 430 bp, Gossypium hirsutum
  Clone ID: LIB3272-015-P1-K1-D6
tctttaccttaatcaaagctttgactactaatcctattataaatttacactcaccgctctcaggatctaccagaaaatcgactaatctcccaaccatggcggtcgtgaaactattcggagcttggcttagtccgtacgtttacaaagtaatttgggctctgaaactcaaaggcataccttacgaatacatcgaagaagatctctccaacaaaagtcctttgcttcttcaatataatccaattcataagaaagtcccggtgctcgttcatgacggaaaaccgatctacgaatccaccgtcatccttcgatatatcgatgaaatttggccgcaaaatcccttgctgccggctaatccctatgacagagccgttgctctgttttggatcaaatttgccgatgacaagaatcctataatcgcaaagctttatcg

SEQ ID NO: 22700 - DNA, 365 bp, Gossypium hirsutum
  Clone ID: LIB3272-015-P1-K1-D7
ctaacgtattctttgaatattatttctataataatatcaaagccctccctgtttttctctgattttccctcattttccgggaaaatcttttttcttcctcattccgctaatctcatttactttcttgattccttatttttattttcttctttttttttgtgtttcaagatctgcatggtgaagtccattttcgcagcataaattttgttcctttacatagaaaggaaaaatccaactttaaatctattaaaaatattcttctgaagggatcggcgtggggattttggaggttaagggtaaaacggaagtgctgctcccgttgtaattgagtcctctactgcttcttttgagggaggagcccgggc

SEQ ID NO: 22701 - DNA, 422 bp, Gossypium hirsutum
  Clone ID: LIB3272-015-P1-K1-D9
gggtggagaagacgagagctcatctctctgcttcaaagctcctgtccgggttgaattctcttcttcctttgcgttgtgttctttgttgttcaatcgccatggcttcaaagcggattttgaaggaactcaaggatttgcagaaagatccacccacttcttgtagtgctggtccagtagctgaagacatgtttcattggcaagcaacaatcatgggaccctcagatagcccttatgctggaggtgtgtttttagttactatccatttccctccagattatcctttcaagcctcctaaggttgcgtttaggaccaaggtcttccatcccaacatcaacagcaatggaagcatttgtcttgatatcctcaaagaacaatggagccctgcactaaccatttccaaggttctgctctcaatctgctcg

SEQ ID NO: 22702 - DNA, 401 bp, Gossypium hirsutum
  Clone ID: LIB3272-015-P1-K1-E1
ttctatagaggtctgctctgctcaacatcctatctctttctctcgaccaaagactcagatccacgcgtgaatctttgttccagcttgttagaatggagacatttctattcacatctgagtctgtcaacgagggtcaccctgacaagctttgtgaccagatctctgatgctgtgctcgatgcctgccttgcccaggaccctgacagcaaggttgcctgtgaaacatgctccaagaccaacatggtcatggtctttggagaaattaccaccaaagctaatgtagactatgagaagattgtgcgtgacacgtgccgcaacattggatttgtttctgatgatgtgggtcttgatgctgacaactgcaaggtcctggtcaatattgagcagcagagccctgatatt

SEQ ID NO: 22703 - DNA, 416 bp, Gossypium hirsutum
  Clone ID: LIB3272-015-P1-K1-E10
tggaaacagtattacagagattaaagatcatcgaacaagaaataagagatttgaaacaggagattcagggaatgaggtattatgagcacagacttctaatcgagcttcaccgtaaagtgaactaccttgtgaactttaatgttcacgtcgaaggacggaaagttcccaacatgttctattttgttcaaactgaaaactactcgaggagattggtaaccaccgttatttccggcatgactgctcttcggttgcacatgttatgtgaattcaggagagaaatgcatgttgttgaagatcaagttggttgtgaagtaatgcacgtagataacactgttgtaaaatgcttagctccatacatgaccaagttcatgaaactggtcacatttgctctcaaaatcggagcacatttagcagcc

SEQ ID NO: 22704 - DNA, 422 bp, Gossypium hirsutum
  Clone ID: LIB3272-015-P1-K1-E11
ctttatctccttcaattgtttgtttttgggttagaaagctctgtttttttattaccctttttcatcaaaaagcttcaatctttcaaccatgttgcttaaagcttcccctgctttttctttgttgaagaatccccaagttgaaactcgggttcctctgttttcaagaaacggttctggggttgggtctggggctgttgttgtttgtgctaccaaaggagccaataataagccattaacaggtgtgatttttgagccttttgaggaagttaagaaggaacttaatcttgtcccaactgtgcctcaaatgtccttggctcgtcaaaagtttgctgatgagtgtgaagctgccatcaacgaacaaatcaatgtggagtacaatgtttcatatgtctaccatgctatgtttgcctattttgataggg

SEQ ID NO: 22705 - DNA, 235 bp, Gossypium hirsutum; identical to SEQ ID NO: 22667
  Clone ID: LIB3272-015-P1-K1-E3

SEQ ID NO: 22706 - DNA, 425 bp, Gossypium hirsutum
  Clone ID: LIB3272-015-P1-K1-E4
cacagatcgtcaaagcttgtctgaatggaaagtatttgccattgaactgcccaaaaacgaaaatcaacaaggtatgtgaagaagcagcaagaactttggtgattcaattggatggagtcttgcaactgtatcgagccacaatggcctccggatgacctgttgatgaaatatcaatatatttctgatttcttcattgcacttgcttatttctcgatccccttagagcttatatacttcgtcaaaaaatctgctgtctttccatatagatgggtccttgtgcagtttggtgcttttatagtactttgtggtgcaactcatcttattaacctgtggacttttacggtgcattcaagaaccgtggcgtcagtaatgactactgcaaaagttttgactgctgctgtatcgtgcataactgccttgatgct

SEQ ID NO: 22707 - DNA, 428 bp, Gossypium hirsutum
  Clone ID: LIB3272-015-P1-K1-E5
cttctacctttttaactctaaagccaagaaagcaagccactaaggttttgagagaagatcaaaatggcttctaaaagatcagcttccatggtcctccttttggcactcaacattctctttttttccctagtcagtgcttgtggctcttgctcttcacccacccctaaaccaaggccaaacccaaaccccaacacccccactcctactccatctgcacgaggcaggtgccctagggatgccctcaaattaggtgtatgtgccaatgtgcttaacctagtcaatgtcaccgttggttcacccccagtgatgccatgctgttcccttctcaatggccttgtcgacctcgaagctgctgcatgcctttgcaccgctatcagagcaaacattttaggcatcaacctcaacatcccaatttcccttagcttgct

SEQ ID NO: 22708 - DNA, 427 bp, Gossypium hirsutum
  Clone ID: LIB3272-015-P1-K1-E6
caaatggtggttataatggggcttatgctgatatagatgaaaatgggtcattttatggggattctacttggctcccttcacccttagacctacagcgatctagttcttttggttttggcccgggaaactcaacttcagatgttaggagtaatagctctactggctacattggtggttatggtgttcccaatatgcagtcagatagaggaattgctgcataggaggaggatgaagctatgatgtcaaattgtaggaaatttgtatggtggagctggttaatgactgtgatttctacatttcctttgtgaaaatatttcagttttatatggcaaaaaatatgagtagagctaatttggttcaccttgtttgatgaaaaaacttgatatagagatcagttgcaaaggattcatgtaaggtttgagctttt

SEQ ID NO: 22709 - DNA, 422 bp, Gossypium hirsutum
  Clone ID: LIB3272-015-P1-K1-E7
atttttcttctttgcttctcttccttttaaacttagaaacaaaacatctagtagcattagaatcatgggtgttgtgagttatgagtttgaggtaacctccccaattgctccagccaggcttttcaaggcttttgttcttgaggctgccaagatttggcccacggctgcccctcatgcagtcaagagtgttgagctcgaaggtgatgctagtcctggaagtattgtaaagatcacctttgttgaaggccttccataccaatatatgaagcaccagattggaggacatgacgaaaacaatttttcatacagttacagtatgattgaaggtgggcctttaggggacaagcttgagaaaatcagctatgagaaccagtttgtggcagctgcagacggaggaagcatttgcaagagctcaataaaat

SEQ ID NO: 22710 - DNA, 398 bp, Gossypium hirsutum
  Clone ID: LIB3272-015-P1-K1-E8
caaaaccgagagatatattcccaaacatgtctaaagcctgcttgcttttgtttctcgttggagtggtggtttttatcatcactccttctctagctaaccaacatcatgataatgagcttcccaaggggaagcctttcccaggtgagaagcaaccacaacacaagccattccctgaacaccgaccgccaatacacagtggacctggcggtaaaggacaggagccaccacatggggaaaaacctcctcatagaaacttattgagtgtggaagttgagggcacacataaacctccacgacattcaggtggtaaacctccaagacactcggggggtaaacctccacatgttgaggggttccctaccgataaagcacccatgaagccattccctggtgaaaaa

SEQ ID NO: 22711 - DNA, 424 bp, Gossypium hirsutum
  Clone ID: LIB3272-015-P1-K1-E9
agaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaaaagcccaccctcggcacctgaacagccaggcacttgccccagagatgcactgaaactaggcgtttgtgctgatttgttgggctcagtgcgcgttgttgttggaccgtcgaggaccaaatgctgctctctcatttcgggtttggctgatctcgatgctgctgtttgcctttgcactgctattaaagctaatgtgttgggggttaacctaaacgttcctgtttcattgtctttgctcctcaattcctgcgaaaagcaaatgcctgctggttacaaatgtgc

SEQ ID NO: 22712 - DNA, 420 bp, Gossypium hirsutum
  Clone ID: LIB3272-015-P1-K1-F1
cactctcccaccccgaccgcttgattttgatcagacggtaatcatgccgatcagaaacatagccgttggccggcctgaagaagctactcacccagatgctcttaaagcagctttagctgagttcatatcaacgttaatcttcgtttttgctggatctggttcaggcatggcttttaataagctgaccgacggcggtgcaacaactccggctggtctcgttgccgcctctctagctcacggatttgcgcttttcgtcgctgtatccgtcggcgctaacatctccggtggccatgtcaatcccgccgttacattcggtgctttcgttggcgggaacattactcttttacgtggtatcctttattggattgctcaactccttggctcaaccgtcgcttgcctgttacttaagttcgccactag

SEQ ID NO: 22713 - DNA, 430 bp, Gossypium hirsutum
  Clone ID: LIB3272-015-P1-K1-F10
cctgtccaaaattgctatcactctctcgtttctatacagattcagaaagaaataaaggaagaagaagcaatggccactcttacagtgcccacgacagttccttcggtgtctgaagattgtgaacagctaagaaaagccttttcaggatggggaactaatgagggcttaatcatagatatattgggtcacagaaatgccgagcaacgaaacttgattcgaaaaacctacgctgaaacctatggagaggatctcctcaaggcactagacaaggagctctcgaatgactttgagaggctggttttgctttgggctcttgatcctgctgaacgtgatgcccttttggctaatgaagccaccaaaaggtggacttcaagcaatcaggtccttatggaaatagcttgcacaaggtctgccaaccaactgcttcacg

SEQ ID NO: 22714 - DNA, 428 bp, Gossypium hirsutum
  Clone ID: LIB3272-015-P1-K1-F11
tcgaaatcgtagctttggaagcatggacttcatagctactatcctgtttctagctcttgtcatctcctccgccaaagctttagacccttgcggctctcagccagatgactcggaccttttggtcatcccaatctatggcaaatgttcaccattcaacccacccaaacctgactcatggttcaacacagtcatgaacatggcatcaaaagacccagcaagggtcaagtacttgtcgagccttctagcccaaaagaccactgcggttcccattgcttcaggccaacaagtcctaaatattggcaactatgtcgtccgggtaaagattggcactccgggtcagctcatgttcatggtattggacactagcaatgatgtggcttgggtcccatgctccggctgcaccaggtgctcagccaccactttctcac

SEQ ID NO: 22715 - DNA, 430 bp, Gossypium hirsutum
  Clone ID: LIB3272-015-P1-K1-F12
cccagcaccaccgaagaactcaagaaacagctccgattagatatgtcaatggtatctacatattgccctcacttcagtgggcttcgccgatcatctcccaacttacacaatgcaccatgtcaatctttccttcaacacttcagctctcaagcccgtctcccttcttctcccaaaccttgcagagctgttattgccatgtccggctctgggaagttctttgttgggggtaactggaaatgtaatggaacaaaagactccaccacgaagcttgtttctgacctgaacagcgcaaagttggagagtgatgttgatgttgttgtggcacctccctttgtctatcttgatcaggtgacttcttcattaactgatcggattgaggtatctgctcagaactcttggattggaaaaggtggggctttcacgggagaaa

SEQ ID NO: 22716 - DNA, 428 bp, Gossypium hirsutum
  Clone ID: LIB3272-015-P1-K1-F3
caattacaagggtatttggaagcctcaagagattccaaaccccgactacgttgagcttgataagcctgactttgagcctattgctgctgttggtattgagatttggacaatgcaagatggcatattgtttgacaatattttgattgccaaaaatgacaaggttgctgagtcatatagggagaccacatggaagcctaagtttgaggttgagaaagaaaaacagaaggctgaggatgagtccactgattcagatggactttcaggcgtccagaagaaggtctttgatgtcctttacaaggttgctgatattcctttcttaagtgaatacaagcttcaaatccttgatctcattgagaaggctgagaaacagccaaacatcaccattggtgtcatcgtctccattttggtgattatcctcacagttctct

SEQ ID NO: 22717 - DNA, 429 bp, Gossypium hirsutum
  Clone ID: LIB3272-015-P1-K1-F5
cgatgccttacctccgcctactgtctgcatcgtcggcagcggcatcggcggttcctccgtcgcccacttcctacgccactacttccatccctccccttcccaacccagacctcccaacatcaagatcttcgagcgtagctacgtcgtcggtggtcgcatggccactgtctccattggcggtgaaacttttgaggctggtgcttcaattcttcaccccaagaactaccacgctcttaactactcgaatcttcttggtttgaaggtcaaaccgccgcctgcctcggaggatgatgattcgatgtcacttgggatctgggatgggaagaaatttgttttcaaaacccttcaagtggattccaagtttccattggtgcagaagattgtttcctatgttaattcttttcgcatctttttccgctatggcttctc

SEQ ID NO: 22718 - DNA, 426 bp, Gossypium hirsutum
  Clone ID: LIB3272-015-P1-K1-F6
cggaaaagggaaagccggtaactggggcatcagacaatcttcgagaatggtggaaggataaagtgaggtttgatcgtaatggtcctgctgctatcgcgaagtaccaggcggataatgcgattcccgggaacaatgatgggtgtaacttgatcggtcctacaccgcacactttacaagaacttcaagatacaactcttggttctcttttatctgcactgatgcagcactgcgatccacctcagaggcggtttcccttagagaaaggtgttcctccgccgtggtggcctacgggaaccgaggaatggtggccgcaactcgggttaccaaaagatcaaggccctccttcttataagaaaccccatgatttgaaaaaggcttggaaagttggggttcttacagccgtaatcaagcatatctcacccgata

SEQ ID NO: 22719 - DNA, 415 bp, Gossypium hirsutum
  Clone ID: LIB3272-015-P1-K1-F7
caaacaaaagcagccccttcttccaatcccactgtcgttgatgatccttacaagcgcctcgaaatcattcttaaccccaatggctcgcttacgcgcaaccctaataggtttcccaacacttcagccatacctgatccggacccaactgtcccggttctctccaaagatatcactatcaaccaaacgacacacacatgggctcgtgtgttcctccccaggcagaaaccgcttggtaggaacaagttccctctcatagtttattaccatgcaggaggattcatccactgcagtgcggcatccacgatcttccatgttttttgctcaaacatggcggtggaactccaagccatcgttgtgtccgtcgactatcgtcgtgcccctgagcataggcttcctgctgcttacgacgatgcta

SEQ ID NO: 22720 - DNA, 420 bp, Gossypium hirsutum
  Clone ID: LIB3272-015-P1-K1-F8
gatacattcagcaagccttgcacaatggccaccatcacctctgccgctgtcgctatcccatctttcaccggccttaaagccggtgcaaccgcagctaaagttagcgccacagccaaggttgcagcctctccagtcccaagggtcagcatcaaggcctccctcaaagacgtcggtgttgctgttgcggcaactgctgcaagcgcaatccttgccaacaatgccatggccattgaagtcttgctcggcagtgacgatgggggtctggctttcattcccaaagaattcagcgtaagcccaggggagaagattgtgttcaagaacaatgccggattcccacacaatgttgtgttcgatgaggacgaaatcccaagcggcgtcgacgtatccaaaatctccatgcctgaagaagagctactcaat

SEQ ID NO: 22721 - DNA, 427 bp, Gossypium hirsutum
  Clone ID: LIB3272-015-P1-K1-F9
gaaaataacacgcagaggctgagagcaccctgttcttcaattcacgatgccctcaaccggcggttaatagctctgagctcaaagcaccgataacagccggccgacaacggcggcggagccacacacactctaagggatgccgaaccaagggctggaagctatgcagtaccactgggctggtatggccctgattcctcaacatcaagggatgatgacctatccttctcatcattacatggcttataatcaccctcatcttgattatcaacaacagtatcaacagcaacagttgcataaacaacaacatggatctaattcagatgaaggtaaaacgatctgggttaggagaccttcttcattggacggatgaaacttatcttcatagtttcttctgtcaatctcgcgaggactctgcttaaaaatgata

SEQ ID NO: 22722 - DNA, 425 bp, Gossypium hirsutum
  Clone ID: LIB3272-015-P1-K1-G1
caaaaatctcctttcatttaaaaaaaaaaaacaccttcctttttatacggcgcacgttagcatcttccagcagcgaaccatcgcaagccttctctatggccgcttcctatcgaccgccgccaccgtcatctattgatctcgacctcaccgtcgtctcagccaagcatctaaagaacgtcaactggcgaaacggcgatctcaaaccctacgctgtcttctgggtcgatccagaccgccgtctctcgacccgttcggacgatgccggatcaacccgaccggtatggaacgagcgtttcacccttccccttccctcccctctacacgacgtcgttttaaccctcgagatttttcactccaagccatcggaaacacctaagccgttagtcgccactctccgtgtcgaactcaaagaattacccgacccg

SEQ ID NO: 22723 - DNA, 421 bp, Gossypium hirsutum
  Clone ID: LIB3272-015-P1-K1-G11
gctatttaaagcccactaccaagagccgaattccccccccccccactagctttcgagacacccccattggatatcacataaaaatcccaacctctcagtttcttggaactgatggggtatatggtattattttggcaaatggggtcttcataaaagcacactggggaggggggaatttgggtgggattcctccattctcaccctcagcccacaattaaaactgtttggcagtgcttattacccaataagctttgcatggaagaggatccatcctacagagcacctacctatctgcggaggcttttttggctaatgcactggcaaatcggcaagtcacgaaaagggcaatcaactcatagtaattagtatgagtctgttatctggctatacatacatatatatatgtatatatcatgttttc

SEQ ID NO: 22724 - DNA, 429 bp, Gossypium hirsutum
  Clone ID: LIB3272-015-P1-K1-G2
ctttcgtgtttgtctattgaattctttccttcactttctcgagaaaaaaaaaatgtcttcaggttgcaattgcggatctagctgcagctgcggatctggctgcaattgcggtgagaactgctcaatgaaccttaaccttggatactcggagaagacaaccagcactcagaccatcatctccggagttgcgccagtgaagatgacctttgagggaccagagatgggcactactgaatcaggacatggatgcagctgtggatcaagctgcaaatgtaatccatgcacctgttgaaaagcttgatgaaagccatagattatgaaaaaagaaagcagcaaaataacaggcctctgtaatgatttattttcaaggatggatgcctgcaaggtctataattatgtctctctctgtcttgtggaatagaagctttg

SEQ ID NO: 22725 - DNA, 418 bp, Gossypium hirsutum
  Clone ID: LIB3272-015-P1-K1-G3
caagtgccaaaatctagggatttgcgggtggagaagacgagagcccatctctctgcttcaaagctcctgtccaggtagaattctcttcttcccttgcgttgtgttctttcctgttcaatcgccatggcttcaaagcggattttgaaagaactcaaggatttgcagaaagatccacccacttcttgcagtgctggtccagtagctgaagacatgtttcattggcaagcaacaatcatgggaccctcagatagcccttatgctggaggtgtgtttttagttactatccatttccctccagattatcctttcaagcctcctaaggttgcatttaggaccaaggtcttccatcccaacatcaacagcaatggaagcatttgtcttgatatcctcaaagaacaatggagccctgcactaacca

SEQ ID NO: 22726 - DNA, 430 bp, Gossypium hirsutum
  Clone ID: LIB3272-015-P1-K1-G4
gaagaagaagaagaagaaaaaaagggaacaaaagatggcaattcagattcctagagtgaaacttggaactcaaggatttgaggtttcaaagctgggatttgggtgtatgggtctttcaggtcacaataattcagtgtcagatgaagctggcatagccatcattaagcacgcattcgaaagaggaatcactcatttcgatacagccgacatgtacggacccaaaactaacgaaattctagttggaaaggcattgaagcatttgccacgagagaaggtacagttggctacaaaattcggtgttgaaagcatgggtccaggtggtccggttatcaatggcactcctgaatttgttcgttcttcacttgaggctagccttcaacggcttgatgtggattatattgatctttactatataatcagagttgaccac

SEQ ID NO: 22727 - DNA, 433 bp, Gossypium hirsutum
  Clone ID: LIB3272-015-P1-K1-G5
tgaaagaggaaaaagtgcaattgcattagccgcacatcgtgccaaagttgctgccctacaaaaggcacaagatggcaatgctgacagcatgatttggaggatggaagcctgatggagtgcatggcaattgttcatattggtagctagtgcagacttgttgactaacccattagatgttacaaggtagaagtcatttttttggactttggtttatatgcctctattaatctgtaaatagagtataatcattctcgggttcgaacttccaatggacctgcgtgaatctttatatactcttaaagcagaatccaactatggagttggagcttggttttccagttagggatagagctaatggaggtttgatttttaggttaccttcctcgcttcatggtagatggtaaagcactcccattaacctttctatagtttt

SEQ ID NO: 22728 - DNA, 424 bp, Gossypium hirsutum
  Clone ID: LIB3272-015-P1-K1-G7
ttcatgccatcactggtgatgagactaagtttaagctctgcaaagttaggtctgtccaatttggccagaagggtattccatacctgaatacctacgatggacgcacaatccgttacccagaccctttgatcaaagccaacgacaccatcaagcttgacttagagagcaacaaaattgttgatttcatcaagtttgatgttgggaatgttgtcatggtcactggtggaaggaacaggggacgtgttggagtgattaagaacagggagaagcataagggtagcttcgagacaatccatgtacaagatgctgctggacacgagtttgcaactcgtctaggcaatgtcttcacaatcggtaaaggaacaaagccatggatttcgcttcccaagggcaagggtatcaagttgtcgatcattgaggaagc

SEQ ID NO: 22729 - DNA, 362 bp, Gossypium hirsutum
  Clone ID: LIB3272-015-P1-K1-G8
gttcgtctttgtttgcccctttcttgtctggggcgaaggtcagggatggctaagcatgacaatgtcagtgccataatgtggcactatcaagaaacactggccgaactatgtgaagactcggttcagtcagccagcgcgaaaggctagaagaagaatttcagggcagaagaaggctgtgaggatctttgcaaggccaactgctggaccccttcgccctattgtccatggccagactttgtagtataacatgctgctgagagctggaaagggttatacccttgaagagcttaaggctgctgttattctaaagaaacttgcaccgaccattgcgttggatgttgatcaccagctgaagaacaaat

SEQ ID NO: 22730 - DNA, 420 bp, Gossypium hirsutum
  Clone ID: LIB3272-015-P1-K1-G9
gcaattatagatgggactgtactttgtgtacatggtggcctttctcctgatgtaagaactattgatcagattagggtaattgaccggaactgtgaaatccctcatgaaggtccattctgtgatctcatgtggagtgatccggaagatattgaaacatgggcggtcagtccacgtggagccggttggctatttgggtccagggtcacatccgagttcaaccacataaacaatcttgatcttgtctgtcgagctcaccaactcgtgcaagaaggtcttaagtatatgtttcaagataaaggcctagtaactgtgtggtccgcaccgaattattgttaccgttgtgggaacgtagcttctatattgagcttcaacgagaatatggagagagaagtgaagttcttcactgaaacagaagaaaat

SEQ ID NO: 22731 - DNA, 413 bp, Gossypium hirsutum
  Clone ID: LIB3272-015-P1-K1-H10
ggtgcactgagcagaggttaaataaggaatggaaggtgaggaattcgcagtgggttgcttcctttcaattaagacaactttgggcgacgaatttgaaggtcaaattatcagtttcgaccgcctctccaacatcctcgtacttcaggagggtttggaatcaggacccagaaggaacattcggctgctgaaggctaatcacattaaagagttctctttattgcgccaagatgaagatcctcttgatgttaagaaatgttttttagaccttactagccttcaagcaagagaagattctgctattaggcaagctgaggctgattcagagaggtttggtgttggagttaccagtgaggcacagactctttttgatgctttgtctaaaacgctacctgttcgctgggacaagactgtca

SEQ ID NO: 22732 - DNA, 397 bp, Gossypium hirsutum
  Clone ID: LIB3272-015-P1-K1-H11
cacaaacccatttaagttggtgttggtgacaccgagagttcaagatccaattaaagatgaaggtgatagagaagatccaatctttgcaagaagggaaagtggtgttttcctttgagttcttccctccaaagactgaggatggagtagacaacctattcgagagaatggatcgtatggttgctcataacccgtccttctgtgacattacatggggtgcaggtggttccactgctgatctcaccctcgacattgctaacaagatgcagaatatcatctgtgtggagacgatgatgcacctcacttgcaccaatatgcccgtagagaagattgaccatgctcttcagaccatcaagtccaacggtattcagaatgttctcgccctccgaggtgatccccc

SEQ ID NO: 22733 - DNA, 414 bp, Gossypium hirsutum
  Clone ID: LIB3272-015-P1-K1-H12
cgattaagtcggcaatctctccctataaataaatcaacaaattcccccaatttcccatcaaaatccaattatttcaatagtcttctcttgattccaaatctctcctagaagatgcagatctttgtgaaaacccttactggtaagaccatcacccttgaggtagaaagttctgatactatcgataatgtcaaggctaaaatccaagacaaagaagggattcctcctgaccaacaaaggcttatctttgccggaaaacaacttgaggatggccgaactcttgctgactacaatatccaaaaggagtccaccctccacctagtgcttcgtctaaggggtggcatgcagatattcgtgaaaactcttactggcaagaccatcaccctcgaggtggaaagttctgatacaattgataat

SEQ ID NO: 22734 - DNA, 428 bp, Gossypium hirsutum
  Clone ID: LIB3272-015-P1-K1-H2
ggaaaaacaaaagcctcttccttagctaactgtctaagcggctactttataccgcatctcaaccatgatcatcccagaaaagaaccgccgcgagatctccaagtacctcttccaagagggcgtttgctatgcgaagaaagactataatttggcgaagcaccctgaaattgatgttccaaatcttcaagtaataaagctgatgcaaagcttcaagtcaaaggaatacgtgcgtgaaacttttgcttggatgcattactattggtaccttacaaatgatggcattgagttcttaaggacttacctgaaccttccttctgagattgttcctgctactttgaagaaacaagctaaacctgctggtcgtcccatggtgccctccggtgaccgtccacgcggcccaccacgctttggtgacggtgagaggagat

SEQ ID NO: 22735 - DNA, 277 bp, Gossypium hirsutum
  Clone ID: LIB3272-015-P1-K1-H3
cgcatcgttaaccccatctactggcggcgtcgtcggatgcaggatcatcggttacttcgctaggcagttcctaatgcaatacttacatatcttccgttccaaaacggacctcgccacactatgatcctaaagcgtatctacctcccattggtgaggcatggccactgccctacatcgagcagagcatctttcgaggctggcgcttaaatcttccacggcaagaactacctatctctctactactccgatgtcaccggtggggaggccaaaccgtcac

SEQ ID NO: 22736 - DNA, 437 bp, Gossypium hirsutum
  Clone ID: LIB3272-015-P1-K1-H4
caacattcccatttccaatctccagctcccaaggtaaatatgccgatcagaaacatagcagttggccggcccgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaggtggccacgtcaaccccgccgtcaccttcggtgctttcgttggcgggaacatcactctcttgcgcggcattctttactggatcgcccaactcctaggctcaaccgtcgcttgcctgttgcttaagttcgctaccggcgaccttgctgtaccagcttt

SEQ ID NO: 22737 - DNA, 433 bp, Gossypium hirsutum
  Clone ID: LIB3272-015-P1-K1-H5
ctcatttcttctcttgtaacactgctaatatttttttttatcgtcgtctccgtcgttcgaagattataaaaaaccggcgtcgtttcaaatggctacgagaacggatcttgatgggaggccaataaagccgttgacgatatgcatgatcggcgccggaggcttcatcggctcccacctttgcgagaaattgatgtcggagacgccgcacaaggtgctcgccttggacgtttacaatgacaagatcaagcatctcctcgagcctgactctctcccttgggctggccgtattcagttccaccgacttaacattaagcacgattctaggctcgaaggcctcatcaagatggcagatctcacgataaatcttgctgccatatgtactccggcagattataatacgcgtccactagacacgatttacagcaattttatt

SEQ ID NO: 22738 - DNA, 439 bp, Gossypium hirsutum
  Clone ID: LIB3272-015-P1-K1-H6
ggcgccgtcacaaaatgtcgtcaacggagtctctcatcctccaactccatgaaatctctgccgttaaattcggtaacttcaagctgaaatctgggatcttctcccctatctacatagacctccgtctcatcgtctcttacccttccctcctccaccaaatctcccactccctcctctcctctctccctccccaaacacactttaacctcatatgcggtgtcccttacactgccctccctatagccacctccatctctctcgacacctccatccccatgctcatgcgccgcaaagaagtgaaagactacggaactgccaagtccatcgaaggtgtttacgaaaagggtcaagcttgtttggtggtggaagacctcgtaacgtccggtgcatcggttctcgaaacggcggcaccgcttcggtctttgggtatcaacgtaac

SEQ ID NO: 22739 - DNA, 342 bp, Gossypium hirsutum
  Clone ID: LIB3272-015-P1-K1-H7
ctcgctctctgtagccgtcaactgcgtctatctcttcatctctctgaaccaaagaggctgtagcttttagcttcgagagagaccatgttggcttaccaggtatctcatgtccggcgacgagcttctttctgactcattcctctacatggatattgtgaatgggatgctctggcaaggtgacggactgtggattgtgcaaggagctggcaatgcttacattgctgcccattattcagccgatggtgctggtctggatggaggtgttgttaaccaagcctcgaaggctgtagacaatgtcgacactttcaagctttaggagcctccccctttcaacaagaagca

SEQ ID NO: 22740 - DNA, 420 bp, Gossypium hirsutum
  unsure (1)..(420): unsure at all n locations
  Clone ID: LIB3272-015-P1-K1-H9
tctttcgctatctgccttttccctttctctctatctgattcctatcgacaatggccgccgccgccacttcttcaccccgcgaggaaaatgtctacatggcgaaactcgccgagcaagccgaacgctacgaggaaatggttgagttcatggagaaagtctctgcctccgccgacaacgaggagctcaccgtcgaggaaaggaacctcctctccgtcgcttacaagaatgttatcggcgctcgccgtgcttcctggcgcatcatttcctccattgagcagaaagaggagagccgtggtaacgatgaccacgtcgctacgatccgtgattaccgggccaagatcgagtccgagcttacttcgatctgtaacgggatcttgaagctccttgacactaggctngtcccctcggcttcctctggag

SEQ ID NO: 22741 - DNA, 390 bp, Gossypium hirsutum
  Clone ID: LIB3272-016-P1-K1-A1
gtcacccttgctgacattatcatgacatgtaacctctacttgggtttctcccagatcatgactaagagttttacctcggagttccctcatgttgagaggtacttttggaccttggttaatcaaccaaaaatcaagaagattcttggtgaagtgaagcaggcagtctctctaccacctgttccttcaaagaagcctgctgcccagccaaaagaaactaaaccaaaggctgaaccaaagaaagaagccaaaaaggaggttgagaaactggcagcaaaggcagaggcagctgaggaggaggcaccaaagcccaaaccaaagaatcctcttgatttgctgcctccaagtaagatggtactggatgactggaagaggctttactctaacacaaag

SEQ ID NO: 22742 - DNA, 386 bp, Gossypium hirsutum
  Clone ID: LIB3272-016-P1-K1-A10
gaaacaaggcacggtgtatatcatatatgatatgagattttccccactcgccttcatcaggtcaatctccaattatatctctaaaccccacatgtcttttccttctacgcatccctaagccaaaaccccgccttcaactcctctcacccaccaaaatcccatgtcacctcctccggcactgcagctcgctctggtggctctactacacctaactctaactaacgccgccacctccttccccgactttcaactcttgaacgtggaacaagctctcgttggggtgttagcacagcctagtcctctccaaacatctgaatataatcatcacgaacttctcaacgttactgaaagtgaagatcaatggaaatggaagctgaaactcatcc

SEQ ID NO: 22743 - DNA, 364 bp, Gossypium hirsutum
  Clone ID: LIB3272-016-P1-K1-A11
ataccagatctgttacactctgaattatttaagcagcacgtcacaagggatctagagcaaggttagtgaccttgggttgagtgtagagatgaggaaaatcatgggtgccaaagttcttttcttctttgctttgctttccttttcagctgtctcggcatttgcacaggatgaggaagaccaaggtcttgttatgaacttctacaaggattcttgtcctcaggctgaagacattatcaaggagcatgttaagctactgtacaagcgacacaaaaacactgctttttcttggctgagaaacattttccatgactgtgctgtccagtcatgtgatgcttcactgctgctggactccacaagaaggagc

SEQ ID NO: 22744 - DNA, 375 bp, Gossypium hirsutum
  Clone ID: LIB3272-016-P1-K1-A12
aaggtcatatattatatattatcagcacaaaaagaaaaaaatgggtctctcaagtcttccagctccatcagaaggagtgttatgtatactcttggtaaacacagctttatctatatctatagttaaaggcataatccgatcgatccttcacgttgtcggtatccatctcccacaaccaccatcggattacactgaaaatccctcggaagcgaatgatttccaccttaatactcctgaaagttacatcgaggaattccggagtaggaccccaacaattcatttcggtgctgttttatgtagctgcaaacggcctcagcacgactgtcgggtttgtctgacctagtttgagccaaaatccgagattaaccacttgtc

SEQ ID NO: 22745 - DNA, 386 bp, Gossypium hirsutum
  Clone ID: LIB3272-016-P1-K1-A2
gccctcatcgtcaccattacagagagcgtgagtgagtgagagacactgcaagcctttactttaccaaacaccatggatgctgctgagagctggtcgagaaccaaatgggtcttccattttatgcttatattcgcacatttctctcttctatcactagctgaagatggtctggtggccaatggggatttcgagacgccaccgtccggcggcttcccaagcgaggcaatatccgatggagcccccgagatccccagctggagcacgaacggtacggtgaagcttgtgtccgccggtgaaaaagtgagcggcgggatgctactcatcgtaccccgaggcaggcacgccgtcagattgggcaacgacgcggagatcagtcaggaagtgac

SEQ ID NO: 22746 - DNA, 366 bp, Gossypium hirsutum
  Clone ID: LIB3272-016-P1-K1-A3
ctaccttctctcaacccaaacacatatttcccaggaaaaagaaaaagcttgagccaaaagaaaatggccgatcagcttaccgacgatcagatctctgaattcaaggaggcctttagcctgttcgacaaggacggagatggttgcattactaccaaggagttgggaactgtgatgcgatcacttgggcagaaccccactgaggcagaactgcaagatatgattaatgaagtcgatgctgatggaaatgggaccattgattttcctgaattccttaacctgatggcaagaaaaatgaaggatacagactctgaggaggagcttaaagaggcattcagggtgtttgacaaggatcagaatgggttcata

SEQ ID NO: 22747 - DNA, 358 bp, Gossypium hirsutum
  unsure (1)..(358): unsure at all n locations
  Clone ID: LIB3272-016-P1-K1-A4
tttcaatctaagaaagagtttttgttgggaaggatcgatttgcaactcaagcttgttgctggcaactcagctggcactgtcactgcttattatctgtcatctcaagggccaacccatgatgagatagactttgaattcttagggaatctgagcggtgacccttacattttacacaccaatgtctttacacatggcaaaggcaacagagaacaacagttctatctttggtttgaccctacaagatacttacacacctattccatcatntggatacccaacacatcattttcttggggataacaccccattagagtctcaaaaatgcctgatcatggtgtccattccccagagccaccca

SEQ ID NO: 22748 - DNA, 365 bp, Gossypium hirsutum
  Clone ID: LIB3272-016-P1-K1-A5
tggtgttggtaatttaacgagtgagattgaaaaaatacatggcttgaaatgtttgtcgatttttagttcgactgtcataagtttttatactttcttcagagcataaagagaatcaaagtttaaaaactcatgacagtcttactaaatctcaacagacaccctaacccttgacacaccaatgtctcaccccatggcttatgcaccacacaaccgcagttctctatccggttacaccctaccggtaccttccgcccttcttgcatcatttataaaccccctcacatcattttcttgactgataacacccccatcagagccttcaaaaatgctgaatccattgatcttccattccccatgagccaacc

SEQ ID NO: 22749 - DNA, 351 bp, Gossypium hirsutum
  Clone ID: LIB3272-016-P1-K1-A6
ctcgaagaagaagtgaagaagaatacccctcttaaaacagcctaaatgaaacgtagcgagagaggaaaagcaacgattttcagaggaagaaagcatagcaatttgaattggtatcggacggaaaatgttcaggaaccagtacgataccgtcatcactacatggagcccagctgtgcggctgttccaagtggagcacgccatggaggctgtgaagcacggttcggcgtacttcggtcttctatccaagacccatgtggtgttgggttgcgtcaacaaggctaattctgaattgtcttctcaccagaagaagatcttcgaaggctactaccacatttgggttatcattgccgg

SEQ ID NO: 22750 - DNA, 233 bp, Gossypium hirsutum
  Clone ID: LIB3272-016-P1-K1-A7
aagaaatttaataaaataaaattaaaaaacgtgtctttttgcgtcgtatatgaagaaagaccgagtctgaaactccaatgaaagatcaaaaactcaacttttacagtttgatttcaatttccgaaggatatagattttttgttttgaaggtttggtgaaaaatggacaagaatttgatggacaaagtttctgcctttggtgagctcctgaaaacagaaggagccgaggtggga

SEQ ID NO: 22751 - DNA, 348 bp, Gossypium hirsutum
  Clone ID: LIB3272-016-P1-K1-A8
tccggtagagtagactcgtaagcacttttactttacacaaacacacatgagatgcctgctgccgagcatggtaagggcaacgcaacatggtgtctctccatatttatagcttatatatcgcatcagtttctcctcttctatgcactagcatgagacatggtactgggtggccatacgtgcgattgtcgagagcgcccaccgtacgcgcgtcatctccaacgcgaggcaatactgcggtggacccaatgggaatccccaactggagcacgaacgattcggtgtagctcgagtgcttcggctaaaaagcgtaccgtggtgtgctgctcatcgtaccctacagcctgcacg

SEQ ID NO: 22752 - DNA, 380 bp, Gossypium hirsutum
  Clone ID: LIB3272-016-P1-K1-A9
acggcatttacgaggagtgtaggcgatagtatagcggagaagattggtgtgattgctgctcctgagatctcgggtgttccgcttactcgtaatcatatattttttggtgttgcaagtgatggagttttcgagtttatctgtatcaaaactggcgtcaacatggcagacagaatacgcagatcctagggatgcatgtgctgcaactgctggagaatcccacaagctctggttggattatgaaaaacaccccgatgattttacaatcatcattgtacagattaaaggcttgtgtaattcgggtgctagggctacggataatgaagtagattgcaggccactggttatgaagtcacataagggtagttttgatacgagcagcg

SEQ ID NO: 22753 - DNA, 384 bp, Gossypium hirsutum
  Clone ID: LIB3272-016-P1-K1-B1
caaactctctcttttctaaattccctcttcaccaggtccgttactctatcacaccagcaacaaccttgagcttgaggatgactcattctcactcttctcaaaatccagtgattgagcagcagagagttataattccaaacaagcatggagaaaagcttgttggattgttacatgaaactgggtctaaagaaattgtgatcttatgccatggtttcagatccaccaaggctgatcgtactatggtcaaccttgctgttgctttagagaaagaaggaatcagtgcctttcgttttgactttgctggaaacggagaaagtgaagggtcatttgagtttggtaactactcgaaagaagccgatgatttgcattccgttatccagcact

SEQ ID NO: 22754 - DNA, 383 bp, Gossypium hirsutum
  Clone ID: LIB3272-016-P1-K1-B11
cttttgctgaaccttcttttttctctctttttctcaccttccctctgctcctgctaatctaaagccttggtgctggttcatggatattgaacccttgtgggctcttggggggtggttttttctttatttctttgattgtatggcagcacctaaatcaacatcatcgctctcacacacctatgaaaaaccccattttttcccactcttcctcacccttgtcttcttggttttccttctactcctcaacccctcttcaaaccctatcaactcatctaatgtcaccccttccatccctttcaagaggctcctcttacataattcatggaaatcatcatcatcaaccatgaacttgccccccaagcaaaggcgtcatccccgcacct

SEQ ID NO: 22755 - DNA, 380 bp, Gossypium hirsutum
  Clone ID: LIB3272-016-P1-K1-B12
aaattacttaaaaacccacaagggttaacccctttacaaaggatcgctgttggtttagttttatccattatagcaatggtagcagcagcattgaccgaaataaaacgattgagagcagcaactacgaatggtcttgcgaataacccaaccgctcaaatcccattaagtgtcttttggttggtccctcaatttttgcttgtaggcgctggtgaagcctttacatacataggacaacttgattttttcttaagggagtgcccaaaagggatgaaaacaatgagtacgggtttatttttaagtacactttcattagggtttttcgtttgttcattattagttactatagttcataaggtgactggaaacaagcatccatggct

SEQ ID NO: 22756 - DNA, 378 bp, Gossypium hirsutum
  Clone ID: LIB3272-016-P1-K1-B3
aggaaaacaagaaaagcagagccgcatcactttttgctagctaagctactgtgggagttattgttcttcagaacagcttctgcagtagctaataataacgttatatattatataaattttatgcatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaagatatgcgatgaaagagtcgtcgtcgtcggagacaagggcttattcttcagctt

SEQ ID NO: 22757 - DNA, 387 bp, Gossypium hirsutum
  Clone ID: LIB3272-016-P1-K1-B5
gtgaggtattgaatggagatcgactcgtgagtgctccttataaactgaattttagagaggaaaaagattcttccgttgtttgtaagaagaaactttctaaggatgaggttgtctttttccgaaaggcggttgaaaaagattattatttccaaatgtactatgatgatttgcctattgtagtaatagtcctcatatggacactcgtgacatctccattgcttgttctgggtggtattgctggcaaaaatagcagggccgagttccaagctccttgccgcaccacgaagtatcctcgagaaattccaccattgccttggtacaggagtgccattcctcagatggcaatggctggatttcttccatttagtgctatttacattgaacttt

SEQ ID NO: 22758 - DNA, 381 bp, Gossypium hirsutum
  Clone ID: LIB3272-016-P1-K1-B7
ggaggattagaagagtgtctaaaggtggatcccgataaagtaagacgtcttagcatgagtgagcaacaacttgaaaaagctgcgattactcacggaaaagaaattgtcaggtttacacagcggaatattcttagggtatatccgaggggtacacgtgtcgactcttccaattacaacccattaatcggatggatgcatggagctcaaatggttgcatttaatatgcagggttatggaagatctttatggttgatgcatggaatgttcaaagccaacgggggatgcggatacttgaaaaaacccgatttcctattgaatactaaggcagtctttgatccaactgtcaagttaccggttaaaaaaattttgaaggtaactatg

SEQ ID NO: 22759 - DNA, 384 bp, Gossypium hirsutum
  Clone ID: LIB3272-016-P1-K1-B8
ctcctttttatctttaaaacacgcacccaaaaaataaaaccctttgaagaccaaagaaggaagaagaagatgtcgtggcaagcttatgtagatgatcacttgatgtgtgaaatcgaaggaaaccatctctctgccgccgctatcatcggccaggacggcagcgtttgggcccaaagcgccagtttccctcagctcaagcctgaagaaattagtgccatcatgaatgactttaatgaaccgggttcactcgctccgaccgggttgcacctcggtggcacaaaatacatggtgatccaaggcgaaccgggagctgttatccgagggaagaagggacccggaggtgttactgttaagaagaccaatatggccttgattatcggaatc

SEQ ID NO: 22760 - DNA, 380 bp, Gossypium hirsutum
  Clone ID: LIB3272-016-P1-K1-B9
gttgaaatcttgatgtatgagagtttacattttgcatacggcttgctggaggtgttgatctttgtgacttctatcaccatatggaataaaggcatcattagccaaataattctttcgttccctatagcagtttttactgggagaaatatgtttgctgaaaggagtaaacaaggcattagtgataataagatatatcattatcacttaaatcttggaggaagtgtttctaccataaggctgactaggctaccttcaattcctaagaatgatgcaaagttcagaacacacttatccaggatgggaaggagatggcatcagtgctttatacttatcgcagctgtgtcaaagcacttcctcagggggtatgttggaattcacag

SEQ ID NO: 22761 - DNA, 388 bp, Gossypium hirsutum
  Clone ID: LIB3272-016-P1-K1-C1
ctcttcttgttcagaacaaaaaagaaaagccaaagaaaagagggagagtatagagactcaagtacaaaagagcaaaaaaaaaaaaaaacccaagaaaccaaataaataaaaggaagggtgggggcaaatagacaacgtacaaacactcttactttttagtgttttttttctttctttcttgttgttatgaggtttcctttgggaagataagtttcatttcctttcttgggggttttctttaaaaccttttgtttttgcttttccttcttggagttcttttccagtctggtttgttcggccatggccggtagcaatgaagtcaacctcaatgaatccaagagggttgttccattgaatacatgggtcctcatttccaatttcaagctag

SEQ ID NO: 22762 - DNA, 299 bp, Gossypium hirsutum
  Clone ID: LIB3272-016-P1-K1-C10
cacattctctcatacaaccatttctttaattcaactacactacatatgggcataaataatttaagtttccactcctattcacaaatcaaattgcgtgaggtccttcataccgaaggaggtcagatctgtgaccatatggtggctaaggatggcatagaggtttgcgcagatcacgggataaatcccaccggttgattccaaagagactgggatcgtcatctcgggagaattaacgattactacaatgaatccagtgggggaggattcggtgctcgagctcggctcatgagatcttgcac

SEQ ID NO: 22763 - DNA, 384 bp, Gossypium hirsutum
  Clone ID: LIB3272-016-P1-K1-C11
ctcttatttgaactcaaagtcccagctaatattagaatcatgggtgttgtcacttatgactatgagaatacctccccagtcgcccctgccaggcttttcaaggcctttactgttgaagctccgaaagtttggcccacggctgcacctaatgcagtaaagagccttgaggttgaagctaatcctagctctggaagtatcgtaaaaatcaactttgttgaaggccttccattccaatatatgaagcaccagatcggaggacatgatgaaagtaatttttcatacagttacgatttaatcgaaggtgggcctttgggggataagcttgaaaaaattagctatgagaacaggtttgaggcagctgcaggtggagggagtatttgcaag

SEQ ID NO: 22764 - DNA, 337 bp, Gossypium hirsutum
  Clone ID: LIB3272-016-P1-K1-C12
gtcaagtcctgtccactctcaaaattctttcaaaaaatattccagctatcctacgcaccgaagttatccggtgcacgttagcatcaccaccaaccaaaagcaacgaccagcgccaccaccactgccgtcgcagctaccatcatggctactcactctcgacctccgccaccaagactacttgacctcgacttgacgatcgtgtcagccaagcatctaaagaacgtcaactggcaaaacggcgatctaaaaccctacgcagtcttctgggttgatccagaccgacgtttatcaacccggtcggacgattctggctcaactagaccggtctggaatgagc

SEQ ID NO: 22765 - DNA, 388 bp, Gossypium hirsutum
  Clone ID: LIB3272-016-P1-K1-C2
ggaagctagaagagcaaagcgaaaatgaagactatactttcctccgagacaatggacatccccgatggggttagcattaaggtcaaggctaaggtgatcgaggttgaaggtccaaggggtaagcttacccgcaacttcaagcacctcaaccttgatttccatctcatcaaggacgaagagaccggcaagcgtaagctcaggatcgaggcttggtttggctccaggaagaccagcgccgccatccgtacagctcttagccacgttgagaacctcatcaccggtgtcactaaaggataccgttacaagatgaggttcgtctacgctcactttccgattaacgcctccatcactaatggcaacaagtcgatcgagatccgtaacttccttg

SEQ ID NO: 22766 - DNA, 385 bp, Gossypium hirsutum
  Clone ID: LIB3272-016-P1-K1-C3
ctcggatccaagctgtgcttcagttcttcaatcagtcctctgtgctagatgcgatccattttcagcgcagttgttcgcaattgataccgagactcgtacggtgcctctcctttgcaactctactgtttcaacaaattcatctcagtctaaccaagcaacaaatgatttctgctctaatgtatgggatacatgtcaaaatgtatctatgttgaattccccgtttgcaccttccttgcaagggcaagccggagcacctgccaattcgaatttcaccaaattgattgatctttggcagtccaaaactgatttctgtaatgcctttggtggagcatctactgatgaatcagtttgctatgatggtgaacctgttagattaaatgagacg

SEQ ID NO: 22767 - DNA, 387 bp, Gossypium hirsutum
  Clone ID: LIB3272-016-P1-K1-C4
aaaagcttcaaatctcctctgcctattggagattacagcaaaaggcttttctgtttttgtttttgttttattttttatttatttataattttacaagtgtaaaaatccccttggggaatgcagagagatgagacgttcatcgttggcaaggcctgagctttcttaccaccgtaagcgctccattggcggccgaaattgtcaccgaaaacacgtcgaagacgggtgattcagtttgaagggtttcagttttaaatatacatatatttctcacttctattgtaaatagacagtaattcagatcaaagggtatccgtttcttttcttatttttcgttttaatttctcgagcttttacggttcaaaaatggcggacaaagctaaaaccgaa

SEQ ID NO: 22768 - DNA, 385 bp, Gossypium hirsutum
  Clone ID: LIB3272-016-P1-K1-C5
gttttccttcaaaaccctaatagctgtcctcgcctcctgaacgtgttcgaaaatggccggttctgagggattgactctacgtggcaccatgcgtgcccacaccgacatggtgacagccattgctactcccatcgataactccgacatgatcgtcacttcctcccgcgacaaatccatcatcctttggcacttaaccaaggacgaaaagacctacggtgtccctcgtcgtcgtctcaccggtcactctcacttcgtccaagacgttgtcctctcttccgattctcagttcgctctctctggttcctgggatggtgagcttcgtctctgggacttatctgccggtatctcagctcgccgttttgtcggccacaccaaagatgttctc

SEQ ID NO: 22769 - DNA, 386 bp, Gossypium hirsutum
  Clone ID: LIB3272-016-P1-K1-C6
gaaggttggacctgaaatttgcctattgaagacccatgttgacatattccctgatttcactccagagttcggttctaagcttcgcgcgattgcagaaaaacataacttcatgatatttgaagaccgtaaatttgcagacatcggtaacacagtaacaatgcagtatgaagggggtatcttccatatattggattgggctgatattgttaatgctcacataatctctggtcctggaattgttgatggtttgaaattgaagggtctgcctcgtggtagggggctgttgctacttgctgaaatgagctctgctggtaaccttgccacgggggactacacagctgctgccgtaaaaattgccgaacaacactccgattttgtcatcggtt

SEQ ID NO: 22770 - DNA, 382 bp, Gossypium hirsutum
  Clone ID: LIB3272-016-P1-K1-C7
ccaaattcgttgctttccatttatcgaggaaaactcagttcagtcgtggattcagtttttctgtttttaacatagttagttgaagcaagcaatcatggcaaggaagatgttggttgatggagacttaaaccaaacgaataacgagggagctgaatatgattttgacttgtttgtcatcggtgctggaagcggtggtgttcgcgctgccaggttctccgctaactatggagcaaaggttgggatttgtgagctcccatttcatccaatcagctcagaagtcattggaggggttggtggaacgtgtgttattcgtggctgtgttcccaaaaagattttggtctatggagccacgtttggaggtgaaattgaagatgctcgaaat

SEQ ID NO: 22771 - DNA, 348 bp, Gossypium hirsutum
  Clone ID: LIB3272-016-P1-K1-C8
ccaaaaacaaaatttttggttacccggtcattactacctctttttctcatctccatcgcgcgccctatgtaccccaaattttgtacttaattctatttccctcttaatttcaaaattccttgaggtcctctgcccccaatatctagcaataccgttcaaattcctaaaccttttctttttctctccatgaatttatatatatgcatataacaaacgattcattgccttggggttgggagtctttctgaatcaagacacatgggttttctgatctataccaaaagaccactgggactgatctatagaattcccattatgagagaccggctgaactgtactggaggccga

SEQ ID NO: 22772 - DNA, 385 bp, Gossypium hirsutum
  Clone ID: LIB3272-016-P1-K1-D1
atgagctacttaaccatttcccagatctcttccattctcttcttcagcgttcttttcatttccgcccatgcagcgcgctttgaaatccgcaatgagtgcccctacactgtttgggcggcagcctctcctggtggtggtcgtcgcctagacccttggcaaagttggaccatcgatgtgcctgctggcactgctatggctcgtatttggggtcgaaccaattgcaatttcgatgccagtggtaggggtcattgccagaccggcgattgtggtggactccttcaatgtcaaggttggggtgtacctccaaacaccctggctgaatatgcacttaaccaatttggaaacatggatttctacgacatttccttagttgatgggtttaaca

SEQ ID NO: 22773 - DNA, 382 bp, Gossypium hirsutum
  Clone ID: LIB3272-016-P1-K1-D10
gccatttgaaaagaaaacaaaacagatcctaaagccccttttcttcccctctcattcggctgaatcaagaggcgcccttggactgccgtttggcctccatgtttagccgccggtcatcacgctaaagcctaatcaggctccgtccaatcacgaatccaaggctacgctcaaagatctcagaatcaacacccaaactccgattgcaacggagccagtgaggattcgagggaaccaaaaacgaaggtaagccccttttttttctttcgaatatatgaacacaaaacccaggcgaacgaaactaaaagaaatccgagattttaatcggaaaatcaccttgatcgattttatatatttgattgttctttttttgttgaatctattc

SEQ ID NO: 22774 - DNA, 385 bp, Gossypium hirsutum
  Clone ID: LIB3272-016-P1-K1-D11
gttcttccatgactgctttgtcaaaggttgtgatgggtcaatactcctagacgacacttcttctttcaggggggagaaaactgcggctcccaataataattccgtgagaggtttcaatgttgttgatgacattaaggccaaggtggagaaagcttgccccggtgtagtctcttgtgctgatatcttagcccttgcagctcgggactccgttgttattcttggagggcccggctgggatgttaagcttggaagaagggattcaaagaccgccagctttgctgctgcgaatagtggtgtcatcccacctccgaccgccacccttagtcaactcatcaatagattccaagcgcgaggtctttctgccaaggacatggttgctttatct

SEQ ID NO: 22775 - DNA, 383 bp, Gossypium hirsutum
  Clone ID: LIB3272-016-P1-K1-D12
gaaaatttatcaaaacaaaattaaaagcagaaaggtcttcaacaacgtcccacggaaaacgcagacaagtttgagcttactataagcccaatttctctctctctcttccttcttcttcttggtcggtttagtcaggcaaaaacctcaatccatacccgtcaaggatttctttgttattcaatttcttttgggggtgaagtgggttttattggtttgatcacttggggtaaggctgtgcttatacaataaactgggatttgttacttcacgagagaggcagataagatggctcataccgcggcagcatgtgctgagagggcaaccaatgatatgttgattggtccggattgggctctaaacattgagctatgtgacattataaa

SEQ ID NO: 22776 - DNA, 438 bp, Gossypium hirsutum
  unsure (1)..(438): unsure at all n locations
  Clone ID: LIB3272-016-P1-K1-D4
cggaattncccgggntcgagcccacgtcgnntccgcttctacatatgccggcgaggtaaagggaaatacctgagagggtagaaaaatgccagcgtggtcacggtctcacgatctncggacctaggntnatctgttttccagaccccttcagaaagaangggttaccatcccattgtccacttatcctcaggacctacaagatcggtgactatgttgacgtcaaggtaaatggtgccgttcacaagggtatgccccacaagttctaccatggccgcactggtcgtgtctggaacgttaccaagcgcgccatcggcgttgaggtcaacaagcaggttggtaaccggattataaggaagaggattcatgtcagagtggagcatgttcaaccttcaaggtgcactgaggaattcaagctgaggaagctgaaaaatgatcagc

SEQ ID NO: 22777 - DNA, 388 bp, Gossypium hirsutum
  Clone ID: LIB3272-016-P1-K1-D6
aaagagcaggaaaacaagaaaagcagagccgcatcactttttgctagctaagctactgtgggagttattgttcttcagaacagcttctgcagtagctaataataacgttatatattatataaattttatacatcctttttaccctactactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaagatatgcgatgaaagagtcgtcgtcgtcggagacaagggcttattcttcagcttggg

SEQ ID NO: 22778 - DNA, 375 bp, Gossypium hirsutum
  Clone ID: LIB3272-016-P1-K1-D7
cctctctcaaaatctcaaacccagatttgttctctctctctctctctctctatttccaatcaattaattcctccattggaggagcttagggtttgttggtgttctggtctttgctttgtctgaaaaataaacagaattataaacgaacaccaacgccatgggaagatttgaagagagaggattccattcagtggtttgccctaagcctatccgaacctttagatggtctaccaacagctgttatcagactgagatggctgattcaaaaactggtgcagagcttcttgatataatcctccccgagggagggtatggggccgagaatcccaccaaccaaatggcttcatcaccaccgtatttctgtggatcaccgcc

SEQ ID NO: 22779 - DNA, 381 bp, Gossypium hirsutum
  Clone ID: LIB3272-016-P1-K1-D9
gttcctcttcccaagaccaaagctttcatgcccactttccctgcccaacatgctcaagacaggcgaatgagaagaatactgaagagcccagatcctttgcaagagcaacgtagaaaggagttgcaacaaggggaactagggactggtggtctatttggctaagagaaaattcatccatcagtgctgtttgatcttcattttttagaattttctcattattgttagagggccgtgtttgaggcactgatgatgttttagctggagatattggttgcctcttcctgtgcgccagatgttttgcaggttatattgttttccagctttgttcatcatataaaaatgcatctgacactgcttgcattgcaaggtgtggctatcagc

SEQ ID NO: 22780 - DNA, 376 bp, Gossypium hirsutum
  Clone ID: LIB3272-016-P1-K1-E1
gttttccaaggaaaaaacaaaacactctctcccccttttgtctttccaacgatcgggctccttcaccgcccaccgtaccaccaccgttttcagtggccggtgacgcgcaacaataggtatttcaaccccatttttgggaccctttgaaggccgagttttcagccaaacaatgcggaaatgaaagggtctctccctctctaaacgacgcgaccccgacgacggaggagggatctccggcgacgaagccccgagcgattccggtgtcagacgcgtggaaggccggtggttggtgccctggtggtggcgcgcgtgatggccaagggcagaggggggagtggcggctgaactttggtggctagggttagggtggctgctg

SEQ ID NO: 22781 - DNA, 383 bp, Gossypium hirsutum
  Clone ID: LIB3272-016-P1-K1-E10
ccaaaagaggcacaggacaaagtggcaaaattttcgttccacggacagccagcagagctcaggcatggcagtgttgtaattgctgctattacgagctgcaccaatacatcaaatcctagtgtcatgcttggggcaggacttgttgcaaaaaaggcttgtgaacttggtttacaggtcaagccttggataaagacaagtcttgcaccaggttcaggagttgttacaaaatatttactgcagagtgggttgcaagaatatttgaataagcagggcttccatattgttggatatggctgcacaacttgtattggaaattcaggagaattggatgaatcagttgcctctgctatttcagaaaacgacattgtagcgtctgctgtact

SEQ ID NO: 22782 - DNA, 383 bp, Gossypium hirsutum
  Clone ID: LIB3272-016-P1-K1-E11
gtaaaagccaaaccaacaaatctgcgaccagccgcctgatcgtcagacctacagacctaccgccggccgaggagctcatcttgagtgtcgcttcttctcctcctacgtctttggaactggaacttgttaacctttaacaataaagacgaagagagagatgccaaacttgtctaaggaaatagaaaaacatgacactaactctgggcatcatccgagagaagatagtgaatacgttaggctggttatttctaatgaacctactgcagctggagtggacatcttacaacctcaaccacccacaaggagtgaaacttttagctggtggatcaaagccttcatcttctgcatttttgcagttatattgattcttgtttttttgaaat

SEQ ID NO: 22783 - DNA, 384 bp, Gossypium hirsutum
  Clone ID: LIB3272-016-P1-K1-E12
gcttattggaatgaccaacagaaaggatctgcttgatgaagcccttttgaggccaggacgtttggaggttcaagttgagataagtcttcctgacgaaaatggtcgtttgcagattcttcagatccacacaaacaagatgaaagagaattcttttcttgctcctgatgttaaccttcaagagcttgctgctcgtacaaagaattacagtggagccgagcttgaaggtgtggtgaaaagtgcagtgtcttttgctttgaatagacaagtaagtatggatgatctaacaaagccagtggacgaagagaacattaaagttaccatggatgattttctcaatgcactcctagaaatcgttcctgcatttggagcctccactgatgacct

SEQ ID NO: 22784 - DNA, 386 bp, Gossypium hirsutum
  Clone ID: LIB3272-016-P1-K1-E2
ggaaaacaagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggtgcaccgccggcggcagtgacggctagctttggtaggcctggagcgatggggaaagtggaacgaatatatgcgatgaaagagtcgtcgtcgtcggagacaagggcttattcttcagcttgggcgcctgaccctgttacgggg

SEQ ID NO: 22785 - DNA, 387 bp, Gossypium hirsutum
  Clone ID: LIB3272-016-P1-K1-E3
gaacttaccctgaagagatgattcagacaggcatatcaacaattgatgtgatgaactcaattgctcgtggacagaagattcctcttttttctgctgctggtcttcctcataatgagatagctgctcaaatttgtcgtcaagcaggtctcgtaaagcgattggaaaagtctgataatctccttgatgatcaggaagaagataattttgccattgtgtttgctgccatgggggtgaacatggagacagctcaattttttaagagagattttgaggaaaatggatctatggagagagtgacgcttttcttgaacctggccaatgaccccactattgaacgaattattacacctcgaattgccctcacaactgcagagtatttggcttatg

SEQ ID NO: 22786 - DNA, 386 bp, Gossypium hirsutum
  unsure (1)..(386): unsure at all n locations
  Clone ID: LIB3272-016-P1-K1-E4
ggattgtgatgaacataagagtttatgcagcaaatatggtgttcaaggctacccaactgttcagtggtttcctaaaggctctttggaacctaaaaagtatgaaggaccacgcacagctgaggcacttgctgaatttgttaacactgaaggagggactaatgtgaagatagccactttgccatccaatgttgcagtgctaaatgcnggataatttgatgagattgtccttgatgaaaccaaagatgtgtgggttgagttttatgcaccttggtgtggccattgcaaaaaccttgctcctacctatgaaaaggtagcaacggcatttaaatcggaagaagatgtagtgatagctaatctagatgctgacaaatacagggatctagctg

SEQ ID NO: 22787 - DNA, 388 bp, Gossypium hirsutum
  Clone ID: LIB3272-016-P1-K1-E5
gagagattttgaactattttctctgctttgggggagttcgtttatcccactgtttccatcaccatgggaggatctcgagctcaagtcaataagcctcacaaaacccgtttctcctctaaatcttctaggaacattcataaaatctctcaaaaagataagaaccggattgcaaaatcgaaccgtaatgtaacgcagggagctcgagctgctcggcttcagcgaagcaagatgctacgagagcagaagaaggaagctcttttgaaagaaaaaagggcttcaagtggatcagccagccctccccgtgtcattcttcttttccctctttccgcatccgtgaatgtaagttcacttgctgaagacattttgagattgctttcagcagatgtta

SEQ ID NO: 22788 - DNA, 388 bp, Gossypium hirsutum
  Clone ID: LIB3272-016-P1-K1-E6
gccgaacgcaatggaaagaatagaattagatgaagcaatgctacaagggcaagcagagatatggcgttacatgtacagcttcgcagattccatggcgctgaagtctgccgtggagctccgcatagctgacataatacactctaatggtggccctgtcactttgtcgcaaatagcttcatgcattaatggtggccttgcttcacctgacatcaccacccttgctcgcataatgagattgctcattcgcagaaagattttcaccgtccatccttcagacggtggagatctcttgtacgacctaactcactcatcgagatggcttctacatgattcggagcaaaccctggcacccatggtattaatgaatacccatccatggcaaatgact

SEQ ID NO: 22789 - DNA, 378 bp, Gossypium hirsutum
  Clone ID: LIB3272-016-P1-K1-E7
gtcttctactctcgctctctcttcgcgttcccttttccatccagctaagtattctcagttttcttcttccttcctagcttgcttgcttgtctccgtttttttattaaaaaattcttcgtatagatctggtttagatctagggtttcttttggttctttgttactgctcggctgtttatgtgcatgtccgatctgcagttcgtaaaaccgtttcaatgattttagattttctatgaactctatcctcatgcgtcgaatccgtattcttcactcgttctcggtcgtcttcctttactggttctacgttttctcatgaattagcatctctttgttcatcgatcttcttatcttgatctaacccgactattaaaaacttcaa

SEQ ID NO: 22790 - DNA, 384 bp, Gossypium hirsutum
  Clone ID: LIB3272-016-P1-K1-E8
gagctacttaaccatttcccaaatctcctccctcctcttctttagcgtgcttttcatttccgctcatgcagcgcgctttgaaatccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccggtgattgtggtggactccttcaatgcaaaggttggggtgtacctccaaacaccctggctgaatatgcacttaaccaatttggaaacatggatttctacgacatttccttagttgatgggtttaacat

SEQ ID NO: 22791 - DNA, 384 bp, Gossypium hirsutum
  Clone ID: LIB3272-016-P1-K1-E9
gccaagaccaagttctctactttaaacacctaaaaaatccatcacccatttctactttgaaatggcagcgtccttttcttccactacccttttcaggcccaatcttaatcctcccaagtctttcctcactcattcagattgtgcccaggagggattcggtcgcgtgaagtgtcatttcatcaatgttagtgcgcactcgtggagctcggctgcgaactacgccagtattcgtcacgtcgccgttaaatcatccggcaaacgcgtcgttgttaaacatttgctacgtaagagagttggactcgtgaagtgcgcaactattgaagaaatcgaagcagagaaatcttccattgagaaagatgttaaagaaagaatggagaagacaat

SEQ ID NO: 22792 - DNA, 376 bp, Gossypium hirsutum
  Clone ID: LIB3272-016-P1-K1-F1
cgaaagcttgcgagagagagataaattggatccacagctaactgaagtgtcgcagatgttcgagcgatcaaaagctgcttcatttaaaaaggtttcgattcatgcgccaatctcctttctcaacttaagggtttgctgacaaagtttaagagccctcctccgctttttgaaaacaccccttatgccggttaccgattggctcttagcagggaaattttacgaccatgttgttgtccttagggttaaaatggaagatccagattcccttgggagggaactttttcaagtggagccctattatacagatgctggtaggcgtctttcaccatcccagcaagagtacctgattctaggtcttaatctcttgagacttctt

SEQ ID NO: 22793 - DNA, 383 bp, Gossypium hirsutum
  unsure (1)..(383): unsure at all n locations
  Clone ID: LIB3272-016-P1-K1-F10
aaaaccgagagatatattcccaaacatgtctaaagcctgcttgcttttgtttctcgttggagtggtggtttttatcatcactccttctctagctaaccaacatcatggtaatgagcttcccaagggtaatggtaggaagcctttcccaggtgagaagcaaccacaacacaagccattccccgaacaccgaccaccaatacaccgtggacctggcggtaagggggaggagccaccacatggagaaaaacctcctcatagacacttattgactgtggaagttgaggacacacataaacctncacgatactcaggtggtaaacctccaagacactcgggaggtaaacctncacatgttgaggggttccttgctggtaaagcaccca

SEQ ID NO: 22794 - DNA, 382 bp, Gossypium hirsutum
  Clone ID: LIB3272-016-P1-K1-F11
cgtgacttctggttattgcgttatacttctgttctagaagatggaagcctcgttgtctgtgagagatctctgaagaatactcaaaatggccctagcatgcctccagtgcagcattttgtgagagcagaaatgttgccaagtggataccttattcgaccttgtgaagggggtggttcaatcatccatattgttgatcatatggatttggagccatggagtgtgcctgaagtgttgcgcccactttatgaatcatcaacagtgcttgctcagaagacaacgatggcagctttacgacaactgaggcagatagctcaggaggtttctcagtctaatgtgactggttggggacgacggccagcagctttacgggctcttagccaga

SEQ ID NO: 22795 - DNA, 381 bp, Gossypium hirsutum
  Clone ID: LIB3272-016-P1-K1-F12
gttgcttctaagtcgcaaaatcgtcatcttttactattgtaggattgctagaagaggcggacattacaaaggctggaacttacaaagtgtaaagtacatttttttgctgtcgtgaaagcaaggcaacccgcataccgaaccgtggaagcaaaacacttgtcctgtcttttccgctaacactttactgtcctcgcgtcagcttcgttggaggcaatgggttattgcaaggctccttgtgtgtttttactatgcctcttcatcagtttctgccttccccgtcaattgttggctgatgaggttgacaaaaacctgacagctcagctgtttatagatgcttccgaacagtcaagccgtccaatacctcaaacactgtttggaata

SEQ ID NO: 22796 - DNA, 384 bp, Gossypium hirsutum
  Clone ID: LIB3272-016-P1-K1-F2
attctctgaaaatttttgtgctgaacttcttttttctctttgtaccaccatgtgtggaggtgctattatctccgatttcataccgccgtcgcggtcgcgacgattgacggccgatttcttgtggcccgatctgaaaaaatccgggttgaagaaggggtcgggtaagagatactcgaagcccgtgatcgacttgggcgatgatttcgagactgactttcaggagttcaaagatgaagaatctgatatagatgattatgatgttgatgatgttttggctgatgtaaagccctttgcttttaacgctacaaagaaacctgcttctgctgtatctcatggttcgaactctgaaaaatccatgcaattcaatggtcaagctgagaaatg

SEQ ID NO: 22797 - DNA, 383 bp, Gossypium hirsutum
  Clone ID: LIB3272-016-P1-K1-F3
ggaaagaaagacattcatatttggattactttgctataaattcaaactatctgacgccaaaatatattatctgatccttctccaccttgtctttctcacagtttttcttgatttttgcctttcccagacttaaaagcttcggtttttattttcactttgaaaaacgaaaatggataagattaagagtctgatgcgcgctgttcagtacagcaaatatggcggaggagtcgccgatctcaagcatgttgaagttccggttcccagtccaaaaaaggatgaagttttgatcaaagtagagacagctagtattaacccaatcgactggaaactacaggatggggtagctcggccatttttacctcggaaattcccccacattcctg

SEQ ID NO: 22798 - DNA, 385 bp, Gossypium hirsutum
  Clone ID: LIB3272-016-P1-K1-F4
gccaaagcctcttcatttaaaaaatatataaatttctgcaaaaaaaaaaaacttacaaaaagatagaccaaaaagaagaagagcccgcagagagaaagacagaggtctgtttcgggggagagctttctatcactgctccaacggacttcttcttttgtggtgctctttacccagatccaggcaatctaagaggactaagatgaatcctttgatgtgcttttaagattatgatgttttggggttactgttcacaccttagtatcatcttgtcatgatttcggatatcgtgatcttcgaggtgagtgttgctgtcaaagttcaacaactacccatgaaagtcttatgtttgaagggtctggatctcaaatttggatttgataagagc

SEQ ID NO: 22799 - DNA, 385 bp, Gossypium hirsutum
  Clone ID: LIB3272-016-P1-K1-F5
ctaatcttctcgaaacatggctttgagatggtttctgcattcagcatgtcatgttctggggtaccaacatgagcctgatgacatgcagtatttcaagaacatggcaggtgaacaaagtggaggagcgactcagagctcaaaggtgtcttccaacggtgagctgacggtggtgaaagcgaaaatacatccggattcagggtttcaaatgccactgcattatcctcgttatacgaaagcggattacgagaaaatggaggagtggaaagtggacatgcttctcagagaatatggactaagtttggagggcaaccttagccttgatgagaagagagcatatgcaatgggcacattcttgtggcctcatcagtattgatccatcttctaa

SEQ ID NO: 22800 - DNA, 280 bp, Gossypium hirsutum
  Clone ID: LIB3272-016-P1-K1-F6
aatacctaaacagtcaaatgtttccctggatggacgctgctactcatgttgcatctgaaaacctattctataggagcctgctgacttgacctgtgtcatcaaattaaatccttttgtcccaactactaagattttactgacttacgtggtgtactgaaaaacataaactaactccactctggactcaaattgagaaaaagcctttgcttaacaccgtagttcctttgggatggtggactgacactctaacggacacttctgtccatacaatagatcgagg

SEQ ID NO: 22801 - DNA, 381 bp, Gossypium hirsutum
  Clone ID: LIB3272-016-P1-K1-F7
gtcatttgaagaaaatgatgttacatacaattttgattttaagaagtttttagattctatggaagatgagattggatctcaaggtaattcaaagaaagctaggagtcttgatgagcttgatcctgagatacagaccattgtattgctaagtgatacttatggagctgaaggtgaacttggtattgtcttgtctgagaaatttactgaacatgatgcctactgtatgtttgaggctctgatgagtggggctcatggttcagttgctatggcagatttcttttctcccattcctgctgctcagtcccagagtggcttgccccctgtcattgaagcctcagctgcattataccatttactgtcaattgttgattcttccctgca

SEQ ID NO: 22802 - DNA, 382 bp, Gossypium hirsutum
  Clone ID: LIB3272-016-P1-K1-F8
atttcccctaaattccgtcttttttcttcaaattccccacaaatggccatcactttctcagatctccacacggaatctggccttaaatcccttaatgacttcctcaccggcaaatcttacatctctggggataagctgactaaggatgacataaaagtttatgctgctgttttgaaaaatcctggtggttcatttcccaatgtgagccaatggtataattgtgtgtcttcccatctcgcttctagcttccctgggaaagctgttggcgtttcacttggtggcaaagctgatccagctcaatctgctgaagctaagtctcctgctgcggacgatgacgatgatgacttggatctgtttggcgatgaaacggaggaggataaga

SEQ ID NO: 22803 - DNA, 383 bp, Gossypium hirsutum
  Clone ID: LIB3272-016-P1-K1-F9
gcgtttctttctgaaactagagctgagaaaataaaacccaaagccttaaaaactatcaaaaatggttcaaaggctcacttaccgtactcgccatagctatgctaccaaatccaatcaacaccgtgtcgttaagacccccggtgggaaattgatctatcagactactaagaagagagcgagtgggcctaagtgtcctgttactggaaagcgaattcagggtattcctcacttgagacctgctgaatacaagcggtctcggttgcctaggaaccgtaagacggtgaatcgtgcctatggtggtgttttgtctggaagtgctgttagagaaaggataattccagccttcttagtggaagagcaaaagattgtgaagaaggttctga

SEQ ID NO: 22804 - DNA, 385 bp, Gossypium hirsutum
  Clone ID: LIB3272-016-P1-K1-G1
gcgattggaacggacggactcggactcggatcggttcgggcacgatccgatgcagccctttaacgatgattcagctgatgtcagcatgcctagtaacgctccgccgttgagaagagtcaggccacaaacagaccgcaatgattcgaatcgtttaccttcctcgaacactgccgtaaacaacattgacagcagcgaggacgatgactctcctctggcgcgtcatgtaacgcgccaactgggagcggtattggcagaggagagggcgttgtctgcaagagaagcagcggaagcagccgctgcggcggtggaacaagctgcagtgacagtgaacaatgctccaccagcgtccgaggaaccggtgaggatgtcattaatggaattatta

SEQ ID NO: 22805 - DNA, 382 bp, Gossypium hirsutum
  Clone ID: LIB3272-016-P1-K1-G10
aaaaaaaaaaaggaaaaaaatggctatgcaattcaatcccatcgcttctcaaactaagaaactcccttcatatgctcttccacccatggcaagtcttagatctcccaaggtttctatggtctccactcttccacctcgctccaaaggggttgaagatctgaaacggcctttcatggctccaaagctggtacaccaggcttcccacaccatgccacctgagaagattgaaatctttaaatctttggatgattgggctagggataacattctgattcatcttaaacaagttgataaatgttggcaacccaaggattttcttcccgatccttcgtccgatggatttgaagatcaagttagagaacttagagaacgggcaaaggag

SEQ ID NO: 22806 - DNA, 381 bp, Gossypium hirsutum
  Clone ID: LIB3272-016-P1-K1-G11
gaaacaaggcacggtatatatcatatatgatatgagattttccccactcaccttcatcagttcaatctccaattatatctctaaaccccacatgtcttttccttctacgcatccctaagccaaaaccccgccttcaactcctctcacccaccaaaatcccatgtcacctcctccggcactgcagctcgctctggtggctctactacacctaactctaactaacgccgccacctccttccccgactttcaactcttgaacgtggaacaagctctcgttggggtgttagcacagcctagtcctctccaaacatctgaatataatcatcacgaacttctcaacgttactgaaagtgaagatcaatggaaatggaagctgaaact

SEQ ID NO: 22807 - DNA, 378 bp, Gossypium hirsutum
  Clone ID: LIB3272-016-P1-K1-G12
aaaatttctctctttttttgtacttttggttggcctggtgacttcttggttgttgcccctgctgctgagctgccgtgtacagacttcttttatacaattgaacactgttcttccaaaattccaagctatttttgaggtcttttgggggcattagactaatgggtttctcttaaaatccttaaatttgggagtctttttcaagttttgtacctaaattcatgccaaacaagaaaactgaagctcttggctttgcagttacttcgatctctttctggcatctggatctgcactgtggaatttattgtgtttttagttcttcgagggctatgaagtgttttatattcctcagctggagaagaaaagatgaaccaaagaccc

SEQ ID NO: 22808 - DNA, 385 bp, Gossypium hirsutum
  Clone ID: LIB3272-016-P1-K1-G2
atttatttcactacccaacaacccaaaagataaaaggaatcgtttacttgttcgtagcaatttatcgtcatttcaagctcaattctctgaaaatttttgtgctgaacttcttttttctctttgtaccaccatgtgtggaggtgctattatctccgatttcataccgccgtcgcggtcgcgacgattgacggccgatttcttgtggcccgatctgaaaaaatccgggttgaagaaggggtcgggtaagagatactcgaagcccgtgatcgacttgggcgatgatttcgagactgactttcaggagttcaaagatgaagaatctgatatagatgattatgatgttgatgatgttttggctgatgtaaagccctttgcttttaacgct

SEQ ID NO: 22809 - DNA, 335 bp, Gossypium hirsutum
  unsure (1)..(335): unsure at all n locations
  Clone ID: LIB3272-016-P1-K1-G3
ctcggttcacaataacgagcgttaggctttatgtgccttaacaccaagtcaatgaatgggtgtaaaaatcgcaagtgacgtatcttcctcgcgatttgacagagaatacggggtaaatttggtggttcagaaggagcttactcttgntctgtaatttttggtggtttagattcattaaaccaggtgatagaaccctgaagtgggttctttacctcggttttgaaagagaaaataaagggggacgacaaattcttgggtatcaatagtgcctcgatctttcgtgtaattgttctggttcaccataggnnnagctttgtttagatgcattaaacaag

SEQ ID NO: 22810 - DNA, 406 bp, Gossypium hirsutum
  unsure (1)..(406): unsure at all n locations
  Clone ID: LIB3272-016-P1-K1-G4
cgtctcgatgtgtgcatggaagatacaatgaacannacttggttcttattcccttgctcctaaatttaccaagattgctatactctcgtactatcgccaaagaaaatccgcagctttgaggacacctgctgttgagacgattgcgaaattctgtcatgatctgcaggatctggacctcagcaaaagtttcaagcttggtgatcactcattgtatgctttggcccatggttgccctaatcttacaaaacttaacatcagtggctgcacatcattcagtgatgaaggtcttggatatttgactcaattttgtcgaaaactaaaaatattaaatctctgtggatgtgttaaagctgcaactgactgcgcattgcaggctattggacagaactgcaatatgttgcaatct

SEQ ID NO: 22811 - DNA, 382 bp, Gossypium hirsutum
  Clone ID: LIB3272-016-P1-K1-G7
ggtggcaggaaacggtgcgtattcgccacgttttttcagcatctctttctcgattgttctctgttttttgtgttttattgcttgtttggctgcgaagagagtgagagagatcaggcaaaaatggcgtgtacgcacgaccacagctgcgaagatcacgattgttcttctaattggtctctttacaagcacatcgacctcgccaaggttaccgctttaaatgaggctaatccaggaagtgttaaatcggtgtttaaggcctgggaggagcgattaaattcttctggggaacgcttggaaagtaatgagggtgatcctgagttacttgtttacattccgtttacatcagatgttaagatcaagagtatatcagttgttggtggtg

SEQ ID NO: 22812 - DNA, 386 bp, Gossypium hirsutum
  Clone ID: LIB3272-016-P1-K1-G8
catcccccgcccctaaaaaatctcactcatataatttaaattcgaagaatctgctacaccaaagactagttactcgaattcgttaattttaagtcgaagaaaaatgggaggtggtagggaaggcgaatcaagtgacaaagggctgttttctcatcttgctggctatgccgccggacattatcctccgcctggatcctaccctccacaaggatatcctcctcaaggatatcccccacaaggatacccaccggctggatatcctccaccagcgggatatcctccacatggcggatacccacctgcagggtatcctcctcatggaggataccctcatccacctcatggtggatatccaccagctggttatcctggacacggttcgcatg

SEQ ID NO: 22813 - DNA, 382 bp, Gossypium hirsutum
  Clone ID: LIB3272-016-P1-K1-G9
ctcctttgctctttctattggtcttggaaaatggaagcctccaagcctaggatctgacacaaaccaaaaccctaagagagagcgagagagagagagagagaggaccacgcaattttaatctataaatcatccatcccctttataagttgcctgcgtccacccctccatcgtattttattctatctcagagtagatcactcccaaggttttctctctttcatctatctaagttgttgagtatggttttctgggtttttggttatggttcactggtctggaaccctgggtttgagtatgatgagaaagtcataggcttcatcaaggattacaggcgtgtttttgaccttgcatgcattgatcacagaggtacacctgaagatcc

SEQ ID NO: 22814 - DNA, 355 bp, Gossypium hirsutum
  Clone ID: LIB3272-016-P1-K1-H1
attgataacttcattgcaaggtcaaggttgagctcagatgttcctgctccgcccagcaacactgctgtaggaggaaaagcatctcttttgccaaaacgtactcctgtctctgagagggaaatcgaggctattctgttaggcggctgcttctgaattttcagctgtcaaagctagctttcccgaagctcgaaataaaatttctgatctgttatttttctcccatcttagttctctgatatgtaaagaactgtttactgaagtttaaaaagctcaaaagaatcaaaatttgtcttaaaaaatcattgtgggatgagacttgattctcagtgaaataatatgtggaaactctatttct

SEQ ID NO: 22815 - DNA, 365 bp, Gossypium hirsutum
  Clone ID: LIB3272-016-P1-K1-H10
gctttgaagtgcagaatcaaaggattgtgggtggagaagaagcggtgacggatctaacttggaactccctttctcttcttaccgctattcccgacctatctctaaccccctcaatttctctcaggtagatattccttgtgttcaagcgtcttcatggcttcaaagcggattttgaaagaacttaaggatttgcagaaggatccaccaacttcctgtagtgcaggtcctgtagcagaagacatgtttcattggcaagcaacaattatgggcccctccgatagcccttttgcaggaggtgtgtttttggttaatattcattttcctccggattatccattcaagcctcctaaggttgcatttaggac

SEQ ID NO: 22816 - DNA, 368 bp, Gossypium hirsutum
  Clone ID: LIB3272-016-P1-K1-H11
aaaaatattatctacatctatcttggccgattgctctttgtgctctcatatggctatggaggatgctgagcaaccgcttctttcccctcggctagtcggcgaggacagccaccaccaggagcagttactttctagactatcaaacaccaccttcacggccggcatcgatgacatcccaccgatcaacggcgtccgtgacttcttcagagaatacctgatagagtccaagaagctctggttccttgctggccccgccatcttcacatctctttgccgatactccctcggcgctatcactcaagtcttttccggccaagttggcactctagctcttgccgccgtctccgtggagaattcattcatccccg

SEQ ID NO: 22817 - DNA, 316 bp, Gossypium hirsutum
  Clone ID: LIB3272-016-P1-K1-H12
gggaatcagaaaatggagaaaactgatggaattgggaacgaaaatggaagcacagaagaaaagcaaagtttcaaagatggatcaatttgtgggtttaattcgcttcaccacctcttgagcgcaaatctcaagcctcaactctaccaggaagtcacttgggtgcttttggggctgatattgcgaaaaacacttgaaactattgttccagccgaatcaactcaagccctcttctcaaaacatgattttgatcttcaagcttttaaattttttgctgacaaagagttgttaagagaaccccgggtagtaagggtcggtc

SEQ ID NO: 22818 - DNA, 382 bp, Gossypium hirsutum
  Clone ID: LIB3272-016-P1-K1-H2
cttcttgcttccatcttctcattgctgtgggtgcgtatcgaccccttcacctcagaagctacaaaagctgctgctaatggtcaatgtggcatcaactgttagtttcgtttctggattattttattccagtaaaccctctctccttcaagttggctattgtgtatataaccaaaggaaaaagagacgtcgccctattatctgcaaaaagattatttctactcctgcggcatgatataagtttatggggacctaagaccagccgccctattatctttttggtcacttctattcttctacgtggtattgctgatgaagtttgatgttggtgttgtgtaattctatgagtatattgctttcattattatgtagagatatttattca

SEQ ID NO: 22819 - DNA, 384 bp, Gossypium hirsutum
  Clone ID: LIB3272-016-P1-K1-H3
caggtgttcttggtttctgagtattgaaggaattctctgtttttctttttaaagctaaagagttcagcttttggggttgatgccttgttggtttcttggcttatattgaagaatttttgtgttcaaagtccatttccttggtgctttatcatggattccccacagtcagttgtttcaccattcaagaactctgttgtagctgagcctgagaagcagaaaaccgagtttttcagtaggaactcgggtggtttgttgtcaaatgggtccgaggttaacaaaaaggaagaaattccattggtgttcttgaggtttatgttcatcaggcaagagatatccataacatctgcatttaccacaagcaggatgtgtatgctaagctttgtc

SEQ ID NO: 22820 - DNA, 383 bp, Gossypium hirsutum
  Clone ID: LIB3272-016-P1-K1-H4
cttgtcttgtctgtttggttcctgagaaagcgaaagaaaacgcaacggtctgtttttaaagacaaaacagtagtggtaatttgattccccctccccccttaattcttgctttaggtatctgttaaaggataaaggtgcgattcttttggtgaaaaaaacaatgaggcctgtgtttgtggggaacttcgagtacgagactcggcaatcagagctggagcgtttgttttcaaaatacgggaggatcgaacgggatgatatgaaatctggatttgcctttgtttattacgaggatgaacgtgatgctgaagatgctattcgcgaacttgataatattccttttggttatgaccgacggcgactgtctgtggagtgggctaagggtg

SEQ ID NO: 22821 - DNA, 388 bp, Gossypium hirsutum
  Clone ID: LIB3272-016-P1-K1-H5
ctccaccattccttctggctccaaagaggttgggaatctgaaaaagcctttcacgcctccaaaggaggtgcctgttcagatcacccactccatgccgcctcacaagattgagatctttaaatctttggagggctgggctgagaacaacattctgactcacctcaaaccagttgagaaatgttggcaacccgccgactttcttccagatcctaattctgatggatttcatgagcaagtcaaagagcttagggaaagggcaaaggagatcccagatgattactttgtagttttggttggtgatatgatcaccgaggaagccctttcaacttatcaaacaatgcttaataccttggatggaactcgtgatgagacaggtgctagccttacc

SEQ ID NO: 22822 - DNA, 371 bp, Gossypium hirsutum
  Clone ID: LIB3272-016-P1-K1-H6
ccggtccggaatctgagtgttcggcccaggcgtccgaaacatagcagccatggcagtccgtatgcttcttgggttaggtgtcctgctactctgccttgcaaaggtttcatctgatctgaaggcagaagaagttataaccaatgtcggtgaggtgggttctttggttaccagaggcggaaacagaagactgatgctagagattgattgtggaggattatgcaagaaaagatgcagtcaacactcgaggccaaacagatgcaacagggcgtgtgggacttgctgcttgaggtgcaagtgcgtgccaccggggacttcaaggaacagggaggtctgcgggacctgctatactggcatgaccacccatggaaacg

SEQ ID NO: 22823 - DNA, 380 bp, Gossypium hirsutum
  Clone ID: LIB3272-016-P1-K1-H7
gagagcaaagactaagaagcgatcaaaaaatggcagcagctccagaaacaaagaccgttcattcaccagcactcacttatttctccatgttatccttgctctcactttgcccactttttgttatcctactatggtatacgatggtacatgctgatggatccgttgttcaaactcggaattatctcaagcagcatggattgcaaggttttatagatatatggccaagacccactgcaattgcttggaaaattatttttgtttatggagcatttgaagcagcacttcaattgcttctccctggaaagagggttgagggtccggtatctcccactggtaaccgacctgtttacaaggcgaatggtatggcagcgtactttgtg

SEQ ID NO: 22824 - DNA, 384 bp, Gossypium hirsutum
  Clone ID: LIB3272-016-P1-K1-H9
ctttcccatccttcgctgttaaactcttccacacttaacttctctttggtgtttccgttttcatttcgaagatgaagaaagcggagctagtgttcatcccattccctgcaaagggccatttggtatccacggttgaagtggctaagcttttagtggatctcaattccaacctctccatctacgctctcatcatcgagcgaaccgtcgacgctgaaagcaccgtctacgccgactctctcaccgccgccagcaccaccactcgcatcaaattcattcacctccctcaacctgttcaagacacagatgcggctaactttattaggagtgtagttcaaacccatgaaccactcgtgagagaggccgtcaccataatagttgagcact

SEQ ID NO: 22825 - DNA, 428 bp, Gossypium hirsutum
  Clone ID: LIB3272-017-P1-K1-A1
ctcatttccagaaacatccattcaggttatcgttttaggtttgcaacactgtctggcacccaatatgcgaagccgaacctcaactatgcaacgagcattttcagtgtccaaaaaagatgggcttctcaagctaagacatctgaggatgacgacaaaatcagcatcggtcctcgtaaaagcaaagaagacgacgaagatgagaaggatgccggggttgtttactacggtccgatttcttctacaatcaagaaagtaaagatgctttcactttcgacctgctgcctctcggtatcgttaggccctgtcattacattcatgacttctcctgatatgaatgtgattgtgaaaggtgcggtagcatcctctgtgatattctttagtgctacaacaactgccgcacttcactggttcgtgagcccttacatcca

SEQ ID NO: 22826 - DNA, 56 bp, Gossypium hirsutum
  Clone ID: LIB3272-017-P1-K1-A10
tgcatttctggatatttgcagacttgtgtatctttctttctttaaagtttctttct

SEQ ID NO: 22827 - DNA, 414 bp, Gossypium hirsutum
  Clone ID: LIB3272-017-P1-K1-A11
ctctatctggtttttagggcttttctaactttcttgataatttttggatatgccaaagttcaatcttttaaaaaagccctaaaatctttgaatcaggtctgagcttgtggtttggtaggcctctttgatcaaactaagtttcatgtctgatcttgacgttcaaattcctactgccttcgatccctttgctgatgcaaatgctgaggactcaggtgcgggtgcaaaggagtatgtgcatattcgtattcagcagaggaatggtcgcaaaagcctgacaactgtccaggggttgaagaaagaattcagctataacaagatacttaaagacctgaagaaggagttttgctgcaatgggaccgtggtccaggaccctgaattaggacaggtgattcaacttcaaggtgaccagcgtaa

SEQ ID NO: 22828 - DNA, 396 bp, Gossypium hirsutum
  Clone ID: LIB3272-017-P1-K1-A12
cttaaggtcatatataatatattatcagcacaaaaagaaaagggggggctctcaagtcttccagctccatcacaaggagtcatatgtatactccaggtaaacaccgctttatctatatatatagttaaaggcataatccgatcgatccaccacgtaggcggtatccatcttcacaaccaccatcttattacactgaaaatccctcggaagcaaatgatttccaccttaatactcctgaaagtaacatcgagtaattccagactatgaccccaacaatccatttcggtgctgttttatgtagcttcaaacggcctcagcactactgtcggctttgtctgactcactttgagccaaaatccgagattaaccacttgtcttgtggtcatctcttttaca

SEQ ID NO: 22829 - DNA, 405 bp, Gossypium hirsutum
  Clone ID: LIB3272-017-P1-K1-A4
ctttcttaacactcttcaagcttttcattacagactctttcaagaatttcctggaggaaaagagaagaagaagaggaggatgttgctgtggaagaggccaaggccacctatgaaaagaaccacaagcatgacagagatcacttttgatctaaacaccaccaccaccaccaacgccagaacttcaccctttgatacacataacccttttaacaactaccccaaacaggctttccctttcggtggcgcagcaccttctgtagctgttgctggcggtggtgttggactcgaagggttggatcaacggttgttggcgacggtgtcacctagagttcatagaatgcattcagctgattgtatggaaacacctcatttcttaaggtcttgcggtctttgtagacgtcgcct

SEQ ID NO: 22830 - DNA, 416 bp, Gossypium hirsutum
  Clone ID: LIB3272-017-P1-K1-A5
atcaaatcgaagatgttgagagtggcaacgaggcggctcacttcttgttcgtctgcgtggaggtcgcaccaggccacctccgctatcgcctctcgtcctttcatcgacggctccgattcttctgattgtctcagatccaatttctcctcctcctcattttccttctctttcgcttctcaattccttcttcccaccagaggttttgcttctgagtcactcaccccaaaaagtgaccacagtgtgattcctgatgttccagcaacagtggctgctattaagaaccccagttctaaaatagtttatgatgaatacaaccatgaacgttttcctcctggtgaccccagcaagcgggcatttgcctattttgtcctgacaggtggtaggtttgtttacgcatctgttatccgtctgctcat

SEQ ID NO: 22831 - DNA, 409 bp, Gossypium hirsutum
  Clone ID: LIB3272-017-P1-K1-A7
aaaattcctttttccttttctgtttacttctctgggtcataattttttttgagatttttgtttaagctttgtggggggaggggggttgcccttttaactatggcttcaacgttgtatactggctctgggttttgtgattgatcttattgcttttggacttgctgatgctgctgagcaaaggaaaagcacctgtcactgttcacactaatgggaacgaaagtttttgcgtttatgataaggatattgcaactgtcttacgtgtaggttcattccttttccttctagacggtcagatactaattatggtggctagcccatgcttatgctgtggtaacgccatgaaaccgcgtggctctagagcatgggcagctgtactcttcatcacttgctgggcgtactttctcatcac

SEQ ID NO: 22832 - DNA, 418 bp, Gossypium hirsutum
  Clone ID: LIB3272-017-P1-K1-A9
catggctaaggtatctttgttgttgttttccttgttcattattgttgcttctgcaattatcaatgggtcagcagcagtggagaaggttgggatatatgagctgaagaaaggtgatctgagtgttaaattcaccaactggggtgcaactattgtttcagtcttcctccctgacaaatatggtaaaatgggtgatattgttctgggatatgattctgtcaatgactacaagaatgatacttcgtatattggttccattgttggaagggttgctaacagaataggaggggctcaatttactttgaatggagtccattataaattgatccctaatgaaggcaaaaacatgcttcatggtggccctattggatttagtgatgttgtatggaaagtgaacaagtataagaaagatggctattct

SEQ ID NO: 22833 - DNA, 425 bp, Gossypium hirsutum
  Clone ID: LIB3272-017-P1-K1-B1
cggaattcttattccttttatatttttcctctccaattttccgtcactttcccgagaaaatgagagaaatccttcacatccaaggtggccaatgcggcaatcagataggagccaagttctgggaagtcgtatgtgccgaacatggcatcgattcaacgggtcgatatggtggtgactcggagctccagcttgagcgaatcaatgtttactacaacgaagccagttgtggccgttttgttccccgcgcagttttaatggatctggaacccggtaccatggatagcgtaagatccggtccttacggacaaattttcagacccgataacttcgttttcggacagtcgggcgccggaaacaattgggctaagggacattacactgaaggagcggagcttatcgattccgttctcgacgtagttagaaag

SEQ ID NO: 22834 - DNA, 409 bp, Gossypium hirsutum
  Clone ID: LIB3272-017-P1-K1-B10
gagtgttgcttttcatactcatttagcccctttcattagcatcaaagtgactgcagttttttttttgactgaaaaatggttggttgggttggaaactggggttggggtcctggtggaagggtggcaaaggcttgggggggtgcaagatgtattcagacctgaacgctggcgagatgaccacaactgaaactttggttcttggtgttgcaccccagaaagcacactctgggggtgctgagatggaattcggagctgagaacggctgcaagtgtggagacagctgcacctgcaaccctagcaattgtaaatgattagggaccaaagccaaagctccctggaagcaggggcgcctccgtatttaaaaaataatatgtagtgctgtttgtgtttgtagaataaagtcagcatg

SEQ ID NO: 22835 - DNA, 407 bp, Gossypium hirsutum
  Clone ID: LIB3272-017-P1-K1-B11
aaaattttaaaccgacactttcgccattccccaattttcatcatttacaacaagaagttttagggttagggattatttttgaaggatgagtcccaccgaaggatcaacgaaaggcgggagagggaagcccaagtcaaccaaggcggtatcgagatcgcataaggctgggcttcagtttccggtggggaggatcgctaggttcttgaaagccggaaaatatgctgagcgtgttggtcccgaacttccgtttattttttcggcctattaaaatattttgcttgtgagggtttagagcttgcttgaaaccccacgagagacaattaaaagaattgaatagttccaaggcatatccaactagctgtaaggaacgatgaagagctaagtaagctttgggttcagtcaccatt

SEQ ID NO: 22836 - DNA, 422 bp, Gossypium hirsutum
  Clone ID: LIB3272-017-P1-K1-B3
ttcttcatcagtttttttttgtcaattttttcttgaactcatagtaaaaaaaacccataaattttccttccaagagtatcaattatttttggtttctgggtatagcttataattcaaattattaaccttttattttttaaagacaatgattttgccattgttgaaattgtatgacaaaggaactagtgttgttaaaagctattacttttggattttccagatttttaatacttataggattgaaacttaagaaccaaatttcattattttcttgtttcatttccttaaaagttataagcgattgtgtagttagataaagaaatttaagtaacattgagataatgggagggccatcattgccaccaggttttcgttttcatcctactgatgaagaattgattggatattacctcaaaagaaaa

SEQ ID NO: 22837 - DNA, 415 bp, Gossypium hirsutum
  Clone ID: LIB3272-017-P1-K1-B4
caccgccataagcgaaatcaaaagccagcagcgctgcagctaaaagagcagtcgtttgacaattattcgccatgggtaaggttcacggatctctagctcgtgctggtaaggtgagaggccaaactcctaaagtggccaagcaagacaagaagaagaagccccgtggccgcgcttacaagcggatgcaatacaaccgccgcttcgtcaccgcagtggttggatttggcaaaaagaggggacctaactcatctgagaagtaagagatctatgtaggtgaaagaaggcaagaagccttgttgaaagctttgatggattttaagtctttgttttcttttgataatgtttttatgatactggtttcaaggattggattgaactaccattttgtttgctagatattatgtgatattggtat

SEQ ID NO: 22838 - DNA, 419 bp, Gossypium hirsutum
  Clone ID: LIB3272-017-P1-K1-B6
tacatcttcgctttgagattagatccaaaattcccctttcatcttatttccgattccccaatttttcctgaaaccctaatcctaatcccggattcctctcgtctacatcgtctagcaaatggcaaccgaggagccggcagtcgtggcagaccccgcaccggagacggaggaggacaagactgctgagaccaaagctacttcaaaatctggcagagcaaagaaaaccaaagaacccaaaaccaagaaagctgcagctcctcggaaaccacgggctgctcctactcatccaccttacgaagagatgatcaaagatgcgatcgttactttgaaagagaggacaggttcaagtcagtacgccattgctaagttcattgaagagaaacagaagaatcttcctgggaatttcaagaagcttcttc

SEQ ID NO: 22839 - DNA, 419 bp, Gossypium hirsutum
  Clone ID: LIB3272-017-P1-K1-B7
aaatggttgagaattttgagatgggtgtgtcaaataagactcctgagttcatcaagataaccctttggggaaggttcctgtgttggaaacacctgagggtccggtatttgagagcaatgccattgctcgttatgttgctcgctcaaaggttaacaaccctatatgtggttctacattgattgattatggtcatatcgagcaatggattgattttgcagccttggaaattgatgctaatattgccaaatggttgtatccaagacttggttacggtgtttaccttcctccagctgaggaagctgctattgctgcattgaagagagcccttggcgctttgaacactcatcttgcttccaacacatttcttgtgggacatgctgtcacccttgctgacattatcatgacatgtaatctctact

SEQ ID NO: 22840 - DNA, 418 bp, Gossypium hirsutum
  Clone ID: LIB3272-017-P1-K1-B8
cgcaaatctcgctttcggaaaatcctcaaatggcagaccaaccgcagatttatgaactcaacaatggaaccgtggttgttaagatcaccaactatggctgcactatcacctcattgtctgttcctgacaaaaacggtaaattagccgatgtcgtcctgggattcgacactgtcgaaccgtacgtgaaaggtgcttcaccttattttggatgcattgtgggaagggttgcaaacaggataaaaaatggcaagtttactcttaatggaacggagtacactttgccaatcaacaagcctccaaacagtctccacggtggattcaagggttttgacaagagaatatgggaggtagcagaatataagaaaggcgacaaaccctccattacttttaaatatcgcagcagcgatggtgaggaggg

SEQ ID NO: 22841 - DNA, 363 bp, Gossypium hirsutum
  Clone ID: LIB3272-017-P1-K1-B9
cgggttaaaattcctgaaccgggacgcggcggctgacggcaacgttagggagtccggagacgtcggcggcggcctcgggaagagttatcttttctgtttaacggcctgcccaccctggaaacggctcatccggaggtagggtccaacggaccggaaagcaccgcacgtcgcgtggtgtacggtgcgcccccggcggcccttgaaaattccgaggacccaatgccgtacgcgcccggacgtactcataaccgcatcaggtctgcaaggtgaaccggccttgggccatgggaccatgttagccaggggaggtggcaaaatggaatcctaacctccgcaaaaggattggctctgagggctgggcac

SEQ ID NO: 22842 - DNA, 414 bp, Gossypium hirsutum
  Clone ID: LIB3272-017-P1-K1-C10
aaactaccccccatcagatgccttcctctttgcagctccaccgcaccaccaccgccgttggcacctgccaccaccaaaaacaacaacctccaccccctaccactctcacgacctttttccctcttcctactggcgtctcctttcccgacatggtctccgcctaccacttccacaccttgggtcctaaccagtgttgctccgctgtggttcaaaccatcaacgcccctgtcgaaaccgtctggtcggtggttcgccgtttcgataaccctcaagcttacaaacacttcctcaaaagctgtcatgtcatcgtcggtgacggtaacgtaggcagcctccgtgaagtccacgtcatatcgggtctccccgccgctttcagcaccgagaggcttgaaatcctcgacgacgaacatcacg

SEQ ID NO: 22843 - DNA, 408 bp, Gossypium hirsutum
  Clone ID: LIB3272-017-P1-K1-C11
aaaacaagagaaaaaatcatggctacaaagtcattggcaatggtaggaggtggtggactgacacagtcatgtggggcgtacaaacggccactgtagaactcactgccgatcaatgcaagcatgaaaggaacctacacattaccctttgcaagccgctagcgtacggtttgctttcgtgcatggaatgctgtcagcgcgtaaggggtaccgatttggaatgcgttcgccccatcatgacgcctaagatccccggccttattgacggcatccgtgccattcgccttattcaaggctggggacgtagtgtttctcgccactacaaatgtggaagtatcacacctacatgagactggcataccttgtgctatactactggttacttatgcttggaggtggaatcagcttctg

SEQ ID NO: 22844 - DNA, 390 bp, Gossypium hirsutum
  Clone ID: LIB3272-017-P1-K1-C12
ccgggaagtaccgggtggaccgacgcgtgcgctttgggtttgaaaaatggagtccaacaccaaaatgtgagctcttcttttgggggtgtgctttttatttcttcagtgacaccaattcttgggtgtggttcatgtgggaaagcaccacacaagcatcgaaagcctaagggaaagtcccctaaaggtcccatcactttgcctccccttgtgaaacctccaatcaagttgccaccggttgttcctccaatagttaagccacccattgacctcccttcggttacagtccctccaattaacctcccttcaaggacggttcctacagtaactaagccaccaagtgggaaaccctgcccaacaccaccaaccaaggacacttgccccattgacaca

SEQ ID NO: 22845 - DNA, 422 bp, Gossypium hirsutum
  Clone ID: LIB3272-017-P1-K1-C2
ctgcttctcttctccttctcttgcctttccaggttccaaactctcgttcttcctccagctcctatcctttaacaggaaatggcggttacattcaacgacttgggttctgctgccggcttgaagaagctcgatgagtatctcctcactcgcagttacatctctggataccaagcttcaaaggatgatatcaccgtctacacagctctatctggggccccatcgtctagctatctgaatgtttctcgatggtacaaacacatcgatgcccttttgaggatctcaggtgtttctgaagaaggctgtggtgtgactgttgagggatttgctcccgctgaggctgtggccactcctccaactgcagattcaaaggctgcagctgctgaagatgacgacgatgatgatgtagacttgtttggtgaaga

SEQ ID NO: 22846 - DNA, 419 bp, Gossypium hirsutum
  Clone ID: LIB3272-017-P1-K1-C3
ccggcacttgctgcatcaaaagatacgtgatccatacatgcacccccagtttgttgcagatgtgatgaagcctcttctcattgagcaattaatggatcaggaagtggttaatctctctggaggagagctgcaaagagttgcattatgcttatgtcttggaaagccagcagatatttatctgatagatgaaccaagtgcttatcttgactccgagcagcgtattgttgcttctaaagtcataaagaggtttatcctccatgcaaagaaaactgcgtttgtggtcgagcatgattttataatggcgacttacctcgcagatagagttattgtctacgaggggaagccttcagtggattgtattgcaaacgctcctcagtccttgttaactggcatgaatctgttcctatctcatctggaca

SEQ ID NO: 22847 - DNA, 418 bp, Gossypium hirsutum
  Clone ID: LIB3272-017-P1-K1-C4
aaaaaaaaaaaccccaaacagacaatagcctaggacaggaggatctctcagggtttaggtgatggcttcaaagcggatcttgaaggagctcaaggatctccagaaagatcctcctacctcttgcagcgcaggccctgttgctgaagacatgtttcattggcaagcaactattatgggtcctcctgacagtccttatgctggtggagtgtttctagtcaccattcatttccctccggactatccatttaaaccaccaaaggttgcattcaggacaaaggtctttcacccaaatattaacagcaacggtagcatttgccttgatattttgaaggagcagtggagccctgccctcaccatatccaaggtattgctatctatctgctcactattgacggatccgaatcctgatgacccattg

SEQ ID NO: 22848 - DNA, 414 bp, Gossypium hirsutum
  Clone ID: LIB3272-017-P1-K1-C5
cgacaaaccacctaaactgaccgcaccttttgaaatggggaaactactacctgtgtctggatttatctgtaaaatacacaacctatatcgtaaatccaaatcttggtttgttttcctacccgcaatactgatggagatggaagcctattcaggcagtcaacgcctgcattttgcgaagatgggatctggatgccaacattataggaggagatgcaagattcacgctccatgtcgcaacgaggtttggtcgcgtgtggcattgccataaccaagctgtgaacctgttaagtaacccttttgacaggcacgagcttgttcgaaaagatgttgaacaagtgatttgctcggttagtgacacagaaccaggccgctgctcaactttgttcaaatagcggagtcaatatacgagaatac

SEQ ID NO: 22849 - DNA, 404 bp, Gossypium hirsutum
  Clone ID: LIB3272-017-P1-K1-C6
cggacgcgtgggttgtatttcatactcatttagcccctttcattagcatcgagatcactccagttttctttatcactgaaaaatgtcttgctgtggtggaaactgtggctgcggttctggctgcaagtgtggcagtggctgtggaggatgcaagatgtacccagacctgaacgttgccgagatgaccacaactgagactctggttcttggtgtagcaccccagaaagcacactttgagggagctgagatggaattcggggctgagaacggctgcaagtgtggagacaactgcacctgcaacccttgcaattgtaaatgattagagaccaaagccaaagctccctggaagcagagacgcctttgtctttaagaaataatatgtgttgttgttatgtgtttttaga

SEQ ID NO: 22850 - DNA, 419 bp, Gossypium hirsutum
  Clone ID: LIB3272-017-P1-K1-C7
cttgttcttgatgaagcaacagcagcagtggatgttaagactgatgcttttatccagaaaaccattcgtgaagaatttaaatcttgcacgatgctagttattgctcacagactaaataccatcattgactgcgaccagattcttgtgcttgatgctggtcaggttctagagcacagtactccagaggaactgctagctaatgaagaaagtgcattctctaaaatggttcaaagtacagggcctgcaaatgctgaatacttacgaggcttaatttttggaggtgaggagaataggtttagtggagatgatgcccggttagatggtcggaagagatggctggcatcatcccgctgggcagctgctgcacaatttgccctagctgttagcctcacttcttcacagaatgaccttaaaaggtt

SEQ ID NO: 22851 - DNA, 418 bp, Gossypium hirsutum
  Clone ID: LIB3272-017-P1-K1-C9
attcctgctcttttgttaatcaagtagagatcagaggatgagtgaaggcaacggccaaggcggcagccgcagtggagatgatggaagttgtagagatcctggaagcagtaacagcaggccgccgaaaacgcctcagacacccattagcgacccaccaatgaagccaccacagaggggaggtgtgatgaagaggattataaaagattttggcaaaaccttgtcttctcactcttaaaccgcttagattattatagtctcgtctcttccatatgtttaattatgtagtgagcagctagagatcaaaataacccacagacgaagtctaggataagggtttgtgtgttggtttgtctaaaattatttctctatattatgaatccaagataccccaaagaaactgaaaggtccaatttcacta

SEQ ID NO: 22852 - DNA, 423 bp, Gossypium hirsutum
  Clone ID: LIB3272-017-P1-K1-D1
acgacaccctgccgccgcaacaatgaagtacaacccgcgtgtctcctcctctcgccgcaagagccgcaaggctcatttcacagcaccttcttccgtccgccgcgtcttaatgagcgcacccctctcatccgatctgaagtccaagtacaacgtccggtctatgccggtgcgcaaggatgacgaggtccaagtggttcgtgggacctacaagggacgcgaagggaaagtggttcaagtgtaccgccgcaaatgggtgatccacatcgagcgcatcacgcgcgagaaagtgaacggttccaccgtcaacgttgggatcaacccatccaaggttgtcatcaccaagctgaggctggacaaggataggaagtctttgctggatcgtaaggctaagggacgcgccgctgctgataaagataaggggac

SEQ ID NO: 22853 - DNA, 418 bp, Gossypium hirsutum
  Clone ID: LIB3272-017-P1-K1-D10
attatcaatttgaagccttcttcgaatttcctcattcaagatgcaaatgttcgtcaagacccttaccggaaagaccatcacattggaggtggagagttctgatactattgacaatgtaaaggccaagattcaggacaaggaaggcatccccccagaccagcaaaggttgatcttcgctggtaagcaacttgaggatggccgcacgttggctgattacaacatccagaaggagtccacactccacttagtgcttcgcctccgtggaggaatgcaaatttttgttaagactttgactgggaagaccattacattggaggtagagagttcagataccattgataatgttaaggcaaaaattcaggacaaggagggaattcccccagaccaacagaggctgatttttgctggtaagcaactg

SEQ ID NO: 22854 - DNA, 415 bp, Gossypium hirsutum
  Clone ID: LIB3272-017-P1-K1-D11
gtatcttatccatatccgacgaacagaatttcctgccaaagtagttcattggtgtttcctatccgaattctccgcttagaaaattttgctttccaaatcaaaagaatcataaaaaaggaaaaatggcgacctctgctttagccattgcaactgcaaagccattgacccatcgtttctccaactctaagcacacttcatcaccatccttctcctgttcttgctcttcttccacgccactcccacctcccaacgaacccaaactctctttcagctcaaaacctgttgcgaaacaatgtgttttcaatgtgggtgttgggcttttagcaacttcacttcttgcttgttcaccattggaggctgatgccaccaggatcgagtattttgcaactgtgggggaacctcaatgtgagctcaa

SEQ ID NO: 22855 - DNA, 413 bp, Gossypium hirsutum
  Clone ID: LIB3272-017-P1-K1-D12
gctttggaagcatggacttcatagctactatcctgtttctagctcttgtgatgtcctccaccaaatttttggacccttgcagccctcagccagatgactcggaccttttggtcatcccaatctatggcaaatgttcaccattcaacccacccaaacctgactcatcgttcaacacagtcatgaacatggcatcaaaagacccatcaagggtcaagtacttgtcgagccttgtagcccaaaagaccactgcggttcccattgcttcaggccaacaagtcctaaacattggcaactatatcgtccgggtaaagattggcactccgggtcagctcatgttcatggtattggacactagcaatgatgtggcttgggtcccatgctccggctgcaacgggtgctcagccaccactttc

SEQ ID NO: 22856 - DNA, 419 bp, Gossypium hirsutum
  Clone ID: LIB3272-017-P1-K1-D4
ctttgggtttgaaaaatggagcccaacaccaaaatgtcagctcttcttttggggtgcatgcttttcatttcttcagtgacaccaattcttgggtgtggttcatgtgggaaagcaccacacaagcatcgaaagcctaagggaaagtcccctaaaggtcccatcactttgcctccccttgtgaaacctccaatcaagttgccaccggttgttcctccaatagttaagccacccattgacctccctccggttacagtccctccaattaacctccctccagggacggttcctacagtaactaagccaccaagtgggaaaccctgcccaacaccaccaaccaaggacacttgccccattgacacactgaaattgggtgcttgtgtggatctgctgggagggttggcgcacattggactaggtga

SEQ ID NO: 22857 - DNA, 421 bp, Gossypium hirsutum
  Clone ID: LIB3272-017-P1-K1-D5
caatcgccgagaaaaaaaatgcagcaccagaggctgaagcaacagcaacaaggcgtggatgcaacaagctcttcttcaacagcagtctctctatcatcccggcatcttagctcctcctcagatagagccaattcccagtggaaatctgcctcctggttttgttccaagcacttgccgcagtgtgtatgtgggaaatatccatacacaagtgactgaaccactacttcaagaggtttttgcaagtactggccctgttgaaggttgcaagcttgtcagaaaggaaaagtcatcgtatggattcgtccactacttcgatcgcagatcagctgctcttgctatattgtctctaaatggaaggcatttgtttggacagcctatcaaggtcaattgggcatatgctagtggtcagagagaggataca

SEQ ID NO: 22858 - DNA, 419 bp, Gossypium hirsutum
  Clone ID: LIB3272-017-P1-K1-D6
cggacgcgtgggtttcctctttcaattctctgggcacccctctcagatcttggaatctctcaccatccagaataaaaggatggggctttcttttgctaagttgttcagtcgcctgtttgccaagaaggaaatgcgtattctgatggtgggtcttgatgctgctggtaagactaccatattatacaagttgaagctcggagagattgtcaccacgattcccactattgggtttaatgtggaaactgtggaatataagaacattagcttcaccgtttgggatgttggaggtcaggacaagattcgacctttgtggaggcactacttccaaaatactcaggggctaatctttgttgtggatagcaatgatcgtgatcgtgttgttgaggccagggatgagcttcaccgtatgctaaatgagg

SEQ ID NO: 22859 - DNA, 415 bp, Gossypium hirsutum
  Clone ID: LIB3272-017-P1-K1-D7
gtcttcctggaaggaaatccgtacttgctagtgatcacaatggtcgtttctgtgcttcattctgtgtttgacttcttggcttttaagaatgatatccagttttggaacaaaaataagtctatggaaggattgtctgcaaagtctgttgtggtgagctttttgtgtcagcttatagttttcctctatctactcgataatgagacctcatggatgatactggcaagttctggaattggttgttgcatcgagttttggaagatagggaaagcaatgcacatagaggtcgatagaaccggaaagatacctatgttgaggttccgagatcgtgattcatatgcaagcaataaaactaaggaatatgatgatatagcaatgaagtatttgtcctacgtgctcttcctccttgttgcaggct

SEQ ID NO: 22860 - DNA, 402 bp, Gossypium hirsutum
  unsure (1)..(402): unsure at all n locations
  Clone ID: LIB3272-017-P1-K1-D8
caccgccataagcgaaatcaaaagccagcagcgctgcagctaaaagaggggtggtttgacaattattcgccatgggtaaggttcacggatctctagctcgtgctggtaaggtgagaggccaaactcctaaagtggccaagcaagacaagaagaagaagccccgtggccgcgcttacaagcggatgcaatacaaccgccgcttcgtcaccgcagtggttggatttggcaaaaagaggggacctaactcatctgagaagtaagagatctatgtangtgaaagaaggcaagaagccttgttgaaagctttgatggattttaagtctttgttttcttttgataatgtttttatgatactggtttcaaggattggattgaactacccatttgtttgctagatattat

SEQ ID NO: 22861 - DNA, 342 bp, Gossypium hirsutum
  Clone ID: LIB3272-017-P1-K1-D9
ggattgattaattttaaaaatcttccattattgttctctcagtctccctttgggtttagatctcataaaagctctaatctgatggctgctaccatcgtttccattaaagctaggcagattttcgacagccgtggaaatccaacggtcgaggttgatgtggaaacatccaacggtaaaaaggctagagccgcagtttcaagcggtgcatccactggaatttacgaggctcttgaactgagagatggaggttccgattaccttggtaaaggtgtatcaaaggctgttgctaatgttaacacgattatcgggcctgcattgattgggaaggatccaactcagcag

SEQ ID NO: 22862 - DNA, 370 bp, Gossypium hirsutum
  unsure (1)..(370): unsure at all n locations
  Clone ID: LIB3272-017-P1-K1-E1
ctttgaagtgctcaaatggctatgcataaggtgtttggtgcggttttatttgtgttcttaggtgtaggcatctgttctgcaactagagctctactcactctaaatgatgtaggttctcacctaccaggtattggtcatggtggtgccaccattggtgtatatggtggtgttgggctcggtggaggaggtggaggcggttcaggaggtggtggtggttctgcggttgtaggaggaggtgctagtgctggatatggaggtggtggtggtagtggagaaggtggtggtgttggaaatgtttttnntctcactagtccgctcaacatcattatccttccattgttaaaccatcctttcaccctaaaccaccaaa

SEQ ID NO: 22863 - DNA, 408 bp, Gossypium hirsutum
  Clone ID: LIB3272-017-P1-K1-E10
tgcatattatatcactgcaccatcaagcttagctgagatggctgccagtgcggtccatgcgttgttctatcttgtgtttatgatatcagcatgtgcattgttctcaaaaacttgtattgaagtctcacggtcatctgctagagatgttgccaagcagctcagggaacaacaaatggttatgcctcgccatcgcgagggaagcttacagaaagagctaaggcgctacattctcacagctgctgcattcggaggcatgtgcattggtgcactcacagtattggctgatcttatgggatcaattgggtcatggacggttattcttctcgcagtcacaatcatctatcagtattttgagacttttgagaaggagaaggcgagttatcttggcttctttggactgtgagctta

SEQ ID NO: 22864 - DNA, 415 bp, Gossypium hirsutum
  Clone ID: LIB3272-017-P1-K1-E2
cttttaacgaactcctttctttctctagatctctcgtccttccatctctggttttctttttatcttacattaatataatcaatatctcatagttctttccttgttgttcctcttatttgtgtgtttttgaatgctcatcaacatcttgtccctgatgtttgaggactcatgtctcccgtactcagtgaaatcctcctttctgggtttatgataaactctactctgaggcgcaggacccatcttgttcaatctttctctgttgttttcctttactggttctacgttttttcatgaactctctctctctctctctctctctctctctctctctctctgattgtaaccccatagcccgctcttattttcttcagcttttcttcaccatttttcataaataattccatatctgagtttc

SEQ ID NO: 22865 - DNA, 420 bp, Gossypium hirsutum
  Clone ID: LIB3272-017-P1-K1-E4
cggacgcgtgggttgtatttcatactcatttagcccctttcattagcatcgaggtcactccagttttctttatcactgaaaaatgtcttgctgtggtggaaactgcggctgcggttctggctgcaagtgtggcagtggctgtggaggatgcaagatgtacccagacctgaacgttgccgagatgaccacaactgagactctggttcttggtgtagcaccccagaaagcacactttgagggagctgagatggaattcggggctgagaacggctgcaagtgtggagacaactgcacctgcaacccttgcaattgtaaatgattagagaccaaagccaaagctccctggaagcagagacgcctttgtctttaagaaataatatgtcttgttgtttatgtgtttttagaataaagtagccatgg

SEQ ID NO: 22866 - DNA, 429 bp, Gossypium hirsutum
  unsure (1)..(429): unsure at all n locations
  Clone ID: LIB3272-017-P1-K1-E5
cgnntccgttctnnagatgaggcncnncaaagcanntaaaaaactcanttagaactnnncaagttgctttagggcgcgtgtgtngtgggcncnnttcgtngcgtataacngtannngatggtngnncttgtcnnntgggaccttccannattcnaaaaatnngccatntnngatgacncnntttatanngctanncttcanngatttctngnnagatatgnnacccatatgctnnngtttacaagnntcattctgnnttctgccatttaaaaatccnnncaatttctttaaaaatccnaagcaaaaggggtattccnnngaaattgcaagggcttatctnntgcagaccaatannatgttnnacgtcgcnnaccaaagctttacactttttcttgagtggganannaccaattattttaacnnttgcca

SEQ ID NO: 22867 - DNA, 422 bp, Gossypium hirsutum
  Clone ID: LIB3272-017-P1-K1-E6
cggaagaagaaggtaatagaatagaacctctcaaagagtgagacacagacagaaaagagcatcgaaatgagttacgagagaggtcctcaagatcattatcctcctcctggttattcctctccttatcccccaccgggctatccatcagcccctcctcccccatcttacgaaggctatcctcctccgccaactggatatcctgcctatcctcctcagccgcctcgccagccctacgacggttaccaaggctattttgctgaagggtatccacctcctccgccccctcaacctcatcctcaatatcaacactaccaccactatgaccactaccattaccagaaccagtctgattctggctgtttctctttcttgcaaggctgtttggctgctctatgttgctgctgtgtgttggaggactgctg

SEQ ID NO: 22868 - DNA, 416 bp, Gossypium hirsutum
  Clone ID: LIB3272-017-P1-K1-E8
gttttcttcttatttatcttcttgaattctctcaagaaagccctaaatgcgcgtgggatcaggtctcatcttgtggttgttaagcctatttgatcaactaagtttcatgtctgatctcgacgtccagattcctactgcctttgatccctttgctgatgcaaatgctgaggactcaggtgctggtgcaaaggagtatgtgcacattcgtattcagcaacgcaacggtaggaaaagcttgacgactgtccaagggttgaagaaagaattcagctacaacaagatactcaaagacctcaagaaggagttttgctgcaatggtactgtcgtccaggaccctgaattagggcaggttattcaactgcaaggtgaccagcgcaagaatgtgtcaaccttccttgttcaggctggcattgtga

SEQ ID NO: 22869 - DNA, 415 bp, Gossypium hirsutum
  Clone ID: LIB3272-017-P1-K1-E9
gttgccctggactatgagcaggaactggagactgcgaagagcagctcatctgttgagaagaactatgagttgcctgacggacaagtcattactattggagctgagagattccgttgcccggaagtcctcttccagccatctttcatcgggatggaagctgctggaatccatgaaactacctacaactctatcatgaagtgtgatgtggatatcaggaaggatctctacggtaacattgtgctcagtgggggttcaaccatgttccctggtattgcagaccgcatgagcaaggagatcactgcacttgctccaagcagcatgaagattaaggtcgttgcaccaccagagagaaagtacagtgtctggattggaggatctatcttggcatcactcagcaccttccagcagatgtgga

SEQ ID NO: 22870 - DNA, 416 bp, Gossypium hirsutum
  Clone ID: LIB3272-017-P1-K1-F1
gaaaaaaagttcctttatgggagcttctttggttctcagtcgttgccaatacttcaatcaccgggatgaacttgagccttatgctgaattcagttggattttatcagatttcaaagctaagtatgattccagttgtttgtgtgatggaatggatactacacagcaaacactattcggacaaagtcaagatttctgtccttgtcgtggtggttggtgttggtgtttgtacagtcactgatgtaaaagttaatgctcaaggatttatttgtgcctgtgtcgctgtcctgtctacctccttacagcaaatttcaattggctccctacaaacgaagtactcgataggctcatttgaattgctcagtcaaacagctccaatccaagctctgtctcttttgttgttcggtccctttgttgat

SEQ ID NO: 22871 - DNA, 410 bp, Gossypium hirsutum
  unsure (1)..(410): unsure at all n locations
  Clone ID: LIB3272-017-P1-K1-F10
aaaaatcatatcctcagaaaaaagaaaaaaaacgcaaagaaaagagaaaatgggtactttgggtggaattagccaggtcgatggaagcgccaatagcctggagattgaaaacctcgctcgttttgctgttgatgaacacaacaagaaagggaatacgatgctacagtttaagaaggtgacgaatgtaaaacaacaagtggtttctgggactatgtattacataacattggaggcgatggatggtgacaagacgaaagtttatgaagccaaggtgtgggacaagccatggatggatttcaaggagttacaggatttcaaggttattggcgatgctcccgccggttgtacttccaccgcttaaggtgactggagattgtagaggaaaggatatcangataccgaatgcgggt

SEQ ID NO: 22872 - DNA, 419 bp, Gossypium hirsutum
  Clone ID: LIB3272-017-P1-K1-F11
ggaaaatcatgggtgccaaagttcttttcttctttgctttgctttccttttgagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgttctgtctgctagggaaggcatcgtttcg

SEQ ID NO: 22873 - DNA, 419 bp, Gossypium hirsutum
  Clone ID: LIB3272-017-P1-K1-F2
tctctctcggaacttgcatctctatcagataaagcgaaatctgacaaaattgatggcctcacgtgacaagaaatctgcgaagccgtcgagcagccgcgccggtggaatacgcacgctctcggatctgaaccggccctctggacccgattccgacagcgattccgatgatccccaggagtactacactggtggcgagaaaagtggcatgcttgttcaagatccttcaaagaaaaatgatgtagatgaaattttcaatcaagctaggcaactgggagctgtagaaggtcctctcgagcatcctcgtccatcaagttcaacaagttttactggaaccggtagattactctcaggggaaactgttccttctgcacctcagcagcctgattccattattcacaacatagttttctggaccaacg

SEQ ID NO: 22874 - DNA, 418 bp, Gossypium hirsutum
  Clone ID: LIB3272-017-P1-K1-F3
tttgcttttccccggcttttcatctctgagtccctgtttcttgtttgcttttggtttgttcatatagtactacaatacgttcagtaatggaaccagcttgggtggatactactttggatctcaacatcaacccttgttttcgcaccaacaaagctatgaaacgagaatttgagggagatgtggtcgagtcggcaccagttaaatatgagagtggagtgttggtggaggaattgaatcgggtcagcgccgagaacaagaagctaactaagatgctaacagttctatgcgaacagtattactctttgcagcaccaattcatggaatttgtcaacaagaaccctgaaattgaaactgctgctgctgcaacaacatcatcatcaaagaagagaaaagctgaatgtgaggattatggtgccaa

SEQ ID NO: 22875 - DNA, 402 bp, Gossypium hirsutum
  Clone ID: LIB3272-017-P1-K1-F4
tttcagtaaagaagcaataatggaacttaaagctaaagctaacaactttcaagtgagacgccggcgattttaacgccgccggtgaacttatggggaaacaaagtaacgacaaatataaacccataccggagatttcatcttttcagtcactttccgctctactctggcgagccgtcacgcgtgggaggaagttaccggcttcccaaacgacgacgtttcgcatggcggtgaattgtcgtcaccgattaaacccaaagcttaatccattatactttggtaacgctattcaaagcatcccaacatacgcgtcagcaggtgacgtcacgtcacgtgatctacgctggtgtgcgcaacgattgaatgagaacgtgaatgcccaccatgatgaaacggtgcgtcgtt

SEQ ID NO: 22876 - DNA, 420 bp, Gossypium hirsutum
  Clone ID: LIB3272-017-P1-K1-F5
actccgccatcttcaataatttcttccgttgatctttgttagagattagcttgttaatttttcattatgggaaagatcaagatcggaatcaatggatttggaaggatcgggcgtttggttgcgagagttgctctccaaagcgatgatattgagctcgttgctgttaacgatcctttcatcaccactgaatacatgacgtacatgtttaagtacgacagtgttcacggtcaatggaagcatcatgagcttaaggtgaaggactcaaagacccttctctttggtgaaaagcctgtcacagttttcggtatcagaaaccctgaggaaatcccatgggctgaggctggagctgagtatgttgttgagtctactggtgtttttactgacaaggacaaggctgctgctcacttgaagggtggcgcg

SEQ ID NO: 22877 - DNA, 421 bp, Gossypium hirsutum
  Clone ID: LIB3272-017-P1-K1-F6
caacctttctcagcttaacaacaacaacaaaatggcttcttttatcactccagctgtcttaaaaatattcctcatcatctctttgtttcaaatctgtttgggtgtacgaaagctgagtgaagtggttgaggagcagcctcagctcttgaaataccacaacggtcctctcctttcaggcccaatcaccgtcaatctcatttggtacggcaagttcaggccttccgagagggctattatctctgattttgtcacctccctctcttctaacccttcttcaccctccctaaaaacccaacccacggtggctcagtggtggcggaccaccgagaaatactaccatctcgcctctaagaaatcgtctctttccttgtctttggggaagcagatccttgatgaacactattcgcttggcaagtctctc

SEQ ID NO: 22878 - DNA, 417 bp, Gossypium hirsutum
  Clone ID: LIB3272-017-P1-K1-F7
cactcctccactgactttcaccaccaccgtcactagcggcgccgtcacagagtgtcgtcaacggagtctctcatcctccaactccatgaaatctctgccgttaaattcggtaacttcaagctgaaatctgggatcttctcccctatctacatagacctccgtctcatcgtctcttacccttccctcctccaccaaatctcccactccctcctctcctctctccctccccaaacacactttaacctcatatgcggtgtcccttacactgccctccctatagccacctccatctctctcgacacctccatccccatgctcatgcgccgcaaagaagtgaaagactacggaactgccaagtccatcgaaggtgtttacgaaaagggtcaagcttgtttggtggtggaagacctcgtaacg

SEQ ID NO: 22879 - DNA, 409 bp, Gossypium hirsutum
  Clone ID: LIB3272-017-P1-K1-F9
cggacgcgtgggttcttattgattttgcagatcggttctctaatccttgttgtggggtgtagcgttgtttatacgtttggttgttgttgaagaagtgctactaccatggctacaaagaagagcgttggggacttgaaggaagctgatttgaagggaaagaaagtgtttgttagagtcgatctgaacgttccattggatgataacttcaacataactgatgacacaaggatccgtgccgctgttcccaccatcaagtatttgatgggtcatggctctaaagtcatcctctctagtcatttgggacgcccaaagggtgtcactcccaagtacagtttgaagcctcttgtgccaaggttatctgaactccttggagtcgaggtttaaatggcaaatgactgtattggtgaag

SEQ ID NO: 22880 - DNA, 417 bp, Gossypium hirsutum
  Clone ID: LIB3272-017-P1-K1-G1
ccaggattgaagagataagattatagtgaaaaactaaacataataaagccccttcgacttgcttcattgatttgccctctcaaagcccaagaaaaatggcttctgcttccgctactctcctcaagtcttcacctattatcgacaagtccgagtggattaagggccaaaacctccgccacccttcggtttgttttgtacggtcacaccctacatcggccgcctttgccgtccgtgctagttcatatgccgatgagcttgttaagaccgcgaaaactgttgcatctccaggtcgtggtattttggccatggatgaatcaaatgctacatgtgggaaacggcttgcctcgattggtctcgagaataccgaggcaaaccggcaagcttaccgtacccttctcgtgtctgcccctggcctcg

SEQ ID NO: 22881 - DNA, 412 bp, Gossypium hirsutum
  Clone ID: LIB3272-017-P1-K1-G10
gagctacttaaccatttcccaaatctcctccctcctcttctttagcgtccttggcatttccgctcatgcagcgcgctttgaaatccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccggtgattgtggtggactccttcaatgcaaaggttggggtgtacctccaaacaccctggctgaatatgcacttaaccaatttggaaacatggatttctacgacatttccttagttgatgggtttaacatccccatggtgtttggtccaactaatggc

SEQ ID NO: 22882 - DNA, 416 bp, Gossypium hirsutum
  Clone ID: LIB3272-017-P1-K1-G11
tttaatttttcttggtttcatttggtagcagaaacatggagttctcgctcagacttcagtattaccgtcttgtgtgtgtcatggtgctattacctgcactgtgttactcaaaggactatttcgtgaagtccagagcaacttactatggcagttccgacggcttaggcactacaagtggagcttgcgggtttggagaatacggaagaaatatctctagtggcaatgtcgctggggtttataggctctacaagaatggagttggctgtggtgcttgctatcaggttaggtgcacaacaaaccctcaaatctgtactaagaaaggggtgaacgtagtggtgactgactatggccaaggcgacaacaccgatttcatcctcagccaccacgcatatgaagcgatggcacgaccaggcacc

SEQ ID NO: 22883 - DNA, 412 bp, Gossypium hirsutum
  Clone ID: LIB3272-017-P1-K1-G12
gtgagttcatcaactctatctaacccgttgagcccaaacacccttcggggggtggttcctggtatattgttcagcttcacacctaccaaacatgagccaacatctactgtacggaactattacgtgaagagaaaaacgatcttttatactcccacgggaaatccttaactcactcattgatacaagtccgttatcaaaagcgctgtaacgatccgtacgaaaccgttacccatcaatcccaaaagctagttttacctcttgctcacctcccactatgtgtacgtcgaaaatattggccacacaaatctgctgattacattacttcacgtccacctaaatcatgctgttcacgctcatctacgcataggtattaaacactccaagctttgactattatttgctcttacccttt

SEQ ID NO: 22884 - DNA, 420 bp, Gossypium hirsutum
  Clone ID: LIB3272-017-P1-K1-G2
agatatcactgcaagaaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaaaagcccaccctcggcacctgaacagccaggcacttgccccagagatgcactgaaactaggcgtttgtgctgatttgttgggctcagtgcgcgttgttgttggaccgtcgaggaccaaatgctgctctctcatttcgggtttggctgatctcgatgctgctgtttgcctttgcactgctattaaagctaatgtgttgggggttaacctaaacgttcctgtttcattgtctttgctcctcaattcctgcgaaaagcaaatgcc

SEQ ID NO: 22885 - DNA, 420 bp, Gossypium hirsutum
  Clone ID: LIB3272-017-P1-K1-G3
tttcttttaagataacccccaaaaatgtgtggaggtgcaattatttccgattgcggcgccgtgaaacatgacccgaaattgaccggcgatgacctttggtctgaaattgacatattctccgacctcctaggtttcgacaacaatggcaaaagctttgtcaatcatcagtttcataacaacaacaagaagctgatcaatccaaaagacaatcaacttaacaaagagagaagcgagacgattcagaagacaagccgagtcactaaaaatgttgaaaagactcagcgaactcggaaaaacttttaccgaggaataagacaaaggccatggggcaaatgggcagctgagattagagaccctcaaaaaggcgtccgagtttggctcggtacccataacacagccgaagaagcggctcgagcctac

SEQ ID NO: 22886 - DNA, 333 bp, Gossypium hirsutum
  Clone ID: LIB3272-017-P1-K1-G4
gaatgtccgatctccgcagagtgcttagcattcagctgatattagatgggtggaggcaagcaactgatctcaggcatggagaatgtcaacgaccaagaacacatagatgcacagcagtgtgaaaaatccatgccgtcatctgaagaggaggatgcacctataaggaaaaaatatggtgggatgaagcctaagaaaccaccactcatttctaatgaccacgaacgtgcatactttgactctgctgatagggcacttgtaaagcaaggtggtgagaaacccaaacgaccacttgaagacctaccgcccaaattggaatccacacaacaacctaca

SEQ ID NO: 22887 - DNA, 422 bp, Gossypium hirsutum
  Clone ID: LIB3272-017-P1-K1-G5
ctcaaacccagatttgttctctctctctctctctctctatttccaatcaattaatggctccattggaggagcttagggtttgttggtgttctggtctttgctttgtctgaaaaataaacagaattataaacgaacaccaacgccatgggaagatttgaagagagaggattcgattcagtggtttgccctaagcctatccgaacctttagatggtctaccaacagctgttatcagactgagatggctgattcaaaaactggtgcagagcttcttgatataatcctccccgagggagggtatggggccgagaatcccaccaaccaaatggcttcatcaccaccgtatttctgtggatcaccgccgagcagggcgtcgaatccggtaatccaagatgcccgattcaacgacgagcagccggtgct

SEQ ID NO: 22888 - DNA, 422 bp, Gossypium hirsutum
  Clone ID: LIB3272-017-P1-K1-G6
cggaattcttattccttttatatttttcctctccaattttccgtcactttcgcgagaaaatgagagaaatccttcacatccaaggtggccaatgcggcaatcagataggagccaagttctgggaagtcgtatgtgccgaacatggcatcgattcaacgggtcgatatggtggtgactcggagctccagcttgagcgaatcaatgtttactacaacgaagccagttgtggccgttttgttccccgcgcagttttaatggatctggaacccggtaccatggatagcgtaagatccggtccttacggacaaattttcagacccgataacttcgttttcggacagtcgggcgccggaaacaattgggctaagggacattacactgaaggagcggagcttatcgattccgttctcgacgtagttaga

SEQ ID NO: 22889 - DNA, 477 bp, Gossypium hirsutum
  unsure (1)..(477): unsure at all n locations
  Clone ID: LIB3272-017-P1-K1-G7
cgnntccgggaggggaagcccnnttccaacttactcnnnaactatgnnnttaatacctnntggatggaagctcnngtgatgannnactggtgnnntagccctnnacttcttgggcnnaacttggacnncagggccnntggactgccnnngaagaaaanncagacacannctgatctnnacttaatnnaagtatctctttacttnngtgtgggagaaagtgganccatgaggcnnaagttgagaagaaccatccagtnnatttgatcggttcaaaggaatggatccgggtacccggagaatagtccttatcntgggattcatctacacnaacattccaagaaagggcaacttttatctcacatgggaatacagctaggctagccaaggtgcatggtgacatgaatttggctcagttatgtggttcaattgcggcagatgaaaagcgccacgagacagcatacactaaaatccttgaaa

SEQ ID NO: 22890 - DNA, 411 bp, Gossypium hirsutum
  Clone ID: LIB3272-017-P1-K1-G8
ttctacttttcgccaggcttcaatgttttgttgacctctcaacttgcttaggggcctttggttgtcgtcgttgtttttcgtgaaaatggcggtggatctgatgagttttcctaagatggatgatcagatggccattcaggaggctgcaacgcaaggtatgaagagcatggagcacctgattagcctcctttctcaccagtctaaccgactcgactgcgctgaggttgccgatctcaccgtctctaagttcaaaaaggtcatctcactaattaacagaaccggtcacgctcggttcagacgtgcaccgattcagtcctcttccttttcctcatcgtcatcatccgctgcttctctaactgttactgattcccacaaggctctaactcgaactcctgccccggttgaaacacc

SEQ ID NO: 22891 - DNA, 411 bp, Gossypium hirsutum
  Clone ID: LIB3272-017-P1-K1-H1
cttcaattcctcatttcaagggagagagtgtatcagtgtttcttcccctctttacttaatttctctccgccatggctctctccgtcgagaaaaccgccgccggccgtgagtacaaggtcaaagacatgtctcaggctgacttcggtcgtctcgagatcgagttagctgaggttgaaatgcctggtttaatggcttgtagaaccgagttcggccctgcccaacctttcaaaggagccaaaattactggttctcttcacatgaccatccaaaccgccgttcttattgaaacccttaccgccctcggagctgaagtccgttggtgttcttgcaacattttctctacccaagaccacgctgccgctgccatcgctcgtgactccgccgctgttttcgcttggaaaggggagaccc

SEQ ID NO: 22892 - DNA, 414 bp, Gossypium hirsutum
  Clone ID: LIB3272-017-P1-K1-H10
ggtttatctgtcatctccaaaatacagtgaaacagttcaggtgactggcgttggatcgctttcgaacactgaggagactaaagattgtgttgcttacaatattgaagccacttcagtgccaaaacctgctattcaggcattcaaattactcaatgagagcccagcagttcagtctgttgttgcttccattgcttctgatccaaatgtatggaatgctgtcctgaacaattcagcttatatggatttcattaaatcccagcagacaaatgataagtttgaatttccgggatctccccgaagttctgtatcttcagtgaagcttgaggaaaatgaagatagtggagattcattttcggcttttatacagaaaatcaagactagtgtggtcgagatggtgagtaaaacgactgattt

SEQ ID NO: 22893 - DNA, 418 bp, Gossypium hirsutum
  Clone ID: LIB3272-017-P1-K1-H11
gcgaattttcagagcaaatttcagtggttcacttcaaagcattccaataaaagtttcttttttatttattatctttggtcacttgcctccatctttcctttgaaatctttcagatttttttttaaatcagggtttctccgcttaaattaagcccaaaaaagggggaataatgttaaccagtaagacattaattcaacctccttccattcatctccaaaaccctaatcttaaaccctctccttcaatccctaaaagacccaccttctcatcccttccttttcaccgatcatttttactgtctttttcacataatttgacgccccgaaatcttagccgtcactgcattagccctggccaggaactgagttatgaaaatgaagatttagtcgaagaacaaaatgaagaagaagaagtggaa

SEQ ID NO: 22894 - DNA, 302 bp, Gossypium hirsutum
  Clone ID: LIB3272-017-P1-K1-H12
ttgaaattaaaataacacctatcttctcttctctcacaccttaataaaagggggcgacttcttcttttatggagaaaccgaccccatctccgatctcattccccatcctccctgtttacttcttactacactccacagccacactctccatctacctgttccttcgctattccctattccagaaaaactttctcttcacgttcaactttcttaaatcaaccatcatctacttcttcaccacgttttaacctgcacagaatctcatcatcatcttccaatgcgcagttcattctctacaacct

SEQ ID NO: 22895 - DNA, 394 bp, Gossypium hirsutum
  Clone ID: LIB3272-017-P1-K1-H2
cgcctggtagtgcttcaacttatcaggtaactgaagaatctgttgttgtgtgtgatgtcataaacctctccaatggagattgaccctaaacctgattctgaaaatgacgccctctttctcgttaagcaaggagctgaagctagagttttcgagtccgtattcgctgaaaaaaggtccatcatcaaagaacgcttctccaagaaatacaggcaccctgctcttgattctaagctcactctcaagcgtttaaacgcggaagctaggtgcatgaccaaggctcgacggcttggcgttttaactacggttctttacgccgtagaccctgtgatccataccctgactttcgagtacgtcgaaggcccttccgttaaagatgtttttctcggaattgggt

SEQ ID NO: 22896 - DNA, 420 bp, Gossypium hirsutum
  Clone ID: LIB3272-017-P1-K1-H3
ctaagatatcactgcaaaaaaaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaagagcccaccctcggcacctaaacagccagccacttgccccaaagatacactgaaactaggtgtttgtgctgatttgttgggctcggtgcgcgttgttgttggaccgtcgaggaccaaatgctgctcactcatttcgggtttggctgatctcgatgctgctgtttgcctttgcactgctattaaagctaatgtgttgggggttaacctaaacgttcctgtttcattgtctttgctcctcaattcctgcgaaaagcaa

SEQ ID NO: 22897 - DNA, 420 bp, Gossypium hirsutum
  Clone ID: LIB3272-017-P1-K1-H4
tggtagctttctctttgttcctccaaactgtgtgcttagatttgaagacctagtccgtgtgatcaaatcttgttgttcatttctgggtttaatttctcaagaaaaagaagatgacaaaagataggcaaatcggtgtagcaatggatttctccaagggaagcaaaccacttttaaaatggcaacccaccatttggtaaacaaaggaaaaaccctttaccttattcacgtcaaacccaatcagagcgacgagtctcgtaaccttctttggttcaccagtggctcacctttgattccattatcggagttcagagagaaggaagtgatgaaacattatgaggtggaacctgatcctgaggttttagacttggttgatacggcttcaaggcagaaagagatttgaagcttgattgtttggtcatg

SEQ ID NO: 22898 - DNA, 422 bp, Gossypium hirsutum
  Clone ID: LIB3272-017-P1-K1-H5
cgataaataaaaaatgagctttcttcaggccttgtcagttttccttttgtttttggggtatgtagtcgtaggatcagctgagcagtgtggaaggcaagcaggtggtgctctttgccccggtggtctatgttgtagccaatttggctggtgtggcagtactgctgactactgcacagttcctggttgccaaagtcagtgcagcggtagtggccctgcccctgggcctggtgggctaaccaatcttatatcaagagagacgtttaatcggatgcttttgcataggaacgatggggcttgtcctgcccgtggcttctatacatatgatgctttcattgctgctgcccgttcctttcctgcatttgctacaactggtgaccaagctactcgcaagagggaaatagctgccttcttagcccaaactt

SEQ ID NO: 22899 - DNA, 420 bp, Gossypium hirsutum
  Clone ID: LIB3272-017-P1-K1-H6
gatgattcccatgagaattcaagtgactaggatagccacactccttgtgttggtggcattaattttgggtcaaaaaggagctgaggccaggaaaggaaggatattggagtcgtttgagtacatagctatgagttgcagagcgcactctgcatcaataactgattttggaggaattggtgatgggaaaacatcaaatactaaagcatttcaagatggagtaaatcatctgagccagtatgcaaatgatggcggggctcagttatatgttcccgctggacaatggctgactgggagctttagcctctccagccatttcactctctatcttcacaaagatgctgttctccttgcttctcaggatatgagcgaatggcctgttttgaaggctttaccgtcgtatggtcgaggaagggatgcagc

SEQ ID NO: 22900 - DNA, 416 bp, Gossypium hirsutum
  Clone ID: LIB3272-017-P1-K1-H7
acttctttcactttcaaaaccaaaactagaagatcggggagagaagatggcggccggcgatcacaccgttttgcagctcagtacgccttcaacggcgaacctatcggccaaggttcatcctctcgtcatctttaacatctgcgattgctacgttagacgccccgaccaagccgagcgcgtaattggcacgctcctcggctccgtccttcctgatggcaccgttgatatccgtaactcctatgccgttcctcacactgaatccgccgaacaggttgctttggatattgaataccatcataatatgttagtctcccaccaaaaagtgaatccaaaggaagtaattgttggatggtattctactggccttggagtcacaggtggtagtgcattgatccacgatttttattctagggaag

SEQ ID NO: 22901 - DNA, 419 bp, Gossypium hirsutum
  Clone ID: LIB3272-017-P1-K1-H8
catagtttaccctatctaattgtgttgtttttgaatttaggagcattgctcaggtcactaggctgccctgaatgttaccgccacccatctccgccgccgaaatgtcctccgccagactatccgcctaaacatcatcatcctcccattgtaaagccaccctatcaccctaaaccaccaaaacatcatcctccaaagccacctaagcctccggtggtaaacccaccatatcaccctaaaccaccgaagccaccggtggtgaagccaccgtatcaccctaaaccacctaagcctccggtggtgaaacccccatatcaccctaaaccaccaaaacatccaccgcatcatcccaagccacctgttgtgaagcctccatatatacccaagccacctattgtaaagcctccaccgtatacacccaa

SEQ ID NO: 22902 - DNA, 439 bp, Gossypium hirsutum
  Clone ID: LIB3272-018-P1-K1-A1
catctgcactgtaccttgcagccgtaaaaggaaatgctctggacaaggttgagtgtgaacttcttgaccttgttcaggcatcaaaaaacagtcaattgttttctcaattcactaaggacttgtcagtacctgcagagacacgggtcaaagccattaatgagatatgtgggcaagctaaattttcagatcttacaaagaactttttagttatactagctgagaatggaaggctaagacatatagaaagcattgcaaagagatttgtggagttgaccatggctcataagggagaagtgaaagctattgtcacaagtgttattccccttccttctcaggaggagaaggaactaaaggagacgttgcaggaaataattggacaggggaagcaggttaagctggaacagaagatcgatcctagtattcttggtgggcttgtcgt

SEQ ID NO: 22903 - DNA, 433 bp, Gossypium hirsutum
  Clone ID: LIB3272-018-P1-K1-A10
attcccatttccaatctccagctcccaaggtaaatatgccgatcagaaacatagcagttggccggcccgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatcttatgtggccacgtcaaccccgccgtcaccttccgtgctttcgttggcgggaacatcactctcttgcgcggcattctttactggatcgcccaactgctaagctcaaccgtcgcttgcctgttgcttaagttcgctaccggcgacctggctgtaccagcttt

SEQ ID NO: 22904 - DNA, 434 bp, Gossypium hirsutum
  Clone ID: LIB3272-018-P1-K1-A11
ctttaaaatatagagaaaagagggaccaaagtgaaagaaaatcgaagtatagatgggattttcaatctgcattttcagggtgtggaacaatgggtgcaggtggcagaatgtcggttcctccaagtcaaaggaaacaagaatcgggctcaatgaaaagagcccctatatctaaaccaccatttactctcagtgaaataaaaaaagccatcccaccacactgtttccaacgctcacttatccgttcattttcctatctcgtttacgacttcattttagtctctatcttttactacgtagccaccacttacttccgcaacctccctcagccactatctttcgtcgcctggccaatttattgggctcttaaaggttcattcttactggcggttggttatcgcccatgaatgcggtcaccacgcttttagcgattacca

SEQ ID NO: 22905 - DNA, 432 bp, Gossypium hirsutum
  Clone ID: LIB3272-018-P1-K1-A12
gaaagaagctgctgagatgaacaagaggtcattcaagtatgcttgggtgcttgacaagctcaaggctgagcgtgagcgtggtatcaccattgatattgccttgtggaaatttgagaccaccaaatactactgcactgtgattgatgcacctggacaccgtgactttatcaagaatatgattactggtacgtcacaggctgactgtgctgttttgattattgattccaccactggtggttttgaggctggtatctcaaaggatggtcagactcgtgagcacgcattgcttgcttttacccttggtgtcaagcaaatgatttgctgttgcaacaagatggatgccactacccctaaatactcgaaggctaggtatgatgaaattgtgaaagaagtctctcctacttgaagaaggtgggatacaaccctgacaag

SEQ ID NO: 22906 - DNA, 444 bp, Gossypium hirsutum
  Clone ID: LIB3272-018-P1-K1-A2
aaacaaccctaaagttttgagattccctcactctcccctccgctcttcgccgaaaggcctatgcgccaagccttcaaccgccccaaaagcccttgcgatcagcgaagcagggtcctccgacggtgtgagcacaatgcgcggtactgtgatgttgtagaggagtgcatgatcgtggggcgtggacgtgcgagctgggggtcgtgcgtgggcgtgtcgatgtacgtggtggagaggcgtaaaacgtgggggctacagcgcagggagaaagaagggtttgttgtttctgaaaaaaaaaattagggtaatggggcttgtgtagttgggtattaggccattgtaaaattttgggccttggatttattttgtatgttttgggtttgttgggcccgggcgaaaattaagccctacaaattatatttagtttgttggcctctaaaatctaaa

SEQ ID NO: 22907 - DNA, 433 bp, Gossypium hirsutum
  Clone ID: LIB3272-018-P1-K1-A4
cgtttaagctctagctctcttcgaaaaatcaaggttattttttttaatcttctctggtcttcagctccctcttgaatttcattgaaaagaaaaatgcctaggtatgatgaccgccgcggtagtggtacacgcctttatgttggtcacttgtcttcgaggacaaggtcacgtgatcttgaggacatgtttaggagatatgggagaatacgtgatgtggatatgaagcgtgactatgcattcgttgaattcagtgaccctagagatgctgatgatgcaagatattcattgaatggtagagaccttgatggaagccgtatagttgttgaatttgccaagggggtgcctcgtggccctggtgggtctagtgattaccctggaagaggtcctgctcctggagcagggcgctgcttcaactgtggaattgatggtcact

SEQ ID NO: 22908 - DNA, 97 bp, Gossypium hirsutum
  Clone ID: LIB3272-018-P1-K1-A5
aaaaaaaaaatataaataaaaaaaaaaaataaaaaaaataaaaaaaaaaaaaaaaaagggaaaaaagaaaaatataaaaattaaataaaaaaaaaaa

SEQ ID NO: 22909 - DNA, 438 bp, Gossypium hirsutum
  Clone ID: LIB3272-018-P1-K1-A6
accccactcattctcaatcccgtcagcacctcaagtgcttcctttcaaggtgatccatctgcagactacttcattggagtcaatggcatcaccattaatactaaaccagtgtcattcaacaaaactttgctttccatcaacaaagaaggccaaggcggaaccaagatcagcactgtcactccctacactgtgatgcaaacatcaatctacagagcagtagttaatgcttttatcaagcaaacttccaaggttgccagggttccagcagtggctcctttcagtgcatgttacaatgctaaaagccttggcagcactcgcgttgggccagcagtgccacaaatcgatctcttgctaccaaacaaagtggtatggagaatatttggagcaaactcaatggtgccaggtaacaaagacgtattgtgtttagggtttgtagat

SEQ ID NO: 22910 - DNA, 354 bp, Gossypium hirsutum
  Clone ID: LIB3272-018-P1-K1-A7
atcaatttgaagccttcttcgaatatcctcattcaagatgcaaattggggtcaaggcccttactggaaagaccatcacattggaggtggaaagttttgatactattgacaatgtaaaggccaagattcacggcttggaaaggatcccccctaaccagcaaagggtggtctttgtttgtaaaccacttggggatggccgcacgttagctgattacaacatgcaaaaagggttcacacttcaactaatgctttcgcttcaggggaggatgcaaatttttgttaaaaatttgactgggatgacccttacattggaggttgagaggtcacataccatttataatctttaggcaaaaat

SEQ ID NO: 22911 - DNA, 425 bp, Gossypium hirsutum
  Clone ID: LIB3272-018-P1-K1-A8
caacgactctgttactaagagcaagttcgataacttgtatggatgccgtcactcacttcccgatggtttgatgagagctactgatgtgatgattgccggcaaggtcgccgttgtctgtggttatggtgatgtcggaaagggttgtgctgctgccttgaagcaagccggtgctcgtgtcattgttactgagattgatcccatctgtgcccttcaggctctcatggaaggacttcaagttttgaccctaaaagatgttgtctccgaggctgatatcttcgtcaccacaaccggtaacaaggacattattatggttgatcacatgaggaagatgaagaacaatgccattgtttgcaacattggtcactttgacaatgaaatcgatatgctcggtcttgagacctattctggtgttaaacgcattacca

SEQ ID NO: 22912 - DNA, 487 bp, Gossypium hirsutum
  Clone ID: LIB3272-018-P1-K1-A9
gcgactccacagcagtccgctttagtcatagtaatctatgagctcttttatcttagatttataggttaaacagggtgtttttttaggtctttatagagtttagaaagagaagattgcaaaaaatatggtctgaacgaacatagtatgtcatagcaccacagttatggtgccaacaacgtgagattttgtcggaaagcccgacaacatcaaaagtctctgtgtctaaatagttatctgcggatcttcaaacttaaaagaacaactaatcttccttctgccaaacaagctctttaatcacactttcgttccttcgtcgtcttcattgccatcgtcatcatcggcccgatcttcgttttcggcatccttgccggtggaggatgaaccattggcgggaacgaaggaaacgaatgtggtggagggggtagaagttcaggttacgccaaacagatgcttgagttgcaagaaacgcgtggggcttacggggttc

SEQ ID NO: 22913 - DNA, 401 bp, Gossypium hirsutum
  Clone ID: LIB3272-018-P1-K1-B1
gaagacagagagagttggagggaatgtcgtttagagggaagaggaaggatggagagggtctcggttccgacgagaacgacgatcacgcgcctcctaataaagtctcgaagatttcttctgcagtcgactctgacgattccgacgatgtcgtcgtctgcgagatatccaagaataggagagtttcagtgaggaactggaatggcaagatttgggttgatattcgtgaattttatgtcaaggatggtaaacaattgcctggcaagaaaggtatttctctaagtctggaccagtggaatgttctacgtgatcatgcagaggcaatcgataaggcacttgctgagaactcgtaggaagtagacatatggtataccaagggaatctaaggaccttttcatatattt

SEQ ID NO: 22914 - DNA, 123 bp, Gossypium hirsutum
  Clone ID: LIB3272-018-P1-K1-B10
cttttttttttttttttttttttttttttttttttcttgaaagaagaggattgatggttagctagtttaattacccttttaatgtaaaatatacataatatatacatatatattttttccttc

SEQ ID NO: 22915 - DNA, 440 bp, Gossypium hirsutum
  Clone ID: LIB3272-018-P1-K1-B11
cttgcattgagtctctaagatatcactgcaaggaaaaaaaaaaaaaaaccagccggggcttccaacactgttgcatccgctgctcttcttcttaccttgaacttgttgttcttcactttggttagctctacctacgtgccttgcccaccaccaccaaagagccacaagcctacccacaagagcccaccctcggcacctaaacagccagccacttgccccaaagatacactgaaactaggtgtttgtgctgatttgttgggctcggtgcgcgttgttgttggaccgtcgaggaccaaatgctgttcactcatttcgggtttggctgatctcgatgctgctgtttgcctttgcactgctattaaagctaatgtgttgggggttaacctaaacgttcctgtttcattgtctttgctcctcaattcctgcgaaaagcaaatgct

SEQ ID NO: 22916 - DNA, 395 bp, Gossypium hirsutum
  Clone ID: LIB3272-018-P1-K1-B12
gttttgtatttcatactcatttagcccctttcattagcatcgaaatcactccaggtgttctttatcactgaaaaatgtcttgctgtggtggaaactgtggctgcggttctggctgcaagtgtggcagtggctgtggaggatgcaagatgtacccagacctgaacgttgccgagatgaccacaactgagactctggttcttggtgtagcaccccagaaagcacactttgagggagctgagatggaattcggggctgagaacggctgcaagtgtggagacaactgcacctgcaacccttgcaattgtaaatgattagaggcccaaagccaagcttccctgaaagcagagacgccttttgctttaaaaaaaaaatatgtttggtggttatgagttttt

SEQ ID NO: 22917 - DNA, 142 bp, Gossypium hirsutum
  Clone ID: LIB3272-018-P1-K1-B2
gaaccttcaatttttcgtaggagagagcatgcatgatgatggatgcttggcgttggatgactagaaggatggtgctgttgacccaacatttttgtactatgcatatgcattgaatgaggtcaagtgctgaggtttgaagcac

SEQ ID NO: 22918 - DNA, 440 bp, Gossypium hirsutum
  Clone ID: LIB3272-018-P1-K1-B3
aagcaagttcagagttggtgatattgttggcgttggttgtattgttgggtgttgcggaaactggcgaccatgcgactcagacaatgaacaatactgtcttaagaagatctggtcgtacaatgatgtttacactgacggaaaacccacccaagggggctttgctggttccatggtcgttgatcaaaagtttgtggtgaatatcccagaaggaatggcaccagaacaggtggccccgctgttatgtgcaggggtgacagtttacagcccattgaatcactttggtttaatggggagtgggttaaggggaggaatattgggacttgtaggtgtagggcacatgggggtgaagatagccaaagcaatggggcatcacgtaacagttataagctcatctgataagaaaaaagtggaggctttggagcatcttggtgctgatgact

SEQ ID NO: 22919 - DNA, 440 bp, Gossypium hirsutum
  Clone ID: LIB3272-018-P1-K1-B4
tagcactgtccgtttgacgcaaaaaaaacaaagacagtgagggacgtaagctaaagccttttgtgctttttcatccgttgaaggaatggcttcagatcctaaagtgcacactttcgaggaggttgccaaccacaacaaaaccaaagattgttggctgattatttctgggaaggtttatgatgtaactccgttcatggatgatcatcccggaggtgatgaaattttgctgtcagctactgggaaggatgccaccaatgattttgaagatgtgggtcacagtggttcagcaagagaaatgatggaaaaatactacattggtgagattgatccaaaaactgtcccagcaaagcgcacttaacattcaccacagcaaacgccttacaatcccgataagacccctgagtttgtcaacaagatcctacaatttcttgttcccctct

SEQ ID NO: 22920 - DNA, 437 bp, Gossypium hirsutum
  Clone ID: LIB3272-018-P1-K1-B5
cttgtcttctttacttaaatggaccaggtctaccactaaagcaccccaatcagatggcaatgttcttcaatttgagaatgggtacttagttgagactgtagttgaaggcaatgagataggagttgttccttacaaaattcgggtctccgaggatggagaattatttgctgttgatgaagttaatagtaacattgttaagattactccaccattgtctcaatatagccgaggaagattggttgccgggtcatttcaaggttacacggggcatgtggatggaaagccaagtgacgctcgtttcaatcatcccaaaggtgtaaccatggatgataaagggaatgtatatgttgctgataccatgaatcttgccattcgaaagataggagatgcaggtgtcacaacgattgctggaggcaaatcaaatattgcaggatata

SEQ ID NO: 22921 - DNA, 435 bp, Gossypium hirsutum
  Clone ID: LIB3272-018-P1-K1-B6
caaaaacaaccccttcctcttcttttgtcctttaaacgtaacaatttcatgatctagaaaatgggatttggggctttaagaagtatcgttcgaccactatgtcggactctcctactatcccaggcttcccctgcttctggaactatgtcgactctcccttcttatttgtgcccaaaatcctgtttgaattcccttttgtgtgggtctatttaccgccaatctccatggatctcgatgtccaatcagttgcatagcttaaccaatactcgtttcccaaagagaaggcctcaagacaaggcacgccgaaaaagagccagcttgaaacctcctgggccatatgcatgggtgaagtatacaccaggggagcctattcttccaaataatcctaatgaagggagtgtcaaaagaaggaatgagaaaaagagaatgaggctg

SEQ ID NO: 22922 - DNA, 153 bp, Gossypium hirsutum
  Clone ID: LIB3272-018-P1-K1-B7
ctttccccagggacaacatgatctatcgggagaggcattgtcccagggaggaagagaaggttcattgtcttgtcccggcacctaaaggatacgtgacccgcgttccttggcctaaaagtagggactatgtgccttatgctaaagctccctata

SEQ ID NO: 22923 - DNA, 316 bp, Gossypium hirsutum
  Clone ID: LIB3272-018-P1-K1-B8
attttctcctttttatctttaaaacacgcacccaaaaaataaaaccctttgaaaaccaaagaaggaagaagaagatgtcgtggcaagcttatgtagatgatcacttgatgtgtgaaatcgaaggaaaccatctctttgccgccgctatcatcggccaggacggcagcgtttgggcccaaaacgccaggtttcctcagctcaagcctgaagaaattagtgccatcatgaatgactttaatgaaccgggttcactcgctccgaccgggttgcacctcggtggcacaaaatacatggtgatccaaggcgaaccgggagc

SEQ ID NO: 22924 - DNA, 421 bp, Gossypium hirsutum
  Clone ID: LIB3272-018-P1-K1-B9
gaaaaacttaatcatggctcggttgacgttggtgtcctccatcatccttctgctaggctccgtcgccgccggatcaactttcgaggactccaaccccatccagatggtatccgatggcctcagcggcttcgaatcctccgttcttcgtgtcatcggtcacactcgtcatgctctctccttcgcccgttttgcatacaagcatgggaagaggtatgaaaacgtggaggagatgaagctacggtttcagattttcaaaggcaacttggatttaatcagatccactaacaagaagggactgccttacactcttgctgtcaatcagtttgctgattggagctgggaagagttccagaaacacagattgggggctgctcaaaactgctctgctaccacaaagggcaatcaccagctcactgatgtc

SEQ ID NO: 22925 - DNA, 430 bp, Gossypium hirsutum
  Clone ID: LIB3272-018-P1-K1-C1
gaaggttactagtgtaaaatttgtagcccagaatgatgtatttttaagtagttcagcagataagactgttcgcatttggcaagggtctgaagatggaaagtatgattgcaggcatattttgaaagatcatacagctgaggtgcaagctgtcacagtccatgccactaacaactactttgtaactgcttcacttgacacgacgtggtgtttttatgatctttcgtctggtttatgcttgacccaggttgaagacctatcaaattctatgggctatacgtctgcagcttttcatcctgatggccttatccttggaactggcaccactggagctactgttagaatttgggatgtgaagagtcggggaaatgttgccaactttgatggacacactggggctgtaacagccatatctttctcagaaaacggttac

SEQ ID NO: 22926 - DNA, 375 bp, Gossypium hirsutum
  Clone ID: LIB3272-018-P1-K1-C10
ggcgggattacccgctgagtttaagcatatcaataagcggaggaaaagaaacttacgcaggattcccctagtaacggcgagcgaaccgggaaaagcccagcttgagaatcggtcgccatcggcgtccgaattgtagtctggagaagcgtcctcagcgacggaccgggcccaagtcccctggaaaggggcgccggagagggtgagagccccgtcgtgcccggaccctgtcgcaccaagaggcgctgtctacgagtcgggttgtttgggaatgcagccctaatcgggcggtaaattccgtccaaggctaaatacgggcgagagaccgatagcgaacaagtaccgcgagggaaagatgaaaaggactttgaaaagaga

SEQ ID NO: 22927 - DNA, 352 bp, Gossypium hirsutum
  Clone ID: LIB3272-018-P1-K1-C11
cttggatttaaagagatttcagttggaaatgctgtgcctgtatggtacaacatgggcaatcaaggtcttgttaatgaaccagttttttcattttggctcaaccgcaatcctgaggatgatgttggcggagaagtggtttttggtgggatggatccaaaacattacaagggggaacacacttatgttcctgtaaaacagaaaggatactggcagtttgatatgggtgatgttctgattggtgaccaaacaactggactttgtgccagtggctgcagtgctattgttgattccggaacttccttgttgactggacctacggctgttattgctcaagtcaatcatgctattggtg

SEQ ID NO: 22928 - DNA, 374 bp, Gossypium hirsutum
  Clone ID: LIB3272-018-P1-K1-C12
cttacaatgccactttgtctgttcaccaattggttgaaaatgctgatgagtgtatggttctggacaatgaggccttgtatgacatctgtttccgcacacttaagctaaccactcccagctttggtgatttgaaccatttgatatctgcaacaatgtctggagttacatgctgcttgcgattccctggtcagctcaactccgatctcaggaaacttgccgtgaatctcatcccctttcctcgtcttcactttttcatggtgggttttgctccactcacttctagggggtctcaacagtaccgagctctaacagtacctgagctcacccagcaaatgttggacgccaaagacatgatgtgtgctgctgatcctcgt

SEQ ID NO: 22929 - DNA, 419 bp, Gossypium hirsutum
  Clone ID: LIB3272-018-P1-K1-C2
caacgactctgttactaagagcaagttcgataacttgtatggatgccgtcactcacttcccgatggtttgatgagagctactgatgtgatgattgccggcaaggtcgccgttgtctgtggttatggtgatgtcggaaagggttgtgctgctgccttgaagcaagccggtgctcgtgtcattgttactgagattgatcccatctgtgcccttcaggctctcatggaaggacttcaggttttgaccctagaagatgttgtctccgaggctgatatcttcgtcaccacaaccggtaacaaggacatcatcatggttgatcacatgaggaagatgaagaacaatgccattgtttgcaacattggtcactttgacaatgaaatcgatatgctcggtcttgagacctatcctggtgttaaacgca

SEQ ID NO: 22930 - DNA, 118 bp, Gossypium hirsutum
  unsure (1)..(118): unsure at all n locations
  Clone ID: LIB3272-018-P1-K1-C3
ggagcctctcctgctcgctgcgtcttcgtctgcaagatctcaattctcaaattgtagcgcccttttatatcaaacaaaggctctgggcttgcatgctngaaaacaaacaaaatgctta

SEQ ID NO: 22931 - DNA, 408 bp, Gossypium hirsutum
  Clone ID: LIB3272-018-P1-K1-C5
ccaaaaacaataacaaaagagagcaaaacaaaaaaaatggagcttaaacctggcttatcaactgtggtcactggccgtgcttccggaattggtaaagctttgtgcttagctttggccttgaaagggatatttgtgacaattgtagatttctcggaagagaaagggaaggaagttgcttctttaattgagaaagagaattccaaattccatcaaaatttaagatttccttctgctatttttgttaaatgcgacgttactagcttaagagatttaaatttagcatttgagaagcatgtctcaacatatggaggactggatatatgcattaataatgctggcatcgcttatacagcacttttctggaaggatcaaactgatggcactaaaacattggaacatactattaat

SEQ ID NO: 22932 - DNA, 442 bp, Gossypium hirsutum
  Clone ID: LIB3272-018-P1-K1-C6
gcaccggcccggacacggtccggaatgtacccacgcgtccgactctacaaacccatatttcccttagaagaagatgcagatctttgtgaaaaccctgaccggcaagaccataacactcgaggtcgaaagctccgacaccatcgacaacgtcaaggccaagatccaagacaaggaagggatcccacccgaccagcagcgtctcattttcgctggcaaacagctcgaagacggtcggacccttgctgattataacatccagaaagaatccaccctccacctcgtcttacgccttcgtgggggcatgcaaatctttgtcaaaaccttaaccggcaagaccatcaccctcgaagtcgagagttccgacaccatcgacaacgttaaggccaagattcaagacaaggaaggaatcccacctgaccaaccaggtttgatcttcgctggc

SEQ ID NO: 22933 - DNA, 370 bp, Gossypium hirsutum
  Clone ID: LIB3272-018-P1-K1-C7
gtttgctgctactttgccttttcccttcagaatccctacgttttttttttctcatgcgtctcttagtctctgaaaatttcctatttattgaaaaaggagaagaatgtcgggatctgagacgggaatgatggcgagtagagagccctacagcttgggcatgcaacagaagagtccggtggcgtcacaaccggtgatacagaacatgcgtttagcctttaggtctgacggaacagctgtgtacaagcccatcacttccgcctcactcacatatcagccagcttccggcgatggtggggccgaggggtccgctggtggacctgcggtcactcaagaacaagggcaagctttgaacatgagcatgagcatgggg

SEQ ID NO: 22934 - DNA, 379 bp, Gossypium hirsutum
  Clone ID: LIB3272-018-P1-K1-C9
cggacgcgtgggcggtctgttcattaaaacagtgccacatgtagggttaaggagagttttaccagtttaacttcatttcatttgattcaacaactactacagataaaaggaactgaaagcattctacatttcaaaatccggtgtcaaaggtttggtaaatgctggaatcactaatgctcctcggatgtttatgacgatatacatttcatctaacactttactgacaacctagaaaacccaatacaaatttggttttattagtttacaaagtattgaatatgatcctagatctcttatagagatcattgttgaagttaggcattcattagatacatgggtctattttcagattgttaaccatggttatactgtatgtgtt

SEQ ID NO: 22935 - DNA, 378 bp, Gossypium hirsutum
  Clone ID: LIB3272-018-P1-K1-D1
gaaaaacttaatcatggctcggttgacgttggtgtcctacatcatccttctgctatgctccgagggcgtcggatcaactttcgaggacttcaaccccatgcagatggtattcggtggcctaagcggcttggaatcctccggtctttgggaaaaacgtcacacttgtcatgctgtttccttcacccgttttgcatacaagcctgggaaggggtatgaaaacgggggggagatgaaactactggttcagatttttaaaggctacttggattgaattagattcactaacaagcaggggccggcttacaattttgctgagaatcagtatggtgattggagctccgaagagtttcaaaaacacagattgggggctggtcaaaa

SEQ ID NO: 22936 - DNA, 401 bp, Gossypium hirsutum
  Clone ID: LIB3272-018-P1-K1-D10
tgttgagaagcaaggtatgagtgatactaggttcttggagaatgggaagtactacgatgatgtgagttctgagaacaactactacccgaaccggttcgagaactcgaggggagtcggttcgaggaacgagttcaacgagaaccgttacaataacatgggaaaatataatcagaatcaagaggagttcgaagaagagttcgagccatgaaaccacacgtatatgctaattaattagcaaaaaagagagtaaggaaagaaggggttatttattggggtttgtgttttaatttggggacccttttaatttaatttgcggggttggatagtttccttggctttggatatggaaagcttaaaagatatgataatggagcctaatctttttaacttttttaaaccag

SEQ ID NO: 22937 - DNA, 308 bp, Gossypium hirsutum
  Clone ID: LIB3272-018-P1-K1-D11
gattatttaattcccgttttccaatcttttttgagaaatcggtagcgaaaaatgtcgtcgtcggggaggaagatcacccttaagagctcagacggcgaatcattcgaggttgatgaagcggtggcgttggagtcgcagacgattaagcatatgatcgaggacgattgcgctgataacgggataccgttgcctaatgttacgaggcaaatcttagcgaaagtgatcgagtactgcaagaaacacgttgaggcttctaagacagaccatcgatccccccatgaccagctcaaaaattgggacccttactt

SEQ ID NO: 22938 - DNA, 432 bp, Gossypium hirsutum
  Clone ID: LIB3272-018-P1-K1-D12
aaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaaaagcccaccctcggcacctgaacagccaggcacttgccccagagatgcactgaaactaggcgtttgtgctgatttgttgggctcagtgcgcgttgttgttggaccgtcgaggaccaaatgctgctctctcatttcgggtttggctgatctcgatgctgctggttgcctttgcactgctattaaagctaatgtgttgggggttaacctaaacggtcctgtttcattgtctttgctcctcaattcctgcgaaaagcaaatgcctgctggttacaaatgtgcttaagctcat

SEQ ID NO: 22939 - DNA, 351 bp, Gossypium hirsutum
  Clone ID: LIB3272-018-P1-K1-D2
aagagactgtgcatataaactgaccaactagcccgaccggccaacttaccgtaggccttaaacgatggcgtttcgtaaacctaacatcacaaatggcatacttagctggataaccttccaaggctgaaaagaaaatcttgtacgacgcgaaactgtgccacctgttagatgagcacactcagatctggattggcacacgcgacaaagtatactcgaaccatctctaaaacatgttgtaaagtggctgacactgcatactcagcgtgctgtaatggtgactagcattatgatgcacaacgtggtcaggatgcatgctgagaagactgtgaaccaagctttcattaactttat

SEQ ID NO: 22940 - DNA, 436 bp, Gossypium hirsutum
  Clone ID: LIB3272-018-P1-K1-D3
aaagaaatggataaagtaaagtttgtgatgctgtttgtatttttggttagcttactaggagcaacaatgggcgagcaatgcggtcggcaagctggtggggccttatgccccaacaacttatgttgcagtcagtatggatggtgtgggaacaccgatgattactgttcaccggaaaaaaattgccagagcaattgcagaagtggcccccctccccctacaggagaaggagcgactgtgagatctacttaccatttctataatccagagcaaaatggatgggatttgatggcagtgagtgcctattgctctacatgggatgctaacaagccatattcatggaggagtaagtatggttggactgccttttgtggccccgttggtccttctttcccggctgcttaggggaggtgcctgagggtaagaaactcaaggactg

SEQ ID NO: 22941 - DNA, 415 bp, Gossypium hirsutum
  Clone ID: LIB3272-018-P1-K1-D5
cataagcatagctaatgcccccttccagcttgcgttttataacaccacgcctaatgccttcacccttgcgttacgcatggctacaacacgttccgagtcgctcttccgatgggtttgggaggccaacagggggaaccctgttcgcgagaacgccacgttctctctcgggactgacgggaaccttgtcttggctgatgccgatggtcggattgcttggcaaagtaacactgccaacaaagctgtggtagggttccaattgttgcctaatggtaacatggtgttacacgattccaatggcaagttcatttggcaaagttttgatcatccaactgacacactcttggtgggtcaatcgcttagagccggaggggcgacgaagcttgtgagccgggcttctgctcaaaacaatgtcaac

SEQ ID NO: 22942 - DNA, 411 bp, Gossypium hirsutum
  Clone ID: LIB3272-018-P1-K1-D6
ggcattacatatcgaaaatgctccccttctgactgatgtgcttataggtgggaacttagatgatgaaccagctttcgctttttgccccctttcgggatatctttgtcagctgaaaagtcttacattggagatgagtgcttataatatgacatttccgaatttccctgaattgacaaatcttaggcacttagcagtaagtgcgtatggtggatatgatgacgatcttcttgtcttgacttccttgattgatgcatctccttctttgaacaaactctcgttggagttgaatatttggagatcttcgacatacaatcatgcacataatacgagtaatgttaccggaaaacccatccctagtcttaaagtggtacaggtgatcggctttagaggttttaaaatcgatgtggattt

SEQ ID NO: 22943 - DNA, 435 bp, Gossypium hirsutum
  Clone ID: LIB3272-018-P1-K1-D7
cttgggttaggtgtcctgctactctgccttgcaaaggtttcatctgatctgaaggcagaagaagttataaccaatgtcggtgaggtgggttctttggttaccagaggcggaaacagaagactgatgctagagattgattgtggaggattatgcaagaaaagatgcagtcaacactcgaggccaaacagatgcaacagggcgtgtgggacttgctgcttgaggtgcaagtgcgtgccaccggggacttcagggaacagggaggtctgcgggacctgctatactggcatgaccacccatggaaacgttgccaagtgcccttaacctttacgtcgcccaatatgtgttgcagccatcaaggggaaaaatgaaatgtttgtttgtgtaatatgtatgttggaacttaagatgtcttacctactcctaaaattattagta

SEQ ID NO: 22944 - DNA, 417 bp, Gossypium hirsutum
  Clone ID: LIB3272-018-P1-K1-D8
atggaagtcgtcgtggtaacgatgaagtgatggctcggggaacttttgctaacattcgccttgtgaataagctgttgaatggggaagttggacctaagacaatacatgtccccacaggagagaaactatatgtatttgatgcagcaatgaggtataaagatgcaggacacgacaccattgttttggctggagctgagtatggaagtggtagctcccgagattgggctgccaaaggcccaatgctattgggagtaaaagcggtaattgcaaaaagttttgagagaatccatcgcagtaatttggtaggaatgggaatcattccactttgtttcaagtctggtgaggacgcggacacactaggtttaacaggtcaccgagcggtataccaatgatctcccacgccaaatagatgaaata

SEQ ID NO: 22945 - DNA, 338 bp, Gossypium hirsutum
  Clone ID: LIB3272-018-P1-K1-D9
ccggcaccggtatcaaccctgctcgtagctttggggccgctgttatctacaaccaggacaagccatgggatgatcattggatcttctgggtcggaccatttattggtgcagccattgctgcaatctatcaccagtttatcctgagggcagctgctgttaaagctcttggatccttcaggagcagctctgccatgtaattaagcaaatcattctccagccacaagtttaaacaaaaaaaaaaaaacggggggggggaggggttgccatggaggattgcattaagttttatcaatgtggacaagaggctttttcagaccactcaattcggaaaatataat

SEQ ID NO: 22946 - DNA, 435 bp, Gossypium hirsutum
  Clone ID: LIB3272-018-P1-K1-E1
ctagactcgcttttctcttcacccttacttttctcctcttcaccttctctcaagcccgcttgagcacatctgaatcccaacatgatgtcacccccgaaaaatccgttaccgattttcccgaatccgaccccgaatccgccatccttctccccagcgagaaaccccactttgaaccccccaaattactcgacttcaagcacgatgatgatgcctccggcgtcgcctccgttcctttgaccaagatcagttttaaccctgtcaaccgccacttcccaaggcgtcccttgattccgttccgtcacaagcacaactgccgtttccataaacgcttcatgcctttgaatccacgcttccatcagaaacgcttcatttcttacggcaacgacatgatactgtccgacgagagaaagtttgacccagagtcacgcggtgttg

SEQ ID NO: 22947 - DNA, 89 bp, Gossypium hirsutum
  Clone ID: LIB3272-018-P1-K1-E10
gcaagccaaacagattttacctcttatcttcgaatcatctcatctatggctcggaccaagcaaacagttaggaaatcaaccggaggaaa

SEQ ID NO: 22948 - DNA, 253 bp, Gossypium hirsutum
  Clone ID: LIB3272-018-P1-K1-E11
cttcatttgaagcagctatgtcttttagaggaggaaatgcatcatcgggcatgggagtggctgaacacagcaaaagcacgtacctggaactgcagagaaagaaggtgttccgatatgttatcttcaagattgatgagaagaaaaaggaggtcatagttgaaaagactggaggtcccacagagagctatgatgatttcgcagcctcattgccggagagtgactgccgttatgcaatttatgacttcgattttgt

SEQ ID NO: 22949 - DNA, 330 bp, Gossypium hirsutum
  Clone ID: LIB3272-018-P1-K1-E12
attccaagaaaaagtggtgtcagagtttcgatcaaataaaagaaattaagttttctgtgtcttcctcggggatccgacgaagctctggaaaaagattttttttactcaagaaatggcgggaagagctcaaattccgacaagtaattcagcactaattgccatgattgctgatgaggatacaggaactggatttttggtggctggaggtggaaatgtggatttaaagagaaaaacaaactatctaatcgttgattcaaaaacaacagtgaaagcgattgaagattcattcaaagactacaccacaaggggggatattgcaattattttgga

SEQ ID NO: 22950 - DNA, 436 bp, Gossypium hirsutum
  unsure (1)..(436): unsure at all n locations
  Clone ID: LIB3272-018-P1-K1-E2
ctcaagacaagtttcaaagcctctctctattttactcctctttctctgtctttcattgacatggatctcctcagtttctgagctatcaatttcaaacaagattcaatggccacgactgaggaatgtcattcaattcaacttattgatggagatggattgttcaatgatgttggaactgaccgtcttatcaaggaaattaagcttgctgaatgtgggttgtcatatgctgtggttgctatcatgggacctcagagcagcggtaaaagcacactgttaaatcatttgttttgcaccaatttcagggaaatggatgcatttaagggaaggtctcaaaccactaaaggtatttggatggcaaaatgtgctggtatagagccttgcactctagtaatggatntggagggtactgatggaagagaacgaggggaggatgaca

SEQ ID NO: 22951 - DNA, 435 bp, Gossypium hirsutum
  Clone ID: LIB3272-018-P1-K1-E3
aaaaaaatccaaaaaaatataaaaagaaaatgagccgaggaagtggaggcggctacgatcgtcatatcacaatcttctctcccgaaggtcgtcttttccaagtggagtatgcgtttaaggcagttaaagcagctggaatcacgtcgattggtgttcgaggcaaagactctgtctgcgttgttactcagaagaaagttcccgacaagctattggatcagactagtgtcactcatcttttccctattaccaagttccttggattgttggctactggcatgacagctgatgcaaggaccttggtccaacaagcaaggaatgaagcggccgagtttcggttcagatatggatatgagatgcctgttgatgtattgtctaaatggattgctgacaaatcacaggtttatactcaacatgcttatatgagacctcttggag

SEQ ID NO: 22952 - DNA, 383 bp, Gossypium hirsutum
  Clone ID: LIB3272-018-P1-K1-E4
cctagatctcctacatttcggagatggcggacgcgcaatccatatacgttaagctgacaaaagatcaggtacctttagaggatatccaacctggtgaacttaatcagcccattgatgttcctcagttgcatgtccgaaagtgcaatgaatgtggacagcctttacctgaaaattttgaacctcctgctgttgaaccttggacaactggaatttttggctgtgctgaagatacagaaagttgctggacgggactattttgtccatgtgttctatttgggcgtaatattgagagcttgagagatgatacgccctggactacaccatgcatttgtcatgctatttgtgttagaagtggcattgcattggcaggtgcaacagctttt

SEQ ID NO: 22953 - DNA, 425 bp, Gossypium hirsutum
  Clone ID: LIB3272-018-P1-K1-E7
gttaattttatccatcttcttcttcttcttcatttcaccacatttgttgtagcaaagacaagtggttgatggaaaagttagagaagcgtcggcagtaggcttggattcttctgggaaaaaaaatatagctaaaggggacctttatgtttttgtctttacaatattgttgtgtgttataataacagtggaaggttggcggaggttttttgcaggattgaaaatcaatgtcaagttcatctccttttcttctttttcattgccttaacctctagggaactagcttgaaccttttttttttctttttccatttaagtttgggggggggtttaatggctatggagatgcaaagcggggggaagatggtggggttcttgggtattcttgtggttttggttatagagatggcagcacccactagtgctagc

SEQ ID NO: 22954 - DNA, 430 bp, Gossypium hirsutum
  Clone ID: LIB3272-018-P1-K1-E8
agtgggttgtgatggaggtaggactcaagaatcacctactctcattaatgctttgcagttgataggaatgtcatcgtgcctagacctttctggtttctttgagaaggaggatgtatctgaaaggaagatcagatttacctcgaatcgttcgggtaaagatttgcttgcaaagatccaagacacggtgacagagatgggatttcgagtccaaatgagaaacggaaagttgaaagcaacgcaagagcacacggtccaaaaacgccttgccagtctttcaattgcagctgaagtgtttgagataagtccgtcattgtacgtagttgaattaaaaaaatcatatggcgattctacagtttatagacagttatgtacaaagctatttaatgacttaagccaaccttaaggccaaagcctggtgttcacaaaagct

SEQ ID NO: 22955 - DNA, 434 bp, Gossypium hirsutum
  Clone ID: LIB3272-018-P1-K1-E9
agaaaagaggtttttgaagaagaaagaaagaaaattatatgtgaaagtatggcggggaaagaagagaatcgaatatttgtgggaggtttgtcatgggatgtcactgaacgacagcttgagcatgcgtttagtccatttggcaaaatccttgaatctcagatcatgttggaaagagataccgggcgtccacgtggatttggatttatcacatttgctgatcgccggtccatggatgaagctatcagggagatgcatggacgggagctgggggagcgcaccatttcagtgaataaggctcaacccaagatgggtgaagatcttgatcacggttatagaggaggttactcatcaagtggcaggggtcgctatgcaggtggagacaggcctgtagcacaggatgaatgcttcaaatgtgggcgttttgggcactgggc

SEQ ID NO: 22956 - DNA, 409 bp, Gossypium hirsutum
  Clone ID: LIB3272-018-P1-K1-F1
agaattccacttttcttcgaattataattttttcgctgtcctcaactctttgacagtgttttttttttcctggtgatttcatcgtgaaaaaaatcgcagattcttagtctcatcattttattttttatttttaaattctgagatatttttatttttgtttacattattatagttgtagagagagatctgaagcttttaatttttttccgtcagcgatctgagaattttctgggaaagaatcgaaggtttttgcgctttgttttcccccctttcttttacattgtctttactaagacgccattggctgttcgctgaaataaagagataaaaaaaaaaagggctgaagaagatcgtctcatttttaccattttcaagagatccaaaacaataaatattcttttttttaaaa

SEQ ID NO: 22957 - DNA, 247 bp, Gossypium hirsutum
  Clone ID: LIB3272-018-P1-K1-F11
ataatccctcgtttttcctttcagtttccaagaaatttctgtagggttttcctgagctgggcataaaaaagatgggtatatatctcagcacccccaaaactgaaaaattctctgaagatggcgagaatgacagggttagatatggtttatcatctatgcaaggatggcgtgctactatggaagatgctcatgctgcataccctgatcttgatgcttctacttcgttctttggcggttatgatgggca

SEQ ID NO: 22958 - DNA, 382 bp, Gossypium hirsutum
  Clone ID: LIB3272-018-P1-K1-F12
aaagaatgcaaaaccgccacaacgctttgttttgaagcttcactcatgtcgcatgcacttcatctcgtccccaataacattcctggttatggaccgacagactgccgatatctctcctactcgggcatttccggaagagcagagactctatctccttgctcttcacatagggaccacaaaatttgtacacaggtgaatgttagatctttggaatgtaagtcggagggaataatatcttttgtatgcaaagcaagtcctggtggccataagaaaaaccctgacttcttgaggcaaagacctgggtgtcgagggaagaattgacaaaatgcagaccgggagaacttttaaaatctagatgaatcccgaatggtatcttcaaaaa

SEQ ID NO: 22959 - DNA, 434 bp, Gossypium hirsutum
  Clone ID: LIB3272-018-P1-K1-F2
tcatgaccactctcgtgaccggtgtgtttctcctcctactatccgtcgccggcgtcgtatccgccgctagatatatcaccggtgatgttctccggttaccttcggaagcttcaaggttcttccgatggaggagcgatgatgatgaagttggtggcacaagatgggcggtcctgattgctggatctaatggatattggaattacaggcatcaggctgatgtttgtcatgcttatcaactcctaaggaacggtggtttgagagaggaaaatatcattgtctttatgtacgatgatatcgctttcaatgtagaaaaccctaggcctggtgttatcattaacaatcctcatggcgatgatgtttataagggagtcccgaaggactatactggaaaaaaaggtaatggtcacaacttttttgcggctctcctcggaaac

SEQ ID NO: 22960 - DNA, 408 bp, Gossypium hirsutum
  Clone ID: LIB3272-018-P1-K1-F3
tttttcttgaactcatagtaaaaaaaacccataaattttccttccaagagtatcaattatttttggtttctgggtatagcttataattcaaattattaaccttttattttttaaagacaatgattttgccattgttgaaattgtatgacaaaggaactagtgttgttaaaagctattacttttggattttccagatttttaatacttataggattgaaacttaagaaccaaatttcattattttcttgtttcatttccttaaaagttataagcgattgtgtagttagataaagaaatttaagtaacattgagataatgggaggggccatcatttgccaccaggtttttcgttttcatcctactgatgaagaattgattggatattacctcaaaagaaaaacttaaggg

SEQ ID NO: 22961 - DNA, 388 bp, Gossypium hirsutum
  Clone ID: LIB3272-018-P1-K1-F4
cttagccaatgcttgctcactttcactcattcccctaatcactgcaaacaggatcgcttcttgttctccgatcaccggtgtctgctcagcgccatattttgatcggataagttacggttccaacgttatatctctgtctgaattgcttttttcctctctttttttttaaattttatttcccaaaaaatggcgtctgaggatgtgaaaagaagcgagtctgcggtctcgacgatcgtgaatctggcggaagaagcgaagatagccagcgaaggagttaaggcgccgagccatgcgttgcttagtatttgcaagtctcttgttgctggtggtgtcgccggtggagtgtcacgtagtgctgttgctcccctagaaagattaaaaaatttac

SEQ ID NO: 22962 - DNA, 279 bp, Gossypium hirsutum
  Clone ID: LIB3272-018-P1-K1-F5
gggcagtccatgcttgttgataattcactgctggtgtttgagcttttatgcttcagctgattagcgaaatgcatctgctggttttttttttatttcaggcatatgcttttaagagtgcacacctgcaactagaatgatgttgtaagagctttgagtttgtagtctttttttaattctataatccctctatatgtgaatattgtaggtatgaagatctcatgttttatgttatatacatgtgaagttttatcaataaaatgtagtctgcacttagctttt

SEQ ID NO: 22963 - DNA, 281 bp, Gossypium hirsutum
  Clone ID: LIB3272-018-P1-K1-F7
ctccctgatatcaaattgcagaagaaacgaaattcagcaagcgcccgtcccatgggagattccagccttgcacttggtacatcagttcataaagcgcttggtggcggctcactttctgatgtgctattggggagaaaatggcgtggcggatctgtgatgctagtcttggctacgacgatgtgggtcttattcgaagtagccgagtttaatgtcttaactttcggggccaacgtgttggtgcttcttattgttattctcttctgtgggaccaaatctgcttt

SEQ ID NO: 22964 - DNA, 430 bp, Gossypium hirsutum
  unsure (1)..(430): unsure at all n locations
  Clone ID: LIB3272-018-P1-K1-F8
ggaaaagctatgtggaagtttgtctctcatctcccaaaatttgctgccgtgaacctaatgattctcttccttttttcttctctgttcattaaggcattctctttgaaacctgagccagcaaaaaataatgcccagatcactgtcatgggccttgtttattgtgacatttgctccaacaacagcttctccagacacagctacttcttaccaggtgcagaagttcaaatagcctgcaacttcagggcatttgttccaaaaacaagagaacaagtatcattcttaggcaacagaactacagataaacatggagtttacaggttggaaataccatcagttgatgggatcgcatgtgcagaggcagccattgcatcatcttgccaggcaagcttagttgggacctcatctacttcatgcanacattctggtcaca

SEQ ID NO: 22965 - DNA, 76 bp, Gossypium hirsutum
  Clone ID: LIB3272-018-P1-K1-G10
atttgcgcttctttctgttgatcatactatcgggacatggcttagcgttgcatagacgcccaaagaaagtactgga

SEQ ID NO: 22966 - DNA, 151 bp, Gossypium hirsutum
  Clone ID: LIB3272-018-P1-K1-G11
caagcgtgttctgtattacatactcatttagcccctttcattagcggcgaaaagactccacttttcaatatcagtgaaaaacgtcttgctcactatgaaactgagacttcaagggtcgctgtaagtggtgccgtgactaccgaggctacat

SEQ ID NO: 22967 - DNA, 122 bp, Gossypium hirsutum
  Clone ID: LIB3272-018-P1-K1-G12
atttgctttctttcgcctttgtctcctcaaaatcccaaagcaaatgggtttcgaaagctttcaattgccgatcacagatttccatatcgggaatgaaactcggaggaatttggtgttaattt

SEQ ID NO: 22968 - DNA, 441 bp, Gossypium hirsutum
  Clone ID: LIB3272-018-P1-K1-G2
attcatttggcttctgtcggctaaggatgtctcactttcggcggcttctttctctgcttgctcgaaatcaacctcaagcctctcttttcaaagaacctctttcaccagccatctcttctgcaagtgtatccttcaacagtagatatgacttttatagaagatggctccaaactcaacctgatccttccggcctggctattgacaacaccgaaaaccaagaagccgacagtttaaagcctgcttcttgctcagctaatgtaccttcggagacaaacgattctgccatgaagcatactgctatatctaacttgaaaacatctgcaaggcacgatcttgccatgatattcacgtgcaaaggctggggaaccccgaccggtaaaaacggttgccggggatcatacgaaaaaggtgtggttgtggtgagatgtggaggatgtaata

SEQ ID NO: 22969 - DNA, 138 bp, Gossypium hirsutum
  Clone ID: LIB3272-018-P1-K1-G3
gaggtttgatagaggaaaatctagtattgttgcggtttctgatgctagtgtcagatgcaaagagtgatttgaatcaaaagacacttcgtacactagctcaaaatcgtgaagctgctctgaaacagcagattgagaaag

SEQ ID NO: 22970 - DNA, 384 bp, Gossypium hirsutum
  Clone ID: LIB3272-018-P1-K1-G4
gtttttcttgcatccctttcatagagtggaagccatggaaacttcacaacccctgtccattgggagcttttcatacagttggttagtgaacctaaaaccttctttagatagtgtagacagctcccttagagcttcacttgatgcatatgatgaagcttccttcattgaaaaggacccgaggatgccaccttccaagaggttcttcagaaattctcaggattttaagtttgattttcccattttacaaactcccctcacccttgttcatgccgatgagctcttttccaatggccatgtcatgccttttttcattaacccttcgaaggtggaggcatacgaagtcttcggttcgacttcatccctgcctactaccacttcacatgc

SEQ ID NO: 22971 - DNA, 447 bp, Gossypium hirsutum
  Clone ID: LIB3272-018-P1-K1-G5
aggaaaccgtgaaccgcaccgatctgatttgcaaaattgctagggatttcgtcgggcagaaaatataaacaaaagaagaaatggcgggggcagcatctgcactatttcttctagatataaagggccgtgttctggtgtggcgtgactaccgtggcgacgtctccgctgctcaagctgaacgcttcttcaccaaactcatcgaaaaagagggagatccgcagtcgcaagatccagtggtgtatgataatggagttacgtacatgtttatacaacacagcaacgtgtacttgatgactgcaacaaggcagaattgcaatgctgccagtcttcttttcttccttcaccgtgtagttgatgtttttaagcattatttcgaggaattagaagaggaatcgctaagggataactttgtagaagtgtatgagttacttgatgagattatggatt

SEQ ID NO: 22972 - DNA, 426 bp, Gossypium hirsutum
  Clone ID: LIB3272-018-P1-K1-G7
cccacgcgtccgcccacgcgttcgcactgtaaaaaaaaagagagaaatttgatcagacggtgaaaatgggtggccttgaaactgagagaacaacaacaggatgggctgccagagatccttcaggagtattgtctccttacacttacactcttaagagcactggtcctgaggatgttttcgttaaagttatgtgctgtggaatctgccacaccgatcttcatcaagccaaaaatgatcttggcatgtcaaactacccaatggttcctgggcatgaagtggttgggtgaggtgttggaaagttgggtcagatgtaagcaagttcagagttggtgatattgtaggcgttggttgtattgttgggtgttgcaaaaactgccgaccatgcgactcagacaatgaacaatactgtcttaagaagatctggtc

SEQ ID NO: 22973 - DNA, 314 bp, Gossypium hirsutum
  Clone ID: LIB3272-018-P1-K1-G8
gatgaagcagctgaggatttcagttcaaaacaacccaacaagaacttggatgctacaccccaaagtcagcttctgaaaggagaaagtgaagagcaagtggccatattggtgaaggcaccccaagacactagcccaaaggcaaaagggaatgcaccgttgtggcgtcaggtagtgggatttcttcatcagattttggaagagctcatggcaccgccaacacttggtgcaattttcggtttcacctttggagcgatcgactggctgagaaaccttgtaattggtccgggggcttcactaccgggtaggccaaagac

SEQ ID NO: 22974 - DNA, 273 bp, Gossypium hirsutum
  Clone ID: LIB3272-018-P1-K1-G9
cccacgcgtccgcggacgcgtgggtctatttcttctcattcttctgctctcccactgtttctctcttcaccctttgccattcatctacaaagaaatttattattttaaccagagaggaaacaagaaacaatttggagccatttagttaaaaaaatgaaaggtgaatgtctagaaccccaaaatgaaggtgaaaaccccaataataatatgttttcaaagcttcaccaccctttttctcatcactgtcaactcattcatgattccgataacacc

SEQ ID NO: 22975 - DNA, 442 bp, Gossypium hirsutum
  Clone ID: LIB3272-018-P1-K1-H1
ttcacttccacctgcttgcttacctatttgttgcgaaaatctcgaagcttccttttgcgtttgagatctcaaaattcaaaaagctctctttttcatctcatggctgctactatcgtctccgtcaaagctaggcagatcttcgacagccgtggaaatccaacggttgaggttgatgtggaaacatcgaacggtataaaggctagggccgcagttcctagcggtgcatccactggaatttacgaggctcttgagttgagagatggacgttccgattacctcggtaaaggtgtatcgaaggctgttgctaatgttaacacaatcatcggccctgcattgattggaaaggacccaaccgagcagactgcaattgacaatttcatggttcaacaactggatggaacccaaaatgagtggggttggtgcaaacaaaagctcggtgcaa

SEQ ID NO: 22976 - DNA, 362 bp, Gossypium hirsutum
  Clone ID: LIB3272-018-P1-K1-H10
cggactggcccggtagacccacgcgtaccgaactaacagaacgaatgctgtggaccaaataaaaatcccaagttcttttataatggctcaaaagcttataaaaagaagtgcgatttcccatttccggtgtttttgttgtggtgagtgttttgatggggaagaaacatagcttagatgagacttcaaactccatttctagttctggaagtgaaagagcacctcttttgaacaaggaggcgaataagcaaacaaatgggcaacaagcagctgaaagtcctctgtcagaccttgagcaaggcaatgcacaagaggcagtcaatgttggattttggagagtatttgcactggcgaagccagatgct

SEQ ID NO: 22977 - DNA, 299 bp, Gossypium hirsutum
  Clone ID: LIB3272-018-P1-K1-H11
cccccatcaagattagaggtgatattcatggtcaatattctgatctggtaagggggtttgagtatggtggatagccaccacatgccaactacttatttttaggggactatgttgatcgaggcaagcaaagtctggagaccatatgtcttattcttgcttacaagataaaacaccctgaaaactttctcctcttgaggggtaaccatgaatgtgcttctataaaccgcatatatgggttctatgatgagtgtagagaagatttaatggtaggctatggaggacaatcacgggatgtttta

SEQ ID NO: 22978 - DNA, 182 bp, Gossypium hirsutum
  Clone ID: LIB3272-018-P1-K1-H12
gcagtacgtatgctagttgggttaggagtaccgttactttggcttgagaaggtgggatctgatctgaaggcagaagaagttataaccaatgtgggttctttggttaccagaggcggaaacagaagactgatgctagagattgattgtggaggattatgcaagaaaagatgcagtcaacactc

SEQ ID NO: 22979 - DNA, 440 bp, Gossypium hirsutum
  Clone ID: LIB3272-018-P1-K1-H2
agaaaacaagggtttcaagtcgtagagaaaaaagaaatcgataaaaatggcgatggcgagtgtgtcgatctggtctcctacgagcagcccttcgcggcggctctcgtcctactgctcctcccacgcgtggcttcgcttcctcttctcatcacgatgatgcttatgaaaccgcaaaatgggaaaagataacatatttaggtgttgctacctgcactgttttagcgatttataacctatcaaaaggtcatccccaccatgaagagcctcctgcatacccatatttgcacattcgcaacaaggagttcccatggggtcccgatggtctggttgagaaaaaggagcatcactagggatggccggatggatgcatatcttttcgagttcggcgcatttttatcatttctctgagaaatcaatcagataattctgtggatcttttg

SEQ ID NO: 22980 - DNA, 386 bp, Gossypium hirsutum
  unsure (1)..(386): unsure at all n locations
  Clone ID: LIB3272-018-P1-K1-H4
acactaacagaacgaatgctgtggaccaaataaaaatcccaagttcttttataagggctcaaaatcttataaaaagaagtccgatttcccatttccggtgtttttgttgtggtgagtgttttgatggggaagaaacatagcttagatgagacttcaaactccatttctagttctggaagtgaaagagcacctcttttgaacaaggaggcaaataagcaaacaaatgggcaacaagcagctgaaagtcctctgtcagaccttgagcaaggcaatgcagaagaggcagtcaatgttgggattttggagagtatntgcactggcanagccagatgctgggaagatatttgttgcccacctttgcattattgatagcatccactacaaat

SEQ ID NO: 22981 - DNA, 364 bp, Gossypium hirsutum
  Clone ID: LIB3272-018-P1-K1-H5
ccggccgggaagacccacgcggacgcttctctcttcaaatcgcagggcttttgtaacctctacctctctctctagaaccgtgactagtgttttcttttggttgtttataaggcatctcaagccagccttctctcttaaaaacagctcatagatcttagtaagaatccgggagatgggttctcggtcggattggctgatgaaaacaatctctttgaatggagtgttacaatgatcgcaccacctgatactctttatgaaagggggatttttcattgccatcatgagctttccgcccaattatccaaccagccctccaccagggaaattacatcagggttttgccatcctaaagttatccggaggg

SEQ ID NO: 22982 - DNA, 359 bp, Gossypium hirsutum
  Clone ID: LIB3272-018-P1-K1-H6
tccgtattaagattagaggcgttcttcatcgaccatctttttgtttggtcaggggggtttagtttcgtggttagggatcccattcccaatgcttatttttaggaacccagtcgcttctgtgtaattatctttcaaacccagatcttcttcatcgcttaaatgctacgttgggttccctaccaggcctgctttcagctctaagctggtttcatcttctagcttgtcctcgataaacacccaccctttcaggggctccttgcttgtcaggtgttctcttgctgatggaaacggtagttcagagaagacgactactttgcatgatctgtatgaaaaagaagggcagagtccatggtatgaca

SEQ ID NO: 22983 - DNA, 121 bp, Gossypium hirsutum
  Clone ID: LIB3272-018-P1-K1-H7
cttttttttttttttttttttttttttttttttttttagaaagtaggtattgatggttacccaatttaattacccttttaatgtaaaatatacataatatatacatatttattttttcctt

SEQ ID NO: 22984 - DNA, 292 bp, Gossypium hirsutum
  Clone ID: LIB3272-018-P1-K1-H8
gctataagtgccaaaatctagggatttgcgggtggagaagaccagagcgcatctgtgtgcttcaaagctcctgtccaggcagaatcctcttcttcccttgcgttgcgttctttcctgctcaatcgccatggcttgcaagcggatcttgaaagaactcacaggatttgcagaacgatccacccacttcttgcagcgcttgtccagtggctgaagacatgttttattggcgagcaacaatcacggcacccttaaactgcccttatgctggaggcgcgtcttaagctactatcca

SEQ ID NO: 22985 - DNA, 426 bp, Gossypium hirsutum
  Clone ID: LIB3272-018-P1-K1-H9
ggggctgtcattcgctaagcttttcagccggctttttgccaagaaggagatgcgaattttgatggtgggccttgatgcagccggtaagactaccattttgtacaagctcaagcttggagagattgtcaccactattcccaccatcggatttaatgtggaaactgttgaatataagaacatcagtttcactgtctgggatgttggtggtcaggacaagattcgttctttgtggaggcattacttccaaaatacacagggtcttattttcggggttgacagcaatgacagagaccgtgttgttgaggcagggatgaattgcatagaatgttgaatgaggatgaactgcgagatgctgggttgcttgtatttgcaaacaagcatgatcttccaaatgcaatgaatgctgctgaaataactgacaaagct

SEQ ID NO: 22986 - DNA, 380 bp, Gossypium hirsutum
  unsure (1)..(380): unsure at all n locations
  Clone ID: LIB3272-019-P1-K1-A1
gaagaacaagaatggattctgccatagctcagaaaacatgggaattagaaaacaatatacttaccgtcgagacacctgacccttcatcggattctatattctactacgacgaggcggctcaagccaagttccagcaagagaagccttgggccaatgatcctcactacttcaagcgcgttaagatctctgcgctcgctcttcttaagatggttgtccacgcccgatctggtggtaccatagaggtgatggggctgatgcaaggcaagactgacggcgatgctatcattgtcatggacgcctntgctttgcctgttgaaggcactgagactagggttaacgctcaggcggatgcctatgagtatatggtcgattattcccag

SEQ ID NO: 22987 - DNA, 366 bp, Gossypium hirsutum
  Clone ID: LIB3272-019-P1-K1-A10
ctttcttcaggccttgtcagtgttccttttgtttttgtcgtacgtagtcgtgggatcagctgagcagtgtggaaggcaagcatgtggtgctctttgccccggtgctctatgtagtagccaatttggctggtgtggcagtactgctgactactgcacagttcctggttgccaaagtcagtgctacgatagtggccctgccgctggtcctggtgggctaaccaatcttatatcacgagagacgtttaatcggatgcttttgcataggaacgatggggcttgtcctgcccgtgccttctatacatatgacgctttcattgctgctgcccgatcctttcctgcatttgctacaactggtgaccaagctac

SEQ ID NO: 22988 - DNA, 256 bp, Gossypium hirsutum
  Clone ID: LIB3272-019-P1-K1-A11
ctcttctctaatacacccactgtaaaaaaaagagagaaatttgatcagacggtgaaaatgggtggccttgaaactgagagaacaacaacaggatgggctgccagagatccttcaggagtattgtctccttacacttacactcttaggagcactggtcctgaggatgttttcgttaaggttatgtgctgtggaatctgccacaccgatcttcatcaagccaaaaatgatcttggcatgtcaaactacccaatggttc

SEQ ID NO: 22989 - DNA, 405 bp, Gossypium hirsutum
  Clone ID: LIB3272-019-P1-K1-A12
atcaaattcaattttaaaaatttctttcaaatataattatcaatttgagttttaaaatactcaattactaaatttacttccacctgatttttagattcttgagattgattggcataagagcttaatttatttcccctcgcttccacccgatcgttgggatcgattagtattagtattgagaagtacttatgggaattggttttaagataactccagtactagtagctgtggtcaataaaaattaaagaagggattctcagattctgttttgttgtgttgctctctgtggatacacaagataattagggtttaattagatttggattcaagattccttcttcatcgtcattttcctaaggaagctacggagcaggaggagttttcaacctttcattaatggaattc

SEQ ID NO: 22990 - DNA, 409 bp, Gossypium hirsutum
  Clone ID: LIB3272-019-P1-K1-A2
caaaaaggatctagaaaagagaatatctcatccttttattttcatttcgtcttcttttcagctcaaactcatcatcgaaattacttgtagttatcaaaatggggacaataggcaaaactactacggccgctctttttctttgtcttcttctgtttcctattgtcttttccacgcctaatgacagattggttagaattggactcaaaaagagaaagattgaccgaaacaatcggatggctgcacaccttgaatccaaggagggaaaggcatctgaagcttttcttagaaagtatcgtcttcatgggaacttgggggaatcagaggacattgatattgtggcactaaagaactacatggatgctcagtactttggtgagattggtattggcactcctacacagaacttcac

SEQ ID NO: 22991 - DNA, 64 bp, Gossypium hirsutum
  Clone ID: LIB3272-019-P1-K1-A3
cgaacggaatggccggggccaacccacgcgtccgggtagttgttgcagaagagtaaaattgtaa

SEQ ID NO: 22992 - DNA, 409 bp, Gossypium hirsutum
  Clone ID: LIB3272-019-P1-K1-A4
gaaaaatctcaaaccaacaactttttctttccttttatctttttgtttgttcttttggcgaaaggtgaagttcatgaagaagcttcatggttctatcctattcatcccggaaaagtcacagttttgaatacagccgaagtaccaagaatttttaatattactacgccgggttacttttgaggccggttgttacgttgttgatttggtcacagctctctctctctctctctctctctttcctgttgatttataaaaacaccattgttgccgatattgacttgcttgcttcctcatctttcctattaaagtctcggagcatgacaactatttcgctccttctttatatgctttctctctgctttcttctccaacccaaaaccaaccttgttgctttcacttaaaagggtca

SEQ ID NO: 22993 - DNA, 413 bp, Gossypium hirsutum
  unsure (1)..(413): unsure at all n locations
  Clone ID: LIB3272-019-P1-K1-A5
caactttactatatcttctaatttttggatcaatttctcctttcgcgctttgaagttgattncttgaagatgggagcggaaaagaacttcattgacatggaggagggaactctggagatcgggatggagtatagaactgtatctggtgttgcgggaccattggtcattcttgacaaagttaagggtccaaagtatcaggagattgtcaatattcggttgggggatggaacaactcgacgtggtcaagtcctggaagttgatggggagaaagcagttgtgcaggtctttgaaggaacatctggaattgacaacaaatacacaactgtgcaatttacaggggaggtattgaaaactcctgtgtcgttggatatgctagggcgcatatttaatggctctggaaaacccattgacaa

SEQ ID NO: 22994 - DNA, 442 bp, Gossypium hirsutum
  Clone ID: LIB3272-019-P1-K1-A6
cggaaattcccgggcgcgcccacgcgtccgttctagattccgctgcaacttttctcagtgcggcattaagcccactttctctgcaggaaaacgcattgtttctgctgctaacaatggtttcaacacggttaattcaacttcattggggactggccaagatgaagatgattatattccaatgccaattgttttgattgatcaagattcagattcagaagcaacagttgtgcagctgagttttggagatcgtttgggtgctctcattgacacgatgagagcattgaaagatttgggattggatgttgcaaagggaactgttgccactgaaggaccagtcaaacaaacaaaatttttcatcacacgattagacaatgggcgcaaagttgaagatcctgatctgttggagagaattcgactcaccattataaacaatcttttgaag

SEQ ID NO: 22995 - DNA, 421 bp, Gossypium hirsutum
  Clone ID: LIB3272-019-P1-K1-A7
gaagaacaagaatggattctgccatagctcagaaaacatgggaattagaaaacaatatacttaccgtcgagacacctgacccttcatcggattctatattctactacgacgaggcggctcaagccaagttccagcaagagaagccttgggccaatgatcctcactacttcaagcgcgttaagatctctgcgctcgctcttcttaagatggttgtccacgcccgatctggtggtaccatagaggtgatggggctgatgcaaggcaagactgacggcgatgctatcattgtcatggacgcctttgctttgcctgttgaaggcactgagactagggttaacgctcaggcggatgcctatgagtatatggtcgattattcccagaccaacaagcaggctgggcgattggaaaatgttgttggatg

SEQ ID NO: 22996 - DNA, 180 bp, Gossypium hirsutum
  Clone ID: LIB3272-019-P1-K1-A8
cgtgaagcttgcaattagtttcttattggctttatttttttttgtttgttctttgtttgctttcttgtctttatgcgtaagctcttttttttagtgtttttatatgatgaaaaataggtttagttaataaacatcacaaaaaaaaatcaccattttgtgattatatatgtaatttctttt

SEQ ID NO: 22997 - DNA, 405 bp, Gossypium hirsutum
  Clone ID: LIB3272-019-P1-K1-A9
gtcgtatcagacgcttttctccccttctctgaaattcccttgctatcgttttgtggaagaaaattttttgagatggcccgtacgaagcaaactgctggtaagtatactcccggcggggctgctacgaggaagcatgtcgccaatgatgcttgcacgaaggcacccacaaccggaggcgtgaagaagcctcaccgatatttgcctggaactgtagctctgcgtgaaatccggaagtaccagaaaagcactgaactcctcatcaggaaactgcctttccaaaggctcgttcgtgaaattgcccaagactttaagaccgatctacgtttccagagccatgctgtattggcgttgcaagaggcggcagaggcataccttgttgggttgttcgaagataccaacctgtgc

SEQ ID NO: 22998 - DNA, 371 bp, Gossypium hirsutum
  Clone ID: LIB3272-019-P1-K1-B1
gctgtagccacggcggcgatgaagacgacgaccctaagttcccttccatttaaccaatcagttttcgggctgaagtcccaaagaaaaggccgctttaccatggcttcacacaaagtaacactgataactccgtcgggaaccaagcaattcgactgctcggacggcgactatatcctggaccgtgccgaggaagtaggaatggatctcccgtactcgtgcagggctggggcttgctcttcgtgtgcgggactgatcaaacaaggcaccgtcgaccaatcggacaatagcttccttgatgatgaattgattgatgcaggcttcgtcctaacttgtgttgccatccctaagagtgatgttatcattgagacaca

SEQ ID NO: 22999 - DNA, 363 bp, Gossypium hirsutum
  Clone ID: LIB3272-019-P1-K1-B10
ctttcattcgacttcgacgagaacaaaaatggaaaaacctgtaacagaggacggaagctcttaactcgactcagatccaaccctacaaaagcaggacaagggtgaatacaaaataatggacaagaaaccaagtaatccaatggagtggttgaatcaaatggtaggagagccgtattatttcttccatttcctatctttcttctcttatttcatcgttcggagctctgcttctaatgtcctctcccctcaaatcactcaacttcttttttatagggaaattcaagcggttttggccttctttatgctgattgcatacaagatggcaagagaagaaacatgggaggctttcattgctgatacatt

SEQ ID NO: 23000 - DNA, 406 bp, Gossypium hirsutum
  Clone ID: LIB3272-019-P1-K1-B11
gagaaaagagtagatcttggcttctctccttcgttcgattccgcttaattatggcccgcgtttctctcagacgtgaaaaatggggctgtctttcacaaagctatttagccggcttttcgccaagaaggagatgcgtatactcatggttgggcttgatgctgcgggtaaaactaccattctttacaagcttaagttgggagagattgtcactaccattcccaccatcggtttcaatgttgagaccgttgaatacaagaacatcagctttactgtttgggatgttggtggccaggacaagatccgaccattgtggagacactacttccaaaacacccaaggacttatttttgtggctgatagcaacgatcgcgatcgtgtggttgaagctagagatgagttgcacagg

SEQ ID NO: 23001 - DNA, 230 bp, Gossypium hirsutum
  Clone ID: LIB3272-019-P1-K1-B12
gaacggaagggccgggccgacctcacccgtccggaaaaaaaaaagctttttcacttctattctcgagacaattccactacaggtggtgtgcttcacactattgaaaggctatcacagagatctcactaatataacgagctattcaaggtagagtctctttttataatactaaaactaatgcaaggcgccttttataagatcaatactacctgaattctctcttattttaa

SEQ ID NO: 23002 - DNA, 412 bp, Gossypium hirsutum
  Clone ID: LIB3272-019-P1-K1-B2
cccacgcgtccggtaatcttctttttcaagcctaagcttgttctgatttgactccctcctaacgctgccttctacagatcacagtacctgaagaaaacccctttttcccctcctattctcttctactatttaaccctcttacaattaccatctgcctacccaagtttcttaaataatttctttttggctctaataaaaggaaaatttggattggaggcattggttcttcatgggtgaagccccggcattctgttttgacaatctacaaaatggatttggtttaaaacccaaaggcttggagacctctgccgacgttggtgacaaaacgtttgtaattggtggggcagacaatgattccacatcatatattgtggttaagatttatgacacatctacaggcaaatgggtgatc

SEQ ID NO: 23003 - DNA, 406 bp, Gossypium hirsutum
  unsure (1)..(406): unsure at all n locations
  Clone ID: LIB3272-019-P1-K1-B3
agaagaccctggagtttttctcatggcctacgtcgagggaggtgttgtgaagtgaaagcgttcaatatggcgactganaactatcactgattttttctgggcaattatcaatttcattggagtgttcttctcaaccatgttctcgatggaaaagtcccatgcctacagaaaaggctttggttcaagcaagaaatgggatggtggtccaggaggacctggaagtggaccatatggtggtggtggtggcccacgaccaccaccacggggaatggacaatgttcggggaattgaccatagttcccttcctgcctgtggctcctgctgcggtggctaattgctgcaagcatacatcttgtgcatgtacaatgttatatagctaaagtcctctaattataagtaaggatgt

SEQ ID NO: 23004 - DNA, 411 bp, Gossypium hirsutum
  Clone ID: LIB3272-019-P1-K1-B4
cccggatggattcctctcttctccggatctaatttcgttttcaccagtcctagaccgagagagaagagcgaagaattgaaggagaggttaaggaagcttaaagaactagcagagaggaaagagtatcaagagcttgttaaagatatcacgccgaagaaggatctcactgaacctttctctacttataaggatcaaattggctttgaattctgctggaggtattcttggattggtgtttggcatgcttcttgaaacatttttgttcattattaggacttcagagcctaaccttaaatcgccgtcctcaacttcgagattgaagaaaaatcaatagagtatttaaaaagaggttggttgtgttttcttttcttgctacctattgtccattatcaatagagtatgtgagtttaa

SEQ ID NO: 23005 - DNA, 377 bp, Gossypium hirsutum
  Clone ID: LIB3272-019-P1-K1-B5
taccttctggctcaggtctacccatctctcccactttgtttctcacttctaatgcccgagggccgtcactttctcaaatcaacacaccgagtctgcacttaaagctgttaatgactctctctctggaaaatcatccatctctgggacttagctgaccaaggatgacataaaagttcatgctgctgtcatgaagaaccctggagattctttccataatgcaagccaggggtgtaattctgggtcttctcaacttgcggccagcttccctggcaaagctgttgacgtcgggtttggtggcatagctgctccagctgagtctgctaaagctgaggctgcacatgatgaccacgacttggatctattccgtgatgagacag

SEQ ID NO: 23006 - DNA, 412 bp, Gossypium hirsutum
  Clone ID: LIB3272-019-P1-K1-B6
acacagagagggagaaatggtttctctgaagctacagaagcggctctccgcgagcgttctaaagtgtggaaaaggaaaggtttggctcgatcctaatgaagtcaacgagatctctatggccaactcccggcagaacataaggaagttggttaaagatggttttatcatcaggaagccaaccaagattcactctcgatctcgtgctcgtcgcatgaaggaagccaagagaaagggacgtcactctggatatggtaagcgcaagggtacaagggaggcaaggttgcccacaaagatcttatggatgagaaggatgcgtgtacttagacgcctactccgcaagtacagggaatcaaagaagattgacaagcacatgtaccatgacatgtacatgaaagtcaaaggtaatgtgttt

SEQ ID NO: 23007 - DNA, 373 bp, Gossypium hirsutum
  Clone ID: LIB3272-019-P1-K1-B7
gacttttcaagtcctttctcctccccatttccatcaaaaggccgccgttaagttatcggcgatgtcgacggcgccgccgatttccgccgaccgggtacagaaattcatcgaagaccttgaagcccagaagaaaatcgtatccaaatgcaccgaattattcacaaccctaaccaatcatttcacttccctccaaaattccctttcccaaaaatcccaatccctggatgccaaattcttatccctttcttccaaattctgccaaactctcgattccctttctcaacgtgaatcttccctccccgaccgtgaatcctgcggcgctgcccacatcgaaaccctaaaagaagcaggtttcgccgaattcaaggaccct

SEQ ID NO: 23008 - DNA, 328 bp, Gossypium hirsutum
  Clone ID: LIB3272-019-P1-K1-B8
attttcacaaacttttttgctgatttttgctctcttttttctttaatcctaagtctgttttcttttttacatttatgggcaaaagatggggtcttacccctggttcccaacccggtactaagaagttttttacaaacaaattctattccaccaaccgtggcggcggttcttttatcgggttgtagcaacaccaccaccaccaccgggacatgtttgagttccctgttagtcttttgggggagagcgatgacgaccgccgtggaactttagatttttctttgccgtgtgatgataccaagattcccgtcgatgagggggattttttctc

SEQ ID NO: 23009 - DNA, 414 bp, Gossypium hirsutum
  Clone ID: LIB3272-019-P1-K1-B9
gtctaccacacacttgctaatattgctacttggagtggtggctctcgccactgcggcttttggtacctatgagtctcccaactatgggaagccccctactcctgtgtataaaccttctaaggtgaaacccctaccttatgaacatcctgttgataaacctcctaaggtgaaacccccaccttatgaacataagccccctgtctatgaaccaccaaggacggaaaagcctccacctaggcgacgaggtggtacacctccaaagaaagagaagcctgaacccaatccaccagtatatgcacctccaaagaaggaaaagcctgatcctaagccaccagtttatacaccaccaaagaaagagaagcctgagcccaaaccaccattatatgaacccccaaagaatgaaaagcctgctcc

SEQ ID NO: 23010 - DNA, 413 bp, Gossypium hirsutum
  Clone ID: LIB3272-019-P1-K1-C1
ttgatgtggaattctgtgggcttctaccagatagcaaagctgagcatgagtgcagtatcttgctttctggaagttgtttttgacaaggttcgctactcaagggatacaaaactcagcattctactagttctccttggagttgctgtctgcactgttactgatgtgagtgtcaacgtcaagggttttttagctgctgtaattgcagtctggagcacagccctgcaacaatattatgtgcattttcttcaacgcaagcattctttaggatcttttgacttattgggacatactgctccggtacaagctgcaagccttctgttagctggtccttttgtggactattggttaacagagaaaaaggtctacgcctataactacactacggtatcaacgttcttcataatcctatcatg

SEQ ID NO: 23011 - DNA, 409 bp, Gossypium hirsutum
  Clone ID: LIB3272-019-P1-K1-C10
aagagctgttcttcttcaaaccctagcctctatctgggagccctttccaatggcttcgcgtcgactcctctcctctttcctccgctccacttctcgccgatctctctccaaatctcccagccctacccctcgcctcccttcaccttcccccacgcgccgcccttttccgtgcccctactttctctcacgcgatgctgagtactctacatctgcggctgctgccgcttctgctccatcgcagcctcctcccgctaagaagggcggaaaaggtaagatcactgatgagttcactggtgctggagccatcggtcaggtttgtcaagtaatcggtgccgtcgtcgatgttagattcgatgaaggcttgcctccgattttgactgcgcttgaagtgatggaccactcgatccgg

SEQ ID NO: 23012 - DNA, 182 bp, Gossypium hirsutum
  Clone ID: LIB3272-019-P1-K1-C11
gcaactgcttacgcaatggataaattcacgcatgctgacaaatgaacggtggggaacttcgccactcgcggtgaaacagtaaatgattacttattatctgtaatggtagccgcaagcctaattatctaactaatgacacgcataagttgtccaacgagatcactactgaacatggctactat

SEQ ID NO: 23013 - DNA, 433 bp, Gossypium hirsutum
  Clone ID: LIB3272-019-P1-K1-C12
ggaacggccgggccggcccagcgcgtcccgtttcgtgtagttataaaagatagtctcaatcggctcgattcgcctgcgttgcggtggtaaagatcccctcttttaaggatgaattcactttcgaccaaaggcttgaagaatcccgcgatatcattgccaaatatcccaatcgggtccctgtgattgtggaaagatactcaaaagcagatcttccagaaatggaaaagaaaaagtatctggttcctcgggacatgtctgttggacaattcattcatatcttaagcttgagacttcgtctgagccctggaaaagcactgtttgtgtttgtgaagaacacgttgccacaaacagctacgcttatggactctctctatgaatctttcaaagaggatgatggttttctgtatatgtgttacagcagtgagaaaacctt

SEQ ID NO: 23014 - DNA, 412 bp, Gossypium hirsutum
  Clone ID: LIB3272-019-P1-K1-C2
ctgggattcttaatagtgaagtaaccgtccatagggacttcgatttgaataatggtcctgctgttgatgaggtaagcactgaaccatcactatttagccataatgctagaagcagaaatgccccatctcaaccatcagcttccagcctccggatgaacagtactgaggtggcaaatttctcatcatggtttcctactgagaatacatactcatctattgcactacaatcgatcttacctgatagagagcagccttttccaattgttgcaactggtgggccacatagggtgttgggcccacctatgggtgccaccccttttaatcctgatgtctatagggaacccatgttgtcatcttcaccagcagtgccatttccatcaacccctttccaatatcctgttttcccctttgg

SEQ ID NO: 23015 - DNA, 399 bp, Gossypium hirsutum
  Clone ID: LIB3272-019-P1-K1-C3
ctcaaacattttcttacttatcaagacaccccacttcaagttatttagatcaagaaagcagtgccttttgctgggtttctttctttcttttttttaattctaaagaaagagaaaattatggggaattgtatgatgaagacattgggatcaaggccgcatctggaagaagaagaagaagaagaagagattggtgaagcagcttcaactgattataagaaggaaaatgaagggaagaaaagcagcataaaggtgaagatagctcttacaaaagaggaactagacttgttattcgtgaagctgaacaacaagggtaatggtgggaagagcttagaggaaattttgggtgaaatagagaaagccagatctgagaaacttgactcttcatggaaaccttcgttg

SEQ ID NO: 23016 - DNA, 380 bp, Gossypium hirsutum
  Clone ID: LIB3272-019-P1-K1-C4
cacgagcagtgttgggatggggtcgatacaaaaaccgcctacacactctttacagtatatcaaagagagctcgccattatcaagagcaaataaaaagagagtttttttttttaagtttaaaactaatggaaagcgctccttattagatcataattggatgaaatctcgcttattttaagctggttttgcgctatctttctatttgcagctctgctcctacaaacaaggtttgaacgatgtcccggcatctgcctatgcatcgaggtgtatccggactgcggaacttgagtaacagcaatgatttttgggattctgaagtgaaagataaaacggaaaaggaagatttggatagaaatcgtgcttctgatcagagctattta

SEQ ID NO: 23017 - DNA, 438 bp, Gossypium hirsutum
  unsure (1)..(438): unsure at all n locations
  Clone ID: LIB3272-019-P1-K1-C6
tcgttccggccgaagaatattaaaggcttctttcgacttgtataacaggccatacaaaacccccattatctaccgtggatggaaggtgttgatcttcgaagcatactgatnnggtttggtgaatatgctagatagaaanacggtgctcgaaggggtaatatgttggtggcacacaccggtgaaggccagctaatgagctgggatgaacacataatgcttatcggtcatactgtcaactgttttggcggatccgttaaagtaattggtaacacgggaagtgactcaaccagggaagcgattcacgccaccgaacaaggttttgctgttggaatgcatgccgctcttcacatcaatccttactatggcaaaacctctctagagggcttggtttctcactttaatagtgtactaccaatgggccctactatcatatacaac

SEQ ID NO: 23018 - DNA, 412 bp, Gossypium hirsutum
  Clone ID: LIB3272-019-P1-K1-C8
gcatattcttgtaaaatagatgtatattgggacctttcttcggctaaattcggatccgggcctgaacctttcgaggggttttatgttggtgttgttgctaataagcaaatggttttgcttcttggggacatgagtaaagaagcttgtaagaaaactggtgcaactcatataccttgtaatgccagtttagtggctaagaaggagcatgtttttggaagagggtatttggtaccaaggcgcagttttgtgataatggtcgaattcatgatctgataattggatgtgacgcggttggtatgaaagaaccttgccttataattcgtgtggatggaaaggctttgatgcaagtgaagcggctgcggtggaagttcacagggaaccataccattttggtcgatggaatggctgtaga

SEQ ID NO: 23019 - DNA, 407 bp, Gossypium hirsutum
  unsure (1)..(407): unsure at all n locations
  Clone ID: LIB3272-019-P1-K1-C9
aaaaaggaatccttattcagagcagcaatggcggacactgtcatctctctcgataagctcaaagccttctggaactctcaagtccacgatgaagaaaactgggctcacaatatgaaactgctgcgagccgccggtttatttgctggatcgattcttctaatgcgcaattacggtgatctcatggctatataaggaattgaggattgattaagaagttcggagtaagctcagtttggaaatggatgcatctgttactttaggaactatatacatggttaatgatgatattgaaacaactttagtaactttttgaagtatgatgctcatatatgcttctaaatgttttggaatttgaatgaaatgaacccacttctggatttattttgaatgaaatggatggctntcct

SEQ ID NO: 23020 - DNA, 394 bp, Gossypium hirsutum
  Clone ID: LIB3272-019-P1-K1-D12
ctttttctttcacctttcgattctccacggtgccgccaggcactgttttctctgttctagatgacaacgcaatcggatccatcggcttccgatccacaagggattgggaatgcctttgtcaaacagtactacactgttcttcacaatgacccttcacatgcttataaattttatcttgacttgagcgtgttaagccgccccggtactgatggtgcgatgaagtccgtgactaccctgaaagagataaatgagttgattctctcattggactaccagagttataaggctgagatttcttttgctgatgcccagttctcattagcaaacgggtgtgatgttttgttactggctctttgatcggaaaagtgatgtgaggaggaaagttacgcagtca

SEQ ID NO: 23021 - DNA, 303 bp, Gossypium hirsutum
  Clone ID: LIB3272-019-P1-K1-D2
acttgtacctttttaactctaaagccaaaaccgtaagccactaacgttttgagagaagatcaaaatggcttctaaaatatcagcttccatggtactcctttcggcactcaacattctctttttttccctagtcagggcatagtggctcttgctcttcaccacacccctaaaccaaggccaaacccaaaccccaacacccccactcctactacatctagacgaggcaggggccctacgtatgccctcaaattaggtgtatgcgccaatgtagcttaacctagtcaatgtcaccattggttcacc

SEQ ID NO: 23022 - DNA, 347 bp, Gossypium hirsutum
  Clone ID: LIB3272-019-P1-K1-D3
gaaatccagacaggaaagaatccaccagaacaacaacgtcttatcttcgccggaaaacagctcgaagatggccggaccttggccgattacaacatccagaaggagtccaccctccatctcgtcctccgtctacgtggtggcatgcagatcttcgtcaaaaccctgaccggcaagaccataactttggaagtcgaaagctctgacaccattgacaacgtcaaggcaaagatccaagacaaggaaggcatcccaccagaccagcaaaggctcatatttgccgggaaacaactcgaggacggtcgcaccttggccgattacaacatccagaaggagtccaccctccattt

SEQ ID NO: 23023 - DNA, 360 bp, Gossypium hirsutum
  Clone ID: LIB3272-019-P1-K1-D4
cacccgtccggtttcgtgtagtaataaaggatagtttaaatcggttggattcgcctgcgtggcaggggaaggatccctttttttaaggatgaattcactttcgaccaaaggctggaagaatcccgcgatatcattgccaaatatcccaatcgggtccctgtgattgtggaaagatactcaaaagcagatcttccagaaatggaaaagaaaaagtatctggttcctcgggacatgtctgttggacaattcattcatatcttaagcttgagacttcgtctgagccctggaaaagcactgtttgtgtttgtgaagaacacgttgccacaaacagctacgcttatggactctctctatgaatct

SEQ ID NO: 23024 - DNA, 407 bp, Gossypium hirsutum
  Clone ID: LIB3272-019-P1-K1-D5
gttatggtgatgtcggaaagggttgtgctgctgccttgaagcaagccggtgctggtgtcattgttactgagattgatcccatctgtgcccttcaggctctcatggaaggacttcaggttttgaccctagaagatgttgtctccgaggctgatatcttcgtcaccacaaccggtaacaaggacatcatcatggttgatcacatgaggaagatgaagaacaatgccattgtttgcaacattggtcactttgacaatgaaatcgatatgctcggtcttgagacctatcctggtgttaaacgcatcaccattaagcctcaaaccgataggtgggtcttccctgaaaccaaaaccggcatcattgtgttggctgaaggacgtctgatgaacttgggatgtgccactggacac

SEQ ID NO: 23025 - DNA, 417 bp, Gossypium hirsutum
  Clone ID: LIB3272-019-P1-K1-D7
aaaacaacagccaattactcttcagtctcagccgatcttaaaccatgggtcgcgttcgcacaaagacggtgaagaaatcgtcccgtcaggtaatcgagcggtactattctcgaatgaccctcgattttcacaccaacaaaaagattatcgaagaagtagctataatcccatccaagaggctccgtaacaagattgccggtttctcgacccatcttatgaaacgtatccagaaaggaccagttcgcgggatttctcttaagcttcaagaagaagagcgcgagcgtcgcatggattttgtccccgatgaatcggccatcaaggtcgaccaaatcgaagttgataaggaaacacttgatatgctttcggttattggaatgggtgatattcccggccttgataaggatgacccggttgctg

SEQ ID NO: 23026 - DNA, 375 bp, Gossypium hirsutum
  Clone ID: LIB3272-019-P1-K1-D8
atttcccgtccgcttgatttccatcagacggtgataaccatgccgatccgaaacatagccgtgggccgacccgaagaggcgactcaaccggacgcactcaaagcagctttggctgagttcatctccacactcatcttcgttttcgccgggtcaggctccggcatggcctttaacaagttgaccgacaacggagccaccactccggccggtcttgttgccgcttctatagctcacggcttaggacttttcgtcgctgtatccgtcggcgctaacatctccggcggtcacgtcaatcccgccgtcactttcggcgctttcgtcggcgggaacattagtcttttacgcagcattctctatcggatcgatcaactactt

SEQ ID NO: 23027 - DNA, 450 bp, Gossypium hirsutum
  unsure (1)..(450): unsure at all n locations
  Clone ID: LIB3272-019-P1-K1-D9
cacgcccgtccgacagttcattagtatattgnngcgttgaatttcaatttgtgttgtatacatcttgaagaagaaagagtggcgtggttcttgcaaaacgaaagcatgaggttagtacatcancttcccccagccaaggctatttaagggcatttgctgaagatctggacactcctattgcccaaggttgccccacaagcaatcaagagtgtggaacgccttgaaggagatggtggccctggaactataaagaagatcacctttgctgaagggtatggattcagttatgcgaaacacagagttgatgtgttagacaaagacaacttgttgtacacttacgttgtgatcgaaagcgacttttttaacaacatggtggagaaaatcagctacgagacaaagtttgtagcagcagcagatggaggaacaagtattaaggtaaataccaccttt

SEQ ID NO: 23028 - DNA, 401 bp, Gossypium hirsutum
  Clone ID: LIB3272-019-P1-K1-E10
atttagtgcaaaaaccatcttcttttttctgctttctcgtatagcagcctggtgtgagaaactttttttttgaggaaattagaaaatgtcatcggagaacgggaaaaggttgctggaaactgatgccggcggcttgaattttgaggctaccgagctgactttagggttacctggagagcctagagtaacatcggacggtggagctaagttgggcagtaaacgtggattttcggaaacctttgatcttaagttgggtgacaacaatcaagaggttaagctgggtcactccctccaagaagctgccaagtctcccgtttcaaagacacaagtggtgggttggccgccggtgagaggctttgcaaagagaggaaagaagagttgcaaatatgtaaaagtggcgg

SEQ ID NO: 23029 - DNA, 295 bp, Gossypium hirsutum
  Clone ID: LIB3272-019-P1-K1-E12
aaaaagggggggcgccgcgcgtaatatttccaggagagaagggctcagtaagaaaatggaatgggggggctccaagtttcggcgacgttcgggagacagaagatggcggatactataattgggcagctgcgattctgcggtgctccgcgaggccaaagctgcgctggtaagcttgtgttgaagcctcgaggctttgctcttccacactatgcgggtgctccaaagaggttatgttctagaaggtaaatgtggagtcggaatacaacaccagctttcaacacaaaagaaaaagtgg

SEQ ID NO: 23030 - DNA, 412 bp, Gossypium hirsutum
  Clone ID: LIB3272-019-P1-K1-E2
ctcaaacattttcttactttccaatacaacccagtacaagttttttagatcaagaaagtagtgggttttgctgggtttctttctttcttttttttaattttaaagaaagagaaaattatggggaattgtatgatgaagacattgggatcaaggccgcatctggaagaagaagaagaagaagaagagattggtgaagcagcttcaactgattataagaaggaaaatgaagggaagaaaagcagcataaaggtgaagatagttcttacaaaagaggaactagacttgttattagtgaagctgaagaacaagggtaatggtgggaagagcttagaggaaattttgggtgaaatagagaaagccagatctgagaaacttgactcttcatggaaaccttcgttggagagtatcatgg

SEQ ID NO: 23031 - DNA, 308 bp, Gossypium hirsutum
  Clone ID: LIB3272-019-P1-K1-E3
ggaacggaagggcgcggcccgacccacgcgctatcggcctgagtaatgttctctccaactaacctactttcttcgagtaccctggtgcgtgcttctgtggatgttatcatgttaaaaccgaaggtattgatttccccccactcagattggaaaagggtacccttagatttcagctaaagagacccctgcccgtggttttctttgttaccttaaccccaagcaaaacaacaacatgtgtgtttcacaggcttttcaaataccactttatgataagcatgagacgggagatcgtttgatggtacacataa

SEQ ID NO: 23032 - DNA, 405 bp, Gossypium hirsutum
  unsure (1)..(405): unsure at all n locations
  Clone ID: LIB3272-019-P1-K1-E4
atttttgaacaggcaaataaaagctttaattacttaaccttaaaaaccccctcccggctcctttgtggattagaaaactaaagatcaaaagatgggcacctaggaaacaaaaaagataggtgaaggatgtcaactgcttcttcattgtgttcatcaactcagattaatggctttggagggggacttggngttctaagaacccatgtttctcaacccaagacactttcttttacaagaaggagaatttctacggtagtgaaggcaacatctcgagttgataaattctcaaaaagcgatatcattgtttctccatctattctctctgctaatttcgcaaagttgggggagcaggtgaaagcagtagaagttgctggctgtgattggatccatgtngatgtaatggat

SEQ ID NO: 23033 - DNA, 407 bp, Gossypium hirsutum
  Clone ID: LIB3272-019-P1-K1-E5
cccatttccaatctccagctcccaaggtaaatatgccgatcagaaacatagcggtgggccggcccgaagaggctactcaccccgatgctctcaaggctgctttggctgagttcatctcaaccttgatcttcgttttcgctggatcgggctcaggaatggcctttaacaagttgactgacaacggagcaaccaccccggctggtctcgtagccgccgctctagctcatggcttcggtcttttcgtcgctgtctccgttggcgccaacatctcaggtggccacgtcaaccctgccgtcaccttcggtgcttttgttggcgggaacatcactctcttgcgcggcattctttactggatcgcccaactcctaggctcaaccgtcgcttgcctgttgcttaagttcgctacc

SEQ ID NO: 23034 - DNA, 457 bp, Gossypium hirsutum
  unsure (1)..(457): unsure at all n locations
  Clone ID: LIB3272-019-P1-K1-E6
tacgcccgnacggaccgggactgcccggctggacccacgcgtgcgtttttttttctcctgttccaccgccgtcaatctcgaaccttatcctcgttttcaaacatgctcaaaaaagatggccaacgctgcatcgggaatggctgtgcatgatgattgcaagttgaagttcttggagctcaagacaaaaagaacccaccgcttcattgttttcaaaatcgaggagaagcaaaagcaagttattgtggagaagcttggtgaaccaaccgaaagctacgaggattttactaaatgtctccccgctgatgaatgtcgatatgctgtgtacgattttgattttctaacggccgagaacgtcccgaagagcagaatctttttcatcgcatggtctcccgacacgtcaaggatcaggagcaagatgatttacgccagctccaaagacagattcaagcgagaactg

SEQ ID NO: 23035 - DNA, 417 bp, Gossypium hirsutum
  Clone ID: LIB3272-019-P1-K1-E7
gtgataagcatagcatggttttctccttctttgagatcgaaaaaaagcatactggagtaacccattgctttaggaagatgccactcctttcactcggttttacaaaacttggaagatttatgtaggtaacctacgctgtgcatcaatcaccccttgtgaaaacccattcaggaaactaatcaaactatgaactgttgaaacatctactgcagttggctgggtttcacttcgaacacagacttacaaatgccagctaccacactgccaagtaattaaaaggcgtgcgcgtgaacttcatcatgtaaagagttgaacgcagttatcactagcctgaacaaacctacagagaagagcagtacgtaaacggccaacttgataaaacgatatttcttgtaagtgttaagatctctgaaaatc

SEQ ID NO: 23036 - DNA, 416 bp, Gossypium hirsutum
  Clone ID: LIB3272-019-P1-K1-E8
catgtgcctggttatttttgcttcttcaaaggttttttttttttaattaattttctcttggaaggagaggaagatagttaaaaactcaaagaagggcttcaattagatcctcttgcttgctatcattccaaacttggagataagagaaagctgacccctggtttgcttatctgtaggatcccctggggaagctgctggtggtggtttttacaggcatttcaaataccattttctatggttctttggctgttctgattctaattgatgttggaggggttcactgaggattaagctcctcaatcatggaaggtctttgtgaaacaccagaaaatggtaaagtagcagatcccgaccttcggaatattcagtacttgccatcctctaccggattatcattactttggtttgatatgaga

SEQ ID NO: 23037 - DNA, 415 bp, Gossypium hirsutum
  Clone ID: LIB3272-019-P1-K1-E9
cagagaaataaaaatgggaggctgggcaatcgcagtgcatggtggtgctggtgtagacccaaatctccctaatgaaaggcaagaggaagctaaaagactcctcaatcgttgccttgatattggaatctctgctcttcgttctaacctctccgccattgacgtcgttgaacttgtcgtgagggaattggaaacggatcctttgtttaattccgggcgtggatcggcacttacggagaaagggacggtagaaatggaagctagtattatggatggaccgaagagacgatgcggtgctgtttcgggtttaacgacagtgaagaatccgatatctcttgctcgacttgttatggataaaacaccacattcgtatttgggttttgccggcgccgaagagtttgcgaggaaacagggtgtg

SEQ ID NO: 23038 - DNA, 408 bp, Gossypium hirsutum
  Clone ID: LIB3272-019-P1-K1-F11
atctcttaagcctccctctcctatcctttgagcataagaaaattatacgcaggaatggagcgaggaaaagagcagggaatggtggtgatgcctcagcaaaaccctttggaacagtggcaagctaagttcaaggaagtggagaccagtttcagaggatggctagctaagcagtccttgcccgtcgaggcggctgttgtaaccaccaccagcgctgctcagggtgctgctatcggtgctttcatgggtaccctcaccaacgatgtctcctactgtcttccaactccccctcaggcttacctcgatcctcaagccatggcttgtgctaagcaagcccaggctctatcaggaggcccctagatacaagctcggaattatgctgtgatgacgggtgtgaatgcaggcatatct

SEQ ID NO: 23039 - DNA, 323 bp, Gossypium hirsutum
  unsure (1)..(323): unsure at all n locations
  Clone ID: LIB3272-019-P1-K1-F12
cacgtccgactacaaacccctcttctccaaggattcaaagaaaccaaaaacccacgccggtatccttccaagattagacggaaaacangaggcaactatccccatgaagcatcgctttacactaaggaaccatatcgatactaaagaagcaaccacacttatacaatgcttacaagacaacggactcaactgtttgcgcaactgccgaagacaccaccaatgctcgagccggtgcatatcattggtgatgctattagtgcccttacaagcaaacgatcctatatcgttgcaactaccaagaaggtttacgttgatcctaaacc

SEQ ID NO: 23040 - DNA, 367 bp, Gossypium hirsutum
  Clone ID: LIB3272-019-P1-K1-F3
atagcagccatggcagtccgtatgcttttggggttaggaatcctgctactctgccttgcaaaggtttcatctgatctgaaggcagaagaagttataaccaatgtcggtgaggtgggttctttggttaccagaggcggaaacagaagactgatgctagagattgattgtggaggattatgcaagaaaagatgcagtaaacactcgaggccaaacagatgcaacagggcgtgtgggacttgctgcttgaggtgcaagagcgtgccaccggggacttcaaggaacagggaggtctgcgggacctgctatactggcatgaccacccatggaaacgttgccaagtgcccttaacctttacgtcgcccaatat

SEQ ID NO: 23041 - DNA, 411 bp, Gossypium hirsutum
  Clone ID: LIB3272-019-P1-K1-F4
atttatttgcaggagtaaggaaaaggtacaagtcaagaaaatggatatggacttatctcccaagtttccggcgacgttcgtggagacagaagatggcggatactataattgggcagctgccgattctccggtgctccgcgaggccaaagttgcagctggtaagcttgtgttgaagcctcgaggctttgctcttccacactatgcggattgctccaaagtaggttatgttcttgaaggtaaatgtggagttggattgacaacaccagcttccaacacaaaagaaaaaatggcattcataggtattaaaaaaggggacataataccaatcccttgtgcatcagtttcatggtggtacaattatggtgattcagacgtggtcatagtgttcttggccgatgcaaccaatgccta

SEQ ID NO: 23042 - DNA, 407 bp, Gossypium hirsutum
  Clone ID: LIB3272-019-P1-K1-F5
gtgaattctctcctaagcaaaaacaaaagtattctctttcacacctttcaattttggaatctcataaaaacaaacatgaaaggaataatcttgggttttaacaaccaacatcaactccaacagggtctgtttttttttttctgttctttggtaattttctctatgtttttctctaagtggtaggagctgtttctgctttgatccttgactggttcctcttttctttcttcctttttcagggtcagtttttacaggtttaatggcttttgatctaatggcccttttttgtttgggaaaaccaaaacaaaaaaaattggtgttttgagctaagatttggtcttcttttttttttttttgaagaaattcctggtgggttgatcctgtggatgtttctttttattgtgtaa

SEQ ID NO: 23043 - DNA, 282 bp, Gossypium hirsutum
  Clone ID: LIB3272-019-P1-K1-F6
ttgttcaaaacaaacagcaaagaataatcatggtttcacaaccaaacactatgtcacagaggcaagctaaagttcatggcaagtggagacgcaatttcagagtgatggctagctaaacagagcttgcccctcctgggcggttgattgcaccccccaccaccgctgttcatggtgcttctatcggggctttcatggctaccctcaccaacgatgtctcctactctcttccaactccccctcaggcttccctaaaactcaaagcctggttttgttaaacaagcc

SEQ ID NO: 23044 - DNA, 414 bp, Gossypium hirsutum
  unsure (1)..(414): unsure at all n locations
  Clone ID: LIB3272-019-P1-K1-F7
caaagagcaggaaaacaagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaagatatgcgatgaaagagtcgtcgtcgtcggagacaagggcttattcttcagcttgggcgcctgaccctgttacggngtatta

SEQ ID NO: 23045 - DNA, 387 bp, Gossypium hirsutum
  Clone ID: LIB3272-019-P1-K1-F8
cccatgcgtacgaaggaaaacacgaaaagcatagccgcatcactttctgctagctaagctactgtgggagatatcgttcttcacaacagcttctgcagtcgctaataataacgttatatattatataaattttatacatacttcttaccctacgactccatatataagcaagtgaaaataaatgtggctcgctctgagtcttcctttaagttccttggtgctgctgtttatgatgctctatatgtctccatatcaaggagaggatactcaggtgcaccgacggctgcagtgacggctagctttgctaggcctggagcgatgcggaaagttgcacgaagatatgcgatgaaagagtcgacagcggcggagacaagggcttattcttca

SEQ ID NO: 23046 - DNA, 415 bp, Gossypium hirsutum
  Clone ID: LIB3272-019-P1-K1-F9
atttaattcccgttttctaatctttttgggaaatcggtagcaaaaaaatgtcgtcgtcggggaggaagatcacccttaagagctcggacggcgaatcattcgaggttgatgaagcggtggcgttggagtcgcagacgattaagcatatgatcgaggacgattgcgctgataacgggataccgttgcctaatgttacgagcaagatcttagcgaaggtgatcgagtactgcaagaaacacgtcgaggctcctaagacagacgatcgatccgccgatgacgagctcaagagttgggacgctgactttgtcaaggtcgatcaagccactctctttgatctcattctggcagcgaactatttgaacatcaagggtttgctggatctcacttgccaaactgttgctgacatgatcaaggg

SEQ ID NO: 23047 - DNA, 341 bp, Gossypium hirsutum
  Clone ID: LIB3272-019-P1-K1-G10
accggacggaaggccgggcagccacccgtaaggcatcaatgacgacgcatatactgagacgacaagtgagtcacatcctttccgatgtgagccctaactctaatcctacctcttatttctgtttagctagacctttatcttaacccaccgacaccattcgagccactctctttcccggcgatggcatcggccccgagatcgctgagtccggcaaacaggtttttagaactgctgaagtgccaattgaatgggaagaacattatgttgtggaccaagttgatccaagaacctaaagttttctaacttgggaaagtctcggatcaagaaaaaagaatcgggta

SEQ ID NO: 23048 - DNA, 385 bp, Gossypium hirsutum
  Clone ID: LIB3272-019-P1-K1-G11
gtcgcaccaagaggcgctgtctacgagtcgggttgtttgggaatgcagccgtgggcgggcggtaaattccgcccaaggctaaatacgggcgagagaccgatagcgaacaagtaccgcgagggaaagatgaaaaggactttgaaaagagagtcaaagagtgcttgaaattgtcgggagggaagcggatgggggccggcgatgcgccccggtcggatgtggaacggcgagagccggtccgtcgatcggctcggggcgtggatcgacgcgggtcgtggcggcggaccaagcccgggcctttgatacgcccgtggagacgtcgtcgcctctatcgtgggattcagcacgcgccgcctcggcgtgcttatgcacctgcgtgctccgggcg

SEQ ID NO: 23049 - DNA, 420 bp, Gossypium hirsutum
  Clone ID: LIB3272-019-P1-K1-G3
atctctatttctatcgcacttttattccccaataccgctctccctctctcatccgtgactctaaccctagccctctatcaggattcaaacatgaaaggaggtaaatccaagtcggatgccaagagcgccaagctctccgggaataagaaatcaatcacgaaagctggaaagaaatcggggaaggcagctaaggatccaaacaagccaaagaggcctgctagcgccttcttcgttttcatggaggagttccgcgagcaatacaagaaggagcaccctaaaaacaagtccgttgctgctgttggcaaagctggtggagataaatggaagagcctttctgaagctgaaaagcgaccttatgttgataaggcagagaaacgaaaggtcgagtatgaaaagaacatgaaagcctacaataagaga

SEQ ID NO: 23050 - DNA, 370 bp, Gossypium hirsutum
  Clone ID: LIB3272-019-P1-K1-G4
cgagacttatacagcctgtctcttctacaccaatccaaaaaaaccaaacatgcagttggagaacctgggcagatcaggcttaaaggttagtcaactatcgaatggagcatggcttagtttcggtaaccagctcgatgttaaagaagcagggtcacttttccagagttagaaagacaactgagtcaactttgtcgacagcgccgatgtttatcccaatggtcgagccgaggagatcatggtttacgctattagggaacttgcgtggaaactatcgcatatcgtggtttctaccaagatcttgagcgctggccctggtccaaatgataaggctctgtctagaaaacatattgtggacggaaccatggctttc

SEQ ID NO: 23051 - DNA, 400 bp, Gossypium hirsutum
  Clone ID: LIB3272-019-P1-K1-G5
taaaggctcaaaaaagtcgcatagaaattctaggggtgttttttttcctaatctaagtgtgaggaggaagaatcaagcttggttttctctcaggatgtcagaggcaccattcagacctagggaaaagcttatcgagtatcagaaatattttcaaggcatccacaaacacacttacttgaaaggtccttacgataagatcacatctgtcgccattcctgccgctctagctgcaagttccttgtttttaatcggacgagggatctataacatgtctcatgggattggaaaaaaggattgagagctctcactcgtggttagaagacatgtttttctttttttgggtttcattttagcatgaaattgtttgtttatttgctctaataattgtttggtttttatg

SEQ ID NO: 23052 - DNA, 254 bp, Gossypium hirsutum
  Clone ID: LIB3272-019-P1-K1-G6
tttattttggaaaagggggggattttttttgaattttgaccaccccttttaacccgaaaggaaaaccttccttttccgaaaaaaggttttccattttcctccataaaaaaagacttgaataacaagtgcttttttcttttgcaatacaactcgtttcaaaaaaaaatcccatttttttttcacaacggaaaatcaattccaaagccaattgttttccttaaatacattgagaaaacttgaaaaacctatcccat

SEQ ID NO: 23053 - DNA, 418 bp, Gossypium hirsutum
  Clone ID: LIB3272-019-P1-K1-G7
aaaaaaaacctccctcttattttccctcaaaaaatcgcttgaaaaaaaagaaagagcttgaaaatgggttcgagtagcagtcgaccggggttgaacccatcacagggaagactcaacctccgattcaaccggtttcccagactatcttctttattcacctgcagtagcggttcttcttatgctcctcttgagatggaagattatcccacccaaatcccagtgaagagttcggaacaccgtgactcgatttccaacatggtccaaactcccttagaggaatctggttcgatatgcagtacggaaacggggctcagctgcactggtactgaaaccggaacttcaagctgaaagcaataacgaagccggtggggatctgtcgattgatggtggttcaagagatgtagaagcaaatgattgt

SEQ ID NO: 23054 - DNA, 324 bp, Gossypium hirsutum
  unsure (1)..(324): unsure at all n locations
  Clone ID: LIB3272-019-P1-K1-G8
gggggcgacccacgcnnncgacttgtacctttttaactctaaagccaaaaaagtaagccactaacgttggctgttaagatcaaaatttcttctaaaatatcagcttccatggtcctccttttggcactcaacattctctttttttccctagtctgtgcttgatgcttttgctcttcacccacccctaaaccaaggccaaacccaaatcccaacacccacactcctacttcattttgctcgaggcatgtgcccatattgatgccctttaattaaatgtatgtaccaattctcctaataaaaccaatttcatcattgttttacccc

SEQ ID NO: 23055 - DNA, 391 bp, Gossypium hirsutum
  Clone ID: LIB3272-019-P1-K1-G9
acttgtacctttttaactctaaagccaagaaagtaagccactaaggttttgagagaagatcaaaatggcttctaaaagatcagcttccatggtcctccttttggcactcaacattctctttttttccctagtcagtgcttgtggctcttgctcttcacccacccctaaaccaaggccaaacccaaaccccaacacccccactcctactccatctgcacgaggcaggtgccctagggatgccctcaaattaggtgtatgtgccaatgtgcttaacctactcaatgtcaccattggttcacccccagtgatgccatgctgttcccttctcaatggccttgtcgacctcgaagccgctgcatgcctttgcaccgctatcagagctaacatttta

SEQ ID NO: 23056 - DNA, 413 bp, Gossypium hirsutum
  Clone ID: LIB3272-019-P1-K1-H1
ctcagccttcagtctagttcagttcactcattatcctttgcattcatagttccatggcattttccctaacaaatttatttagatctgatcagatttaactcagatccttttgtatcgagtcttctaagttccagatctttacttattttgaccttaggcagaaagaaaaagaagagatgagagagattattagcgtccacattggtcaagctgggattcaagtcgggaattcatgctgggagctttactgtcttgaacatgaaattcatcctgatggaaccatgcccagtgacacctcagtcggtgtagcacacgatgctttcaacactttcttcagcgaaacgggttcaggaaagcatgtaccgagagctgtctttgttgatctggagcccactgttatcgatgaagtgcgg

SEQ ID NO: 23057 - DNA, 511 bp, Gossypium hirsutum
  unsure (1)..(511): unsure at all n locations
  Clone ID: LIB3272-019-P1-K1-H10
ccggaacggcccgggctcgagcccacgcccgtccgnngttaaaattcctggaaccccgggaccgcggctggcttgacngngtcaacgttaggggaggtcccggatgagcgtcggcgtggggcccttcgggaaggaggttatcttttcttgtttaacccggcctnngcccacctctggaaaccgnngctcagccggagggggtagggtcccagcggccccggaagagcactcgcnnacgtcgcgtggtggtccggtgccgcnnccccggcggcctcttgggaaaatccggaggggaccgagtgccgtcccgcgccccggtcgtaccctcataaccgcattcaggtctccaagggtgaaccagcctctggtcnaatggaacaatgtaggcaaggggaaggtcggcaaaatgggatccgtaaccctcgggaaaaaggatttggcttctgagggctgggcacgnggggtcccagtncccgaacctcgtcggcttgccggcgcanctgctcgagct

SEQ ID NO: 23058 - DNA, 409 bp, Gossypium hirsutum
  Clone ID: LIB3272-019-P1-K1-H11
gcaagttcagctgttagcattcaaaaggggacgcaaagagtaattttctcttagggtgtttttctgctacactttttgttctttgggggaaacacaaaatggtattgtcggatgatgaaatcaagaggctttttcgaattcgaaagactgtaatgcagatgttgaaagataggggttatttcgttggagattttgaaattaatttgtcaaaacaacaattcatttccaaatacggcgaaaatatgaaaagggaggatcttgttatcaataaaaccaagcggaatgataactctgatcagatctatgttttcttccctgaagaggccaaagttggtgttaagacaatgaagacgtataccaaccgaatgaaatcagagaatgtatttagggctatactagttgtgcaaca

SEQ ID NO: 23059 - DNA, 400 bp, Gossypium hirsutum
  Clone ID: LIB3272-019-P1-K1-H12
ccaattcaaagttccacaaaaaacaggtgaaaatcagagcaaaaaataaaatgcccaattttgctgatcattagcaatggcaaccaacaccacccaagagcaacaacctgcagctggtaggcaccaagaagtcggccataagagccttttgcaaagcgatgctctttaccagtatatattggagactagtgtatatccaagggagcctgaacccatgaaagagctcagagagttgaccgctaagcatccatggaaccttatgactacatcagctgatgaaggtcaattcttgaacatgcttcttaagctgatcaatgcgaagaataccatggaaattggggtttatactggttattctttgttagccaccgccctcgctttacccgatgatggaaagatc

SEQ ID NO: 23060 - DNA, 412 bp, Gossypium hirsutum
  Clone ID: LIB3272-019-P1-K1-H2
gactgactaagatttcaactgtctctcactctcctgttttgctgcctttaccaagggagaatgaaaccaaaatttctgtttctcttccttgtattatgcagtctcactatagacaacgttttagcaacctcacttggaactcatggcaaaattcccgacaatgaaacaatataccgagtctccaagcaacggtgttggggttgtattggagagtcactagagttcctattcactcacaatttggtgagggcaaccaaatgggagccactcttgttttgggatttccagcttgagaaatatgcccgatggtgggcacttcaaaggaaagcagactgcaagctacagcattcgtttccagagggagatttcaagctgggagagaacatatactggggcagtggctcggcgtgga

SEQ ID NO: 23061 - DNA, 409 bp, Gossypium hirsutum
  Clone ID: LIB3272-019-P1-K1-H3
gcgcaagctactcatcgtgcgcaatacaaaccaccatcgtcactgaccgcgatcggcgtcaattcgattttaaaggcaaggagagatgtgggtattttacctgatctcgttgcctttaaccctaggcatggttgttttcaccttgaggtacttcgctggccctgatgtccctcgttatgttctttttaccgtcggatacgcttggttctgttctctctccatcatcattcttgtgcccgccgatatttggacgacgatatcgaagccgggaaattataatgaaaatggaggaatttcattcttttggagttggtcttattggggtacctttctcctcacctgggctgtagtgccccttattcagggttttgaagatgctggagacttctctgtgactgaaaggttgaag

SEQ ID NO: 23062 - DNA, 368 bp, Gossypium hirsutum
  Clone ID: LIB3272-019-P1-K1-H4
cgagaagagccaaattataaaaaatggctgctcctataacaatgctgggtctgtgtacatcttttttatcccttagtttactttctactgctttcacttctcgagattacgctgatgctcttgaaaagtctattcttttctttgagggacaacggtcgggtccgttgccgtctaatcaacgcctcaaatggaggggtaactctggtttgtccgacggtgcttcttatcacgtggaccttgtgggtggctattatgatgctggagataatgtcaagtttggccttccaatggccttcaccacaacaatgttggcatggagtgttattgaatttggcggttcaatgcatagtcagattgggaatgcaaag

SEQ ID NO: 23063 - DNA, 407 bp, Gossypium hirsutum
  Clone ID: LIB3272-019-P1-K1-H5
attgctttccaggccgctatctggaggtggatgaccccaatcaagaagaacgagccttcagcacacgacattttcgtgggcaactggaaaccaaccaagaacgacacagaggaaaaacggggtcctacttttggctccaccatgaacgttctctacggagattacacttgcgggcaaggcgatattgatcccatgaacatcatcatctcccattaccttcattaccttgacttactaggtgtcgggcgagaggaagcagggccacacgaggagctaagctgtgccgagcagaaagcattcaacccaacctcagctccacctgctgccagtgcttcctaatctttggttcagccaatttcattgttaaaatgtagttgtcaatgaagggtaatttaataagagagctg

SEQ ID NO: 23064 - DNA, 406 bp, Gossypium hirsutum
  Clone ID: LIB3272-019-P1-K1-H8
gtcgatttcgctttcgctaagatccagctacaaaattccacaagtccatcctgacattttcctttgtatttcaccaactactgaaatttgatgttcttctgagattcgttaataggacttactagatggtttcgttgatggaagcatatgcaatgaactttagaaaagaaaattttgatttaaatcgatttgaatgcttataaattatcgatttagaagtttaatctgaaattctcagattcttcgattataaacagttgttatttagttagtcgatcgatcttcacttcgttttagtacttaataaggaaaccatgacattggcttccccaaaaggcaatggtaaaatggttgctttccctcggggccttacttccattgcagcctcagttgtgatactagcaat

SEQ ID NO: 23065 - DNA, 222 bp, Gossypium hirsutum
  Clone ID: LIB3272-019-P1-K1-H9
aaaacatggtttctgaaagacgggttttatatggttatcagggcttgtgtttataaatatcctggcctaagccacagctgaagtcctttattacgagttttttttgcaagaatcccagttcactaagctgtgtagcacgaagagcatcttgaccgtcaatggcagctttccaggcctgagattcgggttcggagaggggacacagtttttgtcaacgtccac

SEQ ID NO: 23066 - DNA, 308 bp, Gossypium hirsutum
  Clone ID: LIB3272-020-P1-K1-A1
aataaatcggaattccccagcagcaatggctactccaagtgtagagtatttgcctcgcgccattggatgctactgcacagcaacccgctatctttgatggaacaatcaggttgtatctggcttatccttgcccttacgcacagcgcgtgtggatcgccaggaattgtaagggtttgcaagacaagattaagctggttcctttgaaccttcaaaatagacctgctcggtacaaggaaaaagtgtaccctgaaaacaaggtgccggccttggaacataatggcaaagtcattgaggagagtcttgatttg

SEQ ID NO: 23067 - DNA, 465 bp, Gossypium hirsutum
  Clone ID: LIB3272-020-P1-K1-A10
cggtactcggaattctccgggtccgagcccaccggcgtccgggattgagtcaaggtctattccaggaagtacctacatacatacatactactggtgggtgagtgtcgaacggaggctccataccaggtgttcaacatagtggcacttggacttgggtgaccgatgatcaaattggtaccttttgttcttgtctacacttgtcttcgccgccacttgatcctaagaggaatgcaagagattcccatgttcctgtgttggcaccactccccattggattcgctgtgttcatggttcaccttgccacaattccagtcactggcactggtatcaaccctgctaggagttttggagctgctgtcatttacaacaaagagaaggcctgggatgaccaatggatcttctgggtcggacccttcattggagctgccgcagctgcattctaccaccaatacattctcagagccg

SEQ ID NO: 23068 - DNA, 343 bp, Gossypium hirsutum
  Clone ID: LIB3272-020-P1-K1-A11
caaaaatgtctctttacccttctctcaccatgtcattgctgtctttttccttcttgttgctgtttgcttttagtgccaaagctgttgttcctccatctgaaacttttaggtttgtcaacgaaggggaatttgggccttttattgttgaatatggtgcagattaccgtgtcataagcatagctaatgcccccttccagcttgcgttttataacaccacgcctaatgccttcacccttgcgttacgcatggctacaacacgttccgagtcgctcttccgatgggtttgggaggccaaacaggggaaccctgttcgcgagaacgccacgttctctctctggactga

SEQ ID NO: 23069 - DNA, 384 bp, Gossypium hirsutum
  Clone ID: LIB3272-020-P1-K1-A12
gtgttttgctatagaagaacatatctgggtttattttaattctctttgagttcaatgcaaggagaatttttttttacttttgagtaatttatcttcttggtgtggtttacagcacaatcaaatctcttgaagtcttcaatattggttgttggagctggaggtttgggttcgccggctttattatatcttgcagcttgtggtgttggtcgcttgggtatcgctgatcatgatgttgttgagcttaataatatgcataggcaggttattcacactgaagcatatattggtcagccaaaagtgaagtctgctgctgctgcttgccgatcgatcaactacaccatacagattgttgaacacaaacaagctttgcacacgtgtaatgct

SEQ ID NO: 23070 - DNA, 291 bp, Gossypium hirsutum
  Clone ID: LIB3272-020-P1-K1-A2
cttgcgcttggggttatggatctagggatttgcgggtgtagaatactagagctcaggtctctgcttcaaagctcctgtccaggtagaattctcttcttccttcgcgttgtgttctttgatgctcagtcgccatggcttcaaagcggattttgaaggaactcaaggatttgcagaaagagccacccacttgttgcagcgctcgtccagtagctgaagacatgtttcattggcaagcaacaatcatgggaccctcatatagcccttatgctggaggtgttgttttagttacca

SEQ ID NO: 23071 - DNA, 253 bp, Gossypium hirsutum
  Clone ID: LIB3272-020-P1-K1-A3
ctcccatcccacaggccccatcacaacatccgcgaagaagctcgtctccacaacgccgccaccgtcaccaccaaccaccctcgcttctccgctaaatatgtcccgctcacctccatcaccgatcctgcctcctccgatgaatcctactctctcgacgagatcgtttaccgatctcaatctggctacctccttgacgtccagcacgacatgtacgtcctcaaacactttgacggagcttactggcgaaacctct

SEQ ID NO: 23072 - DNA, 290 bp, Gossypium hirsutum
  Clone ID: LIB3272-020-P1-K1-A4
ccaacgtggatcaatactaacctaactccctcttttcgagagggctaccatgttttcgggatggctcacatctttgattcatttaatgtcacattcattcatgtcaccgatttctctggaaagcaaacaatcgttcctatttctcgtgacctgatggtcaaagctgatagggagaattcttccccttatgcatccatgcttgcagcccaagatgtttctctactccccaaagagtacgatattactgccctctatattaatcataagaacctctgaacggtattagacca

SEQ ID NO: 23073 - DNA, 381 bp, Gossypium hirsutum
  Clone ID: LIB3272-020-P1-K1-A5
tacatttcccggcctgggttcaccgatcattcatgtggatgttacccatgttgggtggcgggttttggtcacatctgatacgtatgtagtactaattataactctatttacagatgaagacggtaagccaaaaaccggctttagcagtagaatggtgctatgaaattgcaggacccagattgttcaagatgactcccctggattcacatatagctgacaacaacaataagtcccatggtacccacttctcatggttcacgcgcataccccaacaggatcgacacctagttgcaaccgtggggaaatgcatactgatatggcaacccatgcaagcgagaacagcgctcactaatgctatcggaatcaaacatgtgttaagag

SEQ ID NO: 23074 - DNA, 386 bp, Gossypium hirsutum
  Clone ID: LIB3272-020-P1-K1-A6
cctttctccgttcttggcatctcctagtgttaatcttttagagagagagagagagaaattaacaggtaaagcagagggagaatcgtgaaagattcataaggtggatctaagacaagggaagaggccattgccgccgtccgatcatgaatcggaagagaaagaggaagcaccccctcagttctacacggctaggtctcaacaagacaccaacgccatgattcaagccctaactcaagttattggaaacgataatgataataataatccactacttgttcaacttcatcaccataatcaataccaataccaatctcaacatcaacctcaagggaacgtgaggagaatacattatagaggagttaggcaaaggccatggggcaaatggg

SEQ ID NO: 23075 - DNA, 283 bp, Gossypium hirsutum
  Clone ID: LIB3272-020-P1-K1-A7
gttgagtatggttttctgggtttttggttatggttcactggtctggaaccgtgggtgtgagtatgatgagaaagtcatacgcttcatcaaggattacaggcgtgtttttgaccttgcatgcattgatcacagaggtacacctgaagatcctgcaaggacttgcaccttggagcacattgaaggagccgtttgttggggtgctgcttattgtgttcggggcagtcctgaaaaggaaagagcagcaatgctgtacttggagagaagggaatgtgaatatgatcag

SEQ ID NO: 23076 - DNA, 295 bp, Gossypium hirsutum
  Clone ID: LIB3272-020-P1-K1-A8
atgacgcgtggggttttgaatctagggatttgcgggtggagaagacgagagcgtcatctctctgattaaaagctcctgttcaggtagaatacttttcctgcttagcgtcgtgacctttgctgcccactccccatgactctactgcgtattctggaggaactaccggatttgcagtaagatccaccctctcgttgcagtgctcatgcactagctgaagacatgtttcattgccaagcaacaataaccttacccttaaatagcccttatgcctgctgtgtcgttttagttaccattc

SEQ ID NO: 23077 - DNA, 360 bp, Gossypium hirsutum
  Clone ID: LIB3272-020-P1-K1-A9
gaaaaagtaggattaaactctttcacgtcacttcccccatatcactacaatttcatctctagactcggtttcccaaagattagaaactctatcaccatgccatcaacttcatcggcaaccccaccgacaccatctcatcccaccactcaccacgtccttcaagccctgttagactcctcacgtcccttccttcgtggcgagctttaatatgtcgacaaaaacttgcctaatttggtcgccgtcttgcgttccgttggtgccggcgagtgttggcacaagcacggcagctttttagagcatctggtcgatatctatcggattctcaaaatatggaaggcgcaagactccgtttgcctttgc

SEQ ID NO: 23078 - DNA, 300 bp, Gossypium hirsutum
  Clone ID: LIB3272-020-P1-K1-B1
ccggtatctgaattgtccggcgccaggccacgcgtgcgattctttgttattctccttctattggactcgctccgtttgctctcattcggaggagaccatccctctgtgtcaaggtgcatgcatcagtaaacgaatctgatcagccaaaatggtgcaaaaggaatgcaggaccaaatatgattgatgttcactctacaaaagaatgtatcagtgccttaagtgacgctgaggatagattagttattgtagaatgttatggaacttggtgtgcttgctgcagagcattatttaccaagctgt

SEQ ID NO: 23079 - DNA, 399 bp, Gossypium hirsutum
  Clone ID: LIB3272-020-P1-K1-B10
ctcctttacccttcttcatctccagccttcgtctgcttctccttgacccgagaaaatagattggcgatgggattatcaaatgcgagcggtgacttgtcaactgaagttgaggtagatgctttcaggtgcctctttccccttcgtttctatgagaaacatcttttagagtctatacgtcctgatgctcgtccgcttggaagagcaagagaaaccaccattgcccttggggctgttgcatctgctaatggttcagcacttgcaaaaattggttcaactactatgttggctgctatcaaaatggaggtcatgaccccttcattggaaacaccggatgagggttgtatagctattgatttccacatgcctccaatttgttctccaattgttaggcctggcaga

SEQ ID NO: 23080 - DNA, 355 bp, Gossypium hirsutum
  Clone ID: LIB3272-020-P1-K1-B12
gcagcacgtcacatgggatctagagcaaggttggtgaccttgggttgagtggcgagatgaggaaaatcatggctgccaaagttctcttcttctttgctttgctttccttttcagctgtgtcggcatttgcacaggatgaggaagaccaaggtcttgctatgaacttctacatggattcttgtcctcaggctgaagacattatcaaggagcaagtcatgctactgatcaagcgacacataaacactgctttttattggctgagaaacattctacatgactgcgctgaccagccatgttatgctttactggtgattgacttcacaagcaggagcttggctgagtacgagacacacag

SEQ ID NO: 23081 - DNA, 413 bp, Gossypium hirsutum
  Clone ID: LIB3272-020-P1-K1-B2
ctgcgttggcttggatttcccccaaactagaactcgccaactgaaggaacagacgatcgtgctcttcccgcaatggcggatgctcaaactgaaaaacccctttccctttccgagcaatatgcacttcaggagaaagaggaaaaatcagatgtgactacaaaaccagcagaagcaaaagaggttgaaaatcctgtaaatgcagccactggttctggggatgttgtaactgagaaattggaggagactcctgccgatccagttgagggaagcactgaggcccctcctcctgctgctgaagaaagcactgaagcacatcctgctactgggaacagtggtgaagatgctgcagaggaaaactcgggtgactctgaggaaactccagagataaagcttgagactgccccagcggattt

SEQ ID NO: 23082 - DNA, 407 bp, Gossypium hirsutum
  Clone ID: LIB3272-020-P1-K1-B3
caaggggtggattagtgaaaactgattgggcaaaagcacctttcacagcttattacaggaacttcaatgccaatgcttgtgtctggtcaggaacaagttcatcatgtgctaaaactaactcggtctccgccggtgcatgggaaacaaacgaacttgatgcaccaggaagaagaagattaagatgggttcaaaaatatttcatgatttataactattgcactgatttgaaacgttcccctcaaggtgttccaccagagtgtaaacgcccaatgttctaaaatcaaacctgttccaccagagtgtaaacgcccaaggttctaaaatcaaacctctcctcttttccatgtaatatattctttttttcactactttcttactatgtattcaagttgaataagttattatta

SEQ ID NO: 23083 - DNA, 400 bp, Gossypium hirsutum
  Clone ID: LIB3272-020-P1-K1-B4
atgcaatggctttaattttcccgaaactagacctcgccaactgcaggaacagacgggcgtcctcttacctcaatggcggctgctcaaactagaaataccccttgtccttcccgcgcaatatgcacttaacgagaaagaggaaaccttcgtttctacgacaaacatagcacagagcctataggttgtaaagcctgtccatgcaggcactgttactattgatgttaccactgacaaattggacgagacttttctctaaccagcatttgcaagcactggtgcacctcctcctgcttatgaaacaagcactgcaacaaatgcttctactgggaacagttttcaagatgctgcagattgaatctggtgtgactctgctggaactccagactcaaacttgatactg

SEQ ID NO: 23084 - DNA, 403 bp, Gossypium hirsutum
  Clone ID: LIB3272-020-P1-K1-B5
tttgtttgctctgtatattgaaattttctttctcgattttctctttagccaaaaaagatgcagatcttcgtcaagactctaaccggcaagacgatcactctcgaggtcgagagctccgacacgatcgacaacgtgaagaccaaaatccaagataaggaaggcatccctccagaccagcagcgtctgatcttcgccggaaaacagcttgaggacggccggaccttggccgattacaacatccaaaaggagtcaactctccacctcgtcctccgtttgcgcggtgggatgcaaatgttcgtgaaaaccttgaccggcaagacaatcactctcgaggtcgagagctccgacacgatcgacaacgttaaggcgaagatccaagacagggaaggcatcctcccagacc

SEQ ID NO: 23085 - DNA, 392 bp, Gossypium hirsutum
  Clone ID: LIB3272-020-P1-K1-B6
aaaaaactaaatcacggttggtgtgacgtacgcaacctaaatgacccttctgtttggctgcgctgcagttgaatcaactcgtaacaactacaaccccatgcagatggaatccaatggcctaaccgaataaaaatgctccgttcttagtgttatctgtcacactaaagatgctatggtgttaatccgtattgcatacaatcatgggaagaggcttgaactcgtggacgaaatgaagcatcagattcagattttcgacgacaactagtagttaatcatatccactaacaagaagggactgacttatactcttgcgtgcaatcactatactgacaggagctgcgaagagtccatgtacacagagtgggggctgctcaaaactgctctgctaccac

SEQ ID NO: 23086 - DNA, 413 bp, Gossypium hirsutum
  Clone ID: LIB3272-020-P1-K1-B7
ctgcgttggcttggatttcccccaaactagaactcgccaactgaaggaacagacgatcgtcctcttcccgcaatggcggatgctcaaactgaaaaacccctttccctttccgagcaatatgcacttcaggagaaagaggaaaaatcagatgtgactacaaaaccagcagaagcaaaagaggttgaaaatcctgtaaatgcagccactggttctggggatgttgtaactgagaaattggaggagactcctgccgatccagttgagggaagcactgaggcccctcctcctgctgctgaagaaagcactgaagcacatcctgctactgtgaacagtggtgaagatgctgcagaggaaaactcgggtgactctgaagaaactccagagataaagcttgagactgccccagcggattt

SEQ ID NO: 23087 - DNA, 388 bp, Gossypium hirsutum
  Clone ID: LIB3272-020-P1-K1-B8
ggttgatgactttgttagtgtccagcctaacttttctcgtgaaacaagaacaactgagaaaagttcggacgtgaataagtcagaaagaaatgtgaagtcgtctcccctttcggttaaggatcaggaagagaaggcaaaaagatgcgagtttgctcaagggctgctgttgtccacaatgcctgatgaaattttataaaacagcgttctcgggttcaaatcggctgctgcaatggaatcgtgaacctgaatcccatggggaaattgggttgacgatgaagagccccccggcaagcaaacttgcaaatctacagttcattactgtgtctgtagtgaaaatgctgaaataaggttggtaggaacgaatgtaatttcttgcatatgtggactc

SEQ ID NO: 23088 - DNA, 362 bp, Gossypium hirsutum
  Clone ID: LIB3272-020-P1-K1-B9
taaaaaatgagctttcctcaggcctcgtcaatttcccttttgcttttggtgtatgtagtcgaaggatcagctgagcagtgtggaaggcaagcaggctgtgctctttgccccggtggtctatgttgaagccaatctggctggtgtggcagatctgctgactactgaacaaactctggttgtcaaagtgagtgcaacgtgagtggccctagcaatgcacctggtgggctaaccaagcttatatcaagagagaccttcaatgagatgctttagcataagaacgatgaggcttgtactgcccgtgggttatatacatatgatgctatcattgccgctgcccgttatgtttctgcatttgctacaac

SEQ ID NO: 23089 - DNA, 402 bp, Gossypium hirsutum
  Clone ID: LIB3272-020-P1-K1-C1
attaagaatgagggaaccaacgatggtggttggcgcagacagcaatgctgctggtgctgctgttggcggtgctgatggatcacctctccctccaccgacgtcttcaccgccgcaatcattagtcgagaggctcaaggactacggccaggaacacgttttcgccctttgggacgagctttctcctgatgaacgcctccacctcgtcaaggatatccagagtttggatctttcgagaatagatcggatcattcgctgctctcttcgatctcaaggactgccggtggcagcaatagagccagttcccgagagttgcgtgtcctctgtagaggagagaacgatggaggaaagggaaaggtggtggaaagatggattgaaagctatattcggaagcaaattggctgt

SEQ ID NO: 23090 - DNA, 382 bp, Gossypium hirsutum
  Clone ID: LIB3272-020-P1-K1-C10
gagagggcgaaactgaaatatctaaggctaatattcttctcccatctctttcaggtgggcctcttgcaccgatgtattccctgtcttacacgaactacgtcttgccggatcgagttttccttcagtgcaagcaaagaaattgatgcgggagttgaatttgtttcctaaagaggaagttaacctggttgatcaaggccgagtttccttaccccaggattcgaagctggtaggaaaagcgattcaagttccccgctttggaagcccttggtggcgtttctgtcgacgatttgggtcatcatgctggctattacaagcttactaattcttatgatgccagaatgtgctatttcttctttgaatcacgcagtaacaaagaggaccc

SEQ ID NO: 23091 - DNA, 395 bp, Gossypium hirsutum
  Clone ID: LIB3272-020-P1-K1-C11
ctcttcccatttctctctcttttcttggcagggaaaaaagtgagtgacttgtgggaaagcaaaaataaaggccatatctttgatgtgaaaagagagcaataccagttacaaggaacaaagattttgtagatattttttccttcacagttagtttaacataatggaaggaatcaaaggtggaggaggaggtagagttggtgttggtgttggtgttgaagaagatatgggagatggtatgcaatgcagtaatcatccttatagaaataaccctggtgggatctgtgctttttgccttcaagagaagctaggcaagttggtttcttcttcttttcctttacctattcgtgcttcaccttcttcttcttcttccccgccttcttttagatctgatactg

SEQ ID NO: 23092 - DNA, 398 bp, Gossypium hirsutum
  Clone ID: LIB3272-020-P1-K1-C12
cgcttagaatcggaggggcgacaaagcttgtgagccgggcttctgctcaaaacaatgttgacggagcctatagcttggtgatggagcctaaacagttggttttgcagtacaagggaatgaactctcctaaaccacttgtctacttcaaatcatctgtttggccaagtacacaagatggtactttacaaactgtgacactaaatgttgaggaaacaagtgatggctttgcttattacgttttgttagactacacagtggctaacttgtccagcggggccggaaatctcatcttgacaaggccgaaatacaacagcacattgtcgattcttcgactcgggatcgatggaaacctgagggtttttacctactatgacaaggttgatttacaggcatgggaa

SEQ ID NO: 23093 - DNA, 397 bp, Gossypium hirsutum
  Clone ID: LIB3272-020-P1-K1-C2
cgaacatatacgccatggccgatcgtatgctttttgggttagggggcccgctacctgggcgtggaaagggctcatctggtttggaagcaggataattctttacccatggctgtggagggggttccttggctaacaagggccggaaccaaaaaactgttcctagaatttgttgggggggcataatccaggaaaggttccatccacaattgggggccaaccaattccaccaggccgtggggaacttgttgtttaaggtgcaggtccttccaaccgggaacttaaggaaccaggggggtttgcggaccctgttttcctgccttgaccacccatggaaacgtggccaggtgcccttaaccttaacgtccccaattttgtgtggcacccttaagggggaaaa

SEQ ID NO: 23094 - DNA, 396 bp, Gossypium hirsutum
  Clone ID: LIB3272-020-P1-K1-C3
tgtaaatgctgcagtttctcgggagcagattggatatacctttgatgctttgaagacttatgttcctgaaatggtagagttgcttattgattctgtgagaaaccctgcttacttggattgggaggtcaatgaacaacttcagaaagtgaaagaggaaattgctgaagcagcaaagaatccacatggcttgcttttagaagctattcactcggcaggttattctggtgcattggcaaatcctcttttagccccagaatctgcagttaatatgttgaacagtacagttttggaggattttgttgcagaaatttttactgcttctcggatggtactgtcagcaactggtgtagaacatgaagaatagttatctgttgcagaaccacttatgtcagatct

SEQ ID NO: 23095 - DNA, 402 bp, Gossypium hirsutum
  Clone ID: LIB3272-020-P1-K1-C4
gcctcactccgccatcttcaataatttcttccgttgatctttgttagagattagctttttaatttttcattatgggaaagatcaagatcggaatcaatggatttggaaggatcgggcgtttggttgcgagagttgctctccaaagcgatgatattgagctcgttgctgttaacgatcctttcatcaccactgaatacatgacctacatgtttaagtacgacagtgttcacggtcaatggaagcatcatgagcttaaggtgaaggactcaaagacccttctctttggtgaaaagcctgtcacagttttcggtatcagaaaccctgaggaaatcccatgggctgaggctggagctgagtatgttgttgagtctactggtgtttttactgacaaggacaaggctg

SEQ ID NO: 23096 - DNA, 403 bp, Gossypium hirsutum
  Clone ID: LIB3272-020-P1-K1-C5
ctcgcagctcgcacgctctcatcattttcctccgggaccgtcagtcttcccaaacaccttctttccgagaaaaaaaaagctcaagagagaagaccatggccgatcaacttacggacgatcagatctctgagttcaaggaggctttcagcctctttgacaaggatggcgatggttgcattactaccaaggagctggggactgtgatgcggtcacttggtcagaaccctactgaggcagaactccaagatatgatcaatgaagttgatgctgatggaaatgggaccattgattttcctgaattccttaacctaatggcaaggaagatgaaggatactgattccgaggaagaacttaaagaggctttcagggtgtttgacaaggaccagaatggtttcatatctgg

SEQ ID NO: 23097 - DNA, 400 bp, Gossypium hirsutum
  Clone ID: LIB3272-020-P1-K1-C8
ctcaactccagctaccgtctcattaggaatccatgcccgggaatctttatcaaatggacccgcaatcggcggctgaaaaggccgtttcagttatcggtttcggattcgacttgtgcagggatgtcaggctatccgcctgcctgcctggcccttccggctccagattgatcgaacttgactcaacagcgactcgggacctggtttttcctgatggagttgttgtaaaagatgtccccaattcgattaaatactataaaggcgagcgtaccaggtttcggtctgatgttctttcttttagccagatgtcagagaagttcaatcgggatctatcattatccggcaagattccttccggcctattcaatgccatgttcgagttcaaaggctgctggcataaaga

SEQ ID NO: 23098 - DNA, 401 bp, Gossypium hirsutum
  Clone ID: LIB3272-020-P1-K1-D1
ggtggaggtcgttgtaagggattgtagtgagtggtgccttgcttgtttaaatagagcttggctactcatcttctttaacagcttatagttgttcccttcatattgtagagagaggaggcttctttgcttgccacctctcttttatctcttcaaacacttctaaaatcatggatgagaagatgagtttgactgttgctgatgcagtggactacaagggtcaccctgctgacaagtctagaactggtggctgggtacctgctgctctcagcttacgaattgaaatatgtgagaggctgtcaacaatgggaatagcagtgaaccttgtgacttacttgggtggaaccatgcaccttccaagtgctacttctgcaaatgttgtgacagacttcatggggacatca

SEQ ID NO: 23099 - DNA, 396 bp, Gossypium hirsutum
  Clone ID: LIB3272-020-P1-K1-D10
cccatttcccttgtaaaaacaaaacatcatcgattccttctaaagaaataacccacggaagatggctactttggcggcggttgcagctcgtagagcagctactctagctcgaacaccccttccatctcaacccgcttctctcattcctcgccgtggtcttgccggcgccgcagatcaccatggacctccaaaggttaatttttggcaagacccaatgagcccatctaaatggaaggaagaacattttgttatcgtctctttaactggttggggtctgcttttctttagtggatacaagttcttcactaaaggcaaaggcaaaaaggaagagaacgcggtggaagcaacacactaacgaggttggagtttttattttatttttataagatttcaagt

SEQ ID NO: 23100 - DNA, 395 bp, Gossypium hirsutum
  Clone ID: LIB3272-020-P1-K1-D11
tttggattggtggagcctgataattactggtacagggtttgtgaaggagagactgagtctgttgttcaaaggccatggcatctggtatggaaatcaaggaggttgatggatatagtgtcggcaattgcgtcaaagttgaactgggattatgactctgttcacattgtgagaggggagaaggcgaggaacagggacctgtggcctaatcttgcccaagatacctcacctgatgcccttatctcaaccttgcagaataagattgaagatgggaggaatgtttatattgcaacaaatgaacctgatacatccttctttgatcctcttaaagacaaatattcaactcactttcttgatgaatataaggatctttgggatgagaacagtgagtggtattc

SEQ ID NO: 23101 - DNA, 388 bp, Gossypium hirsutum
  Clone ID: LIB3272-020-P1-K1-D12
gcctgctgtctctaatgatttgactgctgcaaaggtggatgttaaggtaactcctggcatggaagctgcaaaaagatatatatcttctttgagtacctcagcaagcacagctcaactggcaaatcatggtttggttgttataccgtttctcagtgcatttgtcagcttgaaggtgcttaatctatctggaaatgcaatagcaaggattactgctggtgctcttcctcgaggacttcacatgttgaatctgtcaaggaataatatatccaccattgagggtttacgtgagcttactcgacttcgtgtgctgaatctgagctacaatcggatatttagaattggccatggttgggcttcttgttcctctcctaaagagttatacttggct

SEQ ID NO: 23102 - DNA, 402 bp, Gossypium hirsutum
  unsure (1)..(402): unsure at all n locations
  Clone ID: LIB3272-020-P1-K1-D2
ggagaaatacgatgaggttaagtgttggcaaggggaattgatttatgtgccggaaaaatggacaccgtttgatgtcatatttctctattttctgcctgccttgctattcgaacttgaccaaatatttgcggcgctggcgaaacgttgttcatcaggtgcaagagtggttattagccatccccaagggagggaagtgctagagcagcaacggaaagagtttcccgacattgtaaacggaaacttgcccgacaaaaccacgttacagaaagttgcagctgaccattcctttgagatgactgaatttgttgatgagcctggattttatctagctgttttgaagtttagcgaggcanattagttaaaaacttatttggatttctacttaaaactaggtgcttcatt

SEQ ID NO: 23103 - DNA, 398 bp, Gossypium hirsutum
  Clone ID: LIB3272-020-P1-K1-D3
tttttgtcccccgtggatatcagagggaaaacacaaaaactagggtttttagagagaagcgggagccaaagtgagagagaagaggcagaaatttttagtagtagggttttattatattgcttctctagggtttagaaaatggtggccgacaaaggaaagaagatgaaagtagcatagaaagttgaggaagagaaccatgaacaaatagatggagacctcgtcatttccatcgagaagcttcaagagatccaagatgagcttgagaagatcaatgaagaggcaagcgagaaagtcttggaagtggagcagaaatacaatgaggttcgcaagccggtctatgataagcggaatgaaatcatcaattcaattcctgatttctggttaacagctttcttgag

SEQ ID NO: 23104 - DNA, 323 bp, Gossypium hirsutum
  Clone ID: LIB3272-020-P1-K1-D4
cttcattctcattctgtttccactgaactctcgctaaacggtgtggttttaatcggtctggggtcaatgggcgaggaaccaggccacgttctcagtactggggctgcatgacatagctggtatgcggttgaacccatgattgccaggggagtcatgaagggggctgtccatcccgaagtccttgacgtgctcctatttaccacctgctgcggccgctttgtatggatctaaaatcgagtagagatccactgcgtgctctataataacgggggttaggcctacaacagattctggtagagggatccactgtactctgaggttct

SEQ ID NO: 23105 - DNA, 401 bp, Gossypium hirsutum
  Clone ID: LIB3272-020-P1-K1-D5
cccacgcgtccggattaatgacggaaaatccaggttttccattaatgggaagcctatctaccacttcctaggcacctctactttcagtgaatacactgttgtccatgtcggccaggttgccaagatcaatcctgaggctccgcttgataaagtttgtgttctaagctgcggaatgtccacagggtttggtgccactgtgaatgtagctaaacccaaaaagggtcaatccgttgcaatatttggactaggtgctgtcggtcttgctgctgctgaaggagcaagagtttctggggcttccaggatcattggtgtcgatttgaaccctagcagattcgaactagccaagaacttcggtgttacggagtttgtgaatcccaaagatcacaacaaacctgttcaag

SEQ ID NO: 23106 - DNA, 370 bp, Gossypium hirsutum
  Clone ID: LIB3272-020-P1-K1-D6
ctgatacactctgaataatgtaagcagatcgtgacatgggatctatagcaaggctagtgacctcttgttgagcgcatatactatgaaaataaacactgccaaacatgttttcttgtttgctaagatcaactttgcagctgccttggcattagcacaggttgtgagataccaaaggctcagaatgaacttcgacacggataatggagctaaagctaaaaacattataaaggatgaagtatagctactgttcaatcgacacaaaaacactgcttttttttgacggataaacatttcttatgactgtactgtccattcatgtgacgctttactgttgctgctctccaaaagctggagcttttctgagaaggag

SEQ ID NO: 23107 - DNA, 405 bp, Gossypium hirsutum
  Clone ID: LIB3272-020-P1-K1-D7
ctttaaaacacgcacccaaaaaataaaaccctttgaaaaccaaagaaggaagaagaagatgtcgtggcaagcttatgtagatgatcacttgatgtgtgaaatcgaaggaaaccatctctctgccgccgctatcatcggccaggacggcagcgtttgggcccaaagcgccagtttccctcagctcaagcctgaagaaattagtgccatcatgaatgactttaatgaaccgggttcactcgctccgaccgggttgcacctcggtggcacaaaatacatggtgatccaaggcgaaccgggagctgttatccgagggaagaagggacccggaggtgttactgttaagaagaccaatatggccttgattatcggaatctatgatgaaccaatgacacccggccaatgcaa

SEQ ID NO: 23108 - DNA, 401 bp, Gossypium hirsutum
  Clone ID: LIB3272-020-P1-K1-D9
attcgccgcacggcatcagtctcatcaggcggggaagaatgtctcacaggaagtttgaacacccaaggcatggctcccttggatttcttccgaggaagcgagcttctcgtcacagagggaaagtgaaggcatttcctaaggatgacccaagcaaaccttgcaagctcactgcctttttgggctacaaggcaggcatgacacacattgtccgagaggtcgaaaaacctggatctaagcttcacaagaaagagacatgtgaagctgttacgatcgttgaaacccctcctatggtgattgttggggttgttggttatgtcaagacaccacgtggtcttcgcagcttgaacaccgtttgggctcagcatctgagcgaggaagtcaaacgtaggttctacaagcat

SEQ ID NO: 23109 - DNA, 402 bp, Gossypium hirsutum
  Clone ID: LIB3272-020-P1-K1-E1
cggacgcgtgggcaaaaaaaaaaaagtcatagtttcttcatttctagcttagccatggaaatcaaaatatggcacaggcaatgctcaagcagattggaaaccatcaaattaggccggagctacacgcaacgtggccacgatgaacattccaagcccaagtggagaacgttttggaagatattcacaagagaaaggaagaaaatcttcgcttctccagttggattccaggcttcttatgatccagatgaatattcacagaattttgatcaaggaaccggttgggctgaaccggataatctttctcggtctttctcagctcggtttgctgatccatctaggatctcaagaaggaacccgttgcgttcatgtgattggcaaatgaatgacagctaagaatgttct

SEQ ID NO: 23110 - DNA, 391 bp, Gossypium hirsutum
  Clone ID: LIB3272-020-P1-K1-E10
aaaagctaagcatcttttgtttgtttttctttttgttcgcaccttttggagatgtagccctttctttgcgctccatctgcttacttgtttcgtcaacactctagagctttcacccagtttattttgctacattgtcttcctgaaccctttgcttcccctcttgtttgtgtttttgattcacccattttagcatccttctgtgtttctatcttgctgcactttatggctccaggcgacaatcctcgtctaaaggagaaaaaggacgacgaagggaccaggcatgtaccaccgtagttgccactctctatttttttctaggctcgatcactttgtcctattgttcttatcttcactattttccatgcaaggaaggtcaaattccctctaccta

SEQ ID NO: 23111 - DNA, 395 bp, Gossypium hirsutum
  Clone ID: LIB3272-020-P1-K1-E11
ctgggagggtttatgccactggtcttaatgattttgggcagctagggtcatcagatcttataaagtactctagagagccggttgaagtttcgggtcttgcaaaaggaattgtgcaaattgcagctggttatcatcattcatgtgctattacagtggatggagaactttacatgtgggggaagaactcaagcgggcaacttggccttggaaaaaaggctgcgaaagcagttcataggccaaccaaagtggaatgcttgagcgggcttacaattaaattggctgctttgggttcagagcacacagttgctgttactgatggaggtgaggctttaagttggggagcagttgcatctggaagacttggtcatggccttgagtcgagcatttttggtttt

SEQ ID NO: 23112 - DNA, 396 bp, Gossypium hirsutum
  Clone ID: LIB3272-020-P1-K1-E12
cctcactccgccatcttcaataatttcttccgttgatctttgttagagattagctgtttaatttttcattatgggaaagatcaagatcggaatcaatggatttggaaggatcgggcgtttggttgcgagagttgctctccaaagcgatgatattgagctcgttgctgttaacgatcctttcatcaccactgaatacatgacgtacatgtttaagtacgacagtgttcacggtcaatggaagcatcatgagcttaaggtgaaggactcaaagacccttctcttttgtgtaaaggctgccacaactttcggtatcagaaaccctgaggaaatcccatgggctgaggctggagctgagtattttgttgagtctactggtgtttttactgacgaggacaa

SEQ ID NO: 23113 - DNA, 398 bp, Gossypium hirsutum
  Clone ID: LIB3272-020-P1-K1-E2
ccaatggggtcggaatcggaacttattcccatggcgacgacggcgacgacgttaagcgaaaagctggtttaaaagctctaatagccatggttttcgctagtgttacttccatcaaagctgcttacgccgagctgcaaatggctcaacatccttacgacggtgaagctatccaagttgccgaccaagctgtcgtggaacaactcaaggttctgtcagagttgagacacaagttcttaaaacaagaccttgatctttcacctcaagttactttaatgcttgctgagatccaagaacaacaaagcatgatgcgaacttacgatatcacaatcaagaatctagaatctgatatcgaagaaaaagattcagccattgatttacaccataaacagctcgaacat

SEQ ID NO: 23114 - DNA, 433 bp, Gossypium hirsutum
  Clone ID: LIB3272-020-P1-K1-E3
acgcctgagtaccggttcttttcggtgggccccacgcccgcggcttcttgttgacatgcttaggagagagagaaaacatgttgccggtggtctgcaggggtggtttttctttcataaatggagatgtggatttgtctctgtataagatggaaccatgcttacagctgttaggtcattgagatggaatcatttgcctatcgaattacagagatgatatagttctatgtaaccctgcatctagggagaccatggtcctccccgaatcttgtctcccttgttattcgtcaatctgaaacttgttcccgcataccagcgccttgggattcggatatgattgtagaactcatcactgcaaagttgttatgattattgcgcactgcgaggagcgaagggacagtggctcaccccaccattgcagggtagaagtatactc

SEQ ID NO: 23115 - DNA, 397 bp, Gossypium hirsutum
  Clone ID: LIB3272-020-P1-K1-E5
ctgggagggtttatgccactggtcttaatgattttgggcagctagggtcatcagatcttataaagtactctagagagccggttgaagtttcgggtcttgcaaaaggaattgtgcaaattgcagctggttatcatcattcatgtgctattacagtggatggagaactttacatgtgggggaagaactcaagcgggcaacttggccttggaaaaaaggctgcgaaagcagttcataggccaaccaaagtggaatgcttgagcgggcttacaattaaattggctgctttgggttcagagcacacagttgctgttactgatggaggtgaggctttaagttggggagcagttgcatctggaagacttggtcatggccttgagtcgagcatttttggtttttt

SEQ ID NO: 23116 - DNA, 173 bp, Gossypium hirsutum
  Clone ID: LIB3272-020-P1-K1-E6
tactctgatttgaacatcaccgctggatatttttcatttgggcaggtctgagcatcaggtggtattaagtactccagcgagccataaatatactaagaagccgaatcagacgggagagaccctgaatggtgtgagtatctcatcacacctcacaacacttgtgccaggagctt

SEQ ID NO: 23117 - DNA, 397 bp, Gossypium hirsutum
  Clone ID: LIB3272-020-P1-K1-E7
gtgttttgctatagaagaacatatctgggtttattttaattctctttgagttcaatcaaggagaatttttttttacttttgagtaatttatcttcttggtgtggtttacagcacaatcaaatctcttgaagtcttcaatattggttgttggagctggaggtttgggttcgccggctttattatatcttgcagcttgtggtgttggtcgcttgggtatcgttgatcatgatgttgttgagcttaataatatgcataggcaggttattcacactgaagcatatattggtcagccaaaagtgaagtctgctgctgctgcttgccgctcgataactccaccatacagattgttgaacacaaacaagctttgcgcacgtttaatgctttggaaattttgagc

SEQ ID NO: 23118 - DNA, 388 bp, Gossypium hirsutum
  Clone ID: LIB3272-020-P1-K1-E9
gtgccacattgtcagttcccatggtaggatatctatcaatcaaagaaacattggttgttgtttgagtttaaatttcggatctttgcaaaagaaaggagaaagaagaaatgcttgcagttttcgacaaatcggttgccaagagcccagatgctcttaatgctccagataaccctcaggctgtatctgctctcaaagatggcttcttacctaatcactttgcctctgtttatcccggttgtgtctccatcagtctcggctcttctggggttatggcttattctcttgaaaaacagaacccacttctccccagactgtttgcggttgtggatgacatattctgcttgtttcaaggccacattgagaatatagccgttcttaagcaacaata

SEQ ID NO: 23119 - DNA, 402 bp, Gossypium hirsutum
  Clone ID: LIB3272-020-P1-K1-F1
taaaaatggaggtttcctcgcgtgacaagctgatcgtgcagacccgggtaccggctgggatggctattgtgaccatcaatccaccgaattctctgatcttcttgacccgacacatgatggcggactggaccaaggctttcaaggctcttagaaaggacaactcgctgcgggtcatgatcttgtctggagctgaacagtctttctgttcacagcgtggatttgacatgctgcacatgatgttttcaagggtgacgttacggacccggagacggatccgtttgttcagatggagcaacgccccaaacccatcatcggatctatcaacggcgttgctattactgccggcttcgagatcgccctcgcttgtgacatgctggtcgttgctaagggagccactttcgt

SEQ ID NO: 23120 - DNA, 396 bp, Gossypium hirsutum
  Clone ID: LIB3272-020-P1-K1-F10
cacaaagggtgttgggtccccctactggtgccaccccttttaatcctgatgtctatagggcacctgtgttgtcatcttcaccagcagtgccctttccatcaactcctttccaatatcctgtgtttccctttggaacaacttttcctcttccttcaaccagcttttctggcagttcaacaacttatgctgattcatcttctggtgggaggttttgttttcccccagtccattcacaattgttaggacctgctggcactgttccatcccattacacaaggccctatgttgttaaccttccggacagtagttataatagtagtgctgagagtggaaggaagtggggaaggcaaggtctagatttaaatgcagggcctggaggtccagacattgaaggaa

SEQ ID NO: 23121 - DNA, 394 bp, Gossypium hirsutum
  Clone ID: LIB3272-020-P1-K1-F11
caaaaaagaaaaaatgatgcttggagaaactcatcgtccaaatccaaccgtccacgtaccaccttggcctgatcttgacgatgatcagacggatgtagtttactctcctatccattacaatgcaaccgacaacaacttgagcagtaacggcaacccgttttacctccatgaagcgttatcagctttacaacgttatttgccatcgaacggcccggatgttgagttggattccgagtttccgggtttggatagtccggattcaccggtcgatgcttattcctgtgaccatttcaggatgtacgagttcaaaatccggaggtgtgctcgtgggcggtctcatgactggaccgagtgtccgtacgcccatcccggtgaaaaagctcgtcggagggat

SEQ ID NO: 23122 - DNA, 404 bp, Gossypium hirsutum
  Clone ID: LIB3272-020-P1-K1-F2
atcaagcaaagcattttcataacccaattttttttcttcaaacacaaatcaaagggagaaaaaagaatggcagtggagggttcatcgaagaagatgatagcaacacaagcagagatggtggagaacaaggtccccatcccgtacagggatcaatgtgcacatcttctcatcccgctcaacaagtgccgccaagccgagttttacttaccttggaaatgcgagattgaacgccactcctatgaaaagtgcgagtacgagctcgtcatggagaggatgttgcagatgcagaagatccgtgaagaagaggccaagttgaaacaggctgggaaacagggcgcttctgttcctctcatccccaaaactgctaatgcttaagctgtctccagggagggtttagactactt

SEQ ID NO: 23123 - DNA, 238 bp, Gossypium hirsutum
  unsure (1)..(238): unsure at all n locations
  Clone ID: LIB3272-020-P1-K1-F3
cgcacgccaccgtcgtaacagtgtcaagaacgatgagaattgtgaaaactcagcgttaatggttatgccattgaaagaagagccaatagaacccggcccggaccggaaaacccatccttcgnggcccattcgggtagtcccagttagcaagcagatgtcaatgcaaatccctatccccacgcctgttaccaccgctaaacgctcctacaacaaggaccgtcacacgaaagttgaaagc

SEQ ID NO: 23124 - DNA, 403 bp, Gossypium hirsutum
  Clone ID: LIB3272-020-P1-K1-F4
tacaaagcttcatattatcttttttagttccgacacaagaaaacgaaaaaaatagaagaagtacaatcggtttctttttgaagtcggcttttagtttttggggagaaaaaaatgttgggagtatttagcagtgcgatagcgtctccgccggacgagctggtggcggccggttgtcgaactccatcacctaagataacgggggatgctctggtgaaacggttccttgagacgaactcctgcggcgtgtccatgcacatcggcgaccatgtccaattcgcttattcttaccataaagagtcttctttacggcccagatcattcgctgcgaaagatgaactcttgtgctcgcttgtgggagcccttgatcacttgcggagtttcaagcatcaatatggtctggcaa

SEQ ID NO: 23125 - DNA, 401 bp, Gossypium hirsutum
  Clone ID: LIB3272-020-P1-K1-F5
ctttttatttttttcagagcctccttcaccaaactccgctctgttcagcccgtgatcttttgatctttctctatggctaccatttccaagctctctaaccccaacccagtcgcttctctttcatcatcttccaaacccagatcttcttcatcgcttaaatgcttcgttgggttccctaccaggcctggtttctgctctaagctggtttcatcttctagcttgtcctcgataaacacccaccctttcaggggctccttggttgtcaggtgttctcttgctgatggaaacggtagttcagtgaagaggactactttgcatgatctgtatgaaaaagaagggcagagtccatggtatgacaacctttgcaggccagtgaccgatttgctgccactgattgcaag

SEQ ID NO: 23126 - DNA, 104 bp, Gossypium hirsutum
  Clone ID: LIB3272-020-P1-K1-F6
tctgagggaagaaaaaacgatagttcgagaaactcatggtccaaatccaaccgtgcacgtgaccaccttggcctgatcttggcgatctatcacacaacttttag

SEQ ID NO: 23127 - DNA, 398 bp, Gossypium hirsutum
  Clone ID: LIB3272-020-P1-K1-F7
ctctggtacaaaaagagaaaagaaaaactgaagagccttctccacttcttagctttaatctaatcgaaaaatcctccaaaagaaggggaagattcctgtttctttctcctctttttgggtgcataatgacagggttttggtttcaccatttttggctgcctcgctttccaatcatgggtcgtggcctgagagttatgagagctactttgtcaaggacgcgaagggttaatgggcgtgtgatgcgatcgctgagagattcgcaagttgcagcttcagagatggtgcggcagaatagaaggaccagggcaaagctggagctgatttttgtagccaatacacttgctaatcaatgggtttatgatcgtcttgttgagattgagaacgacccgttgatgagg

SEQ ID NO: 23128 - DNA, 389 bp, Gossypium hirsutum
  Clone ID: LIB3272-020-P1-K1-F8
tttttccttctcgctctctagggttttcttggtcaagtaaaaaatgaaggtggtcgctgcctacttgcttgccgtcttgggagggaacctttccccttctgccgatgatttgaaggatattctcggatctgttggagctgaggctgatgatgataggatagagttgctattgtccgaagttaaaggcaaagatatcaccgagctaactgcatctggaagggagaagttggcttcagtcccttcaggtgggggtgctgttgctgctgctgctcctaccactggtggcggtggtgccagtgctgcaccagctgctgaggccaagaaagaggagaaggtcgaagagaaggaagagtccgatgatgatatgggtttcagtctcttcgattaag

SEQ ID NO: 23129 - DNA, 399 bp, Gossypium hirsutum
  Clone ID: LIB3272-020-P1-K1-F9
gtttcttttagcttacagcttccattgtttttcagtagtgaagagctaaaaaagaagggaaaccaatggaggggaaagaagaagatgttagattgggagcgaacaagttctcagagaggcaacctattgggacagcagcccagtcccaagatgataaggattacactgagccacccccagcacccttgtttgagcccagtgagttgacttcatggtcgttttaccgagctggaatcgctgagttcgttgctactttcctattcttgtacatctcggtgttgactgtgatgggagtccttaaggacataaccaagtgtacaactgctgggattcaagggattgcttgggcttttggtggaatgatctttgctcttgtttactgcactgctgggatctcag

SEQ ID NO: 23130 - DNA, 402 bp, Gossypium hirsutum
  Clone ID: LIB3272-020-P1-K1-G1
aagctacttgatattggatactttgccatctgagtacgactccagagtaaaggctatggaggttgatgagaagccaactgaggactacaatgatattggtggcttggagaagcagatcccaagaactagttgaggccattgtgttgcccatgactcataaagaaaggtttcaaaagttaggcattcgtccacctaagggggtgctcttatatggacctcctggcactggaaaaaccttgatggcccgtgcttgtgcagcacaaacaaatgccacgtttctgaagctagcaggcccacagctggttcagatgtttattggagatggagcaaaacttgtccgtgatgcttttcagcttgcaaaagaaaagtctccatgcatcatttttatagatgaaattgatg

SEQ ID NO: 23131 - DNA, 396 bp, Gossypium hirsutum
  Clone ID: LIB3272-020-P1-K1-G10
taaaaaatgagctttcttcaggccttgtcaattttccttttgcttttgttgtatgtagtcgtaggatcagctgagcagtgtggaaggcaagcaggcggtgctctttgccccggtggtctatgttgtagccaatttggctggtgtggcagtactgctgactactgcacagttcctggttgccaaagtcagtgcagcggtagtggccctgcccctgggcctggtgggctaaccaatcttatatcaagagagacctttaatcagatgcttttgcataggaacgatggggcttgtcctgcccgtggcttctatacatatgatgctttcattgctgctgcccgttcttttcctgcatttgctacaactggtgaccaagctactcgcaagagggaaatagct

SEQ ID NO: 23132 - DNA, 398 bp, Gossypium hirsutum
  Clone ID: LIB3272-020-P1-K1-G11
cttccaaagctttcagacaagactagtgattcgtgttcaaagaaccaaacaagccaagtacatggttgatttggacgttcagatccctacaactttcgatccattcgccgaggctggggaatttggtggcactggaaccaaggagtatgttcatatacggattcaacaaaggaacgggaagaaaagcttgacgacggttcaaggcctgaggcatgacctgagctacgagaaaatcctcaagagtctcaagaaggacttttgttgcaacggcaacgttgttaaagacaaagagctcggcaagatcattcaactccaaggcgatcaacgcaagaacgtgtcgcagttcctcgttaatgccgggatcgtcaagaaagaccaaatcaaaattcatggttttt

SEQ ID NO: 23133 - DNA, 399 bp, Gossypium hirsutum
  Clone ID: LIB3272-020-P1-K1-G12
cgaaaacgcgaacattgcgctcgagcaaatatcggaactcgcttcaccggacggcgatacgatgcaacgtattgccgcttatttcaccgaagcactagcggaccggatcctcaaaacgtggcccggtctgcataaggctattaattcgactagggttgtcgatttggtatcggaacaagctttggttcggaggttgtttttcgaggtgtttccgtttttgaaagcggcattcttgcttgttaaccaagctataatcgaagcgatggaaggggaaaaggtggtacatgtgattgatctcgacgcggcggagcctatgcaatggattgcactcattcgaggtttgagtgcaagaccagaaggtccgccgcatttgaggatttctgggatacatgtacgaaa

SEQ ID NO: 23134 - DNA, 403 bp, Gossypium hirsutum
  Clone ID: LIB3272-020-P1-K1-G3
gctttgaagatcatgttggctatttttcacaaggcatttgctaatccaccagaggagctgaatagtccagcttctcataaatctactaagaagcctaaacagcctgaagaaaccctaaatgatttcctatctcatcaccctcacaacactttctccatgagctttggcaacgctgctgttttggcttatgtccgccatgaacgtgctgcttcagttcatcagaggttgttttgtgggtttgatgacatatactgccttttcttagggagcttgaacaatctatttatgctgaatagacagtatggtctttccaaagggagcaatgaggcgatgtttgtgattgaagcatataggacactaagggataggggtccataccctgctgatcaggttgttaaggatc

SEQ ID NO: 23135 - DNA, 400 bp, Gossypium hirsutum
  Clone ID: LIB3272-020-P1-K1-G4
aacgaatgggtcttacctttgaaagagtcaagtattggttatcggttggggcacaggcttgagagccggtgcaacgcatccttttcagagctggagtattgccttcgccacccatggtggcaatgggacgcaagggtggaccacgcgacatgcgtcccgttgatcctatgactggtcgtgttttaaacgaagagaaaccaattgctggcaaccaagaaaaaagtggcaaagatgaggctggtgatgagtcaaactctgcatgaaaagtttatattatccctaagactcctcactctgcaatatctaaaagtcgggaaaatgaaaagggggattatattggatgattagaaatttgtgacgaaaaatgacatttgccatttgcggaaactgccagcttatt

SEQ ID NO: 23136 - DNA, 403 bp, Gossypium hirsutum
  Clone ID: LIB3272-020-P1-K1-G5
caggctgcggttgaatctcacaggaaagcagctgctgctacagcttctggtaaattcaaagatgaaatagtccctgtggccaccaagattgttgatccaaagactggtgatgagaaacctgtcacaatctctgttgatgatgggatccgagctaacacatcagtgtcagatctgggaaaattgaaacctgtattcaagaaaaatgggaccactactgctggaaattctagtcaagtgagtgatggtgctggagctgttctgcttatgaaaagaagtgttgcgatgcgcaaaggactgccaattcttggtgttttcaggacttttgctgctgttggtgtggatcctgctatcatgggtgttggcccagctgtggcaattccagcagcagttaaatctgctggtc

SEQ ID NO: 23137 - DNA, 404 bp, Gossypium hirsutum
  Clone ID: LIB3272-020-P1-K1-G6
ctttggttagctctacctacgtgccttgcccaccaccaccaaagagccacaagcctacccggaggagcccaccctgggcacctaaacagccagccacttgccccaaagatacactgaaactaggtgtttgtgctgatttgttgggctcggtgcgcgttgttgttggaccgtcgaggaccaaatgctgctcactcatttcgggtttggctgatctcgatgctgctgtttgcctttgcactgctattaaagcttatgtgttgggggttaacctaaacgttcctgtttcattgactttgctcctcaatttctgcgaaaagcaaatgcctgctggttacaaatgttcctaaacaatggttgggtttttcttttaacggtttcttttttttctgggcgtgttaaatttg

SEQ ID NO: 23138 - DNA, 401 bp, Gossypium hirsutum
  Clone ID: LIB3272-020-P1-K1-G7
caatcatccacttcttctcttatttgaactcaaagtcccagctaatattagaatcatgggtgttgtcacttatgactatgagaatacctccccagtcgcccctgccaggcttttcaaggcctttactgttgaagctccgaaagtttggcccacggctgcacctaatgcagtaaagagccttgaggttgaagctaatcctagctctggaagtatcgtaaaaatcaactttgttgaaggccttccattccaatatatgaagcaccagatcggaggacatgatgaaagtaatttttcatacagttacgatttaatcgaaggtgggcctttgggggataagcttgaaaaaattagctatgagaacaggtttgaggcagctgcaggtggagggagtatttgcaaga

SEQ ID NO: 23139 - DNA, 400 bp, Gossypium hirsutum
  Clone ID: LIB3272-020-P1-K1-G8
ctgacaaccatggatggttggaggcttagtccgaaactttggcaagagtccattacatatttgtctagtttgctagataaggatgaccgatctgtccgcattgctgctggtgaagcactggcagtaatttttgagatgggaagcttagaaaaatttgctgccgaaactaaaggttccagtgatggctcagcttcagaaggaaataaatctaaagaaggattctcatatatacaaggactgaagggaaaaattttgaatcaagtcagagacctctcagtggaagctggtggtaaaggttctgccaagaaagatctcaacaaccagaggaacttgtttaaagatgtgttagagttccttgaggattgttatagtcccaacacatcaatgaagattggtgggg

SEQ ID NO: 23140 - DNA, 400 bp, Gossypium hirsutum
  Clone ID: LIB3272-020-P1-K1-G9
attcattttctctacctttggttgttccttttcttgtctcttctaatcttttatatttccatatatttttttagaaaaaaaattgtaaatccctcttgctgtttttctgccatggttgttgctgttttaaaaccagaagactgtttaaagctacctaatcccatgaaacaacctcaaaatccttggcataatcctaatcccagcactaaccggacgaatcgttcacaagggaaccgtaagaagcgttctcccaacacctcccctccttctcgtcccaccgtcggtcgccccaaagctccggccaagaatctcgtcatgggtcaagtcaagatcctcaaacgcggcgaagatcttaaaccatctaagccggataagcatgtgaggttcgcaaaggaaaacg

SEQ ID NO: 23141 - DNA, 399 bp, Gossypium hirsutum
  unsure (1)..(399): unsure at all n locations
  Clone ID: LIB3272-020-P1-K1-H1
nctccattcattatttacgttaagttcaaagaaatggctaatcctgtgaacactcgcgtccacagtctccgtgagcgtttagatgagacccttcttgcccacaggaacgagattttggccttgctctcaaggatcgagggcaaaggaaaaggaattctgcaacaccatcaaattattctagagtttgaagctatccctgaagagaacagaaagaacctcgctgatggtgcattctttgaagtattgaaggctagtcaggaagcgatcgtgttgcctccatgggttgcacttgctgttcgtccaaggcctggtgtttgggagtacattagagtgaatgttcacgcccttgttgttgaggaacttactgttgctgagtatctccacttcaaggaagagctt

SEQ ID NO: 23142 - DNA, 404 bp, Gossypium hirsutum
  Clone ID: LIB3272-020-P1-K1-H10
ttgtaatgtaagcaccttctcttagtatacaagaaaggcaacaaagaaaccccagaaaaatgagaactagcaaccatttgatagggttactaaacttcttaacatttttgttgtcaatagtaatattgggtggtggaatatggctaagcagccgagccaacagcacagattgtctcaagttcttacagtggccattgatagtaataggagcttcaatcatggtggtttcgttagcaggttttgcaggcgcgtgttataggaacaccttcttgatgtggctttacctcttcgtcatgttcttcatcatcgccgccctcatcggctttataatctttgcttatgcggtgactgataaaggctccaggcggtcggtgttgaacaaaggttacttggggtattacttg

SEQ ID NO: 23143 - DNA, 338 bp, Gossypium hirsutum
  Clone ID: LIB3272-020-P1-K1-H11
ggcgccgtccgaaacaatcctaaaggggaaaacatgtcgtccgacgggaacgtcaccggctggcggcggcgctaacaccttcggcgtaaccaataagcctttttttgctaccaatgcaaccgtaccgttgacgaaacgatatccgctccctgttatgatccgacttgtcccatttgaaacgagggttttcctgaaagaatcgacaacccaaaccctaataaaaggtgccggtttctaaacccgtatccgaactcaattcccggtcaatgacccttttttgacgttatggatccgtttggttttctcctttcaggtgtttttttatccggctcttttta

SEQ ID NO: 23144 - DNA, 405 bp, Gossypium hirsutum
  Clone ID: LIB3272-020-P1-K1-H12
cttgcattaagtctcaaagatatcactgcaagaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaaaagcccaccctcggcacctgaacagccaggcacttgccccagagatgcactgaaactaggcgtttgtgctgatttgttgggctcagtgcgcgttgttgttggaccgtcgaggaccaaatgctgctctctcatttcgggtttggctgatctcgatgctgctgtttgcctttgcactgctattaaagctaatgtgttgggggttaacctaaacgttcctgtttcattgtctt

SEQ ID NO: 23145 - DNA, 158 bp, Gossypium hirsutum
  Clone ID: LIB3272-020-P1-K1-H3
cccgaatttccgggcacgcccaacgcctcggctggctttattattcttacaccacatcgggtgaagcacacaatgtgggggcgaggggtcactttatatgcggtcacagatgtatcaccacatatttcacattatacatatactctcagaacaacacg

SEQ ID NO: 23146 - DNA, 343 bp, Gossypium hirsutum
  Clone ID: LIB3272-020-P1-K1-H4
ttgtaatgtaagcaccttcttttagtatacatgaaaggcaacaaagaaaccccaggaaaatgagaactagcaaccatttgatagggttactaaacttcttaacatttttggtgacaatagtaatattgggtggtggaatatggctaagcagccgagccaacagcacatattgtctcaagttcttacagtggccattgatagtaataggagcttcaatcatggtggtttcgttagcaggttttgcaggcgcgtgttataggaacaccttcttgatgtggcttcacctcttcgacatgttctatatcatcgccgcccctatcggctaaataatctttgcttatgc

SEQ ID NO: 23147 - DNA, 406 bp, Gossypium hirsutum
  Clone ID: LIB3272-020-P1-K1-H5
aaacaatcctaaaaggtgaaacatgtcgtccgacgggaacgtcaccggcggcggcggcgctaacaccgtcggcgtaaccaataagcctttcttttgctaccaatgcaaccgtaccgttaacgtaacgatatcccctccctcttctgatccgacttgtcccatttgcaacgagggtttcctcgaagaatacgacaacccaaaccctaatcaaggttccggtttcctaaacccgaatccgaactcaatcccgttccatgaccctttcttgacgttatcggatccgttcgcttccctccttccgctcctttttccgtcctcttcatccacaactacctcatcctctgcttctattgaccctaataaccctagcctatctgggccgacccgctcaggtcgaggcgacccg

SEQ ID NO: 23148 - DNA, 377 bp, Gossypium hirsutum
  Clone ID: LIB3272-020-P1-K1-H6
gcgtccgacaacactcctaaaaggtgaaacatgttctccgacgcaaacgtcaccgccggcggcggcgctggcaccgtcggcgtaaccaataagcctttcttttgctaccaatgcaaccgtaccgttaacgtaacgatatccccttcctcttctgatccgacttgtcccatttgcaacgagggtttcctcgaagaataccacaacccaaaccctaatcaagggtccggttttctaaaccctaaaactaacttaattccgtttcatgaccctttctttgcgcgtatttggttgcgatcgtttgcctccttgcggttctttttccgttcttttcatccacaactacctcatcctatgcttttattgaccctaataaccct

SEQ ID NO: 23149 - DNA, 381 bp, Gossypium hirsutum
  Clone ID: LIB3272-020-P1-K1-H7
gccaaaaagaaaagtttcgtctttgatcgttgcttcatttaagcaacaccaaaagttgctttttttcggttggcgttaatcagaagcgatgccttcagctgtatcgcagcagtggcacgagaaggcgactgcttttttttcttcctcaggggtgaagctgaaggaagctagccaaaccgacgtcacgtttgtcggagaagctgcaaaggatgccaatggcaacgtcactgacgtggcgaaacgagtcggttccatggacaaaaaccgatgggcgtttcttcgtcagccagcgacaagacatgctgtgcaagacagtcttatattggctgctgcaacgaccggaacctttttgaggaaaggcatcaccgggactaaagacag

SEQ ID NO: 23150 - DNA, 396 bp, Gossypium hirsutum
  Clone ID: LIB3272-020-P1-K1-H8
gtaatcctcaagtctactactacaggaatcggttgaagcagagaatggagggaagaagggtcattggatgggctgccagagatgtatcagcacatctttcaccttattcattcactctcaggaaaacaggtccagaagatgtggtgttgaaggtattgtattgtggagtagatcacactgatctacaccagatgaggggtgagcttatgcccatcaactacccattggttccagggcatgaagtggtgggcgaggtcgtggaagtgggttcagaagtaaacaaattcaagcttggagacaaggttggagttgggtgcctggtaagctcttgtgggaaatgcttgtcttgcaactccaataatgaacagtactgcaaccagagggtctttacatatg

SEQ ID NO: 23151 - DNA, 388 bp, Gossypium hirsutum
  Clone ID: LIB3272-020-P1-K1-H9
ctgggattcttaatagtgaagtaaccgtccatagggacttcgatttgaataatggtcctgctgttgatgaggtaagcactgaaccatcactatttagccataatgctagaagcagaaatgccccatctcaaccatcagcttccagcctccggatgaacagtactgaggtggcaaatttctcatcatggtttcctactgagaatacatactcatctattgcactacaatcgatcttacctgatagagagcagccttttccaattgttgcaactggtgggccacatagggtgttgggcccacctatgggtgccaccccttttaatcctgatgtctatagggaacccatgttgtcatcttcaccagcagtgccatttccatcaaccccttt

SEQ ID NO: 23152 - DNA, 343 bp, Gossypium hirsutum
  Clone ID: LIB3272-021-P1-K1-A1
tcgcgccgcaacagttctactacgtcgttccagtcccctaccatgtgcgactagatgacgactaaacgaggacgctctatgactactctcggaacggtacgagcgtatggcgtgcgcggagtgctgaacgtgggagtgtggaggctagttgctgctagggtttctggtgttttaggtcaattgtgccctataattgggtgtagcttgacccaagggttatggggtgtaatcagtatataattggggctgcgcaaataattatggattggtcttatttcgaatgggccgggcaacaataggctattacagtcactatctaatgtaattggcataatatcacacg

SEQ ID NO: 23153 - DNA, 399 bp, Gossypium hirsutum
  Clone ID: LIB3272-021-P1-K1-A10
gtttttgtattttatcaattccgtttctccttaaatcaaaaccatgggagacagtcaatattcattttctctcacaactttcagtccttcaggaaagctagttcagatcgagcacgccttgacggcagtaggatcgggtcaaacatctcttggaatcaaagctgctaatggggtagtaattgctactgagaagaaattgccttcaatcttggttgatgaaacctctgttcagaaaatacagtgtctgacaccaaatattggagttgtttacagtggtatgggccctgattttcgagttttggttcggaaaagtagaaagcaggcagaacagtatcattagattgataaggaaccaattccagtaacacagcttgtaagggaaactgcagctgtgatgca

SEQ ID NO: 23154 - DNA, 404 bp, Gossypium hirsutum
  Clone ID: LIB3272-021-P1-K1-A11
gaaaatcaagaaccgaaaggacctttaatcttttgaaccaaacaccccccctaatcagaaccctaactttttttttcttctaatctttgattgtagaaaccaaaagcaaacgcgtaaagaaatcatgggttctgaacagaatgaaggaactagcttccctccatcggcgccaaaactttgtgccaacggctgtgggtttttcggcacggcggcgaatatgaacctctgttccaagtgttaccgtgacctccgtgccggggaggagcaagctgccaaggcgaaagctgccatggagaaatccctcagcgttaatacgaagcaggaagatgtcgttgacgagactgtgaagcctgttcttgagcttcctcatgtgggttcctcatcgacggtggtcgagatacaac

SEQ ID NO: 23155 - DNA, 402 bp, Gossypium hirsutum
  Clone ID: LIB3272-021-P1-K1-A12
ccaagacttcattgacatctccaacatcgatggctttaatgttcctatggagtttagctccaactccccagggtgcactagggttatcaagtgtacggccgacattgtcggacaatgcccgaaccagttgaaggttcccggaggttgtaacgggccttgcccagtgttcaaaactgaagaacattgctgtaattctgggaactgtcaacctaccgacttctcgaggtttttcaaggagaggtgccccgatgcttatagttacccaaaggatgacccaacaagcttgtttacatgccccacagggactaattacaaggttattttctgcccatgaagagtatttgggatggttttaagtcctttctatacacaaattagtaggtttatatcaataaatggaat

SEQ ID NO: 23156 - DNA, 275 bp, Gossypium hirsutum
  Clone ID: LIB3272-021-P1-K1-A3
cccgttccggatttccgggttgcgcccacccgtccgctggggactccggaaaggtttacctttttcgtttaccgacctgcccaccttggtaacggttaagccggagtgtgggcccaacggccggaaaagcaccccctttttttgttgtcggttgccccccgcctggcctttgaaattccggaggaccgcttgccaccttgccccgtttttcctaatccccggttctgtgttcgatggtgaccaccctctggtcattgaaccaacttaggcagggt

SEQ ID NO: 23157 - DNA, 410 bp, Gossypium hirsutum
  Clone ID: LIB3272-021-P1-K1-A4
gcttttactctgaagggcgagctgtagctgccgctgcagcagtttcacttggcggtaaagtgcctcttttggcttcagcttatggaagtactgcttctgccaatgcatctagagcatggctttcaggagtttttgctcttccagtggcagcttacatgcttcaggagcaggaggttcatgctgcagagatggagcgcaccttcattgctatcaagccagatggagtgcaaagagggctgatttcggagatcatctctcgttttgagcgcaaagggttcaagcttgtggctatcaagttggtagttccttcaaaggagtttgcccagaaacattatgatgacttgaaggaaagaccctttttcaatggcctgtgtgaattcctcagctcgggccctgttcttgccatggtt

SEQ ID NO: 23158 - DNA, 404 bp, Gossypium hirsutum
  Clone ID: LIB3272-021-P1-K1-A5
gtcataatcagcttaatggaagcattcctatggaaattggaggagctttctccttgaaggatttgaggctcaatgctaatttcctaggtggaaaaattcctacatcaattgagaactgcacctcgctatctactttgatcatatcacaaaacaacctgagtggcccaatacctgctgaaattggaaaactgaacaacctacaaaacgtggacctgtcttacaacaaccttgctggaaccctacccaagcaattggccaatctaccccacctcttatccttcaatatttcccacaacaatttacagggagaactgcctgctggtggattttttaacaccatatcgcccacggctgtctctgggaatccatcactttgtggctctccagttaacaaatcttgccct

SEQ ID NO: 23159 - DNA, 407 bp, Gossypium hirsutum
  Clone ID: LIB3272-021-P1-K1-A6
ctcagaaaaaaattgagtgtcagtttgaaagtgttcttcagatatggctatgaaacaagttgctaattctgctatcaaagcaattgccaattctgggtcatcctctcttcttaccagacaactgcatgcttctccagggagcaaaaagattgtgggggtgttttacaaggccaatgagtactttacgaagaatcccaactttgttggttgtgtggagggagccttggggttgcgccaatggctcgaatcacaggggcatcagtatatcgttaccgacgacaaagaaggaccggactgcgaacttgaaaagcatatccctgatctccatgtgctcatatcgaccccattccacccggcttacgttacggctgagaggatcaagaaagccaaaaacttgcaactgcttc

SEQ ID NO: 23160 - DNA, 360 bp, Gossypium hirsutum
  Clone ID: LIB3272-021-P1-K1-A8
aaaaaaaaaagatggatgaaaatgttgttaattcctggttggacattgatttgatcagtctatgggtgtttccaaaatgcatccattagtttgaagaaatgctggggaaaggtgcaatgaaaacagtgtataaagcaatctatgaggtgctgggaatggaggtggcgtggaaccaggtaaaactgaatgaggtgctccgatcgccagaggatttgcagaggctgtactcataagttcacctgctcagcaccctcaatcatgattctatcataagattccactccttctgaatcgatgttcatcgcaagaccttaaatttcataactgaaatgctcactttgggatctctcagagcataca

SEQ ID NO: 23161 - DNA, 414 bp, Gossypium hirsutum
  Clone ID: LIB3272-021-P1-K1-B1
taaagagacggcgccaatcagctgtccgccttgactgaccgtccggcatcgtcttggccctcgattttgcccttttgtaaacctttttttttcaccaattcccgaaatggcagtgaaaccctccaaggccgataagaaaatcgcgtacgacgcgaaactgtgccagctcttagatgagtacacgcagatcttgatcgccgcagccgacaatgttggctcgaagcagctccagaacattcggaaaggtctccgaggtgactcagttgttttaatgggtaagaacactatgatgaaaaggtctgttaggatgcatgctgagaagactgggaacgaaactttccttaaccttatccctttgcttcagggaaatgtgggtttgatctttacaaagggtgatttgaaggaagtcagtga

SEQ ID NO: 23162 - DNA, 398 bp, Gossypium hirsutum
  Clone ID: LIB3272-021-P1-K1-B10
ggaattctgggttttgagtatggaattgttcaaggacctttgggaccggatattgctggtccggagctagttgctgctgttgcaaacgctggtggacttggccttcttagagctcctgattgggaatcaccagattatgtgaaagagttgataaggaagactcggaagttaaccgacaaaccctttggggttggtgttgttctggcatttcctcacaaagaaaatgtaaaggctatactagaggagaaggtagcagtgttgcaactgtattggggagaatgctcaaaggagcttgtaatagaagctcataatgctggggtcaaggttgttccccaagttgggagtttggaggaagcaaaaaatgcaattaatgtgggcgtagatgcaatcattgtcca

SEQ ID NO: 23163 - DNA, 405 bp, Gossypium hirsutum
  Clone ID: LIB3272-021-P1-K1-B12
aaaaatgatgatcggagaatcaatccaaccaaatcccaccatcaaaatccccggaggggacccattcaacgatccgacggctagctttcactccgttaactttaactacaacaatgcagtcagtagtccttgccccgtcgattacctcgggtctctccaccgttacctaccgtcaaacgactacgagtccgattcgctgagtgatgattcggacttacctgttgatgcattctcatgcgaccatttccggatgtacgagttcaaggtgaggaggtgtgctcgtggaaggtcacatgactggactgagtgtccgtacgctcaccctggtgagaaggcccgaagaagggacccgagaaagttccattactctggaactgcttgccccgattttcgcaagggaagctg

SEQ ID NO: 23164 - DNA, 394 bp, Gossypium hirsutum
  unsure (1)..(394): unsure at all n locations
  Clone ID: LIB3272-021-P1-K1-B2
aagtgtaaagattcagtatattcaactttntagtgatcatcttgctgtctctgagcgtgaagaaggtttgcccaaaattactgtttaccatcttccggaagttgaagagccactcgtaaatcttgaagggggtaaatcagttcaatttattgaccctgtatactcagttgatctatcagtatcacagttttcctccaccattttgcggttttcttatagctcattgcggatgcctaaatctgtctatgactatgacatgaatactggggagtctgttttgaagaagattgaaactgttttgggaggctttgatgcatctaattatgtcaccgaaaggaaatgggctacttgcttagattgcactcaaattcccatatcaattgggtaccaaaag

SEQ ID NO: 23165 - DNA, 282 bp, Gossypium hirsutum
  Clone ID: LIB3272-021-P1-K1-B3
attctctgcaatctcttctttttggagtttcatcacaccagatattacaatgggttcaatcggtgaaactcaaatgacacccacccaagtctcagatgatgaagccaacttattcgctatgcaacttgccagtgcatcagtcctccccatggtcctcaaatcagccattgaacttgacttgctcgagatcatggctaaagctggtccaggtgctttcttgtccccaaaagaagtggcttccaagctccccaccaccaaccctgatgcacccgtcatgctgga

SEQ ID NO: 23166 - DNA, 410 bp, Gossypium hirsutum
  Clone ID: LIB3272-021-P1-K1-B5
caacaacctcctctccccccttcatttctctctctctgcattttcatctcttggttctttctcttttacaatctcatacatggctgaggagactcaaaagcctgaagctgctgcaccccctgctcctgctgaggaagtggtggtggagaaggagagtgaacaggaggctgcttccgagaagcctactgatgctgttgttgaagacaaacctgctgaggctgttgaggaggagcctaaggttgaagctaaggacactaaggtaactgagtctgcttctttcaaagaagaaaccaatatagccggtgaacttcctgacccacaaaagaaggctcttgatgagcttaagcaacttattcaagaagcccttaacaagcacgaattcacaccccctcctgccaaagataaagata

SEQ ID NO: 23167 - DNA, 408 bp, Gossypium hirsutum
  Clone ID: LIB3272-021-P1-K1-B6
gttaaattaaagatcacttttgattcttcagcttttgaaattcaggtacgttatatattatttacattaatcgaactctaaattgtattgggtttcgtcgaattttaatttcgtttggtcagttgtttacttcttttacgaaaactttgggctttaggtttaggtttcccaagacgtaaccgcttaaataattgctttttattgcattttaattaaagcttatcaaatttcggatgaggaattagggatgtcttgttattcctgtattttcatggtatgtcatgaggatgattcgataattggggaatttttggaaggtggatgctggtgattgaaataaataggttaaaaagtcttgaaatttgttgtttatcattgataaagctcttgttcttttatcaaaatatt

SEQ ID NO: 23168 - DNA, 406 bp, Gossypium hirsutum
  Clone ID: LIB3272-021-P1-K1-B7
ctctctctctattttctgtcagatttcttttttctctctcaaaaatctctcagatccaatactctccgctcctctgatcttttcttcgacttggtttatgagctcgaaggagaaacccactcttggcggtacgcggattaagacccgcaaacggaatattgctgcacccctggacccttcagcatttgctgatgcagtagtccagatctatttggataatgctggtgacctggaacttgttgccaggagcattgaatcttcagatcttaacttctcaagatacggtgacaccttctttgaggttgtttttgctggaggccgcacacaacctggcacacttaaacctgatgaaggggagtgccacccttactctatcatagagtgtgaggctaaacgtgatgccatt

SEQ ID NO: 23169 - DNA, 406 bp, Gossypium hirsutum
  Clone ID: LIB3272-021-P1-K1-B8
ggaaagggtcttcgggcacttaccaaagcccagttggatgagattctaggtccagctgaatgcaccattgtttcttcattatctaacaagcaagtggactcctatgtcctttctgagtctagcctctttgtctatccatacaagattataatcaaaacctgtgggacaactaagttgcttcttgctatcccacccatcttgaaattggctggcagtctatcccttgctgtaaaatctgttaggtatactcgtgggagttttatattccctggtgctcagccatttcctcaccgaaacttctctgaagaggttgctgttcttgataactatttcgggaagctaggcgctggtagcaaggcttgtgtaatgggtgggctggataaacagaaatggcatgtgtactctg

SEQ ID NO: 23170 - DNA, 300 bp, Gossypium hirsutum
  Clone ID: LIB3272-021-P1-K1-B9
ctcaaacagaaaaccagaatatgggtgccgtttctagaacagggttacttcacaaggctgcaaacgatttccctaccagacgagctccatctgtttgcggcaggatcgatatgacacatgctcaatcaccacacataacataccatgctgctattctgctcatcgcctgcatcatacatcatggcgataagagatactttactttcacaaacaccgggatgcatgacattatgtgatcggctgtacatggatgacgctctaccgccgatccatgtacctcagctgatactgcccaccatt

SEQ ID NO: 23171 - DNA, 417 bp, Gossypium hirsutum
  Clone ID: LIB3272-021-P1-K1-C1
cttcgctttgagattagatccaaaattcccctttcatcttatttccgattccgcaatttttcctgaaaccctaatcctaatcccggattcctctcgtctacatcgtctagcaaatggcaaccgaggagccggcagtcgtggcagaccccgcaccggagacggaggaggacaagactgctgagaccaaagctacttcaaaatctggcagagcaaagaaaaccaaagaacccaaaaccaagaaagctgcagctcctcggaaaccacgggctgctcctactcatccaccttacgaagagatgatcaaagatgcgatcgttactttgaaagagaggacaggttcaagtcagtacgccattgctaagttcattgaagagaaacagaagaatcttcctgggaatttcaagaagcttcttcttg

SEQ ID NO: 23172 - DNA, 403 bp, Gossypium hirsutum
  Clone ID: LIB3272-021-P1-K1-C11
tcttcttctttttggtgaagtgttattataagcttgatacttgaaagtataagattattatcaccggcaacatgtcatccgaatcggaagagcagcagctgagcaagaaagccgccaaaaaagaagctgccaagctggagaagatgcgccgccgccaggaagccgctgccttggcctcagcggcttcttctctctccgtcgaggaggaggactcctattcctccaactacggtgacgtcaccctcccggagctcaaatcttgctccaaaccagatgctggcaattggagcatagcaatttcttccatggactggactcgcgtcggagcccttaccgaggagctgaaggagaaggaggtgcttataaggggacgagtccacacaacgcgaccagtgtcgaagaa

SEQ ID NO: 23173 - DNA, 387 bp, Gossypium hirsutum
  Clone ID: LIB3272-021-P1-K1-C12
caaatgatcaacttcaaaacctcgctgacccttccaaagcacgatcatgggtggaatcaaatgttgtagcttactggccgagtgttcggttccgatacattgctgtcgggaatgaagtccctcattcatcttggttagctcaattcgttttgcccgccttagtgaatgtattcaacgcggttcgatcggccggtttggagagtcaaatcaaggtctcaatcgccattgatatgaccttgatcggtgtctcgtatcctccatcggctggtgcgtttcgtggggacgttaggtcgtatttggaccctatcataggccacttagcatgggctagaacacccttgcttgcaacatttacacttacttcaactattcaggcaatccaaggga

SEQ ID NO: 23174 - DNA, 409 bp, Gossypium hirsutum
  Clone ID: LIB3272-021-P1-K1-C3
gcagtctctcccgctccttctcgctgcgatttcgtcttcaagatctcagttctcaaatcgtagcgctcttttctatcaagccatggctctggtcttgcatgcagcaaaggcagaggcagctgaggaggaggaggcaccaaagcccaaaccaaagaatcctcttgatttgctgcctccaagtaagatggtactggatgactggaagaggctttactctaacacaaagaccaatttccgagaggttgcaattaaaggattctgggacatgtatgatcccgagggatactcactgtggttttgtgactacaagtacaatgaggagaatacagtttcatttgtcacaatgaacaaggttggaggattcctgcagagaatggatttggcccgcaggtatgcatttgggaagatg

SEQ ID NO: 23175 - DNA, 393 bp, Gossypium hirsutum
  Clone ID: LIB3272-021-P1-K1-C4
gagggtccttagctttctctctctctccaaaaaaaaaaaaaaaagaaaacgaaaaaaagtttcgcttctttgctttctttcgagtaaaaatcaaacgaaaaacaacttaaataatattaaaagattttgattttgatcatcaaattttctgtttctgatccaccagtccagtcagagtgttgaagtattgaagctgtctggtgttttgtttgttttttgaaatctgatgtctccgccgcttcttggcgtggaggaagggggtcagaacaatgtgactttactgggttcttctggctctattgatagtgtgtgccagaataatgctgaattgaaggagcgcaattacatgggcttgtctgattgttcttctattgattgctctgttgtcaccct

SEQ ID NO: 23176 - DNA, 408 bp, Gossypium hirsutum
  Clone ID: LIB3272-021-P1-K1-C5
agccaaatacctttctcgagcgtttcttttttaactctccagttctccacgaatccatagaatttcaccaagaagaagaagaagatgtcgtggcaaacatatgtagatgagcacttgatgtgcgaaatcgatggcaatcatctctcctccgccgccatcgtcggccacgatggcagcatttgggcccagagctccaatttccctcagttcaaacaagaagagattaatgccatcatgaatgactttgctgaacctgggtcacttgctccaactggattgtaccttggtggcacaaaatatatggtgatccaaggcgaacccggatatgttattcgagggaagaagggatccggaggtattactattaaaaagtccaatatggctttgctcatcggaatctatgatgag

SEQ ID NO: 23177 - DNA, 409 bp, Gossypium hirsutum
  unsure (1)..(409): unsure at all n locations
  Clone ID: LIB3272-021-P1-K1-C6
caacaagtcctaaatattggcaactatgtcgtccgggtaaagattggcactccgggtcagctcatgttcatggtattggacactagcaatgatgtggcttgggtcccatgctccggctgcaccaggtgctcagccaccactttctcacccaacacttcttccacctatggttcgttggattgcggtttgccccaatgcgcccaggtccatgggctgtcgtgcccggctacggggtctgcggcttgctcttttaaccaatcctacggtggagattcatcattttcggccaacttggttcgagattccttaggattagccaatgacattgtcccagattttgcttttggatgtataaacgccatctctggttngtcagtaccaccgcaaggacttgttggtttgggtcggg

SEQ ID NO: 23178 - DNA, 400 bp, Gossypium hirsutum
  unsure (1)..(400): unsure at all n locations
  Clone ID: LIB3272-021-P1-K1-C7
gtaagattggaacttataccgttgttttgaaggaggcttataaaaggggtttgctgattgagaataatccattgatgaacattaggaatcggtatcttcatcttatgcacactgttaaagaacatggtaaagacatttctatgtctacaggaaccaatcaagaaaagaaagcagcgagtaatgcatccaaaaaggaagctggtgatgatgatagtgaagaggagaataatggactttcagttactttttctggttcagaaactgagaatggtgatagcggccggcgtggttctcgtgaagctgttgcagttagtagaagaacaacaacaagaagttagaggaagaatggngacttgaaaactcatttgggtgatggtgaaggtgaaagggcaatgggaag

SEQ ID NO: 23179 - DNA, 398 bp, Gossypium hirsutum
  Clone ID: LIB3272-021-P1-K1-C8
gaaaagaaaaaggaaagggaaactatgacacacttcgttctagttcatggtatgtgtcatggagcttggtgttggtacaagattgtgtcgctgctcaaatcaggcggccaccgtgtcactcccttggatcttggtgccagtggaatcaaccccaagaccatcactgacttggcttccttgtccgattatgcggagccattaatggcattaatggcctctttgcctgaagacgagaaagtgatactagtgggtcacagttacggtggggttatcatttccttagccatggaaagcttccccatgaaagtattggccgctgtttatctcacagcttttatgccgaatcatgattcttctattgcgactggagtagctgagtacttcagaagggttatggc

SEQ ID NO: 23180 - DNA, 404 bp, Gossypium hirsutum
  unsure (1)..(404): unsure at all n locations
  Clone ID: LIB3272-021-P1-K1-C9
cctttgtcccctttctctctcttcccgtagccggcctctcttaatttaattcagttccacttcttctcttgctctttaataattcaatctcaaatctaaatttaggattgaaaatttcccaactttttggtgttcttttttaaaaggatttaatcatttggatacgaattgaagcacctgatcttgttgaggtggaaataattcagttatttccctttgtttttttagtttttattaggagggtttgttctggatttggagtttagggctgaaggaaaaaattgatttattgggttctctttgaagttaaatttcagggtttgatttgaaatggtatatttccatagatcaatctccgtctgcaactcggctgaccaggcttctccaatggcanattctgggaa

SEQ ID NO: 23181 - DNA, 411 bp, Gossypium hirsutum
  Clone ID: LIB3272-021-P1-K1-D1
gcttccttctttgtcagtagggtagacaccctcattgacaaaatgcttgaaatgattggaacaccagaagcccttgatctccgaggaaaggctgctgtagcacaagcagctctggcatataggctctaccagaagaaattctccggtccaagatgggaggctttggtgaaaaagggtgccaagaaacagaggttgctctgggcttcaactagtgtcaagaaccctgcctaccctgacaccctatatgttgctcctctcattggacctgacacggtctcaaccatgcctgaccaagcactccaagccttcatagaccatggcacagtttcaaggacgattgacgcatacgtgtctgaagctgaaggcatctatagtgcacttgagaagttggggattgactggggcaaagtc

SEQ ID NO: 23182 - DNA, 386 bp, Gossypium hirsutum
  Clone ID: LIB3272-021-P1-K1-D10
ccctgatgaccctcttgttccggagattgctcacatgtataagactgatcgggcaaagtatgaagccactgctcgtagctggacccagaagtatgccatgggatgacagttgttggtgtgtaatatgtatcagctttcttatgttgccaactgtgtcgaaccattttatgttttcttttggggaagggagggggtgttttttcttaaaggaatttgtcattgtgctttggatatgggaagatatggacattctttttatttattccgcgctttataacttgtgtgaaacccttgtttcgttctcgaagtcgctgtgaaaccctttgtttcgttcaatgtaacaaaaaagtctttggttaaaaaaaattaattaattttattaaata

SEQ ID NO: 23183 - DNA, 401 bp, Gossypium hirsutum
  Clone ID: LIB3272-021-P1-K1-D11
ttcttctctcttttactcattcattctttagtttcaatatcaaagcaaaaatggcttcttcttgtaatgttgtttcaatggctttactggcttgtttggtgttgaactccttggtttttgttgcccatggtggtgacttttaccaggatttcgacctaacatggggtgacaaaagaggcaagattttcaatggtggcaagctcttgtctttgtctttagacagggtttcagggtctggttttaaatccaagaaagagtatttgtttggaaggattgatatgcaactcaagcttgttgctggcaactcagctggcactgtcactgcttattatctgtcatctcaagggccaacccatgatgagatagactttgaattcttagggaatctgagtggtgaccct

SEQ ID NO: 23184 - DNA, 405 bp, Gossypium hirsutum
  Clone ID: LIB3272-021-P1-K1-D3
gcaaggtgttatcgtcagataaaaaaacaaaccttacccaaagtcacgttattgtcgtggtgttcctgatcccaagattaggatttatgatgtgggaatgaaaaagaagggtgtggatgagttccctttctgtgttcacttggtctcttgggagaaggaaaatgtctctagtgaagctctggaagctgctcgtattgcttgcaacaagtatatggccaagtatgctgggaaggatgccttccacctgcgagtccgtgttcacccattccatgtcttgcgtatcaacaaaatgctttcatgtgctggagctgataggctccaaactggtatgcgaggtgcttttggcaagcctcatggaacatgtgctagagtagccattggtcaggtcctcctttcagttcgttg

SEQ ID NO: 23185 - DNA, 406 bp, Gossypium hirsutum
  Clone ID: LIB3272-021-P1-K1-D4
gccgtctcgcgtgcgccctgtggctctcttcaaccctcgcatatctcttcaagatctgatctgatctgacaaaaaaatgttcgggagagcaccaaagaaaagcgataatactaaatactatgagatattgggagtgcccaaaaccgcttcccaagatgatttgaagaaggcttatagaaaagctgcaattaagaatcatcctgataaaggcggtgatcctgaaaagtttaaagagttggctcaagcttatgaggtgctgagtgacccagagaagcgtgagatatatgatcagtatggcgaggacgcccttaaagaaggaatgggtggaggcggtggtgcccatgatccatttgatatcttccaatccttctttggtggcaatccttttggtggtggtggtagcagc

SEQ ID NO: 23186 - DNA, 407 bp, Gossypium hirsutum
  Clone ID: LIB3272-021-P1-K1-D5
cggacgcgtgggctcaaatccctctgaaaaatcctctcaaattttctttccatcccacgatcccccaaaatcaccatggccgctacttcaccacgtgaggaaaatgtctacaaggcgaaactcgccgagcaagccgagcgctacgaggagatggttaggttcatggaaaccgtcgtttcctccgtcgttgctcccgacgaacttaccgtcgaggaacggaatctcctctccgttgcctacaagaacgtgatcggcgcccgccgtgcttcctggaggatcgtttcttccatcgagcagaaagaggaaggacgtggcaacgccgatcatgtctccatcattcgtgagtacagggccaagatcgaggctgagttgtctgatatttgtgccggaattttgaagcttctcga

SEQ ID NO: 23187 - DNA, 405 bp, Gossypium hirsutum
  Clone ID: LIB3272-021-P1-K1-D6
gttcatctcaaccttgatcttcgttttcgctggatcgggctcaggaatggcctttaacaagttgactgacaacggagcaaccaccccggctggtctcgtagccgccgctctagctcatggcttcggtcttttcgtcgctgtctccgttggcgccaacatctcaggtggccacgtcaaccctgccgtcaccttcggtgcttttgttggcgggaacatcactctcttgcgcggcattctttactggatcgcccaactcctaggctcaaccgtcgcttgcctgttgcttaagttcgctaccggcgacctggctgtacccgcttttgggttgtcatcaggtgtgggcgtgtctaacgcattggttttcgaaatcgtgatgaccttcggattggtgtacacagtggacgc

SEQ ID NO: 23188 - DNA, 404 bp, Gossypium hirsutum
  unsure (1)..(404): unsure at all n locations
  Clone ID: LIB3272-021-P1-K1-D7
aaaaaaccttagacgctctttcaatccttcgccgaccaacagccttttgaaggtctattcctctgcccctctttttgactcatatgagagtcaatcaaggcctcatcgagtcgaaagattcgtgagtcttgctcgtagaccccgaatcgtcacttggtctcaatcgtggtgagacaagcgtggattcgaaggcatcaaacgcaggtacaagtgcgtggcgtgtgtacgagggtgtgtgctggcgtatggggtgtgggaatgcgccaggaggagtgtacggcactgggggctactggtgaaggctgcggcgcatgagaaaaagaaccctaggattctggggttgtaattttctgagcctatcgagcctgtatttgngtctttgggtcatttagggtattgggcta

SEQ ID NO: 23189 - DNA, 402 bp, Gossypium hirsutum
  Clone ID: LIB3272-021-P1-K1-D9
atcagcctttagctcccttgctgcacatttgtgagcaagtaaaaatgcttcttgcaccttgcttcatgttctgtgctcttgttctctcttttgttgctgcctcttgcaccaacaattggtatcatgagcctatgtcttacgggaccattgattttgcttcccctgcttgttgaaaagaaagaagctgtcaaagcacaagcaagtcattaaggactgcttgtagagaagataatatcggctcaaacttataagatccccaaactagcttgaataagctgaaggaggagtttaaaggaaaggtgtgagctttccaaatgtgcaagcttagcaagatgtcaaagctgcaagcttagcaaagtgcgagcctgatgaagacacctgttgaagacaatatgcaaagat

SEQ ID NO: 23190 - DNA, 315 bp, Gossypium hirsutum
  Clone ID: LIB3272-021-P1-K1-E1
gtagagatccgactttagatggcgacattgtacgcgctgttttctcgtttatgagagatgctagcgctgatcacgtgggcatataattacgcaggtgcgatcgccaggcaagtgatatgcaagattgcggacgacaccgacgtttacgtgtcattattaacaagatcgatacatattgaacgttaaacgcaccgagggactaaccgatcttttgatggatgagcaaagtgcctaaagagccaatgccttagcggttctatgtgacacttatcagagattccgggggacgtatggccacccaatgttttgagccct

SEQ ID NO: 23191 - DNA, 160 bp, Gossypium hirsutum
  Clone ID: LIB3272-021-P1-K1-E12
aattccaactgttgcaatcattgcctttccactactgcttcttttctctttggcatggatctcaagaagaaaaacaaactcgaagaaaacagcaccagaagctggtggagcatggcctattattggtcatctccgccttttaaaagggccacaaccacct

SEQ ID NO: 23192 - DNA, 111 bp, Gossypium hirsutum
  Clone ID: LIB3272-021-P1-K1-E2
gtttaatttactactgtatcttgtcattgtcaagagggtgccccctttggttttccaaggtggctcgaaacttttatgattttcgttgaagctgcggaattatttattatg

SEQ ID NO: 23193 - DNA, 412 bp, Gossypium hirsutum
  Clone ID: LIB3272-021-P1-K1-E3
taaaattatctgtttttcacattgataatcttctcttctcgatctatccgcttcgggtttgagagagaagagataaagaacatagagaaaaagagggtaaaatggcgcatagagtacatcacgagtacgattaccttttcaagatcgtgttgataggcgattctggagttggaaaaacgaatattctctctaggttcaccagaaacgagttttgtttggaatctaaatccactatcggcgtcgagttcgctactagaaccctccaggtagagggaaagactgtcaaggcacagatttgggatacggcaggtcaggaaagatatcgagccatcaccagtgcttactacagaggggctgttggtgcacttatggtctatgacataacgaagaggcaaacctttgataatgttca

SEQ ID NO: 23194 - DNA, 410 bp, Gossypium hirsutum
  Clone ID: LIB3272-021-P1-K1-E5
gaagaccaccgccggcagcggtaagaagaagaaaaagaatagtaatagcggtggtgtgagtgatttcgacggtgttacgggagcatgtgggaacgagttgggtgactcgggtcgggcgaatttgagatccgactcgctgagtttgcggttggggaatttacagaagtatgttgaaggtgaacacgtggcagccggctggcctgcttggcttagtgccgtcgccggagaagccatccatggttgggttccactcaaggccgactcttttgagaagcttgagaagatagggcaaggtacatatagcacagtgtttcgggctcgagaccttgagagtgggaaaataggtgctctaaaagagggtcgttttgacaattttgagcccgagagtgttcgattcatggcaagagaga

SEQ ID NO: 23195 - DNA, 313 bp, Gossypium hirsutum
  unsure (1)..(313): unsure at all n locations
  Clone ID: LIB3272-021-P1-K1-E6
ccggcacgtatacgagctttcacaagtacattcaagcccctcaccatggattcttaaacaaagataagatttacttatggtgggatggggataaaaaagataaacacacatactgtatctatatgtactaatttggtgggttattgtattattagaagctgagtttatttgttggtgtcatttgtcttgttcatgttataagctgtaaagcttttattgacattcttttcttcatatcatacgagggattcgcgtgtttgtcnaatttttaattttttttaaaatttttataattttaatattttataatttt

SEQ ID NO: 23196 - DNA, 399 bp, Gossypium hirsutum
  Clone ID: LIB3272-021-P1-K1-E7
gcatgtataaaaactggttaccttcactgttcgctttcatttttttttatcttttctgatcgagaatcagataaaaatatcttattctacaatattttccgatcaaatcgagatccccgcgaaaatgaacgacggagatgtttccaggcagattcagcagatggtgagattcatccgccaagaagcagaggagaaggctaacgagatctctgtttcagcggaagaggaattcaacatcgagaagctccagttggtggaggcagagaagaagaagatcaggcaagagtacgagaaaaaggagaagcaagttgaagttcgaaagaagattgagtattcgatgcagcttaatgcatctaggattaaggtccttcaagctcaagatgatgtggttaatgaaat

SEQ ID NO: 23197 - DNA, 403 bp, Gossypium hirsutum
  Clone ID: LIB3272-021-P1-K1-E8
caacggcacctttgattgccagcatggccctactgaatgcttgttgaacactgtggaagcttgtgcaattgatgcctggcctaaactgaatgaccatttcccatttatctattgcgttgagaatttggaattggagcgcaagccccttgaatgggaatcgtgctttaagaaattgggattggaatcaaagcctgttaatgattgttataacagtggactggggcaaaaacttgatctacaatatgcagccgaaacaagtgcccttgaaccacctcatacatatgtaccttgggttgttgtggatgggcaaccactttacgaggactatgaaaactatataagctatgtgtgcaaggcttataaaggtgctaacatgcccaaggcttgtagtggactgaccttc

SEQ ID NO: 23198 - DNA, 403 bp, Gossypium hirsutum
  Clone ID: LIB3272-021-P1-K1-F10
ctttttggacaccgtgagaatcggagaccgagaatccgtctttttagggtttggttcggattttaatttttgtagcaatggcggatgattcggagagtaagcagtcggcggtggagtcgatgatggagaagatcagcgagaagattcacggcaatgattcatcgtcatcttcggattcggatcatgagaaaccggcttccccttcctccgttaaggctaagatttatcggttgtttggaagagagagaccagttcatcatgtgcttggtggtggaaaacctgctgatgtgttcttgtggaggaacaagaagatttcagctggtgtccttggtggagcaactgcaatttgggtcctttttgagttgattgaataccacctacttactttaatatgtcacatttc

SEQ ID NO: 23199 - DNA, 340 bp, Gossypium hirsutum
  unsure (1)..(340): unsure at all n locations
  Clone ID: LIB3272-021-P1-K1-F11
gaagaagcccattagactgggaatccagagtaaaaatctccctcggaattgccagaggaatttcccacgtccattctatgggcggtccaaagttcactcatggaaacatcaagtcctcaaatgttctcatcaatcaagaacatgatgggtgtatctctgatttgggtttgacccctcttatgaatgtccctgcaactccatcccggtcagtggggtatcgtgctcccgaggtgattgaaacccgtaagcatacgcataaatcagatgtatacagctntggtgttttgctcctagagatgctgactgggaaagcaccactacaatcacctaaaagggatga

SEQ ID NO: 23200 - DNA, 212 bp, Gossypium hirsutum
  Clone ID: LIB3272-021-P1-K1-F12
cagcttctctgtcaacaacttgccgttgttttttattttcttgcttaaacaaggttaacaagagatggcggatgaggatattcaacctcttgtgtgtgacaatggaactggaatggtcaaggctgggtttgctggtgatgatgcccctagggcagtcttccctagtattgttggtcgcccacgccacacaggtgtcaatggtggggatggtc

SEQ ID NO: 23201 - DNA, 407 bp, Gossypium hirsutum
  Clone ID: LIB3272-021-P1-K1-F3
gatgaggaaaatcatgggtgccaaagttcttttcttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgttctgtctgcta

SEQ ID NO: 23202 - DNA, 398 bp, Gossypium hirsutum
  Clone ID: LIB3272-021-P1-K1-F4
gcaaaatggagtgctgtaggaggcctaataggagtgatatacatttgtcagtggaagaagaggccaaattggaggagcagaccagggattactttgatcacacagcacctaaacgtcacactaagcctcaacgaagcgactattcttccaactacgtcgacgctcttgccgccgctgattccggtatccctgaatacctcgagtttcaacgtctagagaatgatccccagaaaatagtttacaatggaagtgaagtgagagaagaatttgtggagactgaatattataaggatctcaattgcgtcgacaaacaccaccacacgacaggaacaggtttcataaaggtagagaacgacaatggcagaaactttaatttggaaccagattcagacaccagc

SEQ ID NO: 23203 - DNA, 264 bp, Gossypium hirsutum
  Clone ID: LIB3272-021-P1-K1-F5
atctcgtctctctctctttcacctctctagaaaaccctgcatttcaccttcttcactgccattttcttatatctcgaaaccccataaaccaaaggatcgaacccatttcagattgtattcaatggcatcatcggacttgaaagaatcagctgccaataaccctgggcttcatactacccctgatgaagctaccaaagactacatcatgcagcaaactatgtttcgaattaaggatccaaaagccagtcttgattttttactctc

SEQ ID NO: 23204 - DNA, 395 bp, Gossypium hirsutum
  Clone ID: LIB3272-021-P1-K1-F7
gaaacatcctaaaattttcgtggttaaatgcttctgaatcctttgttgagagcatagccaaattgaaaacagcgtgtttggcaagaaagaaatttgttatcatggcgttagaagctgttgtgtttcagcgagaccctttctgctatggcggaagtggaccctgcaacacctatggcgttggttttcaacaacaagaagaaaaagctaattacagtaacaatggagaaatggtttccaaaagtggaggaggaggaactagggggtcttcatcgtcttctttcatggtgcaccaaaaggaatggccatgggatttcaactcttcttcttccccggatattggcttttccaccggtggaccgatattctctccgacggaagcaccagcaatcgacacc

SEQ ID NO: 23205 - DNA, 404 bp, Gossypium hirsutum
  Clone ID: LIB3272-021-P1-K1-F8
aaaatccttcaaaatacgaaaccgttgaagactttccgttagatctgaaaaaaagctccctccacggtggcgccgtcggggccgcaagccctctctcgcagaaaaccaccaccttcttcaagtccaggtgcgagcagagaagatcgaacagaaccttctagaaagagtctgacggtcgattatccattttggcaacagaattggtttatcggattactattcctgatggcgatgggattcttaggtttcgctctcttcctcttcctatctctcgatctcgatcaaggttccccttcctccgcatctgccgcctcctcctcctccacttcccaaaacgttgagattacttatgggacggttctaaagctaatgcacgagaaaacgaaatttaggctgcattcaca

SEQ ID NO: 23206 - DNA, 401 bp, Gossypium hirsutum
  Clone ID: LIB3272-021-P1-K1-F9
ctctgctctaagtcttcttcattctcactctctctccactgaactcttgctaaacggtatcgttttagtcagtctttcatcaatggcgaaagaaccggttcgcgtcctcgttactggagctgcaggacaaatcgggtatgctcttgtacccatgattgctaggggagtcatgttgggtgctgaccagcccgtgatccttcacatgcttgatatcccacctgctgcggaggctttgaatggtgtcaaaatggagttggtggatgctgcttttcctcttctaaagggtgttgttgctacaactgatgttgttgaggcatgcactggagtcaatgttgctgtcatggttggtggtttcccaaggaaggaaggaatggagaggaaagatgttatgtcaaagaatg

SEQ ID NO: 23207 - DNA, 410 bp, Gossypium hirsutum
  Clone ID: LIB3272-021-P1-K1-G1
gttattttcccaccttctttcccgaaaaaatttaatctcaaaattttctcgggaaagcgagggtttattacaaacacagctatatagtggagcagtaatcatgagctttcgagatctggaagccggacggccattggtgtcgaggcaaaacctaatcaacggcaagcaagacgccacgcaagcagttgcctctggcattttccagatcaacaccgcagtctccacctttcagcggctcgtcaacgccctcggtactcctaaggatacgcctgagctccgagaaaagctgcataaaacaaggctacatattgggcaattagtgaaggacacttcggctaaacttaaacaagctagtgaaacagatcacagtgccggaattagtgccagcaagaaggtagcagatgctaaac

SEQ ID NO: 23208 - DNA, 370 bp, Gossypium hirsutum
  Clone ID: LIB3272-021-P1-K1-G10
gatccagcggtctactctacaacttatacatatatttcccaattatgaaatccacccaacgctatgatcagtcaaccctcgacacggtttacgggttcaaagacatcggagacaactggggcgttctttgcggcttactgtacactttcaccactccatctaaccgacggatcgcttatttcggtggaccctgcttgctccttgcggttggtgctctacaatgctttatggactacttgctaatcggggcttacgtggttgaaatgatccctaaaccttcagctgcagggatgtgcatactcaagacttcatcaacatcatgctcagactctcttttatactgagttcgatgtcactgctgagccgaact

SEQ ID NO: 23209 - DNA, 332 bp, Gossypium hirsutum
  Clone ID: LIB3272-021-P1-K1-G11
gcgaaagcttatctcttttcgtctctgaatctgatcaatcaacacctgaaaaggaaaacttacaaacaactactactagtctactacccagcactagaagcagctcgtagccagccatggatgaagagtacgatgtcatagttctaggaactggtctcaaggaatgcatcctcagcggtcttctttctgttgacggactcaaggttctgcatatggataggaatgattactatggaggagagtctacatcactcaacctcattcagctctggaaagagtttagaggaaatgataagccctctgctcatttgggctctagcagaaaatataat

SEQ ID NO: 23210 - DNA, 408 bp, Gossypium hirsutum
  Clone ID: LIB3272-021-P1-K1-G12
ctttgcgaagctatgccctcaccattgctctactccactgctcttatcaactgtcattaaagaactcttattttgtttatcttcttcatcacatttggccaccattttactgctttgtgttcatggagtttcatagattcttattttatgcttcaattattctttcaatttcagtttatttgtttccgataatggcgaattcaatggggatcaactatggacaaatagcagacaatcttccgtcaccggaagatgtggttccgattgttaaatccatcggagcgaccaaagttaagctctacgacgcagatcccaaagtactcatagctttcgccaacactgtcgtcgaattcattgtcggcttaggcaacgaatacttaaacaagatgcgagatccgcccaaagccc

SEQ ID NO: 23211 - DNA, 378 bp, Gossypium hirsutum
  Clone ID: LIB3272-021-P1-K1-G2
gtaaaacacactgacctcagaaagagtacccaaaagaaaaacgctgattaaggaaggatttctagggttttttttttttccgtatcaataagcgatggcaatggcttgctctcaaacccaaagggaggcgtttcgcccctttgatctctccccgtccaatttctgctgcccgatcctctcctatcgttcccactcacgaatatgagggtccgattgtggtgcgcttatttcaactcatatctttagaaaccggatgaagagtgttaagaatattcagaaaaaaacaaaggctataaaaatggttgctgcctaaaattgagagcatttcaactaaagctgaaaattcccgaggcctttggcagccatttactgcacttt

SEQ ID NO: 23212 - DNA, 406 bp, Gossypium hirsutum
  Clone ID: LIB3272-021-P1-K1-G3
ctttctcacagtttttcttgatttttgcctttcccagacttaaaagcttcggtttttattttcactttgaaaaacgaaaatggataagattaagagtatgatgcgcgctgttcagtacagtaaatatggcggaggagtcgccgatctcaagcatgttgaagttccggttcccagtccaaaaaaggatgaagttttgatcaaagtagagacagctagtattaacccaatcgactggaaactacaggatggggtagctcggccatttttacctcggaaattcccccacattcctggtaccgatgtagcaggagaagtcgtacaagttggatcagaagtccagagtttcaaagttggggagaacgttgttgccgtacttggtaatggaggtgcactagctgaatatgct

SEQ ID NO: 23213 - DNA, 324 bp, Gossypium hirsutum
  Clone ID: LIB3272-021-P1-K1-G4
aaaaaagaaaaaatgatgcttggagaaactcatcgtccaaatccaaccgtccacgtaccaccttggcctgatcttgacgatgatcagacggatgtagtttactctcctatccattacaatgcaaccgacaacaacttgagcagtaacggcaacccgttttacctccatgaagcgttatcagctttacaacgttatttgccatcgaacggcccggatgttgagttggattccgagtttccgggtttggatagtccggattcaccggtcgatgcttattcctgtgaccatttcaggatgtacgagttcaaaatccggaggcgtgct

SEQ ID NO: 23214 - DNA, 296 bp, Gossypium hirsutum
  Clone ID: LIB3272-021-P1-K1-G5
gctaatcacagtataactgtagaaagggttgcaatattgtacagaccaagaggatgggggtggatggtcagcaggaagcatgttctttgtaaagacagagtcgcagatcattaaagggatgcgtacgaagcttgcgaggcctgtctccttactgactatagcgatagcttgaaccacaacgacttgcactgggcgtgaaagtataacaagtgatgatgatttcagcatatccacagctggtgctccccctttatgcctttgggcagacatagaacacatggcttattgtctaatgc

SEQ ID NO: 23215 - DNA, 357 bp, Gossypium hirsutum
  Clone ID: LIB3272-021-P1-K1-G6
ggcctgtttactcaggctggctttaatgacccttctcatgatgatgcatctcaaagccactttggcgtgtctaatccaaaccagcttcagtcccagggcttgatgaattctctctactcccagcccttttcccactacaacacacagccactgaacttgcctgctcctcaacagcagcctcagcaggaccagggctcccaaaaccagaaatttcactataacggttaagaataaagatgcatattgctttgatgggttatagtcttttgcaatcagcaacttggtttgtgctgtccttgtttgcccaaaacatacaactccgaagatgcttaaccgtttgcctgttttgaggtcagt

SEQ ID NO: 23216 - DNA, 391 bp, Gossypium hirsutum
  Clone ID: LIB3272-021-P1-K1-G8
cttcccgtaagaatctcttacatggtgtagttttgtctggtggaatatgtcctattaccaagaagatgatgctgaatacatagcagaagagtatgacatggaggacatagatgacatggatgaagagttctgcggcagagatatgtctggctcggagtctgatgttgatgaatttgattactcgaataataaaatatctgatacttctgctgctgaagctagaagaggaaaagacatccagggaataccttgggatcagctcagcatcactagggaaaaatacaggcaaactaggctagaacagtacaagaactatgagaatatcccccactctggggaagtgtcagggaaggattgcaagattaccaagaagggtgcctcatactatgac

SEQ ID NO: 23217 - DNA, 381 bp, Gossypium hirsutum
  Clone ID: LIB3272-021-P1-K1-G9
cagagatcaagtggacagtctctgccaaagcattctcgaggatctatggagtggccttgaatcttccaaggtatctgtgaggtttgaaggatctagttccctatctgcaggataaatgttatgaaagtttgtcaactataatgaaagaactcaaaactgagcttgatatcttgtacactgccattgggagtgaacacaatgaaggtaattcaatgtctccttctataattgttgagatatctctttttattgggagactcttgtttgcattcgagaatcactccaaacacattcctgtggttcttggctctccacgcttctgggtgaaatacacatctcctgcaatttttgagaagctgccttccttattgtggcaatcta

SEQ ID NO: 23218 - DNA, 403 bp, Gossypium hirsutum
  Clone ID: LIB3272-021-P1-K1-H1
ctcattcctgcgtcgcttgtgagaatagaggcagcagtggcttgacgttccgcttggctcccttcttgcagaagccaaaagtttgagttaagaacaatggcttatgctacaatgaagccgaccaaacctggtttggaggagtcccaggagcagattcacatgatcaggatcactctctcctgcaagaatgtgaaaaaccttgagaaagcttgcgctgatttggttcgtggtgccaaggataagagactgacggttaaggggccagtgtgaatgcccaccaaggttcttcacatcacaacgaggaagtctccctgtggtgaacgaacaaacacatgggatagatttgagctccgggttcacaagcgagttatagatcttttcagctcccctgatgtggtcaagc

SEQ ID NO: 23219 - DNA, 262 bp, Gossypium hirsutum
  Clone ID: LIB3272-021-P1-K1-H10
ttcccgcctcgacccacgcatacgttgtattgtaagaatccgttttcattatacaagaaaggcaacaatggggcggcggaatagtgacaacgcgcaggcatttctttgacttactaaactatattaacatccttgtcgacaaagtaacattgggtggtgataactgggtgtacatacatgccaacagcgcatatagtcatatgtctctacagaaagcattgtataaaaattagcatcttgatccatggtggttccatttgcc

SEQ ID NO: 23220 - DNA, 414 bp, Gossypium hirsutum
  Clone ID: LIB3272-021-P1-K1-H11
ctttctcagagtttttcttgatttttgcctttaccacaaacttaaaagcttcggtttttattttcactttgaaaaacaaaaatggataagattaagactatgatgcgcgctgttcaatacagtaaatatggcggaggagtcgccgatctcaagcaagttgaagttccggttcccagtccaaaaaaggatgaagttttgatcaaagtagagacagctagtattaacccaatcgactggaaactacaggacggggtagctcggccatttttacctcggaaattcccccacattcctggtaccgatgtagctggagaagtcgtacaagttggatcagaagtccagagtttcaaagttggggagaacgttgttgccgtacttggtaatggaggtgcactagctgagtatgctgtcgct

SEQ ID NO: 23221 - DNA, 415 bp, Gossypium hirsutum
  Clone ID: LIB3272-021-P1-K1-H12
aattatttaagcagcacgtcacaagggatctagagcaaggttagtgaccttgggttgagtgtagagatgaggaaaatcatgggtgccaaagttcttttcttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaagtacattgagaccatcaaaagagctg

SEQ ID NO: 23222 - DNA, 410 bp, Gossypium hirsutum
  Clone ID: LIB3272-021-P1-K1-H2
ggtaatgaaaagggagcacctcatgaacctaaacctcctcatagacacttattgagtgtggaagttgagggcacacataaacctccacaacactcaggtggtaaacctccacgacattcaggtggtaaacctccacatgttgaaggattccctggtgacaaaccatccaagggtaagggaaagggggcacctcatgaacccaaacctcctcacagacacctattgagtgtggaagttgagggcacacataaacctccacaacaatcaggtggtaaacctccacgacattcagggggtaaacctccacatgttgaaggattccctggtgacaaaccatccaagggtaagggaaagggagcaccttatgaacccaaaccttctcatagacacctattgaatgtcgaagttga

SEQ ID NO: 23223 - DNA, 409 bp, Gossypium hirsutum
  Clone ID: LIB3272-021-P1-K1-H3
ctttcatttcacccttttcctccatatcttcagtgtctcactctctccgtgctgcactccagtttctcctttccctcttcgaagaaaaaatgcgtgagatccttcatattcaaggtggccaatgcggcaaccaaatcggagccaagttctgggaagttgtttgtgctgagcatggcatagatgcaactgggcgttaccaaggagacttggatcttcaacttgagcgaatcaatgtctactacaatgaagccagttgtggtagattcgttcctcgtgctgttctcatggatcttgaacctggaaccatggacagcatcagatctggccctgtcggtcagatttttagaccagataacttcgtttttggtcaatctggtgctggtaacaactgggctaagggccattacac

SEQ ID NO: 23224 - DNA, 370 bp, Gossypium hirsutum
  Clone ID: LIB3272-021-P1-K1-H4
aaaaaatggctcatcgtatggcgttttctgtgtgtgtcgtttcgtattttttattcatcgggttgatatcgtcggaggctttctcggtcgtcggatcagaagttgatccgttgatcaggcaagtaacggacggtcaagatgatggagtggagacacagcccttgaccgctgagcatcacttctcgctgttcaaggctcggttcaagaaatcgtacggctcggaggaggagcatgattaccggttcaaggttttccgggcgaacttgagacgagcggcgcgttatcagaagcttgacccgtccgcgactcacggtgtgactcagttcttcgatttgactcccggtgagttcaagaagaggtttttggggtt

SEQ ID NO: 23225 - DNA, 412 bp, Gossypium hirsutum
  Clone ID: LIB3272-021-P1-K1-H5
acgaaaaatgatgatcggagaatcaatccaaccaaatcccaccatcaaaatccccgtaggggacccattcaacgatccgacggctagctttcactccgttaactttaactacaacaatgcagtcagtagtccttgccccgtcgattacctcgggtctctccaccgttacctaccgtcaaacgactacgagtccgattcgctgagtgatgattcggacttacctgttgatgcattctcatgcgaccatttccggatgtacgagttcaaggtgaggaggtgtgctcgtggaaggtcacatgactggactgagtgtccgtacgctcaccctggtgagaaggcccgaagaagggacccgagaaagttccattactctggaactgcttgccccgatttttgcaagggaagctgtaag

SEQ ID NO: 23226 - DNA, 423 bp, Gossypium hirsutum
  Clone ID: LIB3272-021-P1-K1-H6
aaaaaaagtgtctcatttttagcaaagttacagtcgtcctcatcgaacaactatggcagccatcaaagtccacggaagccctatgtccactgctacacagagggttcttgcatgccttcacgagaaaggtactgattttcagtttgttcccataaacatggctgccggtgaacataaatccgaaaactacctttccctcaatccattcggtcaagttccagcttttgaagacggggacttaaagctcttcgagtcaagagcaatcacccattacattgctcatgaatacagcgacaaagggacccaactcttaatccctggctctaacaaggatatggctgtcttagaattatggaaggaagtggaagcccaccagttcgattctccatcttcaaaaatagcctgggaggcgttttacaagcc

SEQ ID NO: 23227 - DNA, 403 bp, Gossypium hirsutum
  Clone ID: LIB3272-021-P1-K1-H7
aaagaaaagaaaaatggttctgctagagaaactttgggatgatgtagtggccggtcctcaaccggaacgtggccttggccggctgaggaagatcaccaccaccccacccttgtccaccaaagatgaggcttcatcaatggcgatgccgacgagtccgacgacacctgggacaccatcgacgccggtgtcggctcgtagggacaacgtgtggaggagcgtgttcaatccaggtagcaaccttgcaaccaaaggtattggcgctgaagttttcgacaagcctcaacctaactctcctactgtttatgactggctttacagcggggagacccggagcaagcatcaccgttgattaggcgggggctgacggcggcggatggtagcaaaaccactagcagaaggttgc

SEQ ID NO: 23228 - DNA, 404 bp, Gossypium hirsutum
  Clone ID: LIB3272-021-P1-K1-H8
ctcaaccaaaaagcactctttctttgttttcccctcgtcattcacacttcaaacaaaaacatactcgtcttttaggctttgaagaacgctagaggcagtctgtcacagccaaaggccttctttgaaactgtactctgtccaaaggcctttgaaactgtattctgtccaatatgagtatggagaaacaatatttggattgcctactagtcccgatggggattcttttaatggttgcctaccatctatggcttctctatcgaatcttaaaacatcccaccaagactgtcatcggcatcaatgccatcaaccgtcgtttttgggttcaagctatgatggaggacgggtcaaaaggagtattggcagtgcaatcgctgcgaaacaatataatggcgtcgaccttatta

SEQ ID NO: 23229 - DNA, 393 bp, Gossypium hirsutum
  Clone ID: LIB3272-021-P1-K1-H9
cccatctctctttattagtctccattaaaagaatggatgttaaagcaaggagtagtagtggtccaaacatggtaagtactgaagaagaggacttgaaaagaggtccttggactattgaagaagattttaaactcatcaactatatttccattcatggcaaaggtcgatggaactctcttgctcattctgcaggtcttaaacgaactggaaaaagttgtaggttgagatggttgaattatcttcggcctgatgtccgacgtgggaacatcacacttgaggaacaacttttgattcttcaacttcactcgcgatggggaaatcgatggtccaaaatcgcccaatacttgcccggaagaaccgacaatgagatcaagaactattggagaactcgtg

SEQ ID NO: 23230 - DNA, 427 bp, Gossypium hirsutum
  Clone ID: LIB3272-022-P1-K1-A11
ggaatatgtgggataacaatcaacaccagttcacattagagatgacagtggtatcagctcaagggctgaagaacacttcttcttttatcttcacacaccgtctcaggcctttcattaccatcaccaccttcccttcgccgttagaagctgccgatttaaagagctgccgtgggtttcaaacgagggtcgatgaccaaggtggtgttaaccctacttggggtgataagttccatgttcccattcatcataccttctttgctaatcgatactcgtgtatatatctccagttattcaccaaaaggctcatttccggcaaggctcaactgggttggtgccagattccggccgccgatatagggttgccgccccggggatccgttaggcaactgtattaccggctgagggaggcagatgggacgaggactca

SEQ ID NO: 23231 - DNA, 406 bp, Gossypium hirsutum
  Clone ID: LIB3272-022-P1-K1-A12
gaattatactactataactccaccactttccaccagatttacattgcagatggcttcatcaatgctgtgggcttcaagggcggcttcttacctcaagatctctgtcttccacagaggcttttccactgttctaaaggatctgaaatatgcggattctcatgagtgggtgaaggttgagggtgactctgccactattggtattactgatcatgctcaagatcatttaggtgatgttgtgtatgttgaattacccgaagtgggagctgctgtaaagcaaggtgaaagttttggagcagttgaaagtgtcaaggctacaagtgatgttaattctcctgtttcaggaaaagtggttgaagttaatgatgagctcagtggctctcctgctacagttaactcaagtccatat

SEQ ID NO: 23232 - DNA, 222 bp, Gossypium hirsutum
  Clone ID: LIB3272-022-P1-K1-A2
gtagccggcagctgcgtctctctcttcatctctctcaaccaaaaagactttagcttttacctaagagagagaccatgtcggtttaccaggatctgcatctgcgctgacgagcttctttgttactcattctactacacggcaatctggtatgacttactctgcttacgaagagggaatgtgagttgcgcacggtgctattgaagatagcactggtgccaatcc

SEQ ID NO: 23233 - DNA, 411 bp, Gossypium hirsutum
  Clone ID: LIB3272-022-P1-K1-A3
cgcagggcttttttaacctctccctctctctctagaaccctcactattcttttcttttgtttgtttatatggcatctcaagccagcctcctccttcaaaaacagctcaaagatctttgtaagaatccggttgatgggttctcggccggattggttgatgaaaacaatatctttgaatggagtgttacaattatcggaccacctgatactctttatgaagggggatttttcaatgccatcatgagctttccgcccaattatccaaacagccctccaacagtgaaatttacatcagagatttggcatcctaatgtttatcctgatgggcgtgtttgcatatcaattcttcatcctccaggtgatgatccaaatggttacgagcttgcaagtgagcgctggatgccagtccata

SEQ ID NO: 23234 - DNA, 425 bp, Gossypium hirsutum
  Clone ID: LIB3272-022-P1-K1-A4
ggcgccgaagagtttgcgaggaaacagggtgtggagttggtggacaatgaatatttcattacagaagacaatgtggggatgcttaagttagcaaaagaagcaaactcaatcctgttcgattaccgtatcccaaccctcaccacctgcggtggcagcgcagccatggaaaatcaattacaaatgaacggcttaccaatcagtctctacgccccagaaacagtaggttgcgttgtagttgacaaacaaggtcattgcgctgccgctacttccaccggtggattaatgaacaagatgaccggaaggattggtgactcgccgctgattggttcagggacttatgcttgtgacttagtggctgtttcatgtaccggtgaaggtgaagccattatacgaagcactttggctagggaagtagcggcggtgat

SEQ ID NO: 23235 - DNA, 421 bp, Gossypium hirsutum
  Clone ID: LIB3272-022-P1-K1-A6
taaaaaatgagctttcttcaggccttgtcaattttccttttgcttttgttggatgtagtcgtaggatcagctgagcagtgtggaaggcaagcaggcggtgctctttgccccggtggtctatgttgtagccaatttggctggtgtggcagtactgctgactactgcacagttcctggttgccaaagtcagtgcagcggtagtggccctgcccctgggcctggtgggctaaccaatcttatatcaagagagacctttaatcagatgcttttgcataggaacgatggggcttgtcctgcccgtggcttctatacatatgatgctttcattgctgctgcccgttcttttcctgcatttgctacaactggtgaccaagctactcgcaagagggaaatagctgccttcttagcccaaacttcccatg

SEQ ID NO: 23236 - DNA, 308 bp, Gossypium hirsutum
  Clone ID: LIB3272-022-P1-K1-A7
ggaaaaacaacgctttctttgggaattcaagcatggcggggatggaaggaggagggacattatcggaagtgtatcaaagcgctagaaagctacttcttcgagcaagggatgggatcgaacgcttagagagattcgagagctccgtctccggtaccgattctcctgaactctccttcgccgtgaagaaagatatctctcagatccactctctatgcgctgatatggatcgcctctggcgttctatccccgccaaatctcaacgcgatctctggaaaagaaaagttgaacaagtggctgaagaggctgac

SEQ ID NO: 23237 - DNA, 417 bp, Gossypium hirsutum
  unsure (1)..(417): unsure at all n locations
  Clone ID: LIB3272-022-P1-K1-A8
ttatttagcgaaagcagagaccaggtgaagagagggcgagggatctttagatatttctagagctttgtcagccaaggttctaattagccttaggatagggtcttcagagaacagagtggcaagcatcactcatgaagagtctcatgataagctctatctcccaagctctcaacaancttatcctcatgtnccccttctggtgtccaaaaggagagaatggaaccagaggacatgtatgtattatcaggagatggggctatcatatcttcaccttctccaaagccataccctcataagcctcctaaatgctctgattgtgctccgcttttcatgaaggcatatcatatgcgtaatgctggggctgttatccacagtcatggaatggaatcctgtcttgcaacaatgatcaatccacat

SEQ ID NO: 23238 - DNA, 411 bp, Gossypium hirsutum
  Clone ID: LIB3272-022-P1-K1-B1
ctgagatccgacactccacatcgcagcaatgggtgaggaagtaaaggctttggttcctgagtcactgttgaagaagaacaagaggaatgaagaatgggagcttgccaaaaagcaggagctcgaagccgccaagaagaagaatgtcgagaaccggaagttgattttcaacagggctaagcaatatgcaaaggagtacgaggctcaggaaaaagagttgattcaattgaagcgggaggcaaagttgaaaggaggattctatgttgatccagaagctaagcttttgttcattgttagaatccgcggtatcaatgccatgcacccaaggaccagaaagatcttgcagctcctacgtttgagacagattttcaatggtgtttttcttaaagtgaacaaggcaacaatgaacatgct

SEQ ID NO: 23239 - DNA, 388 bp, Gossypium hirsutum
  Clone ID: LIB3272-022-P1-K1-B10
atttcttaatcactcaatccccaaaaggaatgaaaacaatgagcactggcctcttccgaccactctttcactcgggttcttctttagtagcttgctagtttccattgtgaaggccacaaccggaagcagcgacaaacaaggatggttgggagaacacataaacaaaggaagattagattgtttctatgggctcctagctgcattaagcttccttaactttggattattccttctttctgcagtatggttcaggaagaaaacagttaaacaagctcccaaaatggagatcgttgttaaagaatcaacgatcgaggagaaatgctagttttccatactgaatgttacttgaaatcttctttaataaccaaattattactatatatatata

SEQ ID NO: 23240 - DNA, 226 bp, Gossypium hirsutum
  Clone ID: LIB3272-022-P1-K1-B12
gttttcttgtagtttaaacctttcactgattccaactattgaggtttgttggcctgggatagcgaattttgtattagaaaatgtcatggacgacgatcgctatgttatggatgatggtagcgagagaagtgtctgactctgattctgactcagaatatgtagatgtgagcttcgcccaccccttttaagaactctatagacaatagagatgggcttagtgagaagc

SEQ ID NO: 23241 - DNA, 395 bp, Gossypium hirsutum
  Clone ID: LIB3272-022-P1-K1-B2
aaaaaataaaaccctttgaaaaccaaagaaggaagaagaagatgtcgtggcaagcttatgtagatgatcacttgatgtgtgaaatcgaaggaaaccatctctctgccgccgctatcatcggccaggacggcagcgtttgggcccaaagcgccagtttccctcagctcaagcctgaaaaaattagtgccatcatgaatgactttaatgaaccgggttcactcgctccgaccgggttgcacctcggtggcacaaaatacatggtgatccaaggcgaaccgggagctgttatccgagggaagaaaggacccggaggtgttactgttaagaagaccaatatggccttgattatcggaatctatgatgaaccaatgacacccggccaatgcaacatgatc

SEQ ID NO: 23242 - DNA, 404 bp, Gossypium hirsutum
  Clone ID: LIB3272-022-P1-K1-B5
attcacacacaactacttcacttccccatcacaaaaaatatattcttgacctgcatctttttggcaatcaattttgtaagcaagtatggctaatgacgttgcggttggtggtgagttccaagccaaggtctaccatgatccttcaccagcttcattggtggacggggaggagttgacaaaggggtcattttatagggctgtcatagccgagtttattgccacgctcttatttttatacatcactgtgttgacagtgatcggatacaagagtcaggttgaccctgataagggcagtgaccaatgtggtggagttggcattcttgacattacttgggcttgtggtgggatgatctctatccttgtttactgcactgctggcatctctggaggacacatcaacccat

SEQ ID NO: 23243 - DNA, 304 bp, Gossypium hirsutum
  Clone ID: LIB3272-022-P1-K1-B6
ggtacaagattgatggtctaggaactgctcctaaggggtaatatgcgaaactaggagcactcaaacctgggtctggcctgatagtctacttactactgtgctgacaacggtagttaagtttgttgcaattcaacattaatctttgttgtaagtggatcgtgctgacgaatgggctttaacaagtagaatgacaactgttcaagctcttaaactgggcttggatgcttcaatctagatgattgatccggtcaatgaagctgtgaatttgacgtcacaagcatttaacgtggacaagtctacccta

SEQ ID NO: 23244 - DNA, 433 bp, Gossypium hirsutum
  Clone ID: LIB3272-022-P1-K1-B7
gacgcactagataaacaatgcgcatggactattatgccgtctaataagctagattgagagagttatgccttgtgagcacagctgtacgcagcaaaatatgatgggaacaaggtctgtgtctgtcccctgcacattatatatactgaagaactagctactcgtcccatctgagagaatgatggcatctgtttcatgtacatggcactatccctttatacacctcaaattgtattctttttttatgctaactttaatactgcatggaaaaatgggtgagaagctcgtgtttcatagcaaggatgtctaagtgggcctgggagagacaaatgctagttgtccggaacaatgatcagagctatgtttaggaggaagcgctgattatcactggccaaccacgaatacttggtatgtgataaataataatgctcttcta

SEQ ID NO: 23245 - DNA, 430 bp, Gossypium hirsutum
  Clone ID: LIB3272-022-P1-K1-B8
gaagactatagatgtagattctggtaaaattgatatatgttgggacttgtctaatgctagatttggttccgggccagaaccagttgaagggttttacctggctgttgcatttgaccaggaaatggtgctgcatcttggagatttgaagaaggaagcatctaagaagattaacattagcagtactcctcttagttccgatgctgttttcattgcaaaaagagagcatatttttgggaagaagttttatggtgccaaggctcagttttgtgacaagggacctattcacgatgttgtaatcgagtgcgaccccttcgatcttaaggatccatgccttgttatccgcattgatagtaaaacagtgatgcaagtgaagcggctcaagtggaagttccgcggcaaccataccattttggtggatggacttccggtg

SEQ ID NO: 23246 - DNA, 431 bp, Gossypium hirsutum
  Clone ID: LIB3272-022-P1-K1-B9
tttcatttctccaatatggctagagggttgaagaaacatttgaagaggctcaatgcccccaggcattggatgcttgacaagcttggtggtgcttttgcacccaagccatcgtctggtccccacaagtccagggaatgcttgccattgatccttattttgcgaaaccgattgaagtatgctctcacctatagagaagtcattgctattcttatgcagaggcatgttatggttgatgggaaggttaggacggataagacctatccagctggtttcatggatgttgtgtccattcctaaaacaaatgaggacttccgtctactttacgacaccaaagggcgatttcgtctccatgccatcactggcgatgaaaccaagttcaagctctgcaaggttcgatctgtccagtttggccagaacggtattccatactt

SEQ ID NO: 23247 - DNA, 422 bp, Gossypium hirsutum
  Clone ID: LIB3272-022-P1-K1-C1
gtaacactatcgctttctccgctgccgttttactcttttttggtctcgccggtttggattaggcggtggcggaaatgagcgttgagggtgaggcaactcaacttcgcgatgctgccttgccataataatatctcagtaaccaatgaacgacccactcgtctccctcgaagtcgatgtcgtcgttggcgtcagagccgtgccggtattgccttcgttgcggttgccgcgttgcttatctctactgccgcttggctttctcttgttttctccggcactaccactcatcggtggcgtcgtttgaagtactgggaagggagtccacattccctttccgggtccgattcctcctcttcctccttggtttgattcgacacaagacacttcttgtaaccgcagtctctcttagcgtggaaatggaaaac

SEQ ID NO: 23248 - DNA, 391 bp, Gossypium hirsutum
  Clone ID: LIB3272-022-P1-K1-C10
cggacgcgtgggtggcggccgaaattgtcaccgaaaacacgtcgaagacgggtgattcagtttgaagggtttcagttttaaatatacatatatttctcacttctattgtaaatagacagtaattcagatcaaagggtatccgtttcttttcttatttttcgttttaatttctcgagcttttacggttcaaaaatggcggacaaagctaaaaccgaaaacccatcttttctccatggaaaataccaaccttggccgtatgttgggtcatggaacgttcgccaaagtctaccatgcgaagaaccttcaaacagggtagaatgtcgccatgaaagtggtgggcaaaagagaagtgatccaggtcgggatgatggagcagatcaagcgagagatc

SEQ ID NO: 23249 - DNA, 359 bp, Gossypium hirsutum
  Clone ID: LIB3272-022-P1-K1-C11
gtcgttcgaaaggttatggtttcgttcgattcggggatgaaaatgaaaggtggagggccatgactgaaatgaatggagtgtattgctcgagtagaccaatgaggattagtgttgccactcccaagaaagcatttggatatcagcaacagtattactcacaaggtagacaagcatcgaatggtgctgtggaacaaggtcttcattctcataatgacctcgaacaatgctactatttttgttggaggacttgactcggatgttagtgatgatgatcttagacaacccttttcccagtttggtgagatcatctctgtgaaaataccggctggaaaaggatgtgggtttgtgctatttgcaaa

SEQ ID NO: 23250 - DNA, 416 bp, Gossypium hirsutum
  Clone ID: LIB3272-022-P1-K1-C2
tttctctcttagttttctctcttgtcccatttgagaattcttaaggaattctatttgtttgtaatactttggagatagtaaagttatcatctggtgttagtgcccgaggacgtaggtataatttaccgaacctcgttaaatctcttgtgttctttcttgtcctatttttctttcaatatttgagggtataatagtagtatttaattgtgctattaaattactatagaagggatattctgtctaaggaaagacttggtatttaagagatccatgtgatccacctctcttccctgggaattgaactttgtgtgattttttagtacaataatttacacgcttccgaccctattggaacaacagtcaatacactgtctcgtatggatgaagcattctaagctttcaaaacatcaacaact

SEQ ID NO: 23251 - DNA, 414 bp, Gossypium hirsutum
  Clone ID: LIB3272-022-P1-K1-C3
atcaacttttataagagcgctctccacctcccatcaaagtcccgaaggcagagataaacgaaatggcggaaacatgcgacttcctcgcgacaaagagatgtgcagtggtgagtggaggaaacaagggaattggattggaaatatgtaagcagttggcttccaaaggtgtcaccgtggtgttaactgccagagatgagaaaagggggcttcaagctcttgacaagctcaaggaatctggtctttctcataatctggttttccaccagctcgatgtcactaaccctcttagcgttgcttctcttgctgctttcatcaacacccaattcgggaaacttgatatcttagtcaataatgcagcaattgctggagccaatgtgaactatgagattttaactaccgctgttgaaaaagcga

SEQ ID NO: 23252 - DNA, 428 bp, Gossypium hirsutum
  Clone ID: LIB3272-022-P1-K1-C4
cgattttctcagcaaccaaacaaaaccttccattgtcttctagaactatccaagcacactggtattaatcaatggctcgtacaaagcaaacagccaggaaatcaaccggtggaaaagctccacgtaagcaattggcgaccaaagccgcgaggaaatcagctccagccaccggaggagtgaagaagcctcaccgtttcaggccaagaacagtggcgttgagagaaatcaggaagtaccagaagagtaccgagcttttgatccgtaaacttccgttccaaaggctagtgagggaaatcgctcaagatttcaagacggatctgagattccaaagtagtgcggtggcggctttacaagaagcggcggaagcgtatctggttggcctgtttgaggatactaatctctgtgctattcatgccaagagggttact

SEQ ID NO: 23253 - DNA, 421 bp, Gossypium hirsutum
  Clone ID: LIB3272-022-P1-K1-C5
cttgaaggaagctttgcctttgtgatctatgacagcaagactggaaccgtgtttgctgcactggggtctgatggtggagtgaagctgtattgggggattgcagctgatggctctgtggtcatatctgatgatttagatgtcattaaagaagggtgtgccaaatcctttgctcctttcccaactggattcatgttccacagtgaaggggggctgatgagctttgagcatccaatgaacaaaatcagggcaatgccgagggtagacagtgaaggagtgatttgtggtgctaatttcaaggttgatgtttacagtaaagttaatagcattccacgagtgggcagtgcaaccaattggactgatcactgggattcccattaattagtatttaaaaagaggagagagaagcaaaattaaacataag

SEQ ID NO: 23254 - DNA, 258 bp, Gossypium hirsutum
  Clone ID: LIB3272-022-P1-K1-C6
ctcaaaattcttcttcaatggcgtctcgagttcttgttttggcttcaattcttattttctcttgttttgcagagacatgctatggggcgatctcattctcatcccttcaaagaacacttgttgttactgcttctcatagacaaggacttttgaaagccggggaagacaagatcacagtgagatggggattgaaccagagtttcccggccggtaccgacttgtcttataagaccatcaaggttcagctttgctatgcac

SEQ ID NO: 23255 - DNA, 242 bp, Gossypium hirsutum
  Clone ID: LIB3272-022-P1-K1-C7
ctttttaactctaaagccaagaaagcaagccactaaggttttgagagaagatcaaaatggcttctaaaagatcagcttccatggtcctccttttggcactcaacattctctttttttccctagtcagtgcttgtggctcttgctcttcacccaccccctaacccaaggccaacccaaaccccaacacccccacttctacttcatctgcacgaggcaggtgccctaaggatgccctcaaatta

SEQ ID NO: 23256 - DNA, 416 bp, Gossypium hirsutum
  Clone ID: LIB3272-022-P1-K1-C8
aaacgaattgaagaagattactttcttctctttggatctttccactaaccttcttcaaatctatttaagcgctcatttggagctccctgaatggtttgttcattggcttcaaaattgttggccctcttaacttctttacctgactgaaaaaagttagctctcttgccttcttgggtaagacaatggtatgttggtcattgcatggaatgaagtcataatttgtattggttgccccatggaagaccacacttttgctgttggtcaggagttccctgatgtcaaggccttccgtaatgctattaaggaagctgccattgcacagcactttgagctgcgtattataaagagtgaccttatccgttactttgccaagtgcgccacagaaggatgtccatggcgtattcgtgcagttaagc

SEQ ID NO: 23257 - DNA, 434 bp, Gossypium hirsutum
  Clone ID: LIB3272-022-P1-K1-C9
ctgagatccgacactccacatcgcagcaatgggtgaggaagtaaaggctttggttcctgagtcactgttgaagaagaacaagaggaatgaagaatgggagcttgccaaaaagcaggagctcgaagccgccaagaagaagaatgtcgagaaccggaagttgattttcaacagggctaagcaatatgcaaaggagtacgaggctcaggaaaaagagttgattcaattgaagcgggaggcaaagttgaaaggaggattctatgttgatccagaagctaagcttttgttcattgttagaatccgcggtatcaatgccatgcacccaaggaccagaaagatcttgcagctcctacgtttgagacagattttcaatggtgtttttcttaaagtgaacaaggcaacaatgaacatgcttcaccttgttgaaccttatgtga

SEQ ID NO: 23258 - DNA, 425 bp, Gossypium hirsutum
  Clone ID: LIB3272-022-P1-K1-D1
cttgctaatattgctacttggagtaggtggctctcgccactccctcttttgggacctatgagtctcccaactatgggaagccccctactcctgtttataaacctcctaaggtgaaacccccaccttatgaacatcctgtttataaacctcctaaggtgaaacccccaccttatgaacataagccccctgtctatgaaccaccaaagaaggaaaagcctgagcctaagccaccagtttatacacctccaaagaaagagaagcctgaacccaaaccaccagtatatgaacctccaaagaaggaaaagcctgagcctaagccaccagtttatacaccaccaaagaaagagaagcctgagcccaaaccaccagtatatgaacccccaaagaaagaaaagcctgaacctaagccaccagtttatacacca

SEQ ID NO: 23259 - DNA, 404 bp, Gossypium hirsutum
  Clone ID: LIB3272-022-P1-K1-D10
tgaaaagaagggaaaaaaaactcgttcgtcactgaaaaacagttgattttcttttttttgcttctttaaaaaagaattagtaatcaaatcgaatggcgggaattcgctgtgaagttgttggagaaagtgaagcagcggctccggttgagccaacttcaagagcttctcgtcgccggagataggagcttctaccgtttaagttagaggccgaagctgctgttctaccgcggctagagaacggccggaaacgtcagaagctcgatctcgttcgcccgacttctcgtgattgtgataacgctgttcaaaactcggatactgatgagcttgagaaagatcaagaacttaatgccagtcttaattttaatggagcagtcaaatcagaagccgtagaagaagaaaaggaa

SEQ ID NO: 23260 - DNA, 389 bp, Gossypium hirsutum
  unsure (1)..(389): unsure at all n locations
  Clone ID: LIB3272-022-P1-K1-D11
cactcctccactgactttcaccaccaccgtcactagcggcgccgtcacaaaatgtcgtgaacggagtctctcatcctccaactccatgaaatctctgccgttaaattcggtaacttcaagctgaaatctgggatcttctcccctatctacatagacctccgtctcatcgtctcttacccttccctcctccaccaaatctcccactccctcctctcctctctccctccccaaacacactgtaacctcatatgcggtgtcccttacactgccctccctatagccacctncatctctctcgacacctccatccccatgctcatgcgccgcanagaagtgaaagactacggaactgccaagtccatcgaaggtgtttacgaaaagggtcaagc

SEQ ID NO: 23261 - DNA, 247 bp, Gossypium hirsutum
  Clone ID: LIB3272-022-P1-K1-D12
ttcaagggagggaagctgatgtaccagctgtgggtgaagcgaatcacgctttggacaagtagacagctttactgtcagagctcagaactacaaacttcataatagaaatgcaaaatggtgagagtagattaaatgtatctgaacattgtaagagacatattaccacgggttcttatgtactacttaacgggcgacaacgaagtacttaccgtgcctaccctttattactatagcagctacacccaac

SEQ ID NO: 23262 - DNA, 387 bp, Gossypium hirsutum
  Clone ID: LIB3272-022-P1-K1-D2
taaaataagcagagaaataaacggggagactctgaggagaaataataatcagatcctccttctaaactctccacaaagaaaagggaaaaaaaaagagggagatggggttgtcttttacaaagcttttcagccggcttttcgccaagaaggagatgcgtattttaatggtgggtcttgatgcagctggtaaaactactattttatacaagctcaagctcggtgaaatagtcaccactatcccaaccatcgggttcaatgtcgagacagtggaatacaagaacatcagcttcactgtttgggatgtcggtggccaagacaagatccgtcctttgtggaggcactatttccaaaacactcaaggtctcattttcgtggtggatagcaatg

SEQ ID NO: 23263 - DNA, 416 bp, Gossypium hirsutum
  Clone ID: LIB3272-022-P1-K1-D3
ctcttttctcctccttgtgtcgtgcagataaaggatgagtacactggatgcaactagagcagaacttgctcttgtagttttgtatttgaataaggctgaagcaagggataagatatgcagggctatacaatatggctcgaaattcctaagtgatgggcagcctggcacagcacaaaatgttgacaaatcaaccagcttggcacggaaagttttccgtctttttaagtttgtgaacgatttgcatggtcttattagcccagttcctcaaggaactccccttccacttgttctgctaggaaagtcaaagaatgcactgttgtcaactttcttatttctcgatcaaattgtgtggcttggcagaacaggcatctataagaacaaagaacgtgctgagttgattggacgaatattccttt

SEQ ID NO: 23264 - DNA, 427 bp, Gossypium hirsutum
  Clone ID: LIB3272-022-P1-K1-D4
tctctctctctaaaagcccactcagcagtttaaagagagagaaagtgtactttctctctctagaactctaaagggtcaaagctttaaagccttcaaatatatacatataaatcgagagagagggagggaaacatttttttttaaattattttttgggagagattttgaatcatgggtggtgagaagaaattcggggttcttctatgcgcggaggactcggactacattaagaagaggtacggagggtattttggtgtgtttgtggaaatgctggcggaggaaggggagacgtgggacgttttcagggtggcgaacggcgagttccccgacgacgatgagatcgccgaattcgacggattcgttataaccggcagttgcaatgatgctcacgagaatgacgtttggatctgcaggttgatctcgcttt

SEQ ID NO: 23265 - DNA, 420 bp, Gossypium hirsutum
  Clone ID: LIB3272-022-P1-K1-D5
caggtgtgggcgtgtctaacgcattggttttcgaaatcgtgatgaccttcggattggtgtacacagtgtacgccacagccgttgatcccaaaaagggaagcttgggaacaatcgcaccattggcaattggtttcatcgtgggggccaacattttggcaggaggtgccttcgatggagcctcaatgaacccagctgtttcatttggaccagccttggttagctggacatgggataaccactggatctactgggtcggaccccttatcggtggtgggctcgctggtctcatctacgagttcatcttcatcagcaacacccacgagcagctcccaaccaccgattattaagcctaatcagggtttaattgatttgtctgtcactttggaaccggattttctccgatctcatttgagttttcta

SEQ ID NO: 23266 - DNA, 414 bp, Gossypium hirsutum
  Clone ID: LIB3272-022-P1-K1-D6
tttcatgcaggtgaccaagcatgaagatgcaccagagagtgactggaagagctggaattggagatcggaaggcgacctgatggtgaacggtgcatttttcacggcgtcgggtgccggtgcctcgtcgagctattccaaggcttcgagcttgggtgctaggccatcttcactggtggcaaccataaccactaatgctggttcacttaattgcaagaaaggttctcgttgctgattgagacatatatgatccaaaacgtacgacacttcgttaattaccaagtggtcgaaaatggtgtttgactgcaaattaaattcagtttttagaaggaaaaagaaactgaagaaggtgcatgtgaagaaaagtctaccaataggattaatttaaacggcttttccccctccccttcacttttt

SEQ ID NO: 23267 - DNA, 427 bp, Gossypium hirsutum
  Clone ID: LIB3272-022-P1-K1-D7
aaataagttaactcaaacccttcaaaatttcaaaacaaaatcctgaaaatctcaacttgcaatctttcagtttctaaatttattgtcttccccgttttctttatgaaattaaacctctcagaaaatgcaatctcttgaaagcatcacagaatccccatttcctcaaaaccctaacaattcatcatcatcatcatcttcttcgaatgggttgtatggatggctcgttgaatgtcatggattttggcataacttagcacttattatcccttctctcctctttgttctgtttctgggttttcaagctaaaaaaaactttcaaaagctctctcatggaaggtcttatatcatgatttcttattacggttgcctttggctcgttagcttgctcaaccttgtttggtgtttcgttcaggcctgggaatgcact

SEQ ID NO: 23268 - DNA, 428 bp, Gossypium hirsutum
  Clone ID: LIB3272-022-P1-K1-D8
atttccaatctccagctcccaaggtaaatatgccgatcagaaacatagcagttggccggcccgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaggtggccacgtcaaccccgccgtcaccttcggtgctttcgttggcgggaacatcactctcttgcgcggcattctttactggatcgcccaactcctaggctcaaccgtcgcttgcctgttgcttaagttcgctaccggcgacctggctgtaccagctttt

SEQ ID NO: 23269 - DNA, 426 bp, Gossypium hirsutum
  unsure (1)..(426): unsure at all n locations
  Clone ID: LIB3272-022-P1-K1-D9
ggagaacactggtggaatggccgcacctttgttcttatcgtcacaacactcggcatcttctctccattggcatgtttcaagcggatcgattccttaagatttacatccgccttatccgttgctctagcagttgtgtttcttgtcattactgttggaatagcaattatcaagttgattagcggaactgtaatgatgcctagattgcttcccgatgtcactgatttgacctcattctggaaactcttcaccacagtccccgttttagtcactgcgtatatctgccattacaatgtccacagcatagataacgaactggaagattcaacccagataagaccggttgtgcgaacagctctggctntatgctcaactgtttacataatgacaagctttttcggattccttctatttggtgacgccacaatg

SEQ ID NO: 23270 - DNA, 383 bp, Gossypium hirsutum
  Clone ID: LIB3272-022-P1-K1-E10
cacgatacttaagtggtaaacctccaagacactcaggaggaaaacctacacatgctgaggggtttcttgctgataaagcacccatgaagccactccatggcgacaaaccatttaaggttaatgaaaagggagcactttatgaacctaaatctcttcatagacacttattgagtgtggaagctgacggcacacataatacctccacaacactgatgaggtgaaccctcacgacattgaaggggttaacctgcacatgtttaaggattccctggtgacataccatccaaaggtaagggcaaggaggcacctcatgaacccaaacctgctgacacacacctattgagtgcttgatgttgaagcacacataaacctccacaacaatc

SEQ ID NO: 23271 - DNA, 432 bp, Gossypium hirsutum
  Clone ID: LIB3272-022-P1-K1-E11
attgacacgccgacaattacagagaacggttcgacccagtctaaagccgccgctccttccggcggcgaccacaagcctccggcctcagctaacggagcgcaagtggaggtgtcgccggagcctgaaggaacgaaaaagaggcggtcgagtatgctaccgctggaggtgggtactcgcgtgatgtgccgctggagggacggcaaatatcatcctgtcaaagttatcgaacgccgtaagatgccctacgctgtgccctatgattacgaatactacgttcattacaccgaatttaataggaggcttgatgaatgggtgaagcttgaacagcttgatcttgattctgtcgaaactgttgtcgacgaaaagggtgaagacaaggtaacaagcttaaaaatgacacgccaccagaagcgggaagatgatgagacgcat

SEQ ID NO: 23272 - DNA, 400 bp, Gossypium hirsutum
  Clone ID: LIB3272-022-P1-K1-E12
aacgaaacccacaaaaatctgttgggtgtccaaattcaccacaaaacatcaatggcgaacctcaaagcagggacaagaccaccatgggttggtcttggtgctgctgtctgggtacagatagcatctgggaatgcctacaacttccccctttattcccattcatagaaatctgttctggggtttaaccaacatcagctgacaatgcttggtgttgctaatgatattggtgaaaacgtgggattactccctggtattgcttagtaacaagttcccaccttgggttattctattgattggatcttttgcttgtatcttgggttatggcgttctttggcttgctgttagcaaaactgttctatatctgccttattggctgttatggcttgcactttgtgtcgct

SEQ ID NO: 23273 - DNA, 399 bp, Gossypium hirsutum
  Clone ID: LIB3272-022-P1-K1-E3
ctgctaaaaagttgctatgggtgaggcgaaggctcacatcaacattgatgtgattggccatgtcacctctgaaaagtcaacatcagctggtcacttgatctacacgcttggaggtcttgacaagcgtgtgaccgagagggtcgagatggaagctgttaatataaacaaaaggtcatcaatgtatgcctgagcgctcgataagtggacggctgaacgtaagcgtcggatcactattgatattgtcttggggagggtggagacaaccaaatcctactgcactggccttgatgctgctggacatcagcgctagactaacactatgattactggtgcttctcaagctagactgtgctgtccttatgattgacttcacaactggaaggtttgaagctggtattt

SEQ ID NO: 23274 - DNA, 416 bp, Gossypium hirsutum
  Clone ID: LIB3272-022-P1-K1-E4
gaaaagagaaaaatatttctggagaagctttctgcttcaagagaagcttctgcaggaacattgctcggattctggcaataaaggaaaccaggacaatgacagaagaacctgttaatgtcaatgaattcagagaattagcaaggcaagcccttccaaaaatgtactatgatttctacactggaggagcagaggatcagtacaccttaaaagagaatgaggaagcttttagaagaatcattattcagcctagaattcttagaaatgtgaggagcattgatttatcaactacagtgttgggttataacatctcaatgccagttatgattgcccctacttctttgcaaaagctcgcaaaccctgaaggagagatcgcaactgccagagctgcatctgcgtgtaacacgataatggtttta

SEQ ID NO: 23275 - DNA, 423 bp, Gossypium hirsutum
  Clone ID: LIB3272-022-P1-K1-E5
gggaactggccgaagatggatactctggtgtcgaagtcagagttactcccatgcgtactgagatcattatcagagccactcgtacccaaaatgttctgggcgagaaagggaggaggattagggaactgacctctgttgttcaaaagcgattcaagttccctgaaaatagcgtggagctttacgctgagaaggtcaataacagaggcctttgtgccattgctcaggctgagtcccttcgctataagctcctcggaggtctcgccgtccgtagggcctgctatggtgtgcttagatttgtcatggagagtggagccaagggttgcgaggttattgttagtggaaagctaagggcacaacgtgccaaatccatgaagttcaaagacggatacatgatttcttctggtcacccagtgaacgagtaca

SEQ ID NO: 23276 - DNA, 283 bp, Gossypium hirsutum
  Clone ID: LIB3272-022-P1-K1-E6
cgcaaaagcctttatttcgacgcgctgttgaagtcctccaataactacgcgcgccatttcggagtactagaagaacccatcaaagaacttgtgcttaaatggaaaaaaggccagccactcttgccacgaatagcctccgttatcgcacgtgccaacggcgtttagcacgtgctgactgtcaactcagaaaccgacaatagcaccggtctaaacacgattgctcagactgagtacctcgcgtttacgctagtagacaggatctccgctacgagggcttgacttg

SEQ ID NO: 23277 - DNA, 433 bp, Gossypium hirsutum
  Clone ID: LIB3272-022-P1-K1-E7
gtttaccaggatctcatctccggtgacgagcttctttctgactcattcccctacaaggaaatcgagaatgggatgctgtgggaagttgagggaaagtgggttgtgcaaggagctattgatgttgacattggtgccaatccttcagccgaagatgctgatgaggatgaaggtgttgatgaccaatctgtgaaggttgttgacattgttgacactttcaggcttcaggagcaaccccctttcgacaagaagcagtttgtcgtgttcatgaagaagttcatcaagaacttgacaccgaaactggatgcggaaaagcaagagtccttcaagaaaaacattgagggagcaaccaagtttttgctttcaaaattgaaggaccttcaatttttcatcggggagagcatgcacgatgatggatgtttggtatttgcttact

SEQ ID NO: 23278 - DNA, 426 bp, Gossypium hirsutum
  Clone ID: LIB3272-022-P1-K1-E8
caaggagctgctgagccagcgactgcggatgtggcggagggttttgatgatagagttgcggatttgaagaggtgtttggtggattcggtttacgggacggagttggggtttcgagcggggcaggagttaagggctgagattttggagttagtcaatcagttggaagctgttaacccgacccgagctccgattgaggccactcagcttcttgatggcaactggattttgctgtatacggcattttcagaactgttgccactactggcagctggtgcaacccccttactgaaagttaaaagcataagccaatcaattgatacagcgagtcagtctattgtgaactccaccacattgtctggccctttttgttgatctctcctttagtgcatcagctaccttcgaagttagatctccttcaagaataca

SEQ ID NO: 23279 - DNA, 236 bp, Gossypium hirsutum
  Clone ID: LIB3272-022-P1-K1-E9
gtcgcagtcggttgaggagttctctacacctcacttgccgaatcacctagccgctaagacctataggtacttaacatcgcgacctatccccgtccgccgtggcaaggaccactcctttgtgactaattcgtcgacacggtcgtctgataactcttatctgtgagcacgaacagagcaaccgagatgccaaagcttctttgtaagagcacataggtacaagtcatctctccatggct

SEQ ID NO: 23280 - DNA, 400 bp, Gossypium hirsutum
  Clone ID: LIB3272-022-P1-K1-F1
aaaaaaaaaaaaaaaaagaaaccacccaaacagacaatagactaggacaggaggatctctcagggtttaggtgatggcttccaagcggatcttgaaggagctcaaggatctccagaaagatcctcctacctcttgcagcgcaggccctgttgctgaagacatgtttcattggcaagcaactattatgggtcctcctgacagtccatatgctggcggagtgtttctagtcaccattcatttccctccggactatccatttaaaccaccaaaggttgcattcaggacaaaggtctttcacccaaatattaacagcaacggtagcatttgccttgatattttgaaggagcagaggagccctgccctcaccatatccaaggtattgctatctatctgctcactc

SEQ ID NO: 23281 - DNA, 431 bp, Gossypium hirsutum
  Clone ID: LIB3272-022-P1-K1-F10
caatcatccacttcttctcttctttgaactcaaagtcccagttaatattagaattatgggtgttgtcacttatgactatgagtctacctccccagtcgccccttccaggcttttcaaggcctctactgttgaagctccgaaagtttggcccacggctgcacctaatgcagtcaagagtattgaggttgaagctaatcctagctctggaagtatcgtaaaaatcaactttgttgaaggccttccattccaatatatgcagcaccagataggaggacatgatgaaaataaattttcatacagttactatttaatcgaaggtgggcctttgggggacaaacttgaaaaaatcagctatgagaacaagtttgaggcacctgcaagtggaggaagtatttgcaagagttcaatgaaattctacactgttggcgaca

SEQ ID NO: 23282 - DNA, 434 bp, Gossypium hirsutum
  Clone ID: LIB3272-022-P1-K1-F11
cttcaccatgaacaaaagcaagctccagctgcaactttgtgcagggatatttactttaagcatcctctccaatggtgcttatggtagtgacaaaatctttgacataactcacaaaatcacttctcagttgccaacttttggatcacagaagggtcttggtcaattcatttggcttctttccagcatcaaaaatgggtccacagtgaatgtgtcggagttcaaattgggaacccacactggcactcacgttgatgctcctagtcacttctttcagaagtactatgaacaaggatttgatgtttcaacccttagccttcaaactcttaatggtcctgttctagtagttgatgttcaaagaaataagaacattactgctgaagttatgaagtccttgaaaattcccagaggagtacatcgtgtgcttttcaaaacac

SEQ ID NO: 23283 - DNA, 125 bp, Gossypium hirsutum
  Clone ID: LIB3272-022-P1-K1-F12
tttgaatcggaggcggtgcacgtaccatgtttatgtacccaaagacggttacggccgggagaatcaccctgtagacattgagaggcgacacagtttgactgcggcaacgcatatattcaaagata

SEQ ID NO: 23284 - DNA, 353 bp, Gossypium hirsutum
  Clone ID: LIB3272-022-P1-K1-F2
ctttttctttccttttcctctctaaaaccctaatttgatctccaaatacctgcgagatctccaagcttcgtcaccccaaaatggccacgacacgcagatcccttcctcttctgagaaccctcatagccggaaaaacccaaacccgaaacgtgacgtacatgccccgaccaggagatggagccccaagacccgtaacgttaatccccggagacgggatcggacctttggtgacgaacgcggtggaacaagtgatggaagcgatgcacgctccggtttacttcgagaagtacgatgttcacggtgacatgaaacgggtaccacaagaagtgttggattcgataaagaagaacaag

SEQ ID NO: 23285 - DNA, 413 bp, Gossypium hirsutum
  Clone ID: LIB3272-022-P1-K1-F3
gtttccacccaaatgcaaaaccccaattttctattctcccttttgttttctatatcgatcccaattctgttgttcaacaatttaatcgctgaatcaaccttctgccctgaaacaatggcgacaaccactactttgggcggagtccacccttcccaaggctcccaaaacagcgtcgagctcgaaaacctagcacgctttgccgtcgacgagcacaacaagaaagaaaatgcaatggtggagtttgtgagggttgtgaaagcaagcgagcaagttgtggcggggacgcttcaccatttgacggtggaagctgtcgacgccggcaaaaagaagctttatgaagccaaagtttgggttaaaccttggatgaattttaaagaattgcaggagtttaaacatgctggtgatgctgatag

SEQ ID NO: 23286 - DNA, 426 bp, Gossypium hirsutum
  Clone ID: LIB3272-022-P1-K1-F4
gtttttagttctcacttaacccgtttgcctccggcatcttcccactcatggcttcggagaaagaagctgcccttgctgctgctccctctgattctcctaccatatttgacaaaatcatcaacaaggaaatcccagctaccgtggtgtatgaagatgataaggtcttagctttcagggacatagctccccaggctcctacgcacattttaattattccaaaatcaaaggatggcctaacgggtttgtctaaggctgaggagaggcactgtgaaatccttggctgccttctttatactgcaaagcttgttgcaaaacaggaagggctggaagatggattcaggattgtgatcaatgatggccctaaaggatgccaatctgtgtatcacattcatgtccacctcattggagggcgccaaatgaactggc

SEQ ID NO: 23287 - DNA, 422 bp, Gossypium hirsutum
  Clone ID: LIB3272-022-P1-K1-F5
caagtaataaaaagtggggtagcatcaatattgatatgggtgaagaggtgaaggtttttggagcatgggcaagcccttttagccgtaaggtagagctggctttgcggttgaaaggtgttccatatgactacatagaagaagacttgaataacaagagctctttgcttttgcaatacaactcggttcataagaaagtcccagttcttcttcacaacgggaaatcaattgcagagtcgattgttatacttgaatacattgaggaaacttggaaaacctatcccatcttgccacaagatcctaacgacaaagccatggctcgattctggatcaatttcattgatggcaagtgctcgtctgccattaggaaagttgcatttagccctgaggaggagagagagaaggcagtggaagaagcttgtgag

SEQ ID NO: 23288 - DNA, 386 bp, Gossypium hirsutum
  Clone ID: LIB3272-022-P1-K1-F6
caagtaataaaaagtggggtagcattaatattgatatgggtgaagaggagaagatttttggagcatgttcaagcccttttagccgtaaggtagagctggctttgcggttgaaaggtgttccatatgactacatagaagaagacttgaataacaagagctctttgcttttgcaatacaactctgttcataagaaagtcccatttcttcttcacaacgggaaatcaattgcatagtcttattgttatacttgaatacattgaggaaacttgaaaaacctatcccattttgccacaatatcctaacgacaaagccatggctcgattctggatcaatttcattgatgacaagtgctcttctgtcattatgaaagttgcatttatccctga

SEQ ID NO: 23289 - DNA, 337 bp, Gossypium hirsutum
  Clone ID: LIB3272-022-P1-K1-F7
cggacgcgtgagcaaaaacatagcagccacggcagtgcgtatgcttcttgagataggtgttctgctactctgacttgcaaaggtttcatctgatctgaaggcagaagaagttataaccaatgtcggtgaggtggtttctttggttaccagaagccgaaacagaatactgatgctagagactgattgtggaagattatgcataaaaagatgcaatcaacactcaaggccaaacagtatgcaacacgacgtgtgggacttgctagtcaaggtgcaagtgcatcccaccgttgactgtatggaacagggaggtctgcgacacctgctatactgtcatgac

SEQ ID NO: 23290 - DNA, 419 bp, Gossypium hirsutum
  Clone ID: LIB3272-022-P1-K1-F8
aaaaccctagttgttagcgagcagaagcaaagagcctccaaaaaacacttcaaccctctagccatgacattcaagcgtaggaatggtggccgaaacaaacatggccgtggccatgtcaagttcatccgctgctctaactgcggtaaatgttgccctaaggataagtcaatcaagaggtttcttgtgaggaacatcgtggagcaagctgctgtcagggatgtccaggaagcctgcgtctatgacacgtacactctgcccaagctgtatgtgaagatgcaatactgtgtttcatgtgcgatccattcccacgttgtgagggtccgatcccgcactgacaggaggaaacgtgacccgcctcagcgcttcattagacgcagggatgatatgccaaagcccggtcagcctagtcaggctcctcg

SEQ ID NO: 23291 - DNA, 248 bp, Gossypium hirsutum
  Clone ID: LIB3272-022-P1-K1-F9
ggagtctgacagcagtaccagtcaatgggctagaaaacccataaagcacaaggtagctgtttgaagagaccgctcaacactgcctccacaaacgacctttatttttttaaccggactagcgtgagagcacccctgagtggacctagaaggctgggaactttgcctgagcagcgcgaatccagtaaaaactctactcaacgtcctggaccgcgctggaatgctacacatgaacataacttgcttctaga

SEQ ID NO: 23292 - DNA, 382 bp, Gossypium hirsutum
  Clone ID: LIB3272-022-P1-K1-G1
gtaacaatggcggcttctgcttctatttacaatcttctcactctcctgctcctttctggcatcccttttaccttctccgagctcgttaaagagcaacctctggtgttggaataccacaatgggcccattttggagggggaagatcactgttaatctcatttggtacgggaagttctccccaacccaacgctccataatcgtcgatttcatcaactctttgagctccgccgtcaaacccaaggttccgtcggcgtcgttttggtggaaaacgacggagaaatacaagtccaggtcctccactttggtcgtgggcaaacaaatcctcctagaaaattacccgctcggtaaaatccttaagaacccacacttgccggggttggcc

SEQ ID NO: 23293 - DNA, 356 bp, Gossypium hirsutum
  Clone ID: LIB3272-022-P1-K1-G10
caaacgcgcatttacgttgggagagttcagcgaaaatggcaggcgaagcagctgcggcggcgaatttctggggtgatatgccggaggaagactattacaggtcgcagggtgtacgcaacaccaagtcttacttcgacactcccaacggaaagctcttcacccagagcttcttacccttggataaaaaagtgaaggcctccgtctacatgacccacggctatggatccgacactggttggctcttccagaagatctgcatcaacttttccaattggggttatgctgttttcgccgctgatcttctcggccatggcagatccgagggtctccgctgctacttaggtgacatggagaaa

SEQ ID NO: 23294 - DNA, 431 bp, Gossypium hirsutum
  Clone ID: LIB3272-022-P1-K1-G12
agcattttcaatggcatcaaaaaggcattgagagaagaattgaaaggacgaaaggaaaggtcatttttagttgtggttgtgaaggggctattggtgggcatggaagggctggccatgctcgggcagctaatcggtcagcttcaagatcttttgcaacttcacggctctcctccgccgcctcctcctccgtctcattttcgccttcttcatccgcatcttcaccccggcgactaccaccgcaggtggtgtttgcacaatatagatgatactcctgcagacgattactacagtcttgtaatggctgctgggaaatctggaagttgtaagatgttggaacctttcgagcctccaggtcctccaccaagcaagaaatcacgaaagggacggaaccaagagaaattacatggaagtactgctatacctgaggccga

SEQ ID NO: 23295 - DNA, 396 bp, Gossypium hirsutum
  Clone ID: LIB3272-022-P1-K1-G2
gggttttcctgttttcttttattcttttttttcttttttaaatggccttttctccctcgttcagacctaacatgcccctcgttctatctcctttccttgaccgaaccggaccccctaatcctcttttaaatcgacctcaatttcctggtttttctgctcgcgggcagttccttcgtggttccctatccgtggccaagtttgggttcaaacccggactcttgcccgacccggaggcttccgaaggtgttctcagagagctgttcactagagctgaaagccttctttatacgattgctgatgcttctgtttcgtcttccgacaccattgctacaaccactagtgctactagtaaacaaaataatgattggctttctggaattgccaattccatggaaa

SEQ ID NO: 23296 - DNA, 231 bp, Gossypium hirsutum
  unsure (1)..(231): unsure at all n locations
  Clone ID: LIB3272-022-P1-K1-G3
gtggcaaggtgtacattttttatatccatatttgagcaccaaaaaaattgtaggaaagagctgccaaagtatccattgaggcttatcttgataatatgtttatagacgatacttacaatagctcagtatatacacaatgaattcagatagactacaaatccatctaaagattcatgtgctttgaaagatgcgngtctttgccattgataatggtgctctatacaccataca

SEQ ID NO: 23297 - DNA, 423 bp, Gossypium hirsutum
  Clone ID: LIB3272-022-P1-K1-G5
cactgctcgatctccttacagctaccgtacacactcacacacacattcactgaatgggtcgagtcatccgagctcaacgtaagggtgctggttccgtcttcaaggcccacacccaccaccgcaagggtcctgctcgtttccgcagcctcgacttcggtgaacgaaatggctacctcaagggtgttgtcaccgatgtcatccacgaccctggtcgtggcgctcctttagcccgtgttgtcttccgtcaccctttccgttacaagaagcagaaggaacttttcgttgccgcagagggtatgtacactggacagttcgtctattgtggtaagaaggctactcttgtggtcggaaatgtattgcctcttagatctatccctgaaggagctgtcgtttgcaacgtcgagcatcatgtccgtgatcggg

SEQ ID NO: 23298 - DNA, 274 bp, Gossypium hirsutum
  Clone ID: LIB3272-022-P1-K1-G6
cactgctcgatctccttacagctaccgtacacactcacacacacaggcacagaatgggtcgagttatcctagctcaacgtaagggtgctggttccgtcttcaaggcccacacccaccaccgcaagggtcctgctcgtttccgcagcctcaacttcggtgaacgaaatggctacctcaagggtgttgtcaccgatgtcatccacgaccctggtcgtggcgctccttaagcccgtgttgtctttcgtcaccctttccgttacaagaagcacaatga

SEQ ID NO: 23299 - DNA, 314 bp, Gossypium hirsutum
  Clone ID: LIB3272-022-P1-K1-G7
gagactaggcatgccattatcttagcaaggctggtgtcagcgcaattaggagggtgagatagactgtcaacaacagaattgcaaacgcatctagagctgttattgtgaatcgtcctgacgaattgcaggaattcgatgtaagactgaagctgcgctatctgaggttaaaaaaatctgcgatgaattcttcgcattcattgccgaacgcaaagatccaaaagcttgcacagttctcttaagggatgctcgcaaggatctactgcacgagcgtgaaagaaatttgcacgatgccacgtctgctgttagaaacataa

SEQ ID NO: 23300 - DNA, 378 bp, Gossypium hirsutum
  Clone ID: LIB3272-022-P1-K1-G8
gtttgtgctcatgtttaagatctatagactgtaattaactctttcccccttttctgggtgtttttctatgtaatcctttgcctgttttctctgaaaacatggctgcggatagctttcttatgcccccatgccgaaagattcggatttgcaaagcgaaaagagagccgaatctgaaccatagtgattcttcctcaggtgtagaacctcaggatgcagattactcttatgttcctcagctctgtgatgagttagagaatttgatattggctcgatttcctcgatcggaattttggaaactttacttactaaacaagcatttcttacagattttaaagagtggtgagttatttaagattaggaggcaaattgggtttaaag

SEQ ID NO: 23301 - DNA, 431 bp, Gossypium hirsutum
  Clone ID: LIB3272-022-P1-K1-G9
gaagttataaccaatgtcggtgaggtgggttctttggttaccagaggcggaaacagaagactgatgctagagattgattgtggaggattatgcaagaaaagatgcagtcaacactcgaggccaaacagatgcaacagggcgtgtgggacttgctgcttgaggtgcaagtgcgtgccaccggggacttcagggaacagggaggtctgcgggacctgctatactggcatgaccacccatggaaacgttgccaagtgcccttaacctttacgtcgcccaatatgtgttgcagccatcaaggggaaaaatgaaatggtttgtttgtgtaatatgtatgttgtagctcagatgtctcacctactcctaaaattattagtacttgtaatatatatttttaaaatagtagtatgcatttagcctccgttcagtattac

SEQ ID NO: 23302 - DNA, 371 bp, Gossypium hirsutum
  Clone ID: LIB3272-022-P1-K1-H1
cttgggttgagtgtagagatgaggaaaatcatgggtgccaaagttctcttctggtttgctttgctttccttttcagctgggtcggcatttgcacaagatgagggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaagaatttcaggtacattgagaccatcaaagaagctgtag

SEQ ID NO: 23303 - DNA, 354 bp, Gossypium hirsutum
  unsure (1)..(354): unsure at all n locations
  Clone ID: LIB3272-022-P1-K1-H10
agctacttaaccatttcccaaatctcctccctcctcttctttagcgtccttttcatttgcgctcatgcagcgcgctttgaaatccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccggtgattgtggtggactccttcaatgcaaaggttggggtgtacctncaaacaccctggctgaatatgcacttaaccaaatttggaaacatggatttcta

SEQ ID NO: 23304 - DNA, 288 bp, Gossypium hirsutum
  Clone ID: LIB3272-022-P1-K1-H11
cctttctcaaatcttggctcgccagtcgcctctctttcttctactgctccttcttcttgattctgtcggctgctgctgctgctttggtggcagtgatttagaagccacaactcaatttcatataaagaaaaaaaaaagagtgagatggatccagacgcagtagccaaggccttcgtcgagcactactactccacattcgatgccaaccgggccggtttagccaatctctaccaggaaggttccatgttgaccttcgaaggtcaaaagatccagggctctcagagcatc

SEQ ID NO: 23305 - DNA, 255 bp, Gossypium hirsutum
  Clone ID: LIB3272-022-P1-K1-H2
cgccctaactctttcacttcgtcttctccaatttcctccaaaagtaagaaggctgtggatccctcagagcttcggttttatgaggatgatgacactccaacaatgaacacactcaggggtgcaactactggttttgttgctggaactatgtggacaaccgttgctgctacatatgatgtgcctcgtgttgagagaagagttgccatacctcggcttgttagaacactcaataagatggggaaatatggaatgaca

SEQ ID NO: 23306 - DNA, 372 bp, Gossypium hirsutum
  Clone ID: LIB3272-022-P1-K1-H3
aacaagtcaaatgtcaaaaaaggcatctttgataacgcctctttcatgaccagaaaaaagaaccatactgttaaatcttaagaaggtgcaaaagttacagcgcttgatatataaacgagggcgctggcgagggcaaacactgatgtattcttttcttaccgatgcaaaagatgcgctgcttacgtctggatgagaaagatctgccaagtgtgtcaacaaagacaacgcctccaagcacatcaacgaagtggagtggatgcattcaggcttatacgagtcaacatctgattgtgcctgaaatgttctgaagcccagaacagagtatgacgtgtagcacatgtatttggaaaacgaggtttaacttagaaacat

SEQ ID NO: 23307 - DNA, 430 bp, Gossypium hirsutum
  Clone ID: LIB3272-022-P1-K1-H4
ggcttctacgtgagggtgtagatgcaaattaccgtgacaagcaaggattatgtgtactgcatctggcgacattattcaatcgaaccgatatagtgtttgccctcatggactgtggagcaagcatggactacaagaatgcacaaggagaaacaccaatggattgtgcaccagtcactttgcaatacaagatgcaaacgaagctgaaagagggccgagcagcgtgaaatcaactagacaagagaatccgaaaccgatttcatacttcgacaaccgacatgctcgatctcgagttgtcagctttaacgagaaattattttatataatgcttgatcctgtcagcttagtgctggtactgttttgtattatagctggtagacaaaccgtcaaacagacttcaggacatagagtctcaatcaaaaatttttttttt

SEQ ID NO: 23308 - DNA, 302 bp, Gossypium hirsutum
  Clone ID: LIB3272-022-P1-K1-H5
gtctgacttgctctgtaaccgtagaagtgattattggttgagaaatcatgggggaggacaagcataagcctgatgataagggtctgttttcacatcttgctcatggtcttagtcatggtggtcatggacacccttctggtgcatacccttcaccttctggcggatattcacctgctggagcttaaccaacttaaaggtattcaacaagttgcttaccttcttaaagaagatacccccctcaacgattttcacacaatttgcttttcctgtgccttccaattaaggcaccgtggccttggaac

SEQ ID NO: 23309 - DNA, 417 bp, Gossypium hirsutum
  unsure (1)..(417): unsure at all n locations
  Clone ID: LIB3272-022-P1-K1-H6
acgcgtccggtctcacttgctctntnaccgaagaattgattatcnnttnnnngagggagaggtagggattatcttattcctgatcataacgctctgntttcacatcttgctcatggtcttagtcatggtggccatggacaccctcctggtgcatacccttcacctcctggcggatatccacctgctggagcttacccacctcaaggctatccaccagctggctaccctccttaaggaggatacccccctcacggctatccaccatctggctatcctggtgcatcccattcagggcacgggggcatgggaacgctgcttgcatgtggtgcaacagctgccggagcttctatgggggctcaccacgtggcttacggtgctcatggagctcatggcgcttatggtgctcatgggttttgt

SEQ ID NO: 23310 - DNA, 104 bp, Gossypium hirsutum
  Clone ID: LIB3272-022-P1-K1-H7
attaaaacaaagcattgcgatggtccctgcggatgctcacgcaatgtgattggtgcccagtgctcttaatgtcaaagtgaaaaaattcaaccaaacgcgggtaa

SEQ ID NO: 23311 - DNA, 427 bp, Gossypium hirsutum
  Clone ID: LIB3272-022-P1-K1-H8
ggttagggctctttattttctgtgttcatcaggttctttttatctcttcgaattttcattacagaccctgatcctaaactctcaattatgtcttccaagcaaggtggcaaagcaaagcctttgaagcaacccaaagctgagaagaaagaatacgacgagcatgatttggctaacattcagaaaaagaaagaagaagagaaggcccttagagagctgagagcaaaggcatcacaaaagggatcatttggtggttctggtcttaagaagagtggcaagaaatgagtttcttaaaaacccgagctaaaccgaacttatcgagtcctgtcttgggattaaaacatctattatgctgatgtctcttgtttctattgggatagttgggatgatttgatgctctagtttcattctgaatttgctattaaaaaca

SEQ ID NO: 23312 - DNA, 388 bp, Gossypium hirsutum
  Clone ID: LIB3272-023-P1-K1-A1
cttcacagatttgcttcaaccccctcccgctcttccccctgctaaaaggcttgagctttcagccaaaatgggtatttctcgtgattcgatgcacaagaggcgtgccacaggtggcaaaaagaaggcttggaggaagaagagaaagtatgagcttggaaggcaaccagcaaacacaaagttgtcaagcaacaagacagtcaggaggattagggttcgtggtggaaatgtgaagtggcgcgctctgaggctcgacactggaaactactcatggggaagtgaagctgtgactcgtaaaaccagaatattggatgtggtctacaatgcatctaacaatgagcttgttcgtactcaaactttggtgaagagtgctattgttcaagttgatgct

SEQ ID NO: 23313 - DNA, 414 bp, Gossypium hirsutum
  Clone ID: LIB3272-023-P1-K1-A10
gttggtggtcgatacagtgtttgcagtgcagttggagtgttgcctttgtctctgcagtatggtttttcaatagtagaaaagttcttaaagggggcttcaagtattgatgagcatttccgttcagctccttttgagaagaatatacctgtacttttgggtttgctaagcgtatggaacgtttcatttcttggatatcctgcaagagctattttaccatactcccaggccctcgagaaatttgctccacacattcaacaggtcagcatggagagtaatggcaagggggtgtcaattgatggtgtgccacttccttatgaggctggtgaaattgattttggtgaacctggaacgaatggccagcacagcttttatcaactaatccaccagggacgtgtaattccttgtgatttcatt

SEQ ID NO: 23314 - DNA, 438 bp, Gossypium hirsutum
  Clone ID: LIB3272-023-P1-K1-A12
cagaacatcaaccaaaagtagaacatgaagacgaggcagtagttggaggtggtgaaaagaagtggcctggatggcctggagagagtgtgtttcgaatgttggttcccgcgcaaaaggtcggtagtataatcggacgaaaaggggaattcataaaaaaaatagttgaggagacgagagcacgtattaagatacttgatggtcctccagggacgacagaaagagctgtaatggtatctgccaaggaggagcctgattcttctcttccgcccgccatggatggacttttgagggtccataaacgcattgttgatggtttggagggtgatccatctcatacacctacggctgtgggaaccaaggtttcaactaggctgctagtccctgcctcacaagccggaagtttgattggaaaacagggagcaactgtcaaatccattc

SEQ ID NO: 23315 - DNA, 265 bp, Gossypium hirsutum
  Clone ID: LIB3272-023-P1-K1-A2
cccaaacatgtataaagactgcttgcttttgtttctcgaaggagtggagggatttatcgtcagttcttctttcgttaagcaacattatgattatgagcttacacaggggaaatctgtaggaggtaataatcgaccccaccaccagccattatgttaacaccgaccgccaatacacaatgcacctggctgcaaaggacaggtgccagcatatgggggaagaccttataacaaaaacttattgtgctaatatgttcagggcacacat

SEQ ID NO: 23316 - DNA, 435 bp, Gossypium hirsutum
  unsure (1)..(435): unsure at all n locations
  Clone ID: LIB3272-023-P1-K1-A3
ttcattttcattttcttgttccttccttcgccgactattgctttttgttacctcgatttcaagtgaatcagaatgggtaaggaaaagactcacattaacattgtggttatcggccacgtcgattctgggaaatcaaccaccactggccacctgatttacaagcttggtggtattgacaagcgtgtgattgaaaggttcgagaaagaagctgctgagatgaacaagaggtcattcaagtatgcttgggtgcttgacaagctcaaggctgagcgtgagcgtggtatcaccattgatattgccttgtggaaatttgagaccacgaaatactactgcactgtgattgatgcacctggacaccgtgactntatcaagaatatgattactggtacgtcacangctgactgtgctgatttgattattgattccaccactggt

SEQ ID NO: 23317 - DNA, 300 bp, Gossypium hirsutum
  Clone ID: LIB3272-023-P1-K1-A4
cctattttaaaatttcaaacccagacttggtctttctatgtctctctctctacaagcagtgaattcctccattggaggagcttaacatacttagattattcctgatcttcgctctgtctgtaaaataaacacatatataccccaacaccaacgccatgggaagatttgaagagggagaattatattcaatcgtatgtcctaagcctatactaacctttagataatctaccaacacctgttattagactgagatggatgatttaaaagctgctgcagagcttcttgatataatcctctccg

SEQ ID NO: 23318 - DNA, 446 bp, Gossypium hirsutum
  Clone ID: LIB3272-023-P1-K1-A5
attttctaacacctttgcatttgcatctttctttttcacaccagatctggggatccaagctatggctgaaaaggtgacgataatggtgctgaaggtcgaccttcagtgtagtaaatgttacaagaaggtcaagaaagtgctctgtaaataccctcaaatacgagaccagatgtacgatgaaaaggctaatacggtgaccatcacggtggtatgctgtagccctgagaagatcagggacaagttatgttacaaaggtggtggatccatcaagagcattgaactcaagtcgccggcgaaacccaaggaaccggagaagaaacccgacaaaccaaaagaagctgagaagaagccggaaaaacccaaagaagctgagaagaaaccggaaaaacccaaagaagcagctgagaagaaaccggaaaaacccaaagaagctgagaagaaaccgg

SEQ ID NO: 23319 - DNA, 443 bp, Gossypium hirsutum
  Clone ID: LIB3272-023-P1-K1-A6
cggtaacacgccactggtatatctcaacaatgttgtagatggatgtgtggctaaaattgctgccaagttggaggcaatggaaccctgctccagtgtcaaggacaggattggatatagtatgattgcagatgcagaggagaagggtctcattgtaccaggcgagagtgtgctgatcgagccaactagtggtaataccggaatagggttggcattcatggcagctgctaagggttacagactcataattacgatgccttcttcaatgagtttagaaagaagaatggtcctccgagcttttggagctgagctggttcttacggatccagcccggggcatgaagggggctgttcaaaaagctgaggaaattatgtcaaagactcctaattcttacattcttcagcaatttgaaaaccctgccaacccaaagatccattatctgacaa

SEQ ID NO: 23320 - DNA, 235 bp, Gossypium hirsutum
  Clone ID: LIB3272-023-P1-K1-A7
gaccctggggagcttgactatactccgactttgacacatgacttcctaggtgaaagataaattgaccctctgtgaccgaaactgaaatcccactactcctaacgttatttgacttattcacgagaatcctaagcggtgcactggctctctttatctaccctacgctgattctcggctgagcgatccgctcagatgacatctgtagatgttgagcctagatggggcgtcccatctg

SEQ ID NO: 23321 - DNA, 370 bp, Gossypium hirsutum
  Clone ID: LIB3272-023-P1-K1-A8
agaaaagaaaaaatacagtgaaaatggcaacccttaaggttccagctcatgtacctgccccttctgaggatgctgagcaacttcgtaaagcttttgaaggatggggtacaaatgagcaattgattatcgacatattggctcacaggaatgcagctcagcgcaatttgattcgtaaaacttatcgtgaagcttatggggaagatctccttaagtctttggatgaggaactttcaagtgactttgagcgagctgtggtgctgtttactttggaccctgcagagcgtgatgcatttctggctcatgaagctacaaagaggttcacatcaagccattgggttctcatggaaattgcttgcactaggtcttcaca

SEQ ID NO: 23322 - DNA, 347 bp, Gossypium hirsutum
  Clone ID: LIB3272-023-P1-K1-B1
aaaacactgaaatggcatacgactatcattattacgaatacaaggctgatgcacaggcgtactaaacctatcctgagaaggcccctactattcgaaagaaccgatatatgaagattaaaggccagccctacacggatgctgaagattccacactagaagacagtgaacctcggacatgctcaaaggcactggattggaatacatatcttaactgacgagaagatggaagatgtggttcacatcataccagaactgtgatgggcctgataggcaagatgctgactacacaagtgcttgacattgatgaagatggacctatacgcttgctgactgatatcggtgatact

SEQ ID NO: 23323 - DNA, 202 bp, Gossypium hirsutum
  Clone ID: LIB3272-023-P1-K1-B10
cggacgcgtgggttacaccgtgggcggggagaatttcaattgttttaatcagtactttatgggctatcttttatttttggtgtcctggacatgcaatgagtgttgtgtttgctatctaagttgacaagttagcttatgtttaaattggagtttttcagtagatattattaaaatgatagaatttttgctgattgatttgatg

SEQ ID NO: 23324 - DNA, 440 bp, Gossypium hirsutum
  Clone ID: LIB3272-023-P1-K1-B11
catcgccacaccttccaaatcgggtggttggatcgcatgggccataaatccaaaggccaccggcatggcgggttcacaatccctcgttggctacaagaactccaccaccggcaccgtccaggttcatacctatgacatcagctcctacagttcaattgttgccaaggatctgtccttcgaggtctgggataagacggctgagagtagaagggacgggagtttggcgattttcgctaaaattaaggttccggcggatttagcggcgagtgggaagattaatcaggtttggcaagtgggtcccagcgtcggaactgatggcaggttggacaaacatgccttcgccgtctctaatttgcaatctaaaggaaccttggatttgaaaagtggacagagtagcactagttcttgaggagacgacaggctcaagaagaaaaatattc

SEQ ID NO: 23325 - DNA, 440 bp, Gossypium hirsutum
  Clone ID: LIB3272-023-P1-K1-B12
cattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgaaggttgttgacattgttgacactttcaggcttcaggagcaaccccctttcgacaagaagcagtttgtcgtgttcatcaagaagttcatcaagaacttgacaccaaaactggatgcggaaaagcaagagtccttcaagaaaaacattgagggagcaaccaagtttttgctttcaaaattgaaggaccttcaatttttcgtaggagagagcatgcatgatgatggatgcttggtgtttgcttactacaaggatggtgctgttgacccaacatttttgtactttgcatatgcattg

SEQ ID NO: 23326 - DNA, 330 bp, Gossypium hirsutum
  Clone ID: LIB3272-023-P1-K1-B2
gtcgagctttcccgtcggcttccttgcttccgttaatgtcaaagctctctttctctatgcgctgtggcttatgtatcgcttcgatttcgcgtccttactgtgcactcgatggcaaatcgatggttgaggcctgacgtgtattcgttgctcgggggcgtcagtgtcgctagacaaatctgatggtttcacatgaagcaaaatatcttcataaaccctgaatgcaggatgaccaaggagaacaacgactgctggggtttcggacaactctgctgagggatgaaaaatgtactgaacatgccttgagataatatgtctcgcatcaagacgcca

SEQ ID NO: 23327 - DNA, 142 bp, Gossypium hirsutum
  Clone ID: LIB3272-023-P1-K1-B3
ggagggttcagtatttatgatgttgttgtgtcatattttgtatcgtgttatttttagttgtttgaaataatcaagtctaattgtgtacttggacgaatagagttgtagctgttgtttaatcaatgtatgtttttattgttct

SEQ ID NO: 23328 - DNA, 321 bp, Gossypium hirsutum
  Clone ID: LIB3272-023-P1-K1-B4
ctaagactgtgccttgtaacacgcacactactaggtatcgagccagctgtcgatcttagatgctacatgtttttccgaagcactgcgagcgtattgcatctaatgttaatacgtagggggggggcagggaccatttctgtcgagaaaacggctgatacctggaacatcatattctatcaaagaactggatgcacagactgcatgggctattaaccctctcactatatgatcatgattcgacgtggcatgctgctttatcacagcaagttgagtcgttgatcctaagacccttgctgctgtggactacaagacatgtgggaa

SEQ ID NO: 23329 - DNA, 441 bp, Gossypium hirsutum
  unsure (1)..(441): unsure at all n locations
  Clone ID: LIB3272-023-P1-K1-B5
cccacgcgtccgtattttgtgaatcaggtaattcaggatgcaggcgtcgtcgcatttagtcagagggaatttcggcattgagatttcaaaacggagagtattcccttgctttggtgaagttaggcaacggagtttaactttgaatcgcaatttttgcatccgaagtggttccacctgcagcggtttaagatcaggtgacgtttcgatgggagcaggacttgtacgtgccaaaaatggtatcgaaactgccgttcgctcttcggtcaaatctcgatcgatcaaagctcaagcctctggtggagacattgaggatttgacaccgatcaaccctcangcgaaatcttctggggcagttctgccatttgttggtgttgcgtgtttgggagctatgttatttggttaccatctaggggtggtaaatggtgctcttgaatatctatc

SEQ ID NO: 23330 - DNA, 434 bp, Gossypium hirsutum
  Clone ID: LIB3272-023-P1-K1-B6
ggaagatcattgcgccagagttcttcatggacaaggttaagggcatggtggggctgatggtggaatcgacagtgccattgctaaaaaagtgggaagccatgattgatgcaggtggtggtttggcagctgaaattaatgtggatgaggatttgaggagtgtttcagctgatgttattgcaagggcatgttttgggagctcttatgttaaaggcaaacagattttctccaagcttaggaccattcagaccaccattaccaaacaaggctttctttttggcctcaatggttcaagattctttcccaacaagaaagtcagcaatttagaaagagaggtggaattgttgatttgggagaccgtgaaacgacgacagcaagaatgcgtagacaaatcttcaggtcaaaaggatttaatgcagcttatattagaaagtgct

SEQ ID NO: 23331 - DNA, 409 bp, Gossypium hirsutum
  Clone ID: LIB3272-023-P1-K1-B7
ggatcaccccccggttatgtcgggtatgaagaggggggtatgctcacagaagctattagaagacgaccattcacgttgttattgcttgatgaaatagagaaggcccatccagatatattcaacatccttctacaattgtttgaagatggccacctcacagattcacagggtcgaagagtatctttcaagaatgcattggtggtgatgacttcaaatgtgggttcttctgctattgcaaaaggtagacgtgcttccatcggcttcttgctcaatgacgatgaatctgcttcatatactggaatgaaagctttggtaatggaagaactgaagacatatttccgtccagagttactcaacaggattgatgaagtagttgtatttcggtctctaaaaaaatctcagatgcttg

SEQ ID NO: 23332 - DNA, 421 bp, Gossypium hirsutum
  Clone ID: LIB3272-023-P1-K1-B8
cctctctcaaaatctcaaacccagatttgttctctctctctctctctctctccaatcaattaattcctccattggaggagcttagggtttgttggtgttctgatctttgctctgtctgaaaaataaacagaattataaaccaacaccaacgccatgggaagatttgaagagggaggattcgattcagtggtttgccctaagcctatacgaacctttagatggtctaccaacagctgttatcagactgagatggctgattcaaaagctggtgcagagcttcttgatataatcctctccgagggagggtatggggccgagaaccccaccgaccaaatggcttcatcaccaccgtatttctgtggatcaccgccgagcagggcgtcgaatccggtaatccaagatgcccgattcaacgacgagc

SEQ ID NO: 23333 - DNA, 424 bp, Gossypium hirsutum
  Clone ID: LIB3272-023-P1-K1-B9
tataagttaagtaagctaatcaaggcggaggaggcgagagctaagctcgttaaacgagcaatttcgggggaggaagacgaggatttgagctgggatattgatgaggacgatgaaggagtagagggtggaaatgttgatagtgagaaaaaggagcatgatttgcgtgaagatagtgaggaatgttcgaaaaaggatgaggataaagtgagttcgtgtaaggatagtgatgtttccataatttcgacccaacattcaatggctgaggaggaagggtgggatgagattgaggagattcggagtagtaacgacaataaaggggacaatgttgttgggagcactagtaggattgatctatgtaagcggctgagtgttgcagaagaagaaaaagatttgacttgtgatatcgatgacgaggaagaagatc

SEQ ID NO: 23334 - DNA, 447 bp, Gossypium hirsutum
  Clone ID: LIB3272-023-P1-K1-C1
ctccctacggctgaccaaaaggacacccatccaccgtccgccgcactaccaccgtacccggtggcctacgatgcgcaaagatgggtttttagccctatttcaaggcgcgtttgaaggccaaaacgccttcgacccttgaaatcgaaagggtaagggctcgtgcccccttttgggttcgatcgcgacaacgacgaagagccctctgacgaggcggtcacgaggcagtttcagtgtagtgtgacgcgtggagaagatggcgtgcggcgtgctacgaagcggctcacgtggtggccctgctggtgaggagcggcggctgaagcctagtggctagggttgctgttgttttctttgtaatgggctagggttggaattgggcttaagtagtttgggttttaattgggttttaaaatttgggcttggttgggtttggatttgggttttttttgg

SEQ ID NO: 23335 - DNA, 423 bp, Gossypium hirsutum
  Clone ID: LIB3272-023-P1-K1-C10
accactcttatcaatctccaatcaactaataacctttccttcccttcttcttcttgttgttgttattattaacggactcgtttaactcagtgattcgtccaagaagccactgagtccggtgatgtggtcctgagttcttctttctttgaagggggtagaatcggaaactgaaaaaaagagagacaaaaatggatcgagcagacttgacggtcggaccggctatggatatgccgattatgcacgacggtgaccgttacgatttcgttagagatatcggatcgggtaatttcggagttgcccgacttatgacagataaggttaccaaggagctcgtcgctgtcaagtacatcgaaagaggccgtaagatagatgaaaatgttcaaagagaaattattaatcatagatcattgaggcatccgaata

SEQ ID NO: 23336 - DNA, 439 bp, Gossypium hirsutum
  Clone ID: LIB3272-023-P1-K1-C11
aaaagaaatcacagcgtcgtattgtcggtcattttctccgatggaatcccaaagctccgacgaagaggatcagttcttcgatgcatttgacgacttccccttttacgattgccttacctttgaccaatcagatccttccacgtctcacttaccgtctactctccgccggcgagccttatctcgccggggaatctcctccaaggaatccggaggagagtcccttccagaaacttccactctcgaagaccactccaggaccagttctagagagccaaggtacaatcttttccgcgatttgaagccaagcgacagcactttggtggtaaccgagtcgcctcgagatggagttaacccgatccgcgtctcagaagagaacgccggcgttgaatccactgtcaccaccgcagaaaatgatgaatcacttgaccaagcccgttac

SEQ ID NO: 23337 - DNA, 439 bp, Gossypium hirsutum
  Clone ID: LIB3272-023-P1-K1-C12
cggacgcgtgggcttctttcctacgccaaaatgccgccaaaatttgatccaagccaagtcgtcgacgtcttcgtccgcgtcaccggcggtgaagtcggagcagctagttcactcgctccgaagatcggtcctctcggtctctctcccaagaagatcggagaagatatcgctaaagagaccgccaaggaatggaagggtctccgcgtaaccgtcaagctcactgtccagaaccgccaggcgaaggtcatggtggtaccgtcggcggcagcgctggtaatcaaggcattgaaggaaccggggagggataggaagaagaccaagaacatcaagcataacgggaacatcggactcgatgacgtcatagagatcgctaaagtaatgaggccgaggtccatggctaaggatttgagagggacggtgaaggagattctgggcacct

SEQ ID NO: 23338 - DNA, 443 bp, Gossypium hirsutum
  Clone ID: LIB3272-023-P1-K1-C2
ctgaaacttacaacttcaccatgaacaaaagcaagctccagctgcaactttgtgcagggatatttactttaagcatcctctccaatggtgcttatggtagtgacaaaatctttgacataactcacaaaatcacttctcagttgccaacttttggatcacagaagggtcttggacaattcatttggcttctttccagcatcaaaaatgggtccacagcgaatgtgtcggagttcaaattgggaacccacactggcactcacgttgatgctcctagtcacttctttcagaagtactatgaacaaggatttgatgtttcaacccttagccttcaaactcttaatggacctgttctagtagttgatgttcaaagaaataagaacattactgctgaagttatgaagtccttgaaaattcccagaggagtacatcgggtgcttttcaaa

SEQ ID NO: 23339 - DNA, 363 bp, Gossypium hirsutum
  Clone ID: LIB3272-023-P1-K1-C3
caacattcccatttccaatctccagctcccaaggtaaatatgccgatcagaaacatagcagttggccggcccgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaagtggccacgtcaaccccgccgtcaccttcggtgctttcgttggcgggaacatcactctcttgcgcggcattctttactggatc

SEQ ID NO: 23340 - DNA, 421 bp, Gossypium hirsutum
  Clone ID: LIB3272-023-P1-K1-C4
ctttcctctcctctccacaaaacagttgaaaatatctctctcttcactttcttctctttgcaacgcagggtgaaaggcggggaggccgtaaacaatctctcttgcgctcttctcgtagaatggatcagattcaacatccaactgtcatgcagaaggtagctggccagctccttcttctagcatttcccgagattttcaagggtatgatgggtctttcaagaggcctgccctataccaaggacattttgcatatgggaattattccaatgctggaatgcactatcctattgttccatcaacagctaccgccatttgtgttcaagcccctgcagagaaaggatttaccagctttgccattgatttcctcatgggtggagtttctgctgctgtgtcaaaaacagctgctgctccgattgagcgt

SEQ ID NO: 23341 - DNA, 439 bp, Gossypium hirsutum
  Clone ID: LIB3272-023-P1-K1-C5
ctccttctaagccagagccaaagcagcagagaagaggagaggaagatagaaaaatgggcgcaacagccaccggcaaatctctccatttttgctcttcacaggaccccctttcatttctctccctaacaaaggcaaaatcaaaagcagaaaccctaaacctcaacttcagattctccaaacccccaattctcgtcgccttcgtctttccattagagcttcttcaccctcctccaccgccctcaatgacccgcctcttccctctctcaccaattccgatcttcaacttcgagttcgaatcctctctgaatcactcccctacattcagaaatttaggggaaaaaccattgtcgtcaaatacggaggtgccgccatgaaatctgcggagctcaaggcctctgttgtcagggacctcgtcctcctctcctgcgttggcctccgt

SEQ ID NO: 23342 - DNA, 438 bp, Gossypium hirsutum
  Clone ID: LIB3272-023-P1-K1-C6
catttcccaaatctcctccctcctcttctttagcgtccttttcatttccgctcatgcagcgcgctttgaaatccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccggtgattgtggtggactccttcaatgcaaaggttggggtgtacctccaaacaccctggctgaatatgcacttaaccaatttggaaacatggatttctacgacatttccttagttgatgggtttaacatccccatggtgtttggtccaactaatggcggttgtcacaacattcggtgcactgcagacatcaacgg

SEQ ID NO: 23343 - DNA, 329 bp, Gossypium hirsutum
  Clone ID: LIB3272-023-P1-K1-C7
ctataaacggtgttattgatgtattacgtgatgttgccacatggcaagccaaaggaaatgcggcggatacaatattcagcttatgatgggtacacgcctacaggaaagggctggggaggaagacacgtgtgataaaaggatgggtagattagtgaaaagactggcccaccaattctaaaaggagcgcacacgagactattttgaattgggcgggagataggcagacacgggagaggctagtgtaaggaggaagtatagagacagtgatccgagtcattaacatgctaccagaaaatgccatgtctatacttgatgcagaacctaagaga

SEQ ID NO: 23344 - DNA, 434 bp, Gossypium hirsutum
  Clone ID: LIB3272-023-P1-K1-C8
agccgattctctttggaaatttggtagaagaagtggtagtgggtaagcatctttaaaaaagcttacttttttcccccttcatttccattctcatcattttctcttttgttttcctctttttccaatatcatcaaaaaccagccctaacagagcagctgaacctaacatcatcatcatccatggcggcaccgatctggctatgggctttctctgtagccctaactctggttccgtctgtttttggaaactctgaaggagatgctcttaacacgttgagaaaaagtttgaccgatccagataacatactccagagctgggatccgaaccttgttaatccttgtacttggtttcacatcacttgtaaccaaaataatcgagtcactcgagtagatttaggtaattctaacctgtctggacatttggtacctgagctt

SEQ ID NO: 23345 - DNA, 436 bp, Gossypium hirsutum
  Clone ID: LIB3272-023-P1-K1-C9
ctaaccatgagctacttaaccattttcaaaatctcctccctcctattctttagcgtccttttcattaccgctcatgcagcgcgctttgaaatccgcaatgagtgctcctacaccgtctgggcagcagcctctcctggaggtggccgtcgcctagaccctcggcaaagttggaccatagatgtgcctgctggcactgctatggctcgtatttggggtcaaaccaattgcaatttcgatgccagtggtaggggtcattgccaaaccggtgattgaggtggactacttcaatgcaaaggttggggtgtacctccaaacactctggctgaatatgcacttaaccaatatggaaacatggatgtgtacgacatttgcttagttgatgggtttaacatacccatcgtgtatggtgcaactaatggcgggtgacacaacattc

SEQ ID NO: 23346 - DNA, 389 bp, Gossypium hirsutum
  Clone ID: LIB3272-023-P1-K1-D1
cttttcctctgaattactcgcgctcatgggaagagtctggaaggtaaaaaccgaagaaacaaagcgctctctctttttgtgaattcaatcaaatcgaagatgttgtgagtggcaacgaggcgggtcacttgttggtcggctgcgtggaggtcgcaccacgccacctccgatatcgactctcgtactttcatcgacggctccgattcttctgatcgtctcagatccaattgctcctcctgctgattttccttctcttacgcttctcaatgccgtcttaccaccagacgtttttcttctgagtcactcaccccaaaaagtgaccacagtgtgattcgtggtgttccagcaactgtggctggtattcaaaaccccaaagctaaaatagatta

SEQ ID NO: 23347 - DNA, 438 bp, Gossypium hirsutum
  Clone ID: LIB3272-023-P1-K1-D11
attcttctcctcaggcataacccgcattttctccttccaagaggccaacccgccggaaggtatgagaacagcgctcgcaggcttcgaaacatggtttctttttgccaccgggttcccttcaaaccccgatttcaacgaagccaaagggaatccgcggctcaatctcaaggcaagtcccctttttcttttctttttcatgaatgtaaaattataaaagcaaaaaaaaacggaggaaataacaaatagaatcgaggaacaaagatcaccttctcaagaagtgactctctgattttcaagcaaactgtattgcgtatgtattgcttgtttgtattctctctcaacgtaaccttttacaaagactcaaactctggctttatagcccgaaggaaagaggaaaaatttacgaaaaaacaaaaaatacaatgtttttcttttttg

SEQ ID NO: 23348 - DNA, 448 bp, Gossypium hirsutum
  Clone ID: LIB3272-023-P1-K1-D2
cggaccttcactttcccagacttcaagagtgggagaaaccgattctttcttcgagaacaaatcagccaagatcttagcagcaggccatacaggcctagttggttctgccataattcgtaaacgtcagtgcctacgctttaccaaccttctactccgcacccatgcccatctggaccttactcgccaatccgacgtgcgcatccttcttcgacgatgagaaacctcactacgtcgtactagctgtcggtaaagatggtgggatccacgccaacaacacttaccctgccgatttcattgccatcaaccttcaaatccagaccaacggcatcaattcctgttaccgacacggcgtgaacaaaatcctcttcctcggatcctcgtgtatatatcccaagtgtgcgctcgaacccatccgtgcaaatgcgctcttatccgggcgcctggaacc

SEQ ID NO: 23349 - DNA, 442 bp, Gossypium hirsutum
  Clone ID: LIB3272-023-P1-K1-D3
cttttcctctcgatttcccgagctaattggaagagtcttgaaggtaaaaaccgaagaaacaaagcgctctctctctttgtgaatccaatcaaatcgaagatgttgagagtggcaacgaggcggctcacttcttgttcgtctgcgtggaggtcgcaccaggccacctccgctatcgcctctcgtcctttcatcgacggctccgattcttctgattgtctcaaatccaatttctgctcctcctcattttccttctctttcgcttctcaattccttcttcccaccagaggttttgcttctgagtcactcaccccaaaaagtgaccacagtgtgattcctgatgttccagcaacagtggctgctattaagaaccccagttctaaaatagtttatgatgaatacaaccatgaacgttttccttctggtgaccccagcaagcgggcat

SEQ ID NO: 23350 - DNA, 442 bp, Gossypium hirsutum
  Clone ID: LIB3272-023-P1-K1-D4
cgatctaacacctttccttttcatttcccctttccttaaaaacaagctcaatcaggtaccccattaaccctaaacgaaaatcagctgaaaaaaaaccatttatttttcttcagctctaagcgacaagaacaatggctgacttcaagaaagccactgctttgattctcacagtggctttgcttgtgaatctcgctttaatggttgatgctgatggtgatgatgataagaagattcgagtcaggaaacataagggtgagaaggagtgtatacaagggtgggaatgttcctactggtcgaaatattgttgcaaccaaacgatttcagatgtcttccaggtttatcaatttgaggacctgtttgctaaaaggaattcgccggtggctcatgctgttggattttgggattaccattcttttattttggctgcttccatttatgagcc

SEQ ID NO: 23351 - DNA, 443 bp, Gossypium hirsutum
  Clone ID: LIB3272-023-P1-K1-D5
ctttcttcacacccgacaatctaaactacatacaagaaaaaagtgtgtttggcaaaagagaaaaaaaaaaaaaatcaaagatggcggaaaaagaagatctgggtttgagtctgagcttgagtttccctcagaatcaccactctttacagcgaaatcttaggccttcgcttgttccttcctctgctaattcttgctcttctccttctactttaacccttaacaaacactcatggaatgattcttctcctccttcagatcataacttggaatcattccgggcggagatggggtcaatttttagaggaatcgacatgaacatattgccatcgacggcagattgtgaagaagaagctggggtttcatctccgaacagcacgatatcgagcgtgagtggaaaaaggagcgaaagagaaggcaacggagacgagcttgagatcgaaaaa

SEQ ID NO: 23352 - DNA, 220 bp, Gossypium hirsutum
  Clone ID: LIB3272-023-P1-K1-D6
ctatcttccccccccacaatctaaactacataccctaaaaaaccgtctcagccagggttgtgataaaaaatttttctaagatcacccaaaaaaaaacccttcattatagtctaaccttgagctaccctaacaattaccactctttacaatgctatctttcgccttctcttattccttcctctactaatatcttactctcctccttcaactttaacccttt

SEQ ID NO: 23353 - DNA, 440 bp, Gossypium hirsutum
  Clone ID: LIB3272-023-P1-K1-D7
ccacgcgtccggctaagggtaccaccacgctagctttcatctttaaggaaggggtcatggttgccgctgattctagagctagcatgggaggctatatctcttcacaatcagtgaagaaaattattgaaatcaatccttacatgcttggaacaatggctggaggagctgctgactgccagttttggcacagaaatttaggcatcaagtgccggctgcatgaattagcaaacaagcgtagaatttcagttacaggggcatcaaaactgttggcaaacattctctattcttaccgaggaatgggactttcggttggaaccatgattgctggatgggatgaaacgggccctggactatactatgtggacagtgaagggggaaggttaaaaggaatgcgtttctctgttggatctggttcaccatatgcttatggtgtgctggat

SEQ ID NO: 23354 - DNA, 434 bp, Gossypium hirsutum
  Clone ID: LIB3272-023-P1-K1-D8
atttaattcccgttttccaatcttttttgagaaatcggtagcgaaaaatgtcgtcgtcggggaggaagatcacccttaagagctcagacggcgaatcattcgaggttgatgaagcggtggcgttggagtcgcagacgattaagcatatgatcgaggacgattgcgctgataacgggataccgttgcctaatgttacgagcaagatcttagcgaaggtgatcgagtactgcaagaaacacgtcgaggctcctaagacagacgatcgatccgccgatgacgagctcaagagttgggacgctgactttgtcaaggtcgatcaagctactctctttgatctcattctggcagcgaactatttgaacatcaagggcttgctggatctcacttgccaaactgttgctgacatgatcaagggaaagaccccagaagagatc

SEQ ID NO: 23355 - DNA, 413 bp, Gossypium hirsutum
  Clone ID: LIB3272-023-P1-K1-D9
cttatattcatcacttgtttaaggggtgtcggaccatcgaccgtttgctgtgcttcagatcgttgaaatcgaggagaaaatgcaaatattcatattgtgtaatcagggcgaagggactttggctagctgagaaatacagtggtaaagatggtgaacatgacactgattgccactgtgactgatggttttctatattgcggagggactagatgatggttgtgatctggctgatgctgaaatgtacaaacatcatgttaaggctgtatttaacaatctctacaaaggccataatgaggcttgaaggatgtgtatagaaaccggcccatatatcttccactatatgatggaaagacgtgtttgttacttgacaatgtgcgatcgatattattcgataaaacatggcttttaatata

SEQ ID NO: 23356 - DNA, 433 bp, Gossypium hirsutum
  Clone ID: LIB3272-023-P1-K1-E1
ctgattttccttttctctctctctctctttatgtctgtgtttatctctatctctagttgtcttagccgttggaaactgaggtaagaaagtggagaaagaaagttcaaaaaaaaaggtgtatttcatatgggttggttcccttgtggtggaaaaccaaacaaaaaaggaaagaaaaagctgcccaatcataataatacaaccaccatcaattcatctgatgatcagatcccatctacttcagaaaagctgaaggtgaattctgtgccggatgctaagaaggaggctaacaaggatggagggtcggatcacattgcagcacacacatttactttccgtgaattggcagctgcaacgaagaatttccgggcagattaccttctgggtgaaagaggttttggccgagtgtataaagggcgattggagagcactaatc

SEQ ID NO: 23357 - DNA, 436 bp, Gossypium hirsutum
  Clone ID: LIB3272-023-P1-K1-E11
ctcaagtcaagctccccatgtagatcctctcctccttatctttcctgttttctctgtttttctctctcaaatgcggatagaagctaatagaaattagctttttcactcatgggctctgtcactgtaaaaccctcattaaatactttctgttttattcccaagagtcccaaaattcgttgtcattcgcctcacttctcattcctcaaactcagaccttcccttgtttctttcccctttaaatctccttctgatccaataaactcatatcccaaatgtaaaattcgaagctttatggttaaccctttattggttttagtcccagttttgagaagcatcagaggcttggctttttcgcattcccaaaaatgggcttcacgtttgcacgattgcattacagaatcggaagaaattttagaccaatacaatggcaattatt

SEQ ID NO: 23358 - DNA, 433 bp, Gossypium hirsutum
  Clone ID: LIB3272-023-P1-K1-E12
gcgaaaaggatttgctcaaagccgtggaccgcgagtacgtgtttgcttacatagatgatccatgcagtgctacttatcccttgatgcaaaagctaagacaagtccttgtcgagcacgcattcgccaatggtgacaatgaaaaggatacacacacttccattttccaaaagatcacagcatttgaagatgaattcaaagctgcattgccaaaagaagttgaaggtacaagggtttcacttgaaaatggaaatgcaacaatccctaacaagatcaagggttgtagatcatatccattgtataaatttgtgagggaagagcttggaactgggttgttgagtggtgaacaaggtaagtcacctggtgaagaatttgataaggtattcatagctatgtgtgaagggaagattatcgatccaatgatggaatgtttaaa

SEQ ID NO: 23359 - DNA, 438 bp, Gossypium hirsutum
  Clone ID: LIB3272-023-P1-K1-E2
cgcgtcgaccgagggagctctccggagtcggtgatggcggcgtcgccggagcatcgtgatgattcctcctcctcctctcccgtagaagttccggtcaaaaaagagctagaaatatgcgtcgatgctaaacagatagatagtgacggaggctcccgggaagccgccagtggcgacaattcccgcgccgaagttgattttgcattgaataacggtgctgctgagccttatagcattgttcaccgaagcttttctgaagttggaacattgcgtgtgggcacttcaaacattgaaaaattggattcaagccagcctaaattggtaaaatcaaaaactgaggcacccagacatcggagcatacttgctgaagatgcagcacagatttttgacaataagatgtctgcccaaaagaagcttcaattgttgaacagaatagctacc

SEQ ID NO: 23360 - DNA, 431 bp, Gossypium hirsutum
  unsure (1)..(431): unsure at all n locations
  Clone ID: LIB3272-023-P1-K1-E3
ctgcttcttcgatactctcaaggctcaacctttctgggttattttccttttcactttgggttctttatcactcttgaagttttcatttgtttttctgaaatgggtctggatcaattttcttagacctggtaagaatctcaaaaaatatggttcctggggtcttgttactggaccaactgatggtatcggcaaaggatttgcctttcagctggctaggaaaggccttaatcttgtcttggtgggccgtaatcctgataaactgaaagacgtttccgattcaatcttggccaagtatgccaagattcagatcaggacagttgttgtggacttcactggcgatcttgatgaaggcgtgaagaagataaaagaaactattgaaggactggatgtggnggttttgattaacaatgttgggatttcatatccttatg

SEQ ID NO: 23361 - DNA, 423 bp, Gossypium hirsutum
  unsure (1)..(423): unsure at all n locations
  Clone ID: LIB3272-023-P1-K1-E4
aaaggtttttagggcttttctaacttttctgattattttttgataatccggagttcaatcatctaaaagaagccctaaaatccttgaatcaggtctgagcttgtggtttgttaggcctctttgatcaaactaagtttcatgtctgatcttgacgttcaaattcctactgcctttgatccctttgctgatgcaaatgctgaggactcaggtgcgggtgcaaaggagtatgtgcatattcgtattcagcaaaggaatggtcgcaaaagcctgacaactgtccaggggttgaagaaagaattcagctataacaagatacttaaagacctgaagaaggagttttgctgcaatgggaccgtggtccangaccctgaattaggacaggtgattcaacttcaaggtgaccagcgtaagaatgtatcaacc

SEQ ID NO: 23362 - DNA, 442 bp, Gossypium hirsutum
  Clone ID: LIB3272-023-P1-K1-E5
gaaattcacggactcaccggtgatacagcttcaagtgcgtgattcccaactctctatccaacaagacaatggctccttccacgttggtacctccgtctggccttgttctttggttctagccaaattcgtagagcgctgggcaccatcttcgcccaccaccaccaccagcgataacccttattatgacctccttgattttcacacccgccgtcgtcgcgccatcgaattgggaactggttgtggagctgctggcatgactttccgcctattgggtctccaagacatcatcctcaccgatatatcccctgttatgcctgcgctcaagcataacctcaaacgtaataaacccgttctgggtaagaacatgaagacctcgattctttattggaacaacaaggatcagatcaggggcgttaatcctccgttcgatgtggtgatcgcg

SEQ ID NO: 23363 - DNA, 445 bp, Gossypium hirsutum
  Clone ID: LIB3272-023-P1-K1-E6
atcccttcaaaaccttgccaaccctttctttcctcttcttaacccttttcagcttagccgatgcagccacatttgatataagaaacaactgcccttacaccgtttgggctgccgcatctccgggtggtggcaagagacttgaccaaggtcaagcatggcaaatcactgcagcctctggaaccacacaagcccgaatttgggctcgaaccaaatgcaatttcgatgcctccgggaaaggctcatgcgagacaggcgactgcggtggagtcctcgaatgcaagggatacggtaaagctcccaacacactagccgaatacgcaatcgaccaatttgagcaccaagacttcattgacatctccaacatcgatggctttaatgttcctatggagtttagctccaactccccagggtgcactagggttatcaagtgtacggccgacattgg

SEQ ID NO: 23364 - DNA, 425 bp, Gossypium hirsutum
  Clone ID: LIB3272-023-P1-K1-E7
gtctcaaccaaactctctctggtgacccttcaaaagaatcaccgccatggcgatgcaaaccggagtcggcttttcgaagattttgatccttgccggcgcaggttacaccggtacgatccttctcaagaacggtaagctatcggacatgttaggcgaattgcagtctcttgtgaagggactggaaaaaactggggaccaatcagatgattcagatgcccttctggctcaggtgcgtcgtctctcaacggagattaggcaactggcctcagcacggcagataactgttctgaatggggattccggcgttaagttaacctctctggtaatccctgctgctaccttgggggcattgggttatggttacatgtggtggaagggcatttcgttctctgatctattttgggtaacaaaacgcaatatggcat

SEQ ID NO: 23365 - DNA, 439 bp, Gossypium hirsutum
  Clone ID: LIB3272-023-P1-K1-E8
gtgggctaattctcttctcttgaaagaaactcaggctggagattgagtcttaattgtcatggatcttgagtttgggaagtctttggatacttcaaagaaattcttggaggacctcattgctattagcgtaccaaagtcttggtgtagtttatggggacctgagtacttctcctctttatgtctacaaaagtacatttgctgaagacattcaacattcagagacaaatgaagagatttttggtgttctatcctttgtcttctggacccttactttagtccccttattcaagtatgtgtttgtggttcttcgagcagatgacaacggagagggaggtacttttgcattatattctctgatatgccgacatgcaagagttagtcttctgcccaacagacaggtcggcgatgaagcactctttacgtataaacttgagcacca

SEQ ID NO: 23366 - DNA, 443 bp, Gossypium hirsutum
  Clone ID: LIB3272-023-P1-K1-E9
gcgagctttgcacctgcaggaaaacagccacaaagataaagctgaattccaagaagcaaagatgttgagcgtctcaattgcgtccccagctaccttaactctccctccaaaacccaaatcctcaattcccaaaacttccttcaccggcgttagaatccagcacttatgtccccaacggttgccttctcaggcgacctgcttttggcaaccgtcaccttcgtcctccgtggtcatgatggctaagagagaagaagaaatgaaggaaataagagccaaaaccactgaggaaatcaacgatgaagtggttgaattaaaaggtgagcttttgatgcttcgtctccagaaatcggttcgtaatgagttcaagtctagcgagtttgggcgaatgcgcaaaaagattgctcgcatgcttactgttaaacgggaaagagagctcgaagagg

SEQ ID NO: 23367 - DNA, 442 bp, Gossypium hirsutum
  Clone ID: LIB3272-023-P1-K1-F1
ctgagttccaaaccaatttggttccatacccccgtatccatttcatgctctcttcatatgcacctgtcatctcagctgagaaagcataccatgaacaattgtcggttcccgagatcacaaatgctgtgtttgagccttcaagcatgatggcaaaatgtgaccctaggcatgggaagtacatggcatgttgcttgatgtatcgaggagatgtcgtccccaaggatgttaatgctgctgttgctaccatcaaaacaaagaggaccgtgcagttcgttgactggtgccctactggcttcaaatgtggtattaactatcagcctccaactgttgtacctggaggagatctcgctaaggtgcagcgagctgtttgcatgataagcaacaacacagcagtggctgaggtgtttgcacgcattgaccacaagttcgatctcatgtactc

SEQ ID NO: 23368 - DNA, 422 bp, Gossypium hirsutum
  Clone ID: LIB3272-023-P1-K1-F10
ctcgaaacagtacctccggttccaacttcagctcaaaaatatgtcaggggaagaagttgcggttgcccaacccgaggcggcgcctgcactcggtgagccaatggacatcaacacagccttgccccttgtggttaggaagtcacgagctcacggtgggctcgcacggggcttgcatgaagctgccaaggcaattgaaaagcacaatgcgcatctttgcgttatagctgatgactgcgaccagccggactatgttaagctggtcaaggcactttgtgctgatcataatgttaaagtgctacgtgccccgagcgcaaaaacactcggcgagtgggctggtttgtgtaagatagactctgagggtaaagcacgaaaggtagttggttgttcctgcgtagttgtgaaagattatggtgaacaacatg

SEQ ID NO: 23369 - DNA, 214 bp, Gossypium hirsutum
  Clone ID: LIB3272-023-P1-K1-F11
attttcattttcttgttccttccttcgccgtctattgctttttgttacctcgatttcaagtgaatcagaatgggtaaggaaaagactcacattaacattgtggttatcggccacgtcgattctgggaaatcaaccaccactggccacctgatttacaagcttggtggtattgacaagcgtgtgatggaaaggttcgagaaagaacctgttgaaa

SEQ ID NO: 23370 - DNA, 434 bp, Gossypium hirsutum
  Clone ID: LIB3272-023-P1-K1-F12
attcattttctctacctttggttgttccttttcttgtctcttctaatcttttatatttccatatatttttttagaaaaaaaattgtaaatccctcttgctgtttttctgccatggttgttgctgttttaaaaccagaagactgtttaaagctacctaatcccatgaaacaacctcaaaatccttggcataatcctaatcccagcactaaccggacgaatcgttcacaagggaaccgtaagaagcgttctcccaacacctcccctccttctcgtcccaccgtcggtcgccccaaagctccggccaagaatctcgtcatgggtcaagtcaagatcctcaaacgcggcgaagatcttaaaccatctaagccggataagcatgtgaggttcgcaaaggaaaacgttcatgtagatctgggttccaccgactgtttgag

SEQ ID NO: 23371 - DNA, 435 bp, Gossypium hirsutum
  Clone ID: LIB3272-023-P1-K1-F2
ggaaaacaaagaagaaaaacttaatcatggctcggttgacgttcgtgacctccatcatccttctgctatgctccgttgccgctggatcaactttcgacgactccaaccccatccagatggtatccgatggcctcaccggcttcgaatcctccgttcttcgtgtcatcggtcacactcgccatgctctctccttcgcccgttttgcatacaagcatgggaagaggtatgaaaacgtggaggagatgaagctacggtttcagattttcgaagacaacttggatttaatcagatccactaacaagaagggactgccttatactcttgctgtcaatcagtttactgattggagctgggaagagttccagaaacacagattgggggctgctcaaaactgctctgctaccacaaagggcaatcaccagctcactgatgtcg

SEQ ID NO: 23372 - DNA, 328 bp, Gossypium hirsutum
  Clone ID: LIB3272-023-P1-K1-F3
caattttctgttattttctctctcgacaaacaatggaagcgttctttgaatctcgatcgagaagcaactggagttacgatacactcaagaatttccgtcagatttctcccgtcgttcaatctcatctcaaaagggtttatttgaccttatgttgtgccctggttgcctctgcttttggggcttatcttcatatcttatggaacattgggggttacctcacatcattcgcatgcttcggaaccatgatttggctcctctctatccctccttatcaagaacaaaggagagtttcccttctgatggcatccgcaatgttcgaaggggcttc

SEQ ID NO: 23373 - DNA, 445 bp, Gossypium hirsutum
  Clone ID: LIB3272-023-P1-K1-F4
taacccgtttgcctccggcatcttcccactcatggcttcggagaaagaagctgcccttgctgctgctccctctgattctcctaccatatttgacaaaatcatcaacaaggaaatcccagctaccgtggtgtatgaagatgataaggtcttagctttcagggacatagctccccaggctcctacgcacattttaattattccaaaatcaaaggatggcctaacgggtttgtctaaggctgaggagaggcactgtgaaatccttggctgccttctttatactgcaaagcttgttgcaaaacaggaagggctggaagatggattcaggattgtgatcaatgatggccctaaaggatgccaatctgtgtatcacattcatgtccacctcattggagggcgccaaatgaactggcctccaggctaaataaagatgttatagttgatatag

SEQ ID NO: 23374 - DNA, 432 bp, Gossypium hirsutum
  Clone ID: LIB3272-023-P1-K1-F5
gaaaaaaaaaggcccttttttttttctctcttgtttttaagttcggatgttcattttctatagacaaaacctttattttttttttataagagtatataaatatagtcttgacggaaggcttcgacacaatcatccacttagtaccatcatcaagcaataaagcagggtgacatgacggtgcaatagtcaataaccaaattgtctataaatctatcattgattggataacctttcattcttgcactcaaatagtggaaacttttctgggttcttctggttttgtgctcttaatcagcagttgcagtactttattgctctttggagattgtatagtctttagtcatggccctttgtgcatcttcatttcctgccattatcaactggggtgcagcttcagatcctcaaaaatccactccttttgcttcccatttt

SEQ ID NO: 23375 - DNA, 398 bp, Gossypium hirsutum
  Clone ID: LIB3272-023-P1-K1-F6
gtctgccatataatcatataaccaggctccggggtggaactctgcggccaccacaatggcgaaaatagacttggggacaagccaagaggctggttaacctgactgcatcaaagcccttgtgggcgagtttatcaccactttcctcttagtattcgatggagtaagagctgccatggccggcgatgagtccgaggcaaatgcgctggtgggattggttgctggggcgtgtgctcatgcccttgacgtcggcgctatgatatcggacggacacatatgaggcggccatcttaaccgactcgccacgcttgggttgctattcagtggcaacatcacaggggtgcaagcgatcctatactggatcgatcaggtggtggcatctgcagctgcttgtatactac

SEQ ID NO: 23376 - DNA, 428 bp, Gossypium hirsutum
  Clone ID: LIB3272-023-P1-K1-F7
gactgaacaagagcaggcactctcttcagagcttagcaacaaggtgaaaggaaggcagacagcacgtgaaataattttatggattgaggaaactgtctatactattcacggccaggaaattaccctcagtgtggttatacaaactcttcttgacattgggtctaaaagtttcactcatttgatcactgtcttggagaggtatggacaggtcatggcaaaactttgcgctgatcaagataagcaggtcatgcttatatctgaagttggttcatattggaagaacaatgcacagatgacagccataacaattgatagaatgatgggttatcgtcttatatctaatttggccattgtgagatgggtcttctctccagaaaacattgagcaatttcatatatctgatcgtccatgggaggttctgaggaatg

SEQ ID NO: 23377 - DNA, 439 bp, Gossypium hirsutum
  Clone ID: LIB3272-023-P1-K1-F8
gtactttcaagggccgacagaggcaccactggacgcggagagcgcttgtacggggatatctgaaaaaggagctttcccaacatatcacgggaaaggttttgatgggcaaaacgacggaagccagctataacgcagttggagttaacggtcgtaagtatttgctcccagcgatgtggaatcctcagacctcggcatgcaaaactcttttatgaaacaaacaaaactgacaataggaacgaaggacatcctaatgttattacgtatctatatcatgaactccatccgatattgatacggacaaacacagtatgtaaaaatattgtaataaatttgtacgtgatgcatcattgtaattaaattttgtaaaatctatgtgccatttttaattataaaagggggccactcaagggccatacctaataaatatttgggcttaaaa

SEQ ID NO: 23378 - DNA, 439 bp, Gossypium hirsutum
  Clone ID: LIB3272-023-P1-K1-F9
cggacgcgtgggctaatattctctaaacatggctctgagatggtttctgcattcagcatgtcatgttctggggtacctacatgagtctgatgacatgcagtactgcaagaacatggcaagtgaacaaagtggaggagtgactcagagctcaaaggtgtcctccaacgctgagctgacggtggttaaagcgaaaatgcatccgggttcggggtttcagatgccgctgcactatcctcgttacgcgaaagcggattacgagaaaatggaggagtggaaagtggacatgcttctcagggaatatggactaagtttggagggcaacctcagccttgatatgagagcatatgcaatgggcacattcttgtggcctcatcagtattgatccatcttctaatcatcatcgtgccttaatcaagctgctagctaatatcatatgcat

SEQ ID NO: 23379 - DNA, 393 bp, Gossypium hirsutum
  Clone ID: LIB3272-023-P1-K1-G1
aaaaaccataaccaagcaaaacaaaatcgaagggaagtgtgtactgctttcaaactatgggttctttttctgatccatcctcattttctttctctcggtttctcagcttttcttttaaggatcacatcatcacattccggctgcttacatcaacttcacggcaaaccatttactgttaaaaggcaaaaaactttggatctataagaagggaacaaacaagttgtgttttgatagtgggttttggattatagaggcaatgaggcatttttcctccatgttcaatgggttggcgaggtcgttttcgatgcgaagagggaagaattcgagcaatggtgatggaagagaagctgctgagacaatggcaaaagatgcaaagaaacatgacatgatttt

SEQ ID NO: 23380 - DNA, 431 bp, Gossypium hirsutum
  Clone ID: LIB3272-023-P1-K1-G10
gccgtctcttcctcctccactttcagatcaccaaaaccttcaacaatgggctttgttaaggctcaaaaaaccaaagcttactttaagcgttttcaggttccattcaagagaacgagagagggaaagactgattacagggctaggattcgcttaaccaatcaagacaagaacaaatactacacgcctaaataccgattcgttgttcgatttagcaacaaagatatcaccgcacaaataatttctgccaatattactggtgatatggttcttgcttcagcttactcacatgagcttgctcgttatggacttgaagtcggtcttacaaactatgccgctgcttattgcactggattacttttgggacgccgcgtccttaagttgcttgaaatggacgatgaatatccacgcaatgtggacgctaccggagagga

SEQ ID NO: 23381 - DNA, 438 bp, Gossypium hirsutum
  Clone ID: LIB3272-023-P1-K1-G11
gtaggattgcctcctctaccaccttgtgagtcccttcgatcgctgtctatccgtggctgccgggggtttggtgatgctagcttggctgcgttggggaagttgtgccctcaactgcagaatgtggagttgagtgggcttcatggaataacagatgttgggtttttcccattgctcgagagttgtgaggccggtttggtgaaggttaatctcagcggttgtcccaatttgggtaacaaagttgtttgtaagatggctgatttgcatggttggactctagagatgctgaatcttgatggatgcaagatcagtgatgcgggggtggttggaattgcatagaactggcacttgctcagtgatctctatgtttccaagagcacaataaccgactctggaattgcagctcttgctcgttctaatctgatcaatctgcagatccta

SEQ ID NO: 23382 - DNA, 252 bp, Gossypium hirsutum
  Clone ID: LIB3272-023-P1-K1-G12
ggggctgtcgtgcccggctacggggtctgcggcttgctcttttaaccaatcgtgcggtggagattcatttttttcggccaacttggttcgagattccttaggattagccaatgacattgtcccacattttgctttcggatgtataaacgtcatctctggtggatcagtaccaccgcaaggactgttgggtttgggtcgtcgacccatgttacttatttcacaatccggggccctctactctggtgttttatc

SEQ ID NO: 23383 - DNA, 432 bp, Gossypium hirsutum
  Clone ID: LIB3272-023-P1-K1-G2
cgtcctcccaacttccacacccatacgaaaatgacaacccgcttcaagaagaaccgcaagaagcgcggccacgtcagcgctggtcacggacgtattggtaagcataggaagcatcctggaggtcgcggaaacgccggaggcatgcaccaccacaggatcctctttgacaaatatcaccctgggtatttcggtaaagtcggtatgaggtacttccacaagctccgcaacaagttttactgccccattgtcaacatcgacaagctctggtctctcgtcccacaagacgtgaaggcaaaagccaacaaggacgctgcgccgatgatcgacgtgacccagttcgggtactttaaggtccttggaaagggtgttttgcccgaggaccaaccgatcgtggttaaggctaagttggtgtccaagacagctgaaaagaag

SEQ ID NO: 23384 - DNA, 430 bp, Gossypium hirsutum
  Clone ID: LIB3272-023-P1-K1-G4
aacaaatcaagcttcaactccactttacctgtgaaaaagcttcactcattcattcatgcatctctttttttttcctctaagaagaacaagagagttgcttgaattgaattgcctcaaaactctttgatgtctgtcccaaagctgtttcctttaacttctctttgtctcctgttctcgaagaagaggagcctgtgatatagattgaagaagcaagttagatttaaaaaggacaatgcggttgtttccatcgaattcgagtaagggtcagagtaatggtggaagcaatcgtgctttgttgtatctcaatgtatatgacctcacacctataaataactacctttactggtttgggattgggatattccactcgggtatagaagtacatggtttggagtacggatttggagcgcatgagtaccctacaagtggg

SEQ ID NO: 23385 - DNA, 441 bp, Gossypium hirsutum
  Clone ID: LIB3272-023-P1-K1-G5
caaaaagcttcaaatctcctctgcctattggagattacagcaaaaggcttttctgtttttgtttttgttttattttttatttatttataattttacaagtgtaaaaatccccttggggaatgcagagagatgagacgttcatcgttggcaaggcctgagctttcttaccaccgtaagcgctccattggcggccgaaattgtcaccgaaaacacgtcgaagacgggtgattcagtttgaagggtttcagttttaaatatacatatatttctcacttctattgtaaatagacagtaattcagatcaaagggtatccgtttcttttcttatttttcgttttaatttctcgagcttttacggttcaaaaatggcggacaaagctaaaaccgaaaacccatcttttctccatggaaaatacgagcttggccgtatgttgggtcatg

SEQ ID NO: 23386 - DNA, 442 bp, Gossypium hirsutum
  Clone ID: LIB3272-023-P1-K1-G6
gactgaacaagagcaggcactctcttcagagcttagcaacaaggtgaaaggaaggcagacagcacgtgaaataattttatggattgaggaaactgtctatactattcacggccaggaaattaccctcagtgtggttatacaaactcttcttgacattgggtctaaaagtttcactcatttgatcactgtcttggagaggtatggacaggtcatggcaaaactttgcgctgatcaagataagcaggtcatgcttatatctgaagttggttcatattggaagaacaatgcacagatgacagccataacaattgatagaatgatgggttatcgtcttatatctaatttggccattgtgagatgggtcttctctccagaaaacattgagcaatttcatatatctgatcgtccatgggaggttctgaggaatgcaattagtaagaca

SEQ ID NO: 23387 - DNA, 443 bp, Gossypium hirsutum
  Clone ID: LIB3272-023-P1-K1-G9
ggccgccgttgtcgttcagcagcagaacagcaaaagaagcaaagcaatggcaaggatcaaggttcatgagttgcgacagaaatcaaaaaccgagcttttagctcagttgaaagatctcaaagctgaacttgctcttcttcgcgttgctaaagttaccggtggtgcacctaacaagctttctaagataaaggtggtgaggctgtccattgctcaagttctgactgtaatctcacagaagcagaagtctgcattgagggaggcatacaagaataagaaattcttgcctcttgatctccgtcccaagaagacccgagccatccgcagaaggcttaccaagcaccaggcatttttgaagaccgaaagggagaagaagaaggaaatgtacttcccaatgaggaagtatgccattaaggtgtagggcaggatctcacattctatttaaa

SEQ ID NO: 23388 - DNA, 428 bp, Gossypium hirsutum
  Clone ID: LIB3272-023-P1-K1-H1
accattctaaagaggtcatcgtaaattcgagtacaaagcgctaaccgagatgagagccaagtggaagaagaagcgtatgaggaggctgaagaggaagcgccgaaagatgagtcagagatccaagtagatgcgccttggactgaattagttttgccctgacaatcccttgtcttcataattatcctgcatatgttgcatgaagttgtgaagattgaagggtattttcaggcaaccttatctgttttgtcttctatatctcggttaaagttttaagactgtttgagatgtttgtctagtactattagatattatgttggggatttgtggtttgatctgtgtaagcagttatcttaacatcctaaatgtttgaaattgaaacttttgttcttcttatatggtctataatatgcgagatagattgtttcctt

SEQ ID NO: 23389 - DNA, 311 bp, Gossypium hirsutum
  Clone ID: LIB3272-023-P1-K1-H10
actcaaggttgtttttcttttatcaactgttccaatccaaactcatagatccggtggccgaggatgactttgtaactaacgatcgcaaaatcctggtggccgtcgatgaaagtgaggagagcacgaacgctctctcatggtgcctcaagaacatgatttcttacacttctaaagatacccttgtcctattttacgctaaacctccactagccatatacactgtcctagatggcacggtgtatttgatttcttctgatattctggcctctatggacaagtacacccacgatgtggcggattgtgtcatctaa

SEQ ID NO: 23390 - DNA, 444 bp, Gossypium hirsutum
  Clone ID: LIB3272-023-P1-K1-H11
ctttgccttaccctattctcacccacacattccacggattgttcatcgctcaaactctccggtggcaaaaaacaatactccaattgcacccacctccccaccttgaacgcaaccctccatttcacctacaatgccaccaattcttccctttccatagccttctcagcacctccggctaaagccggcggttggattgcttgggccgtcaaccccacggggacaggcatggcaggttcacaaaccctcctggctttcaaaaacaatggatctatggttgttaaaacctacaacataagctcctacagttccattgtggaagggaagctttctttcgatgtttgggacttggaagccgaagccggcagcgatgggaagatgattttatatggttcattgaaagtggaggaaagtgcggagaagttgaaccaggtgtggcaagttggg

SEQ ID NO: 23391 - DNA, 446 bp, Gossypium hirsutum
  Clone ID: LIB3272-023-P1-K1-H2
gggagaggaggtgaacatgactctggcaaaaacagaggcgaagttgcttcatgagaaaatttcaaacaaagcttacagtgatgacgatgtcataagggttttggctacaagaagcaaggcacagatcaatgcaactctgaatcactacaaaaatgaatatggaaatgacataaacaaggacttgaaggctgaccctaaggatgagttccttgcactactaaggtccacagtgaagtgcttggtctatccggaaaagtattttgagaaggttcttcgcctagcaatcaatagacgaggaacggatgaaggagctcttacaagagttgtttgcactagggctgaggtggatctaaagatcatagcagatgagtatcagcgaaagaacagtgtcccactgactcgtgccattgtcaaggacactcatggagactatgaaaaattgctgg

SEQ ID NO: 23392 - DNA, 432 bp, Gossypium hirsutum
  Clone ID: LIB3272-023-P1-K1-H3
gcggagcagcagcaactagagccatggaccgacctcagtggcaaagtggtgatggtgacgggggcatcttctggtttaggtcgtgacttttgtcttgacttgagtaaagccggctgtcgtatcgtggctgccgcgcgccgcgtcgatcgccttaaatccctctgtgatgaaatcaatcacctcacctttcctttttccggaccccagcctagtggccctcgagctttcgctgtcgagctcgacgtatgtgctgacggatccaccatacagagctctgtgaaagcggcctgggatgcctttgggaggatcgatgctttaataaataacgctggcgttagaggtaatgtgaaagatcctttggaattgactgaggaggaatggaatcaaaacatcagaaccaatcttacagggtctttgttggtgtaaaatatg

SEQ ID NO: 23393 - DNA, 426 bp, Gossypium hirsutum
  Clone ID: LIB3272-023-P1-K1-H4
aaagaaccagagttttgtttctctttagtttacgttttttttgtccttttggattttttgatactaaaaaagggaagcaaagaagaagggaaatggagggcaaagaagaggatgttagattgggagccaacaagttcacagagaggcaaccaattgggaccgcggctcagactcaagatgacgggaaagactattctgaaccaccaccggctccatttttcgagcctggcgagttaacctcatggtccttttatagggctgggattgccgagtttgtggcgactttccttttcttgtatatcactattttgactgttatgggagttgttaaggaaaaaactaagtgcccaactgttgggattcaaggaattgcttgggcttttggtggtatgatctttgctcttgtttactgcactgctggcattt

SEQ ID NO: 23394 - DNA, 444 bp, Gossypium hirsutum
  Clone ID: LIB3272-023-P1-K1-H5
acccattgattttctctctgattcgatatccagatcagaaaattagccacgaaatcgataaagcttttcgcgatacccagaggtgaaacaaattgtcacagcctagacgggtgcacgggtgattatggcagacttagaaaatttgcttcttgaggcagcgggaagaactggtactgggggaaggaaccgacactcacttccaccatctagaaggcgacgtgaaggttcatattcagatgggggaagtgactctagggatgatgattcggatgatgatcatgggtatgcaagtagaaaaccgtctggttcacaagttccattgaagaagaggttagaccctgctgaaagagatgatgatcagggcagtcaggaagaaggtgattatgatgatgcttgttctggtcgagagcgtgacagcagtgatgaatctgatgttggtgacga

SEQ ID NO: 23395 - DNA, 435 bp, Gossypium hirsutum
  Clone ID: LIB3272-023-P1-K1-H7
gtggagagtctctctctggtctttttttccccaaatttttttttatttctctttcttttaatttcttcatttttccctaattagggttttttttttttgttaatttatgaactttttagggactttatttcaataaatttaccaagtttctcaattacttagatcgaaactcgaacgagagagaaaaaaaagtagcgttcttttctcaacagaaggaaaaagaatggagtcaaattcatggaggtttcgattttccaattcttcttcgtcttcctcaaggcgtcatcaatctcgatctgatccgtttctgggtggaggatatgaagaatttgatggagacgaggatttcaaggcggagtttttatgtccgttttgcgctgaggatttcgatattgttgggctttgttgtcacatcgatgaggaacatcctgttga

SEQ ID NO: 23396 - DNA, 437 bp, Gossypium hirsutum
  Clone ID: LIB3272-023-P1-K1-H8
attccttctgtcattttgggttttactcctttttttgtgaaatcagggaaatggatcttgatctttctccaaagctggcaaagaaagtgtacggtgacgatggtggaagctactacgcatggtgccccaatgaactccctatgttgcgtcaaggcaacattggtgcagccaagttggcccttgagaagaatggctttgccctccctcgttactctgattcttccaaggttgcttacgtccttcaaggggctggtgttgctgggattattctccctgaatcagaggagaaagtgattgcaatcaagaagggtgatgcaattgctcttccatttggtgtcatcacctggtggtccaacaaggaggacactgaattggtggtccttttcatgggggatacctcaaaaggccacaaaccaggccagttcactgatttcttc

SEQ ID NO: 23397 - DNA, 423 bp, Gossypium hirsutum
  Clone ID: LIB3272-023-P1-K1-H9
cttgttcttccctccgttgtttgctccctcttgaatattcaccgaaatcccaaaaatcccatcttgtttttgttttgtttttgaggttcaaacgtctcaaaactctggaaaggaatcacacatacctatggaggaattcaagacgatcaagaagaaaatgtggatgttttctctttagtctttctttctgtttgaaaaaacgatctccctagaattgttcacttgcgttatggaagctatcatcgaaacaatcatagcactgatcatcggcaacaacgagaaagtcgctaaccatcaaaactttgttcttcaaaagctctctttctggttcgctcccactacacgcccacctggtctactctctttcacttctggttcctaaaaacaaactctcatacaactgtcgttagctttctttttatt

SEQ ID NO: 23398 - DNA, 352 bp, Gossypium hirsutum
  Clone ID: LIB3272-024-P1-K1-A1
aagacagcaagccattaaggttatgagataagatcaaaatgggttcagaacgatcagcttgcacagacctccttttagccctcaacattctattgtttaccctagacagtgctcattgtggatcttgttcttattgtggctctaaccaaaggccaactgccacccctactccatctgcacgaggtctgtgccctagggatgccctcaaattaggagtgtgtgccaatgtgcttaacttagtcaatgtcaccgttggatcacccccggagatgccatgtggttcccttctcaacggtcgttgggacctcgaacccgctgcttgtctatgcaccgatatgagagctaacatctt

SEQ ID NO: 23399 - DNA, 405 bp, Gossypium hirsutum
  Clone ID: LIB3272-024-P1-K1-A10
gagctacttaaccatttcccaaatctcctccctcctcttctttagcgtccttttcatttccgctcatgcagcgcgctttgaaatccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccggtgattgtggtggactccttcaatgcaaaggttggggtgtacctccaaacaccctggctgaatatgcacttaaccaatttggaaacatggatttctacgacatttccttagttgatgggtttaacatccccatggtgtttggtccaac

SEQ ID NO: 23400 - DNA, 392 bp, Gossypium hirsutum
  Clone ID: LIB3272-024-P1-K1-A12
tgaaattccaagcaaaatatcatgggcaagggtcctggtctctacactgaaatcggaaagaaagctagagatcttctttacaaggattatcagactgaccaaaagttcactttgaccactagctctcccactggtgtttcaattacctctgccggaacgaagaaaggtgatcttttcttggctgatgttaatacccagctgaagtctaggaatgttacaactgatatcaaagtggacaccagctccaatctatttaccaccataacagttgatgaacctgcacccgggctaaaggcaatctttggcttcagagtccctgatcagaggtctggcaagattgaactccagtatttgcatgagtatgctgggattagctcaagcattggattgac

SEQ ID NO: 23401 - DNA, 422 bp, Gossypium hirsutum
  Clone ID: LIB3272-024-P1-K1-A2
tcggaacccctgaaaggggtttccttgctgctgatgaatccactggcaccatcggcaggcgtctttcaggttttaatgtaaagaatgttgaagacaacaggcgtgctctccgtgagctcctattcacaactcctggagctcttcagcacctcagtggtgttattctctttgaggaaaccctttatcaaaaaaccgcttcgggcaagcccttcgttgatgttttgaaggaaggtggtgtcctccctggcatcaaggttgacaagggtacggttgagcttaatggaacccatggcgaaactttcacccagggtctagatggccttgcacagcgatgccagaagtactatgaagctggtgcccgctttgctaaatggcgtgctgtccttaagattagtgctaatgaaccaaccgagcttgcaatc

SEQ ID NO: 23402 - DNA, 299 bp, Gossypium hirsutum
  Clone ID: LIB3272-024-P1-K1-A3
ataggaagcatggacttcatagctactatcctgtttctagctctggtcatgtactccaccaaagctttggacctttgcggacatcagtcagatgactcggacctttgggtcatcctaatcatatggcaaatgtactaccagtcaacccacccaaacctgactcatcgcgtaacacagtcatcgaacatggcatcaaaagacccagcctgggtcaagtacttgtcgtgccttgtagcccaaaagaccatctgcggttcccatagcttcatgccaacatgtcctaaacattggcaactata

SEQ ID NO: 23403 - DNA, 418 bp, Gossypium hirsutum
  unsure (1)..(418): unsure at all n locations
  Clone ID: LIB3272-024-P1-K1-A4
cgaacatggcgatgggagttaaggccttgcacttgtcctttgtgcctcatgccctcgcgattgccggcgctgttatggtattggtttggtgcattcacttcaggggtggattagcttgggaatcttctaacaaaaatctcatctttaatctccatcctgtattgatgttgattggcttcattatcttaggaggtgaagccattatgagctacaagtcattgccactgaagaaggaagttaagaaagtcatacatcttgtgctccatgccactgctctgattctaggcattattggaatctatacggcattcaagaatcataatgagagttcaatacctaatctctacagcgtgcattcttggcttgggattggaatcattaccctntatggcattcagtggatatatgggtttctcat

SEQ ID NO: 23404 - DNA, 418 bp, Gossypium hirsutum
  Clone ID: LIB3272-024-P1-K1-A5
gattctacagtgctttccagtgaaatgtctgatgaatttatagagatggtttcaaatatctcccagctgcatcacacaaatgtaacagagctggttggctattgttccgtgcatggacagcacctgcttgtctacgagttccacaaaaatggctctcttcatgacttcctgcatatatcagatgagttcagcaagccattgatttggaactcccgtgtcaaaattgcactggggactgcacgtgcactagagtaccttcatgaagtttgctcaccgtctgtcgttcataaaaatatcaagtcagccaacatcttacttgatgctgagctcaatcctcacctttcagactcgggcttggcaacctttattcccaatgcagatcagttactgaatcgtgatgacgtgggatcccgatact

SEQ ID NO: 23405 - DNA, 298 bp, Gossypium hirsutum
  Clone ID: LIB3272-024-P1-K1-A6
tatacattcatttgtttggaaaaacttccatttctttgattgtttttaagcgcaggaacatcgaaaggcatcaggaaaaggcaaatctagatgtcgatggtatcttgaaggagctccccaatgctgggcgtatccctaaaaccaagatcgttggtactttaggtgcggctacactgtccgcacatacaatagagcacctgctgagggcatgcatgaacgctgctcgcttgaattactctcatggcagccatgactatcatcaatagaccttggatgactcataggcctgctatgcaca

SEQ ID NO: 23406 - DNA, 410 bp, Gossypium hirsutum
  Clone ID: LIB3272-024-P1-K1-A8
ggaaaatcatgggtgccaaagttcttttcttctttgctttgctttccttttcagctggctcggcatttgcaccagatgggggaaaaccaaggtctggtaatgacctctaacagggtttctggtcctaaggctgaaaccattataaaggaccaggttaagctactgtccaggcaacacaaaaccactgttttttctgggctgagaaacattttccatgactgtgctgtccagtcatgtgatgcttcactgctgctggactccacaagaaggagcttgtctgagagggacacacacgagctctggcctatggagtttcaggtgcactgtgaccatcaaagaagctgtagaaagggaatgtcctggagttgtttcttgtgctgatatccttgttctgtctgctagggaaggca

SEQ ID NO: 23407 - DNA, 421 bp, Gossypium hirsutum
  Clone ID: LIB3272-024-P1-K1-A9
acttgcattaagtctcaaagatatcactgcaagaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaaaagcccaccctcggcacctgaacagccaggcacttgccccagagatgcactgaaactaggcgtttgtgctgatttgttgggctcagtgcgcgttgttgttggaccgtcgaggaccaaatgctgctctctcatttcgggtttggctgatctcgatgctgctgtttgcctttgcactgctattaaagctaatgtgttgggggttaacctaaacgttcctgtttcattgtctttgctcctcaattcct

SEQ ID NO: 23408 - DNA, 424 bp, Gossypium hirsutum
  Clone ID: LIB3272-024-P1-K1-B1
gtctttatctcccctcttaaaacaaaaaccatggttcaagaaaagaagctagtccaggacgtatctggttggctaagagtctatgatgatggctcagtcgacagaacctggactgttccccctgaggtcaagttcatggctgaaccagtctcaccccatgaacaattcattgatggtatagccactcgtgatgtcaccatcgatcaaaattcaggcctccgggctcgaatttacttgccggaggaggaaaatcccaagtttccgatcatacttcatttccatggcggtggcttttgcatcagccaagctgattggttcatgtactatcagttttacactaggttagccaaatcgattccagctattgtcgtctcggtttacctcaggccagcacccgagaacaagcttccggcagcttgtgacg

SEQ ID NO: 23409 - DNA, 391 bp, Gossypium hirsutum
  Clone ID: LIB3272-024-P1-K1-B10
cccaaacactccatctctctctctctctctctctccatatatatatatataagactgtttgaacaagttctgaacattgtaggctgattaaagacagctacatccctctttttgtgtctgccggttttgagtctctgttctggcatttttacaaacaccctgtaaacgaaaatggcgcttccctatacccatcactatgacctttcgttctttgctctcaatttaaagaaatttggctcttcgcatttgcaacccttttgttgtttacggtgcaattccagcgtttcatcttcaccattcacggagaagcactcgttgcagaggtaccaaagggaccagtgggtctacaacaacaataaccagcagcggccgtctctcagctgcgatgatg

SEQ ID NO: 23410 - DNA, 415 bp, Gossypium hirsutum
  Clone ID: LIB3272-024-P1-K1-B12
ctaccaagaacaccgtgttctaattaattctcctcttcattttgattctaaggttagtgatgaaaatgagggctggttatagcattttccttctcattctttctcttactgtttgtaatgctggtaagttgagtaatagcttttacaaaaatacttgcccacaagttgagaagatcgtgagagagattatccagattcatactcgaaacaatccatctttgggtgctcaacttattaggatgcagttccatgattgctttgttaggggatgcgatgcatcagtgttgttggatacagttaacaattccaaggctgagaaagaagcaatgccgaatcaatctttaggtggtttcgacgtgatcgacgatatcaaggcaacaatcgaaagggtttgccctaaagtcgtttcttgtgc

SEQ ID NO: 23411 - DNA, 418 bp, Gossypium hirsutum
  Clone ID: LIB3272-024-P1-K1-B2
ctgagttttgaatctagggatttgcgggtggagaagacgagagctcatctctctgcttcaaagctcctgtccgggtagaattctcttcttcctttgcgttgtgttctttgttgttcaatcgccatggcttcaaagcggattttgaaggaactcaaggatttgcagaaagatccacccacttcttgtagtgctggtccagtagctgaagacatgtttcattggcaagcaacaatcatgggaccctcagatagcccttatgctggaggtgtgtttttagttactatccatttccctgcagattatcctttcaagcctcctaaggttgcgtttaggaccaaggtcttccatcccaacatcaacagcaatggaagcatttgtcttgatatcctcaaagaacaatggagccctgcactaacca

SEQ ID NO: 23412 - DNA, 415 bp, Gossypium hirsutum
  Clone ID: LIB3272-024-P1-K1-B3
aaagcttcagaattgcaaatggagattctttctcaacgaccatcttctttctcaactttgaatcccaacgctccattgtttgttccgttagcgtatcggacggtggaggatttctctgatgagtggtgggctctcgtccaatcctccccgtgtttccgcgactactggcttcaagaacgtttccacgatccccaaaacgacgacgccgatcttctttttcccgacgatcttgatgccgtctttgacgattacgacgactttttcgttgaccctacctgtgaagggaaggaagaagatactcaaaaggaattggtacccgttggagcattcaaatggcggaaggggcgagttgtgagcgagtcaactaggtttcttgagaaagcgcccaagatcgtgaatgtgaaagtgagtccga

SEQ ID NO: 23413 - DNA, 417 bp, Gossypium hirsutum
  unsure (1)..(417): unsure at all n locations
  Clone ID: LIB3272-024-P1-K1-B4
gaaaaacttaatcatggctcggttgacgttcgtgacctccatcatccttctgctatgctccgttgccgctggatcaactttcgacgactccaaccccatccagatggtatccgatggcctcaccggcttcgaatcctccgttcttcgtgtcatcggtcacactcgccatgctctctccttcgcccgttttgcatacaagcatgggaagaggtatgaaaacgtggaggagatgaagctacggtttcagattttcgaagacaacttggatttaatcagatccactaacaagaagggactgccttatactcttgctgtcaatcagtttactgattggagctgggaagagttccagaaacacagattgggggctgctcaaaactgctctgctaccacanaggggcatcaccagctcactga

SEQ ID NO: 23414 - DNA, 187 bp, Gossypium hirsutum
  Clone ID: LIB3272-024-P1-K1-B5
ccctagccactctttgctcaactcgccaatgggggcttataagtacgtgtcggagctatggaggaagaagcagtcggatgtgatgaggtttttacagagggtgaggtgctgggaataccgccagcatccatcaattgttagggtcaaccatcctactcgccctgacaaggcacgccgcttgggttat

SEQ ID NO: 23415 - DNA, 379 bp, Gossypium hirsutum
  Clone ID: LIB3272-024-P1-K1-B6
aaaaagagcaaaaaatggcaaaaagaggcggcggagagcgtggcgcttttaggcgcggcttcggtggaggaaggggtgaccgtggtccaagaggcaggcgccgtggccgcaaggacgaagaggagaaatgggtacccgtcacgaaactcggccgtttagtcaaatccgggaaaatcacgtccctcgaacaaatttacctccactctctccctatcaaagagtaccaaatcatcgaccagctcgtcggcccttccttgaaagacgaagtcatgaagatcactcccgtccagaaacaaacacgtgcaggccagcgcacgcgtttcaaggccttcgtcgtcgttggatactgaaacggacacgtccgattgggtgtcaagtg

SEQ ID NO: 23416 - DNA, 417 bp, Gossypium hirsutum
  Clone ID: LIB3272-024-P1-K1-B7
tcttatttgaactcaaagtcccagctaatattagaatcatgggtgttgtcacttatgactatgagaatacctccccagtcgcccctgccaggcttttcaaggcctttactgttgaagctccgaaagtttggcccacggctgcacctaatgcagtaaagagccttgaggttgaagctaatcctagctctggaagtatcgtaaaaatcaactttgttgaaggccttccattccaatatatgaagcaccagatcggaggacatgatgaaagtaatttttcatacagttacgatttaatcgaaggtgggcctttgggggataagcttgaaaaaattagctatgagaacaggtttgaggcagctgcaggtggagggagtatttgcaagagctcaatgaaattctacactataggcgataatg

SEQ ID NO: 23417 - DNA, 411 bp, Gossypium hirsutum
  Clone ID: LIB3272-024-P1-K1-B8
atttgctctgaagatcatgttggctatttttcacaaggcatttgctaatccaccagaggagctgaatagtccagcttctcataaatctaccaagaagcctaaacagcctgaagaaaccctaaatgatttcctatctcatcaccctcacaacactttctccatgagctttggcaacgctgctgttttggcttatgtccgccatgaacgtgctgcttcagttcatcagaggttgttttgtgggtttgatgacatatactgcctcttcttagggagcttgaacaatctatttatgctgaatagacaatatggtctttccaaagggagcaatgaggcgatgtttgtgattgaagcatataggacgctgagggataggggtccataccctgctgatcaggttgttaaggatcttga

SEQ ID NO: 23418 - DNA, 404 bp, Gossypium hirsutum
  Clone ID: LIB3272-024-P1-K1-B9
aatcaaaaatcctaattgatggcagatttaaagcaaaggggtatatatagattgcaaccaaaataagcatttttttcctactttcatttctctttttctttctttcttcctgtctggtctggatcttctcttttgtttaatttgtttagagtgagcgtatcctattatgaaagtgaagctcattattttagtcccattcatggtgttggtttccatggttgtagctcaacaacatgttgatcaaatgcagcatcaacacgattccaactccatcacattagagttaatacataggcatgctcctcagttcaccaacaaccaccctataactcagcaccaacgcctggtcgaccttctctaccatgacattatccgccacggtatcatgtcccaccgaagacgag

SEQ ID NO: 23419 - DNA, 377 bp, Gossypium hirsutum
  Clone ID: LIB3272-024-P1-K1-C1
ggtaactctcgatttcacgttttggttaatgggttagtagctttaaccaattttagcggtggggattttgtaaatcctaaagttatagaatatttgctttacgttaattcagaaaaggttgaaattcgtttcgttccagctaaaaaatcgaattttgctttcgttaatgcaatcgaagtgatatctgcaccaaaagatttggtactagaaactgcacagtatgttaatggtgataaaattgaggaatttcagggtttaaataaacaagcatttgaaactatgtatagggtaactgtcggaggtcctaaagttactccgttcaatgattctttgtggagaacttggatccctgatgatgagtatttgaaatcgagtga

SEQ ID NO: 23420 - DNA, 392 bp, Gossypium hirsutum
  Clone ID: LIB3272-024-P1-K1-C10
ctccaaggttgaagataacagtgataaacttgctatgtttggtggtgctctgcggggcaactgaatcgccacagtacgaggtggtacacgctgaatccgatttcgaaatcagacactaccgggacgccacgtggatgtctgcaaccgttaacgaactttccttccaaaaagccaccttatttgggtttcacagattattccagtttatacaaggtgcgaatctgaattattctcgggtagccatgacagcgccggtggtgacgagcctagtcccgggagctgggccacttcactcattagcctatgttgtccgattttacttgcctgccaagttccaggacagtccaccaaccccacttccggagctaaacctgaaaccttacgcatgggat

SEQ ID NO: 23421 - DNA, 333 bp, Gossypium hirsutum
  unsure (1)..(333): unsure at all n locations
  Clone ID: LIB3272-024-P1-K1-C12
gacgacccgggtccgaaaactcgctaatgcccggctcaataaaacaagcgggggagcgaaagtcttggcccaagtttggggatgctgtaagggaagatgttggtagccgactcactatggtttccactgaagaaatcctccttgaacgacctagagctcctggtagcaaagcagaagaaccgaaggctgccggagattccttggctcaactaggaaaaggaggtgctgtccttatggtgtgtangacttgtggtaagaagggtgatcactggacatctcggtgcccatacaaagacctcgctctgccggctgagtcattcgtcgataagcctg

SEQ ID NO: 23422 - DNA, 379 bp, Gossypium hirsutum
  Clone ID: LIB3272-024-P1-K1-C2
attgtttttgtttttaaaatataaacttacgacatctacaaatggtgacctcagtgctacctagagtagaaagcttggcaagcagtgggattcaatcaatcccgaaagaatatatcaggcctcaagaagagcttacaagcataggtaacgtgtttgaagaagagaaaaaagaggaagggcctcaggttccgaccatcgatttgacagaaatcgagtcggaggacaaagaggtccgggaaagatgtcagcaggagctgaaaaaggctgccatggaatggggtgtgatgcaccttgttaaccatggcatctccgaggagctcatggatcgtgttaggaaagttgggcagaaattctttgaactccctgtggaggagaaaga

SEQ ID NO: 23423 - DNA, 196 bp, Gossypium hirsutum
  Clone ID: LIB3272-024-P1-K1-C3
gtgtggttgtgcaaaagctaatacaaaaaaggcacccaggggtacatgtttgtcggccacgtatgttgcacacctaagcgtcatggaggacgccatggtatacctacaatcaggcaaacgcctagatgccggcgtgttgattgctcggagcataaaccggaccgacactagcttggccctatccaccgctattgtc

SEQ ID NO: 23424 - DNA, 408 bp, Gossypium hirsutum
  Clone ID: LIB3272-024-P1-K1-C4
attaaaacagggaaggaaaagcagcgtaatgggtgaagaagtgaaggtttttggatactgggcaagcccttacagctacagggcagagcttgctttgaagttgaaaggtgtttcttatgagtacataaatgaggatatctttggcaacaagagcgatttgcttttgaaatacaatccggttcataagaaagtcccggttcttcttcacaacgggaaaccaattgtagagtctcttgttatacttgaatacattgaggaaacttggaagcataatccctatttgccacaagatccttatgacaaagctaccgctcgattctggatcaagttcatcgacgaaaagtgctttcctaccctttggctagctgcatggagcgccgagaatgagcgagaaaaagtgacgaatga

SEQ ID NO: 23425 - DNA, 414 bp, Gossypium hirsutum
  Clone ID: LIB3272-024-P1-K1-C5
ggacttcatagctactatcctgtttctagcggttgtgatctcctccaccaaaggtgtggacccttgcgggcctaagccagatgactagcaccttttggtcatcccaatctatggcaaatgttcaccattcaacccacccaaacctgactcatcgttcaacacagtcatgaacatggcatcaaaagacccagcaagggtcaagtacttgtcgagccttgtagcccaaaggaccactgcagttcccattgcttcaggccaacaagggctaaacattggcaactatatcgcccgggtaaagattggcactccgggtcagctcatgttcatggtattggacactagcaatgatgtggcttgggtcccatgctccggctgcaacgggtgctcagccaccactttctcacccaacacttt

SEQ ID NO: 23426 - DNA, 415 bp, Gossypium hirsutum
  Clone ID: LIB3272-024-P1-K1-C6
cgccgccttcactccactttgcagtcagccatcgcagacgttcctcgggccagctgataccgccggtgttcagctctcttcctcctcaatctatttgccggcttaaaaacctaaaacaaatccggatgtaggggaatttgataaggaaacgtcacaaaaaaaaaaaaaagagattgcgtgatgttatcttcctttttcattttttgatttttttcgcccaaaattctctcccattctcaccgctgccgccgacatcgtagcgattctttgtggcgatcttctcagtacttaactgtatctactctatcgcttccgtgatttggatttgactctcgtttccgatttttagtaaagctctctctgctttttgttagcttcgtcttattgaaaatcatcttttacagtttccgttctt

SEQ ID NO: 23427 - DNA, 160 bp, Gossypium hirsutum
  Clone ID: LIB3272-024-P1-K1-C9
aaaaaaaagagcttccgccacaaggaaaggaactccgcggcttccgttccgtatttactcggccactcccttacaaaatagaaacagaaccctttattacctcaaatattcggctccctattactcttttcctctagggtcagtggtaatgatttttaca

SEQ ID NO: 23428 - DNA, 275 bp, Gossypium hirsutum
  Clone ID: LIB3272-024-P1-K1-D1
tatatccagaaacctcattttcataggagtgcttataaactaccattaaaacgcgggacatggtagtgagtgcttgcttataggaatattgcttttaatcaattttcttactatttgcaaaggtgtcaaggcgagtaatagcttttacaaatatgcttgcccacaattttataagttcgtgagatagattttccagattcatactcaaaacactctatattttggtgctcatcttattatgatgcacttacttgatttctttgttaggggatgct

SEQ ID NO: 23429 - DNA, 408 bp, Gossypium hirsutum
  unsure (1)..(408): unsure at all n locations
  Clone ID: LIB3272-024-P1-K1-D10
cgcttaacttcgcgcgattgctagcttcatcttctctgttcgaccttcccaaaaaaaaaaaaaaaaggaaaagaaaaattcaggttgggagtattacacagctttgttttggttaactccttttcgtccaccatatttgcccccaatatgaagatcttgttctcgaaagttctaacgaacaccgatatacagaaaagattggcggttcccaacaattcactgaagcatttcgagcttgaaaatggtaattgctccaaatcatttgaagttaaagatgaaaacggattcacatggccttttcgttgctatgttcgtaacgacggtgcctacaagaagcctgttttatccagcggttggcgtcaatntgtccttaataaaggagttcaccagggggatttgattacactc

SEQ ID NO: 23430 - DNA, 411 bp, Gossypium hirsutum
  unsure (1)..(411): unsure at all n locations
  Clone ID: LIB3272-024-P1-K1-D11
cttttcttctcttgtgacactgctaatattttttattgtcgtctccggcgttcgaagatcataaaaaaccggagtcgtttcaaatggctacgagaacggatctagatgggaggccaataaagccgatgacgatatgcatgatcggtgccggaggcttcatcggctcccacctttgcgagaaattgatgtcggagacgccgcacaaggtgctcgccttggacgtttacaatgacaagatcaagcacctcctcgagcctgactctctcccttgggctggccgtattcagttccaccgacttaacatcaagcacgattctaggctcgaaggcctcatcaagatggcagatctcgtgataaatcttgctgccatctgtactcccgcagattataatacgcgtncactagacacga

SEQ ID NO: 23431 - DNA, 404 bp, Gossypium hirsutum
  Clone ID: LIB3272-024-P1-K1-D12
ctaagatatcactgcaaggaaaaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaagagcccaccctcggcacctaaacagccagccacttgccccaaagatacactgaaactaggtgtttgtgctgatttgttgggctcggtgcgcgttgttgttggaccgtcgaggaccaaatgctgctcactcatttcgggtttggctgatctcgatgctgctgtttgcctttgcactgctattaaagctaatgtgttgggggttaacctaaacgttcctgtttcattgtctttgctcctca

SEQ ID NO: 23432 - DNA, 389 bp, Gossypium hirsutum
  Clone ID: LIB3272-024-P1-K1-D2
tgaaatttttcaggaggggaagtggttcgcatctgcctccttctagacaagtggaaattctggttttttgcaacaatgagttttgttttccgagggactagaggggatattgaaagcgggttttcaggatttattcctgaacgtccagctgtgcgcatacatgcagcccgaccagctaattctaattcgctggcctttcttgtcacagctctgttgctgttcatgattttaaactgtcatcaaatgtcaccaaactttctggtttggctagtagtgggtgtctttctaatggctacgagtctaatgatgtatgcaacttgtcaacatacttaagctcacgcccgagctcacgctgctgcagctagtgggttgcttggtcatactgagct

SEQ ID NO: 23433 - DNA, 420 bp, Gossypium hirsutum
  Clone ID: LIB3272-024-P1-K1-D3
cttggcctccgctgtttattcgcttcagctcatcacttcccatagtctctcctcctccctcaccaaatcaaaatgtctctggtggcgaacgaagactttcagcacattttgcgtgtgctgaacaccaacgttgatggaaagcagaagatcatgtttgctttgacctccatcaagggtattggaaggcgtttcgctaacattgtttgcaagaaggctgatgtcgacatgaacaagagggctggtgaattgactgcacaggagctggacaatctcatgaccattgttgcaaaccccaggcagtttaagatccctgactggtttttgaataggcagaaggattacaaggatgggaagtattcccaagttgtgtctaatgctctcgacatgaagttgagagatgacttggagcgattgaagaag

SEQ ID NO: 23434 - DNA, 412 bp, Gossypium hirsutum
  Clone ID: LIB3272-024-P1-K1-D4
catttatttcactacccaacaacccaaaagataaaaggaatcgtttacttgttcgtagcaatttatcgtcatttcaagctcaattctctgaaaatttttgtgctgaacttcttttttctctttgtaccaccatgtgtggaggtgctattatctccgatttcataccgccgtcgcggtcgcgacgattgacggccgatttcttgtggcccgatctgaaaaaatccgggttgaagaaggggtcgggtaagagatactcgaagcccgtgatcgacttgggcgatgatttcgagactgactttcaggagttcaaagatgaagaatctgatatagatgattatgatgttgatgatgttttggctgatgtaaagccctttgcttttaacgctacaaagaaacctgcttctgctgtatc

SEQ ID NO: 23435 - DNA, 389 bp, Gossypium hirsutum
  Clone ID: LIB3272-024-P1-K1-D5
gcggggttgtgtaaaagctgcgacaaagaaggcaaatggaggtacttggttctaggccaagcatgttgccacctaggcttaatggaggacgccatggttctcctccaaacaggcaaacgcctcgcttccgccgcgttccgccgtgagagcatttgttggtccgacgatagcttctccctccccaccgctattgccctttcagacatctcctctgctgccacaacaccttcttccacgcccccacgcaatcctacatctttctccgaatccgaaaacatttcccagcttctatcccacatcaagctcctcatccgccgtagaactgctgccattgcggccttagatgctggcctacactccgaagccatccgccatttctccaaaatagt

SEQ ID NO: 23436 - DNA, 380 bp, Gossypium hirsutum
  unsure (1)..(380): unsure at all n locations
  Clone ID: LIB3272-024-P1-K1-D6
gcggaaatgattgcaaaggtgggtttcaaaatgttccttggggtcactgcatctgtcatgaactgggatgctgatggcacttgttgcagcattgttttggaggataatccccttgtggactttgtagagcttcctgatacttgtcaaggcctctactatcgcaacattttaagtggtgtcaataggaggagccctagagatggggggcaatgaagaccggaagtcaacctggattcgtgatatgcttagaggagatgatgcatatgagttgcaggttaaacttttgaagcaagttccagaagagtatccttacaaggatgatgaataacatgccctacttacctctttaacggccttgcgcactngccaatgttctattt

SEQ ID NO: 23437 - DNA, 391 bp, Gossypium hirsutum
  Clone ID: LIB3272-024-P1-K1-D7
gtcaggcgggattacccgctgagtttaagcatatcaataagcggaggaaaagaaacttaccaggattcccctagtaacggcgagcgaaccgggaaaagcccagcttgagaatcggtcgccatcggcgtccgaattgtagtctggagaagcgtcctcagcgacggaccgggcccaagtcccctggaaaggggcgccggagagggtgagagccccgtcgtgcccggaccctgtcgcaccaagaggcgctgtctacgagtcgggttgtttgggaatgcagccctaatcgggcggtaaattccgtccaaggctaaatacgggcgagagaccgatagcgaacaagtaccgcgagggaaagatgaaaaggactttgactcttttacagcttttgaac

SEQ ID NO: 23438 - DNA, 418 bp, Gossypium hirsutum
  Clone ID: LIB3272-024-P1-K1-D9
ggaagagctgtcctttttctctctctatattttctcatctccttttccaccgccgttgatctcgatccgtatccccgttttcaaaaaagctccaaaaagatggccaatgctgcatcgggaatggctgtgcatgatgattgcaagttgaagttccaagaacttaaggcaaaaagaacccaccgctttattgttttcaaaatcgaggagaagcagaagcaagttatcgtggagaagcttggtgagccaactgagagctatgaagattttactaaatgtcttcccgctgatgaatgtcgttatgctgtgtacgattttgattttctaacagccgagaacgtcccaaagagcagaatctttttcatcgcatggtctcccgatacatcaaggatcaggagcaaaatgatatatgctagctcca

SEQ ID NO: 23439 - DNA, 286 bp, Gossypium hirsutum
  Clone ID: LIB3272-024-P1-K1-E1
gaaaataaaggtcctcctagtaaatattaccaggtagcaccatggcttagttcccggggttcttcctttggcctgtctgtttgtttttttctaatctcaactagttcgattagtccccacttttttttctttttttttactttgtttttaggttttgtttggttgatacttgattcttcatcttcctcatctttattgtgtctagatctcgaaggaaagtcatggattttggtttaatgaggaaggaataagttccttttcatactctcatatcttctttcttatc

SEQ ID NO: 23440 - DNA, 406 bp, Gossypium hirsutum
  Clone ID: LIB3272-024-P1-K1-E10
gcagaatcaagggattgtgggtggagaagaagcggtgacggatctaacttggaactccgttttctcttcttaccgctattcccgacctatctctaaccccctcaatttctctcaggtagatattccttgtgttcaagcgtcttcatggcttcaaagcggattttgaaagaacttaaggatttgcagaaggatccaccaacttcctgtagtgcaggtcctgtagcggaagacatgtttcattggcaagcaacaattatgggcccctccgatagcccttttgcaggaggtgtgtttttggttaatattcattttcctccggattatccattcaagcctcctaaggttgcatttaggaccaaggtcttccatccaaacatcaacagcaatgggagcatttgtcttgata

SEQ ID NO: 23441 - DNA, 409 bp, Gossypium hirsutum
  Clone ID: LIB3272-024-P1-K1-E12
cttctctcttgcttttcgtcttgcgttcttttgatatggcaggaaccggggtggttgcagtttatggaaacggggctataaccgagactcacaaatcccctttctcggtgaaagtggggctagcccaaatgctccgaggcggagttataatggacgtggtcactcccgatcaagctcgcatcgctgaagaagccggagcctgcgccgtcatggctctcgaacgagtccccgccgatatccgagcccaaggcggcgtggctcgaatgagtgacccacaactcatcaaagagattaagcaatccgttactatacctgtcatggcgaaggcccgtattggacatttcgttgagcccagatcctcgaagcccatggcatcgattatgttgatgagagcgaagttcttaccctg

SEQ ID NO: 23442 - DNA, 411 bp, Gossypium hirsutum
  Clone ID: LIB3272-024-P1-K1-E2
gcaaatgcaaagatatacaaatgtgaagatgagcgatgccctcgtcctatgcgctacaaggcatatggaagtggaaaggaggatagtcctctttgtgatgtgcccggctttgaaaactgtaggatgaagttgctgagacatgtatcttttgtagattgcccaggtcatgatattctcatggctactatgcttaatggagcagcaatcatggatggtgcattacttcttatagctgccaatgaaagctgtccgcaacctcaaacttctgagcatctggctgctgttgaaattatgcgactccagcatattataattcttcaaaacaaggttgatcttattcaagagaatgtagccatcaatcagcatgaagcaattcagaaatttattcagggtacagttgctgatggtgca

SEQ ID NO: 23443 - DNA, 156 bp, Gossypium hirsutum
  Clone ID: LIB3272-024-P1-K1-E3
gtaaaagaggggtaatatggagggagaggtggaatcacatgcgcattagttcactgtcgttctactggatcctcgattagcttagcttgttctatttcttgctaatcatcatcatcatataccttgtttttcgtcacggatgacgataagcatgaa

SEQ ID NO: 23444 - DNA, 382 bp, Gossypium hirsutum
  Clone ID: LIB3272-024-P1-K1-E4
gaaaaaaatccctaatcaaaaaatggggaaattgtggctaatttgcattgcttcgatctcaatccttctcccatttctctgcaatgctttctctcccgaatcgccaacggatcgccgagtccttgttctcctcgacgacttcgccatcaagtcgtcacactccctctacttcaatgccctcaaatcacgtggcttcgacctggaattcaaactcgccgatgatccaaagatcgccttgcaacgctacggccagtatctttacgatgccttgatcctcttctgcccctccgtcgaacgatttggaggatctattgatgttgccgccattgtcaattttgttgattccggtcatgatttaattgttgcggcggatgttaatgct

SEQ ID NO: 23445 - DNA, 400 bp, Gossypium hirsutum
  Clone ID: LIB3272-024-P1-K1-E5
gtcttcttcattctcactctctctccactgaactcttgctaaacggtatcgttttagtcagtctttcatcaatggcgaaagaaccggttcgcgtcctcgttactggagctgcaggacaaatcgggtatgctcttgtacccatgattgctaggggagtcatgttgggtgctgaccagcccgtgatccttcacatgcttgatatcccacctgctgcggaggctttgaatggtgtcaaaatggagttggtggatgctgcttttcctcttctaaagggtgttgttgctacaactgatgttgttgaggcatgcactggagtcaatgttgctgtcatggttggtggtttcccaaggaaggaaggaatggagaggaaagatgtatgtcaaagaatgtgtctatttac

SEQ ID NO: 23446 - DNA, 327 bp, Gossypium hirsutum
  Clone ID: LIB3272-024-P1-K1-E6
ctgactttcaccaccaccgtcactagcggggccgtcacataatgtcgtcaacggaggctatcatcctacaactgcatgaaagatctgccgctaaatccggttactggaagctgaaatctgggatcttctgctctatctacatagaccgccgtctgagcgattcttaccgttgactactccaccaaatctcacactctctactttcctctctctgtgcgaaaacacactgtaacctcatatgcggtggcccatacactgtcctccctatagccacgctgcatctgtctcgacacgtccatgctcatgctcatgctccgcaaagaagtg

SEQ ID NO: 23447 - DNA, 415 bp, Gossypium hirsutum
  Clone ID: LIB3272-024-P1-K1-E7
gaagttcagatctgctgcttactccaactgcgctcgcaagccatcctgatatactcacaagcgtgccgtctgaccactagtagtggttaataaaactgttatttgctttgttagttagttttagattatttccccgaccaacttcttcctcttctctcttcgtggctggtttctttacattgcgttctcctgatttggcgactgtgtaattccgataaagtttgcagcccttggttgaatcacaatggcagtatctgcaattggatttgagggttatgaaaaaaggcttgaaatttccttttttgagcctggcatctttgctgatcctgaaggaaagggtcttcgggcacttaccaaagcccagttggatgagattctaggtccagctgaatgcaccattgtttcttcattatct

SEQ ID NO: 23448 - DNA, 386 bp, Gossypium hirsutum
  Clone ID: LIB3272-024-P1-K1-E8
atctaatacacccactgtaaaaagaagagagaaatctgatcacacggtggaagggggtaaccttgaaactgatagaacatccacaggatgggctgccagagatccttcaggagtatggtctccttacacttacacttttaagaacactggtcctgaggatgtattatttaatgttatgagctgaggaatctgccacactgatcttcatcaagccaaatatgatcttggcatgtcaaactacccaatggttcctgggcatgaagtggttgtcgaggtgttgaaagttggatcagatgtaagcaacatcagagtggctgatattgatggagtggcgcgaattgttggatgtcacaaaaactgtcgaccatgcgacttatacaatgaac

SEQ ID NO: 23449 - DNA, 346 bp, Gossypium hirsutum
  Clone ID: LIB3272-024-P1-K1-E9
gcaaaagaggggtcaaatggagggagaggtggaatcacatgcgcattagttcactgtcgttctcctggatcctcgtttagcttagcttgttctatttcttgttaatcatcatcatcatataccttttttttcgtcatggctgacgataagcaggaaatctcggcccctgttgttgatgtcaacgatccagtcactggtcacgtcatttccaccacgattggaggcaaaaatggagagcctaaacagaccatcagttatatggcagagcgcgtagtcggcaccggatcttttgggattgttttccaagcaaaatgcttggaaacgggagagactgtggctataaaaa

SEQ ID NO: 23450 - DNA, 378 bp, Gossypium hirsutum
  Clone ID: LIB3272-024-P1-K1-F1
ataggacgaaaatactgacatccggcatatacagacttacccaatatttgtgtgcgatgagatcctcagactctctcagcgagccatagtcggcgttcactgctaaatcagggctagaatcatgaagcgggtaacttcatggatgatcagagcaggaaaaaacgttggggtttctttgaaatggaagaatagctaaaatcagggtgggagagatccttattatcttggctagaagcttcatacattcaccatagccctgagtttgcactgacgtcaaaagagttcgacgactcaacataggctactgccaacagcgactgggtctaattcaaagagcaggatctatgtaccatgcttcacctctggttacagaaaatc

SEQ ID NO: 23451 - DNA, 390 bp, Gossypium hirsutum
  Clone ID: LIB3272-024-P1-K1-F10
tgactgtcaccttgcaaaacccagattaccataacagatgcaaaatctgatcggtgaacataagaaaatggagaccatgggaaaacttctaatcctgcttacagcttttttatgcctctacctcttcgttgctttgctcaatgttttctacaagtattggtggatacctcaacgggtacagttcatcatgaattcacaaggaatcagaggacctccttatgaatttatccatggaaacaacaaagaagctgcccaaatgctcatggaagcatctaccaaacctatgggcttgacacacgatatatttcccagagtcgtgcctcatgtttactcctggatcaacaaatacgggagcacttttcttagttggaatggaattcgagctcaact

SEQ ID NO: 23452 - DNA, 412 bp, Gossypium hirsutum
  Clone ID: LIB3272-024-P1-K1-F11
caatttcgaggtcccctgttactaaatttcaaaaaatggtgtcccaaaccattgatgtgttgaagaacgagctgcctcttgagcaggagcttgttgttttgcctgaagatgttgtcactggccttgttcttgtcgatatcatcaatggcttctgcactgtcggtgctggaaacctggccccaagagaacccaacagacaaatatcaagaacgatcagcgaatcagtgaggctggcaagacttttctgcgacaagaaattgcctgttatggcgtttcttgattctcatcatcctgacaagcccgaggatccttatcctcctcactgcattcaaggcaccgatgaatctaatttggttccagctttgcaatggatacaaaacgaaacaaacgtgacaatcaggcggaaagattg

SEQ ID NO: 23453 - DNA, 407 bp, Gossypium hirsutum
  Clone ID: LIB3272-024-P1-K1-F12
cttcttgcccttttttctatttctttcttcagacgatcttcaatctgttcgaacattttaggcaatgaagcccggagtttcttcattgaacccatatgcagcatcatacatacctcttgccaaaagggaggccagtgataatgtgacagccaaagatattaaacacagcaatgagaatgcttggttcaaaccttcctcacactttgcatataacccacacagtagcaatgcttctcttggctcttcagcctatggtactgaaaagcaccaggttgcagaaggttctgcagtgaaaagccatcctgctcatggttctttgatgcacaatcctggtgaaatgactgacaagcagattgtggatgaagaatttgacatggatttggagtatcttcgcatgtcatttcctg

SEQ ID NO: 23454 - DNA, 411 bp, Gossypium hirsutum
  Clone ID: LIB3272-024-P1-K1-F2
cagggctaagaaagagaaaaaaaaatggctttgcgaaaggcgaaggacgtcgtatctaccaatcctgtcgtcgctttcagcaagtcctactgtccgctctgtgtggatgtgaagcaattgcttcaacaacttggagcttctttcaaggccattgagctcgacagagaaagtgatggatctgatattcaagcagctctggctgagtggaccggccagcggactgtgccaaacgttttcattggtgggaaacacattggtggctgtgattctacaatggccttgcacaaggaaggtaagctggttcctctgctaactgaagctggagctattacaaaatcatctgtttagaatagagttaagctgcttgtctcccctaaaattaataaacgaataccaagttcgatttcatgt

SEQ ID NO: 23455 - DNA, 383 bp, Gossypium hirsutum
  Clone ID: LIB3272-024-P1-K1-F5
tgactgtcaccttacaaaaccttgattccgtctctatacttacttggtgtggtcaatggctacagacaagaccattaagatcgggattaacggatttggaagaatcggacgctcggtcgccagagttgctcttcagaggaacgatgtttaacctgtcggcgctaacgatcccttcatttgcaccgattacatgacatacatgttcaaatacgacagcgttcacggtctatggaagcaccatgatcttaaggtcaaagactctaaaaccctcctcttcggcgaaaaacccgtcactgttttcggaatcaggaaccctgaggagattccatgggctgaagccggagctgagttccttgttgtgtcaactggagtgttcactgaca

SEQ ID NO: 23456 - DNA, 416 bp, Gossypium hirsutum
  Clone ID: LIB3272-024-P1-K1-F6
ctttgattcgattctcaatggagaaaatcagaagagcttcgcatgcaggatcttggtacactgataacccgaacaagttatcggaagagcttgatggatggatcagggcggctggcttgccaaaatcttctgatgtaagaggtgtaattgctccgcatgccggctattcatattcaggtcgtgctgctgcatatgcttttggaaacattgacccgacaaacatcactcgggtattccttcttggtccttctcaccattattacactccaaaatgctctctctcgacagctacagtttacaagacaccaataggggacctacccattgatttggaagtcattgaagagctgaaagctacaggaaaatttgaattgatgaatctccgggttgatgaagctgagcacagcatggaaatg

SEQ ID NO: 23457 - DNA, 420 bp, Gossypium hirsutum
  Clone ID: LIB3272-024-P1-K1-F7
ccaatttcttctgaaaccctaatcctaaattgataccccaacttcggtgttccaatggccactgaggaaccaactgtcgccgtggaatctgcgcctgagccggcggaagagaaccccgctgaggctacagccaatcccaaatctggcaaagcaaagaaagctaaagagcccaaagccaagaaggctgcagctcctaggaagccacgagcttctcctgctcatcctccttacgaagagatggtcaaagatgcaatcgttactttgaaggagaagactggatcaagtcagtatgctatcactaaattcattgaagagaaacagaagaatcttcctggaaattttaagaagcttctgcttttccatttgaagaagcttgtggctgctgggaaagttgtcaaggttaagaattcgtataaactt

SEQ ID NO: 23458 - DNA, 407 bp, Gossypium hirsutum
  Clone ID: LIB3272-024-P1-K1-G10
gctgctcacattgcagccacaacggccacaactctcggacatgtcccaaccgaggggtcaaactcttcggagtccgcttgactgacgggtcgattcggaagagcgccagtatgggcaacttaagccaatattccgggtcgaattctggcgcgcataacgggaatgggtcgggttcgcccggtgagggtccggatcacaccgatggttatgcttctgaggatttcgtccccgggtcgtcttcgagtcgtgaaaggaaaaaaggtgttccttggacagaagaggagcataggatgtttctccttggtctgcagaagcttgggaaaggtgattggcgtggaatctcacgcaattatgttatatcaaggactcctactcaagtggctagccatgctcagaaatatttcatc

SEQ ID NO: 23459 - DNA, 392 bp, Gossypium hirsutum; identical to SEQ ID NO: 23400
  Clone ID: LIB3272-024-P1-K1-G11

SEQ ID NO: 23460 - DNA, 410 bp, Gossypium hirsutum
  unsure (1)..(410): unsure at all n locations
  Clone ID: LIB3272-024-P1-K1-G12
caaaaggaaggatcatatcatcatcctccaccttttatcaaagcccaaaatcacccatttttaaaacgttttctcaactcttccaccctttacatcaaattcaactcatccttcaaagaaatttccttcctttttctttcctttctatacaagttagttcaagcttcaatcccaatctttgtttttttcttttttctatccttttctgtttacggggtataaataaagggtgcaaaaatcttgattttatttccctcttccgagaaacactaattttactgtttcgatctgtggaaagttttcagtttttctttttcaggagaatatggcatctgggttatcgggtcggggcaactcgagtggttccaaagggttcgattntgggtccgatgatattctttgctcgtatg

SEQ ID NO: 23461 - DNA, 418 bp, Gossypium hirsutum
  Clone ID: LIB3272-024-P1-K1-G2
cttttgtcccccgtagatatcagagggaaaacacaaaaactagggttttagagagaacgggagccaaagtgagagagaagaggcagatatttttaggagtagggttttgttatattgcttctctagggtttagaaaatggtggccgacaaaggaaagaagctgaaagtagcagagaaagtagaggaagagaaccatgaacaaatagatggagacctcgtcatttccattgagaagcttcaagagatccaagatgagcttgaaaagatcaatgaagaggcaagtgagaaagtcttggaagtggagcagaaatacaatgaggtttgcaagccggtctatgataagcggaatgaaatcatcaattcaattcctgatttctggttaacagctttcttgagccatcctgctcttggtgatctt

SEQ ID NO: 23462 - DNA, 464 bp, Gossypium hirsutum
  Clone ID: LIB3272-024-P1-K1-G3
cgcctgcaccaccgctcctgtaattggccgggatcgacccacgcgttcgcttgcttatcatacatcaatccgatcatccgccttggaggcaactaattccatgggtatttgggggatttttcacgagcattgactggttgtatatgatagcgaatgagcttgttgctctgttggtagcatttggtgtgatatttggaattaatccttccattcttggagtaactattctggcttggggcaattcaatgggtgatttggtgtcaaatgttgcactggcaatgaatggtggtgatagtgtgcagattgcaatgtctggctgctatgcgggtcctatgttcaacacacttgttggtctgggcatctcattgctgcttggagcttcatcaaagagtccttcctcatacttagttactcaagatagcaccttggtttacaccatgggctttctcatgtctggactaatc

SEQ ID NO: 23463 - DNA, 413 bp, Gossypium hirsutum
  unsure (1)..(413): unsure at all n locations
  Clone ID: LIB3272-024-P1-K1-G4
caaatttacaaccttgtaaatgtgtggtcaataaaggaacccattttccctttaaaaatcacttcttttaagctcaagttcacttgataacaaactccattaatggctgcttttatcccattcaagctatcacttcttttgagtctgctctcaaacattggtttctggccggaaaccagcaagaacgatgttgggatatttccacctacatgtaatcggattgaatgcccaagtttcgatttgattgaagtcggcaatggctatgagattcgtagatacaattccaccatctgggtgactacttcaccaattcaggatatttctctcgttgaggccaccaggactggttttcttcagctatttgactacattcaagnggagaacaaatacaagcaacaaatagagatgacagc

SEQ ID NO: 23464 - DNA, 409 bp, Gossypium hirsutum
  Clone ID: LIB3272-024-P1-K1-G5
ctttacaaaatatctgctcctcttagtttccctttttgtcccttgtttatttgatactcccccctcatggctgccgctgatgtcgagttccggtgcttcgtcggagggctcgcatgggccaccgacgaccgggcccttgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacataactgtcaacgaagcccaatcgcgcataagtggaggcggtggcggaggatttggaggaggaaacggtggttacagccgcggtggaggcggcggcggatatggtggtc

SEQ ID NO: 23465 - DNA, 413 bp, Gossypium hirsutum
  Clone ID: LIB3272-024-P1-K1-G6
cactgttttccttcaaaaccctaatagctgtcctcgcctcctgaacgtgttcgaaaatggccggttctgagggattgactctacgtggcaccatgcgtgcccacaccgacatggtgacagccattgctactcccatcgataactccgacatgatcgtcacttcctcccgcgacaaatccatcatcctttggcacttaaccaaggacgaaaagacctacggtgtccctcgtcgtcgtctcaccggtcactctcacttcgtccaagacgttgtcctctcttccgattctcagttcgctctctctggttcctgggatggtgagcttcgtctctgggacttatctgccggtatctcatctcgccgttatgtcggccacaccaaagatgttctctccgttgccttttcaattgacaac

SEQ ID NO: 23466 - DNA, 405 bp, Gossypium hirsutum
  Clone ID: LIB3272-024-P1-K1-G7
actgtgtactgttacgctatcacggcctaaggccattaaagctgagatctcttgttttctccgcttcccaaattccttctgagtcaaaccacaacgaaggaagaaaacaaagatgacaaccgtcaggagcctcacttccccatctattgttaaagctccaaccccaaaccgatttacaagtcccatcgtcagggccccaacatctcttggatctgttaaaaccatctctagatctttcggcttgaaatgttcctcaaatcaacgaacatcaatggcaatgtacaagattaagctcgtaggaccaaacggtgaagagaatgagtttgaagtccccgataaccagtacatcttagaggcagctgaggcagcaggagtagagctgccttattgttgcagagctggagc

SEQ ID NO: 23467 - DNA, 419 bp, Gossypium hirsutum
  Clone ID: LIB3272-024-P1-K1-G8
tcgctggcttattttcagcaattacttccttcgttttaggctcaacaatagccagtgatgaatttgatcctgtgcttgacatctcaggtcaagagctccgaacaggcattgactactacattttgccggtaatccgcggtagaggtggtggcctcactctagccagcactggcaacgagacctgcccacttgatgttgttcaagagcagcaggaggtgtcaaacggtctcccattaacattttcacctgtgaatgtcactcaaggcgttgtacgtgtatccactgatctaaacatcaagttctctgctgcttcaatttgtgtccagaccactctctggacactgcacttcgatgaatcggtacaaaagtatatagtaacaaccgggggagttgaaggtaacccaaggcgtgaaactctg

SEQ ID NO: 23468 - DNA, 416 bp, Gossypium hirsutum
  Clone ID: LIB3272-024-P1-K1-G9
cttcacttcattaggaacatcaataccttgatcctttgaaccaccaaatggctcttcatctcttccacctcctcctcttcctccttctcagcccattatcttatgtctctagcgttggcattaactatggcactctaggaaacaacctgccttctccaaagaaagttgctcagctcctccaatctacgctcattgataaagttaaaatctatgacaccaaccctgatatccttgaagccttttccaacaccggaattgaccttattgttgccgttgaaaactaccacgtcgccaacattagcaaggacgcagccgcagccgacgactggtttgccactcgtgtgcagcccttcatccccgccacttccatcgtagccgtttgtgtaggcaacgaatatttgacctccgatgataat

SEQ ID NO: 23469 - DNA, 315 bp, Gossypium hirsutum
  Clone ID: LIB3272-024-P1-K1-H1
gactatcgggcttgcttctatttgttgtccatattttcctttgtggagaacccaaggaactccttgagggtttagcagttaacaagagaataacatatgttggcgaccgccattgtacatggcgccgtagggcagttttctcttaaagaagcctacatcacaaatgatgtcgaccgcctaagttcatctctgtaccaaaaaccgcgacttaaaaatggatggtgtcgtctttacgcgtcgcaatgtctgaatatacatcattaaccttgacacgacctgcgagagactatgcctcgcagatagtgttattgctgc

SEQ ID NO: 23470 - DNA, 343 bp, Gossypium hirsutum
  Clone ID: LIB3272-024-P1-K1-H10
gcccttctttctcgctccaaaggtaagcaatgaattaggattagaagcagctgtggaagctactgccaattttctgaacaaagctgtgaagcctgtccttgtgggtggacctaaattaagggttgcaaatgcaaaagatgcctttgtggagcttgcagatgcctgtgggtatcccattgccgtaatgccttcgggcaaaggattggtacctgaacaccatccacactttattggaacatactggggtgcggttagtactagcttttgtggggaaatagcggaatctgctgatgcctatgtttttattggcccaatctaaaatgattatcgctgtgtaggctac

SEQ ID NO: 23471 - DNA, 362 bp, Gossypium hirsutum
  unsure (1)..(362): unsure at all n locations
  Clone ID: LIB3272-024-P1-K1-H11
catttatttcactacccaacaacccaaaagataaaaggaatcgtttacttgttcgtagcaatttatcgtcatttcaagctcaattctctgaaaatttttgtgctgaacttcttttttctctttgtaccaccatgtgtggaggtgctattatctccgatttcataccgccgtcgcggtcgcgacgattgacggccgatttcttgtggcccgatctgaaaaaatccgggttgaagaaggggtcgggtaagagatactcgaagcccgtgatcgacttgngcgatgatttcgagactgactttcangagttcaaagatgaagaatctgatatagatgattatgatggtgatgatgttttggctgat

SEQ ID NO: 23472 - DNA, 212 bp, Gossypium hirsutum
  Clone ID: LIB3272-024-P1-K1-H12
gcgtgagggacgaagagagagacaaactgataagacaactagaatggaaaaaaccaccgaaacgacgccgtcctactcattgcaagatcaggctacgacagagctcggcgccggcgggaaactaaggaggcaacggccacgtcgaccacctaccacaccctacgcccgtcctcagcagaaccaatccttacgcggtcgcttactctccaaac

SEQ ID NO: 23473 - DNA, 420 bp, Gossypium hirsutum
  Clone ID: LIB3272-024-P1-K1-H3
ttcagtgtctcactctctccgtgcttcactccagtttctcctttccctcttcgaagaaaaaatgcgtgagatccttcatattcaaggtggccaatgcggcaaccaaatcggagccaagttctgggaagttgtttgtgctgagcatggcatagatgcaactgggcgttaccaaggagacttggatcttcaacttgagcgaatcaatgtctactacaatgaagccagttgtggtagattcgttcctcgtgctgttctcatggatcttgaacctggaaccatggacagcatcagatctggccctgtcggtcagatttttagaccagataacttcgtttttggtcaatctggtgctggtaacaactgggctaagggccattacacagaaggtgctgagttaatcgattccgtacttgatgttgt

SEQ ID NO: 23474 - DNA, 409 bp, Gossypium hirsutum
  Clone ID: LIB3272-024-P1-K1-H4
gtaacaatggcggtctcacttcaagctgcagctaccctgatgcaaccaatcaaggttgctgcaccatcaaggaccaatgtgccgctcaggtcctcccagagcgtttctaaggccttcggtttggagcctgttggtgctaggcttacctgctctttgcaaactgacctcaaggacttggctctgaagtgtgttgatgctaccaagctcgctggtttcgctcttgctacatctgctcttgttgtctcgggagcaagcgctgaaggagtttcaaagcggctaacctacgctgaaatccaaagcaagacatacatggaagtcaaaggaacaggaactgctaaccagtgcccaaccatcgatggtggtgtcgactcttttgccttcaagcctggcaaatactacgccaagaagt

SEQ ID NO: 23475 - DNA, 406 bp, Gossypium hirsutum
  Clone ID: LIB3272-024-P1-K1-H6
ggaaaacaagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggtgcaccgccggcggcagtgacggctagctttggtaggcctggagcgatggggaaagtggaacgaagatatgcgatgaaagagtcgtcgtcgtcggagacaagggcttattcttcagcttgggcgcctgaccctgttacggagtattaccggccggagaactg

SEQ ID NO: 23476 - DNA, 332 bp, Gossypium hirsutum
  Clone ID: LIB3272-024-P1-K1-H8
gaagcgttcttcgaaaatttatctgtgaaattttctgcagttttcttcttacaatagaagatctaaaacaacctatacggcgccatgtacggatccagaggatttcaagatcgttgaagacaggatacacattgcatgccgccccgatgggaaagccactggagaggcatacgtggagtttacttccgtcgaggaggctaaaagagcaatgtgcagggataggatgatgataggggtctcggtattggggaatggtttctttcaacaccagacgaagctcgacgagccgaatcaagatcgaggcagggaagaggtccggtaatctgggtttt

SEQ ID NO: 23477 - DNA, 417 bp, Gossypium hirsutum
  unsure (1)..(417): unsure at all n locations
  Clone ID: LIB3272-024-P1-K1-H9
ggaaaacaagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaagatatgcgatgaaagagtcgtcgtcgtcggagacaagggcttattcttcagcttgggcgcctgaccctgttacggngtattaccggccggagaa

SEQ ID NO: 23478 - DNA, 370 bp, Gossypium hirsutum
  Clone ID: LIB3272-026-P1-K1-A1
aaaaaaagatatggaaaccgttactttgacaggattacttacaaggctgcggccgagttccctaccaggcgagctttatcagtttccggcaagttcgatttgacgcatgctcaattacaacacatcatcgatcatgctgcttttcttctcatcggcttcggcattcattccggcgatgtggggggtcttactttcccaaacaccgaggagcttgttattatgttcttggctgtaattagatgccgtgcaaacgccgcgccgttaaactcagcttatactgccgaggagtttgagttttacctttctgattcagaatccaagctgttattaattccaggcgaaggcattaaagccgctgaagccgccgttt

SEQ ID NO: 23479 - DNA, 413 bp, Gossypium hirsutum
  Clone ID: LIB3272-026-P1-K1-A10
gccgccgcctgcgtctctctcttcatctctctgaacctaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctattgatgttgacattggtgccaatccttcagccgaagatgctgatgaggatgaaggtgttgatgaccaatctgtgaaggttgttgacattgttgacactttcaggcttcaggagcaaccccctttcgacaagaagcagtttgtcgtgttcatgaagaagttcatcaagaacttgacaccgaaactggatgcggaaaagcaagagtccttcaagaaaaacatt

SEQ ID NO: 23480 - DNA, 416 bp, Gossypium hirsutum
  Clone ID: LIB3272-026-P1-K1-A12
gaaatttaaaaaagagagagagaatgaaggttgttgctgcatatttgttggctgttttggggggcaacacttccccttcagctgatgatcttaaggccattcttggctctgtcggagctgaagctgaagatgaaaggattcaacttcttttatctgcggtcaagggcaaagatataacagagcttattgcatccgggagggaaaagcttgcttccgttccatctggtggtggtggtgttgctgttgcagctgctgctcctggtgctggtgccgctgctgctccagctgcagccgaggctaaaaaagaagagaaagttgaggagaaagaagaatccgatgatgatatgggattcagtctctttgattaaagagttggttttttgcagaaattctcttctttttttttcaaatttaag

SEQ ID NO: 23481 - DNA, 299 bp, Gossypium hirsutum
  Clone ID: LIB3272-026-P1-K1-A3
tgggcggagcacccgcccgttatttataccacacaaaatagggatccgcttgcttttatgtaggaaaaaattctaaactggtgggtacgttcgctggatactatcgctcattttttccttaaaacccttaatggttaccggagccctttaatcatttttgggcgtgttcccaaaaaatctgattacacttaggtttaccaagttcttggggttcccaaaagggcaaggcagggtgaattaaaaaaggcctattagaaaggctgcatttaaaaataatccgggtaagggtggaacccccg

SEQ ID NO: 23482 - DNA, 131 bp, Gossypium hirsutum
  Clone ID: LIB3272-026-P1-K1-A4
gtcggagggtgtgttaataaacgccttcgattgaacctaaaagtccctatagcttcgctatgcgagagaccctgttttgttaccaggatatcatatccgggggcgagcttttttctgactcattaccctac

SEQ ID NO: 23483 - DNA, 154 bp, Gossypium hirsutum
  Clone ID: LIB3272-026-P1-K1-A5
ggggaaagctgccacaatggcagcggccacattgaccacgccggcagggtcagcggttatactaaataacgtggggttaaagaaatcgccggctaaagacacatttgttggcggtgaagaaggcgaacatctattaaaatcgcccatatcgttg

SEQ ID NO: 23484 - DNA, 193 bp, Gossypium hirsutum
  Clone ID: LIB3272-026-P1-K1-A7
gtcgattccggtcgcccacgcgtccattttttttaccagatctgttacactctgaattatttaagcagcacgtcacaagggatctagagcaaggtttgtgaccttgggttgagtgtagagattgggaaaatcatgggtgcccaagttcttttcttctttgctttgctttccttttcagctggctcggcatttt

SEQ ID NO: 23485 - DNA, 386 bp, Gossypium hirsutum
  Clone ID: LIB3272-026-P1-K1-A9
cgtaacttgtggggaagaatcttgctatcccttgcttttgtgtcgcaaaaaattctcaagcttgtttttaacgttcgctgaatactatcgctcatttcttccctcagaaccctaatcgataactgaagccatttaatcatgtttgggcgtgttccaaaaaaatctgataacactaagttttacgaagtacttggggttcccaaaagtgcaagtcaggatgaattaaagaaggcttataagaaagctgcaattaagaatcatccggataaaggtggagaccccgagaagtttaaggaactggctcatgcttatgaagtacttagtgccccagagaagagagaaatttatgatcaatatggtgaagatgctcttaaagagggaatggg

SEQ ID NO: 23486 - DNA, 428 bp, Gossypium hirsutum
  Clone ID: LIB3272-026-P1-K1-B1
gaaacttgaggggaagaatcttgctatcccttgcttttctctcgcaaaaaattctcaaacttgtttttaacgttcgctgaatactatcgctcatttcttccctcagaaccctaatcgataactgaagccatttaatcatgtttgggcgtgttccaaaaaaatctgataacactaagttttacgaagtacttggggttcccaaaagtgcaagtcaggatgaattaaagaaggcttataagaaagctgcaattaagaatcatccggataaaggtggagaccccgagaagtttaaggaactggctcatgcttatgaagtacttagtgacccagagaagagagaaatatatgatcaatatggtgaagatgctcttaaagagggaatgggaggaggcggttcttctcacaacccatttgacatatttgagtca

SEQ ID NO: 23487 - DNA, 387 bp, Gossypium hirsutum
  Clone ID: LIB3272-026-P1-K1-B10
aagaaagtaagccactaaggttttgagagaagatcaaaatggcttctaaaagatcagcttccatggtcctccttttggcactcaacattctctttttttccctagtcagtgcttgtggctcttgctcttcacccacccctaaaccaaggccaaacccaaaccccaacacccccactcctactccatctgcacgaggcaggtgccctagggatgccctcaaattaggtgtatgtgccaatgtgcttaacctagtcaatgtcaccattggttcacccccagtgatgccatgctgttcccttctcaatggccttgtcgacctcgaagccgctgcatgcctttgcaccgctatcagagctaacattttaggcatcaaccttaacatcccag

SEQ ID NO: 23488 - DNA, 241 bp, Gossypium hirsutum
  Clone ID: LIB3272-026-P1-K1-B11
gcaatttattgcccccaaccccttttacatcaactcctaaccctaccttaccaatcaggcggggcatcttgcccttccttggtattcataattttcctacaaaactttctacattgctgtctattctaagggctaataccttatcagcgatcttaattgcctgctgcaccatcaacgcaggtacactcatgtcagttgcttgagaaactaggctcgtcctggacaagaaatctatcgccat

SEQ ID NO: 23489 - DNA, 408 bp, Gossypium hirsutum
  unsure (1)..(408): unsure at all n locations
  Clone ID: LIB3272-026-P1-K1-B12
cggacgcgtgggtgtcgagaaaagaaaaaaagaatatggaaaccgtaactttgacaggattacttcacaaggctgcggccgagttccctaccaggcgagctttatcagtttccggcaagttcgatttgacgcatgctcaattacaacacatcatcgatcatgctgcttctctcctcatcgcctccggcatccatcccggcgatgtcgtcgctcttactttcccaaacaccgtggagcttgttattatgttcttggctgtaattcgttgccgtgcaaccgccgcgccgttaaactcagcttatactgccgaggagtttgagttttacctttctgattcagaatccaagctgttattaatcccagccgaaggcatcaagccggctgaagccgncgctttcaagttgaaca

SEQ ID NO: 23490 - DNA, 318 bp, Gossypium hirsutum
  Clone ID: LIB3272-026-P1-K1-B2
aagtggatcaacaacgagcagctttcatgccttgtctgcgtttcatcagctaaccccgtacggtgaactagcatcagcctaccactgtgtacatgaatgcaagctgggctctaagaatctaagacctgagctgcaaacaattgaattggtaacccctcaaagctgactactgtccatttcgtggttgcggatgacaatgcggataaaaaggacgtggatttagaaacaatggactctccaatatggtatgctgcgagatcttcagtttcatagagatatcaatgggctcttgaactacgaccgcatgtgcttatgggg

SEQ ID NO: 23491 - DNA, 399 bp, Gossypium hirsutum
  Clone ID: LIB3272-026-P1-K1-B3
aaagaacccagtcttctgatctctgccccaaagcaaaaaagttctcatcttttacaatcacagctactgcttatttattttcatggctcaaggagattctaacttccagcaagacatggctaaagaggaagaagaacagaggctgaaatacttggaattcgtgcaagtagccgccgttcacgccgctttgtgcttcaccaacctttacctttacgctaaggaaagatcggggccgttaaaacctagcgtcgagaccgttgagggaacggttaagtgcgtggttggaccggtttatgataaataccatgatgcccctgctgaattccttaaatccgttgattccaaggtgggtgaatcagcgaccaagcttgatcgtcgagtccctccagtcatcaaaca

SEQ ID NO: 23492 - DNA, 398 bp, Gossypium hirsutum
  unsure (1)..(398): unsure at all n locations
  Clone ID: LIB3272-026-P1-K1-B4
tacccatggaatcaaagcctttctttcgtttcctctttttcttcatcgccatagctttcctttttctcttcgcctggactcacctccattacgcgccatcccctggcgtcaccaccctcctcgactgtgccagcaactctccttggtgcacctcctccaagaaccggtttcagtccaaacaacccacactcacaaaaaccccacgtgcctccacctcccagcgtcgtcaccacgagtcagctgtccctcgccacccactcgaccccctcaccatccaagagttcaacaaggtccgcaaaatcctttcttcccacgcgctcttcaagtcctncaataactacgcgctccattccgtcgtcctagaagaacccaacaaagaacttgtccttanatggaaa

SEQ ID NO: 23493 - DNA, 402 bp, Gossypium hirsutum
  Clone ID: LIB3272-026-P1-K1-B5
gaaaaatggagtccaacaccaaaatgtcagctcttcttttgctttgcatgcttttcatttcttcagtgacaccaattcttgggtgtggttcatgtgggaaagcaccacacaagcatcgaaagcctaagggaaagtcccctaaaggtcccatcactttgcctccccttgtgaaacctccaatcaagttgccaccggttgttcctccaatagttaagccacccattgacctccctccggttacagtccctccaattaacctccctccagggacggttcctccagtaactaagccaccaagtgggaaaccctgcccaacaccaccaaccaaggacacttgccccattgacacactgaaattgggtgcttgtgtggatctgctgggagggttgtgcacattggact

SEQ ID NO: 23494 - DNA, 328 bp, Gossypium hirsutum
  unsure (1)..(328): unsure at all n locations
  Clone ID: LIB3272-026-P1-K1-B6
ggaaaatcatgggtgccaaagtactttacttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagctngtctgagaaggagacagacaggagctttggcctaaggaatttcaggtacattga

SEQ ID NO: 23495 - DNA, 356 bp, Gossypium hirsutum
  Clone ID: LIB3272-026-P1-K1-B7
ataaaaatggcgatggcgagtgttcgatctggtctcctacgagcagcccttcgcggcggctctcgtcctactgctcctcccacgcgtggcttcgcttcctcttctcatcacgatgatgcttatgaaaccgcaaaatgggaaaagataacatatttaggtgttgctacctgcactggtttagcgatttataacctatcaaaaggtcatccccaccatgaagaggctcctgcatacccatatttgcacattcgcaacaaggggttcccatggggtccggatggtctgtttgagagaaaggagcatcactagggatggccggatggattcatatttttccgagttcggcgcatttttat

SEQ ID NO: 23496 - DNA, 292 bp, Gossypium hirsutum
  Clone ID: LIB3272-026-P1-K1-B8
aatacgtacacaagaaacaatcaggtggacaagggcagtttgctgatattactgttcgtttcgagccgatggatgcaggtagcggatacgagttcaagagtgaaatcaaaggtggagccgtgccgaaagaatatattcctggagtgatgaaaggactggaggagtgtatgtgtaatggtgtacttgcaggtattcctgttgttgatgtacgtgccgtgctagcagatggttcttaccatgatggcgattctagtgtcttggcatttcaactggcaaacaggggagccttact

SEQ ID NO: 23497 - DNA, 290 bp, Gossypium hirsutum
  Clone ID: LIB3272-026-P1-K1-B9
gaaacttgaggggaagaatcttgctatcccttgcttttctttcgcaaaaatatctgaaacttgtttttaacggtcgctggatactgtcgctcatttcttccctcaaaaccctaatcgataactgaagagcatttaatcatgtttgggcgtgttcaaaaagagtctgacaacgccaagttttacggagtgcttgggggtcccaaaagttcaagtgagggataatttaaggacgcttataaaaaagctgcgcttcagaataactccggttaagggggggaccccccgaagtt

SEQ ID NO: 23498 - DNA, 244 bp, Gossypium hirsutum
  Clone ID: LIB3272-026-P1-K1-C1
ttctcttccaaagtcaattccaaaaagagagaaaatcccaccaaaaaaatggcgaattctaatgacaacaacaacgacgagcaccatgaatcgagtcctcttttgagcaaacaagtggcagaccaagatttgaaggaaaaacctagtggtaaaaaggcaaaagaagctgacgccgaggtgccagctcatacggtagttgctaccagagatgggtttgggtggacggctgatgggtcgccattgg

SEQ ID NO: 23499 - DNA, 404 bp, Gossypium hirsutum
  Clone ID: LIB3272-026-P1-K1-C10
atacccccagaacttgtactaacatctactccacgacaagtcggaaatgcacgccaggacagattcacaggtgacaagcctcgccccatcattcccaaccaggtctccgcggcgtccagtttactatgtgcagagcccttcacgtgattctaacgatggagaaatgacaacaacctccttccattccacgccggttatcatccctatggagtcacctccccattcccattcctccatgggccgccactctcgagagtcttcatccagtcggttctcaggatcgcttaaacctggatcccgcaagatctcgactaacgacgctccattaaggagagctcatcggacggggcataaacagcggaaagaatgtgatgtgatcgaacgaagacgcctccttgaagatg

SEQ ID NO: 23500 - DNA, 114 bp, Gossypium hirsutum
  Clone ID: LIB3272-026-P1-K1-C11
aaaagtctttggttctttcgctcaacttaatactgggtattgaactttgtgcaaggggggttggggttctttatggctttgttgcgatttcatgaatgctatgtggaattggac

SEQ ID NO: 23501 - DNA, 411 bp, Gossypium hirsutum
  Clone ID: LIB3272-026-P1-K1-C12
gtcaatttctgttttatatataatagcagaaagagggctacccattatcaattctagcactcaaacaaattgcctttctcaattcagagagaagagcaagtgcaaacgaagtctctctttcttttgcgcttcaaaacaaaatccatctaagcgctttagttgacaacatatagtagttcaacggttggttctacttgtttgacaccttgaagcttggtgggtttcttgcgaaaagtacttttcaattttaatctaagtttgttgtatgagggaggtgcatgccatgtgcttgtaaattattattgcaatctctatggaacaatttcatgaaagagggcaccaatgcaaaacatcgtcttatatggaggatgttcagttgaatacaaattgggacgatgtgatttgtcctat

SEQ ID NO: 23502 - DNA, 397 bp, Gossypium hirsutum
  Clone ID: LIB3272-026-P1-K1-C2
tgccgctgtatgtgtttttattagtttatacctcatggcttcttggaactcagtttttctttcatggcttaagaatttcagtaatattttcaagtacaaaatggatgaagtccagcttggttcacatactataaggtcccatggtctcaccattgcaaggacacacatgcatgattggcttattcttgtattgcttgtggtgatatgggttgtcatccttatcattcatccattttatcgctttgttgggaaggatatgatggatgatctaagataccccttacaaagtaatacagttcctgtttgggctgtgccgatgtatgccgttctgttgcccatgctgatttttatctttgtgtccatttcgagaagggatgtttatgatcttcattatgct

SEQ ID NO: 23503 - DNA, 90 bp, Gossypium hirsutum
  Clone ID: LIB3272-026-P1-K1-C4
cccgggggcccggcccggtttccggggcgcccagcgttcgggctaacggggggttgttctaaaattcttttacgtgtcctttgtgcttta

SEQ ID NO: 23504 - DNA, 389 bp, Gossypium hirsutum
  Clone ID: LIB3272-026-P1-K1-C5
aaagaaaggaagagaggtccgacaatggggagactcgtttcagtttggcttgcttttgctgtcatcgcatgctctctaacggcgatctcagctgaagagagcggcgaatcgaaagagtttgtgttgactttggatcaatctaatttcactgacaccgttagtaagcacgatttcatagtcgtcgaattttacgctccttggtgcggacactgtaagaatctttctccagagtatgagaaagcagcatctatgttgagtaaacatgatcctccgatccttctagctaaagttgatgccaatgaggaatcaaacaaagatttagcaaatgaatatgaagtcaggggtttcccgactcttaaaattttgagaaatggaggaaagaatgttca

SEQ ID NO: 23505 - DNA, 372 bp, Gossypium hirsutum
  Clone ID: LIB3272-026-P1-K1-C6
aggaaagggatatctggttatctttatactgaattctggcacttctcaataccactagaaccagctttagaagtaaaataaacccagtgagaggatgataagatttttccaggataatcacctccatggttcaagctaaagttcagtaacttaaaatatttttgtttacaagaacaatatacattacaaaataaaaaagttgcactgccttacctggatatgtaggtaactccagtttgtccgattttatgtacggttttaagagtcacatttccggatgcctctgtctcaaatttcccattgattatgcacaccatctctttaagcatagacacatcaacatctccatttggaagaggtataaccatatta

SEQ ID NO: 23506 - DNA, 77 bp, Gossypium hirsutum
  Clone ID: LIB3272-026-P1-K1-C8
cttggttcacatactataaggtcccatggtctcaccattgcaaggacacacatgcctgattggcttattcctggatt

SEQ ID NO: 23507 - DNA, 382 bp, Gossypium hirsutum
  Clone ID: LIB3272-026-P1-K1-D1
cgacgagcaagatcaagcagacctggaagcagaagaagagaacagcaaaaacagagcgaagggaggtgtagctggcaagaaggctcgaagaccagtggcacctaaaaacccgaagaaggtaaacaagaaagatgacccacaagtacccgaagcctcagaaatttcgtctacgacagcaatggaagcagaaaatgttcctgctgttgttaaacccaaaggccgggccggtgcaaagaagaagacaaagaaggatgatagtgatgatgatgatgacaacgactttgatattcctgatctaagggagcgacttgccaagcataacatcgattcctctcctgataattccgctgatatggaaactgaattgtttcaagaacctgct

SEQ ID NO: 23508 - DNA, 134 bp, Gossypium hirsutum
  Clone ID: LIB3272-026-P1-K1-D11
ttgtcatttcaagtccttgggtttcgtggttcaaggcggctagtttaccagcactgggttctctactgcttactccattgattttatacaagtcttatcctccccaaaccaaaagacacacccgattgcccctt

SEQ ID NO: 23509 - DNA, 412 bp, Gossypium hirsutum
  Clone ID: LIB3272-026-P1-K1-D12
cgccggtggaataactgctggggcgactgttattctcaacattcttgttgctgggccaagtggggggggttcaatgaatccggggagggcactcgggccggctgtagcagcagggaattatagggcattgtggatttacttgatagcgcccacactgggtgctgtgatcggttctgccacctacactttggtgaagctccgcgaagatgaggtcgacgcaccacggcaggtcaggagttttcgacgctaggtaatatggagcccacgaaattatgacatcgttgaaaatggaaggggcaaaaaaagtgtggttttcttcttctaatgtctctctatgaaatgaaaccatacacatcgctgttcgtttgtttgtttgattgtgtggggtaaagataagatagcttttgggaat

SEQ ID NO: 23510 - DNA, 424 bp, Gossypium hirsutum
  Clone ID: LIB3272-026-P1-K1-D2
cgttccctctctttaacgtgttcgccgttgaaggctgccgatccgacttagtcataaacaatgggccgcaaagctgatgcgctttatataaatccaaagaaatttggctctcttacaaaaccttgcatgaaggaaatgatatcattcctaaattggatggcttttaacaagggtaatgatgaaaaatgtgtcccgcagaaggatcttttgaatgcttgcatggatgctcaatctaccaagaataggaagccatggggcaacattaattaccacttgcagaggcttaacaagggaagggaggtatgtgggttttctttaaagatgaatgttgaatttatgcatcattcttctaggtcatcacttctaagtagatgatgtgcattaggttgtagctacagaaaacattcatttgtatttttttttt

SEQ ID NO: 23511 - DNA, 289 bp, Gossypium hirsutum
  Clone ID: LIB3272-026-P1-K1-D3
ctacactttcactttctctctctagaaaccctctcgttaaacagtttattataaaatgttcaaatccttaataaaatcaccagcaactctctgatttgaaaactgagggttttctttttttgtgcaatttttttggaactgaagatttactaatggttatgggggataacgaaggaaataaaaagagagcccgggaagagacagaggctaactcggtgcccaatacaaaactcgctcgagttgacttggacgataataagggtcccgactccgactttcccgaggctac

SEQ ID NO: 23512 - DNA, 413 bp, Gossypium hirsutum
  Clone ID: LIB3272-026-P1-K1-D4
gtttatcagagcaagaaaaagaagggaaaatggaagggaaagaagaagatgttagattgggagctaacaagttctcagaaaggcaacctattgggacagcagctcagtcccaagatgataaggattacactgagccacccccagcacccttgtttgagcctagtgagttgacttcatggtcgttttaccgagctggaatcgctgagttcgttgctactttcctattcttgtacatctcggtgttgactgtgatgggagtccttaaggacaaaaccaagtgtacaactgttgggattcaagggattgcttgggcttttggtggtatgatctttgctcttgtttactgcactgctggtatctcaggtggtcatataaatccggcggtgacatttgggctgttcttgggaaggaaa

SEQ ID NO: 23513 - DNA, 309 bp, Gossypium hirsutum
  Clone ID: LIB3272-026-P1-K1-D5
gattttaaaagaaaaagaaaaaagcaattcaattagcagagaaaatggcaaccgaaacctcagtggtttacgatagaaccaaagagttgaagcaattcgacgacacaaaagctggtgttaaaggactcgtcgacgccggaatacttaacatccccaagattttcgttcgaccatccgaggaccttgccgccgacgaactgaattccagtcagaaaaccattgaagtcccgatcatagatgtaagcaacatcggagacagtatccggcgaaaggagatcgtaaacgaagttaagattgcatcaggggaat

SEQ ID NO: 23514 - DNA, 414 bp, Gossypium hirsutum
  Clone ID: LIB3272-026-P1-K1-D6
aaaaaaaactgaacctatcctctccctttcaaggttcccagcagccaaacatggcccacgccggcgagcgggggttccaaaggccaaagcttcttcacgagcggtggtcggagcgagaaaaggggggctttttaaccccgttcttgaccttcaccttaagggccggtccttcaaaccaaacaaggccaaacaaggggaggcctttcgtcttcttcttggtccgattccaacacccaagattgtgttcggcgaccggctttctagaccggttctggtgaagtcaacgggtattgggagaataaacctatcctttttggtgcacaactggtcgtgcttctggcgttgagtgcgctccaaatgcacgaggagacgtacggcgcactgaggctgctggttgtgagctcaattgggcta

SEQ ID NO: 23515 - DNA, 206 bp, Gossypium hirsutum
  Clone ID: LIB3272-026-P1-K1-D7
tttcatacttaatcaactttatttctcattgatcccgcctttttctttctgtttccatctttgggttttcaagttatttcctttgttaatcatggagattatcttggaactttttctgacagcttttattgctcttgttttttctttcttgatagccaagattgtctctcttgctaccggtggtgatgctggtgggggttgtagtg

SEQ ID NO: 23516 - DNA, 314 bp, Gossypium hirsutum
  Clone ID: LIB3272-026-P1-K1-D9
cgactacacagtaaaggatattgatgggaaggatacccctcttagcaaatagaggggaaaagttcttttgatcgccaacgcctctccaagatgaaaactgacggcttcctttttttctgcaatttttttggaactgaagatttactaatggttatgggggataacgaacgaaataaaaagagagcccgggaagagacagaggctaactcggtgcccaatacaaaactcgctcgagttgacttggacgataataagggtcccgactccgactctcccgaggctactcgtgtagaacctgatcctgatgatggaga

SEQ ID NO: 23517 - DNA, 415 bp, Gossypium hirsutum
  Clone ID: LIB3272-026-P1-K1-E1
gttttcattccccatttaactcacacccagtttcatagattttctatactaccccaacattactctctctagattcttacattttgagcttcagtgcagaatcaggaaatggttaaaaggtatggagtgttttgatgtgtggaagatatcatgttgcagtgcgtagctggtgtgaagcatttatttgcttctgtactgcaatgttgtgatattgatttgtacaaacaatctagaggtctcggtgatcccgaacttcttgcacgagagactgtgtttagtgtaagtgaaatagaagctctttacgagctgttcaagaagataagtagcgcggtgatagatgatgggctgattaacaaggaggagtttcaattggcattattcaaaacaaacaaaaaggagagcttgtttgcagatc

SEQ ID NO: 23518 - DNA, 302 bp, Gossypium hirsutum
  Clone ID: LIB3272-026-P1-K1-E10
ctgctgaaactgaagtaaaagtcgaaactgaagcacccgcacccgttgaagtcaagggagaagagaaggccgacccaccggttgaagcacccgcacccgttgaagtcagggaagaagagaaggcccatccacctattgaagcacccgcacccgagaccgtggtgtaaacagaagtggtcgaaaaggtttcaagctgccgtgacgacagtgccaagaccggtgagggaattgaggaattctttgtagcagtggccacttcttcaaccgcctaaaaaccaaaagtagaggcccttttttttttt

SEQ ID NO: 23519 - DNA, 407 bp, Gossypium hirsutum
  Clone ID: LIB3272-026-P1-K1-E11
tttgtcacgagttcgagaggttcagtacttatctgcctgatatcaaggttgctgtcgtggtatggaggtgtcaacatcaaagttcacaaagatctactgaaaaatgaatgcccccacattgttgttgggacacctggaaggatattggctcttactagagacaaggatctttctttgaagaatgtgaggcatttcattcttgatgaatgtgacaaaatgcttgaatcacttgacatgaggagagatgtgcaggagattttcaagatgacccctcatgataaacaagttatgatgttttctgcaacgctcagcaaagaaattcgcccggtttgcaagaaatttatgcatgatccaatggaaatttatgttgatgatgaggccaagttgacccttcatggtcttgtaca

SEQ ID NO: 23520 - DNA, 393 bp, Gossypium hirsutum
  unsure (1)..(393): unsure at all n locations
  Clone ID: LIB3272-026-P1-K1-E12
atcaaagtgcaggagctagggtttccatcaattgcaaaaatggagggattagtttcaatgaaaacagcttctggaatttccttccactctattccttcccctaatcagcgacctaatttcttcctcagacgctcctaaatggaccttcagcatcggcgattccattttccctccattcgagctcaacagtcggggacgatatttccgggaaaagaacgtgaggaagattctttgaaggtaacggaatgggaagttggaatgttgcaaaacgaagtcgcagcaggtcaagggattagaatacggcggcgtccaccgtcgggtccgcctttgcattacgtgggtcccttncaattccgtttacagaatgagggaaacactcctcgtaacattctt

SEQ ID NO: 23521 - DNA, 215 bp, Gossypium hirsutum
  Clone ID: LIB3272-026-P1-K1-E2
tttttctccagttcaaaagcttcactttcgcagctgctatttttttttttttgggggtgaaaccctcaaatctattttctccatcaacctgaaatagaagatgggaacattgggtaaagcaatctacaccggtggattctggatcaaagaaaccggccaaacttttgatcggcttggctggcggcttcagggcaactactactttcaagaacaac

SEQ ID NO: 23522 - DNA, 353 bp, Gossypium hirsutum
  Clone ID: LIB3272-026-P1-K1-E3
cggacgcgtgggcgaatctctcccagaagatgcagatctttgtgaaaacccttactggtaaaaccatcacccttgaggtggaaagctccgatactattgataatgtcaaggccaaaatccaagacaaagaaggcattcctccagaccaacagaggcttatttttgccggaaaacaactcgaggatggccgaactcttgccgactacaacatccaaaaggagtccaccctccacctagtccttcgtctaaggggtggcatgcagatatttgtgaaaacccttacgggcaagaccatcaccctcgaggtggaaagttctgatacgattgataatgtcaaggccaagatccaagac

SEQ ID NO: 23523 - DNA, 388 bp, Gossypium hirsutum
  Clone ID: LIB3272-026-P1-K1-E5
aatactcacaacttcaattgaaacacctctgcttttgctgtttccaatcttaggcggggctaaatcttgctatacaaaggtacaatttttttctccaaaagatacatttaagttttagtcgtgcagattagaatggatcaccaggggcatggacagcccgcggcaaaggggatcataggtggtggagcccaaatgccgcacagcactaacccgtatccaaaccaagtgactggggccccgtattcaggatcgggtggaggcattcaaccgagcagccaggcaacaggagctcaacttgcacagcaccaacttgcttatcatcaaattcaccagcagcagcaacagcaactttagcaacaacttcagacatgttgggcggatcagtatc

SEQ ID NO: 23524 - DNA, 196 bp, Gossypium hirsutum
  Clone ID: LIB3272-026-P1-K1-E8
gaaaaaataaaaactcccctccctttttttctgcatctgcttttatttctttacagctgaaaattaataattataaatcaaatcaaatcaaattcttttctttcctattcctttcaacctgctaacaaagtatttcaaagattttttttttgaccaaaaaaattagtgggccattcccgcccttggaggatgagct

SEQ ID NO: 23525 - DNA, 387 bp, Gossypium hirsutum
  Clone ID: LIB3272-026-P1-K1-E9
gcagcttctccaccttgcatgggacaaggagaatgaacagtgtcccatggaaggtggagaagctgcttgtctccatatcagtaaacctaattgtgatcgggtaagcgtacaaggtatctatgaatatatggaggaagagacattccttttattaacatcattgatgcgcttaaagggatgaaaagaataaagagatgaactggatgatgtagaggaagatacacactggaaggatgggtgatttcaggtatcagtgatgcatgtcgaaccagtggagcttgtacctaattggaggacatgacaaaaacaatttttcatacagttacagtgtgattgaaggcggacctttatgggacatgcttgagaaaataaactatgaaaaccagt

SEQ ID NO: 23526 - DNA, 414 bp, Gossypium hirsutum
  Clone ID: LIB3272-026-P1-K1-F1
attcaatcatccatttttcttctttgcttctcttccttttaaacttagaaacaaaacatctagtagcattagaatcatgggtgttgtgagttatgagtttgaggtaacctccccaattgctccagccaggcttttcaaggcttttgttcttgaggctgccaagatttggcccacggctgcccctcatgcagtcaagagtgttgagctcgaaggtgatgctagtcctggaagtattgtaaagatcacctttgttgaaggccttccataccaatatatgaagcaccagattggaggacatgacgaaaacaatttttcatacagttacagtatgattgaaagtgggcctttaggggacaagcttgagaaaatcagctatgagaacccagttgtggcagctgcagacggaggaagcat

SEQ ID NO: 23527 - DNA, 308 bp, Gossypium hirsutum
  Clone ID: LIB3272-026-P1-K1-F11
gaaaaatgaaattgctttcctgtgtcaaacttgacgagaatcggaccttgttttacagggttatgcatccgaatacctttgacttcttttgcaacaaggtgcacccatttttaacaataaaattgtttcctcggcaaacaatcgattagtgaaatagcttctgcagacaatgggatacttgtatgttttctgctgaattccatgattttggtcatggttggggaaaagtgtctccaaactttttatttttcacttttgttttaaaaattacccaaagcaaattcaagaattatttttttactccgagc

SEQ ID NO: 23528 - DNA, 298 bp, Gossypium hirsutum
  Clone ID: LIB3272-026-P1-K1-F2
tcagcctctttgactaagcaagcaaagcaaatatcaatgcttaaagatccctcatacgttgaggaacacctgatctaaaccaacttctttttgggcaatgttttgtcactttttatttttatttgttatgataatgatataagttgagaatttaagattgttttttctttatgttttggattttctttttgaatgcactgcaaatttcatgcatcttcaaattttaatggtattttgattttagggtttaaaaaaaaaaaaaaaaaaaaaaaaaaaaaaaaaaaaaaaaaaaaatagg

SEQ ID NO: 23529 - DNA, 418 bp, Gossypium hirsutum
  Clone ID: LIB3272-026-P1-K1-F3
aaaaaaaataaaaaaaaagttctggaaaaacaaaaattgcagaattcgctcgtatacggttccttgtctctcgcttgtatcgatctcgatttccagtatttaatcttcacattttctttgttttttttttgttttctttcttcaggactcactgatttaccagatccgagttcgccaagtctcgattttgggtacacaaaaatgttttaaggaaaaaaatagcatcgaactcagttttagcattgtttgtttgaaaactgggtttttctttaacttcgaaaagcttcagcggggcaatcaatggttttttcctttgatccttgtaattttctaagaattggggtttcatagaagaattattaaaagaaactagtgtttttaggatctggcgcttggatataagggaaaattacaatcg

SEQ ID NO: 23530 - DNA, 363 bp, Gossypium hirsutum
  Clone ID: LIB3272-026-P1-K1-F4
caaaaagttaagagcaaaagaaagagcagagtaagctaagctttgatcatcaatggcggagaagagtttcaagtacgtgatccttggcggtggtgtagctgctggatatgcggcgagagagtttgccaagcagggagtgcatcctggtgagctagcaattatttccaaggaggcggtggctccatatgaacgacctgccctgagcaaagcatatctcttccctgagggagctgcaagacttcctggtttccatgtctgtgttggaagtggcggaaagagattgcttcctgagtggtacaaggaaaaaggaattgaattgatccttaacacaaaaatagtgaaagcagatcttcccgccaatac

SEQ ID NO: 23531 - DNA, 397 bp, Gossypium hirsutum
  Clone ID: LIB3272-026-P1-K1-F5
atgatgcctactcgtatactaatgatttcccaaactctccatctcatttctgcgagagagctacttctagcatcataattgcaaattgtaatattaaagcgtcgatatggtgcttgtgagaggcccgcctgagaatcgattgagatcaactgattgggatcaaccctctcccggagtaactgtgaaagaagcatatcttgttaggagataataccttgaaactgaacctctccactctatacctatcatttccttgtgaagggcacacagcagaactaacagggaggttggttgctccaagcggttttgctcttgctataaatacaccatttggcggtacatattcgtgttcgtgttttttttttctaaaggaaaatgttaggagctagttagaata

SEQ ID NO: 23532 - DNA, 390 bp, Gossypium hirsutum
  Clone ID: LIB3272-026-P1-K1-F6
gagctacttaaccatttcccaaatctcctccctcctcttctttagcgtccttttcattgccgctcatgcagcgcgctttgaaatccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccggtgattgtggtggactccttcaatgcaaaggttggggtgtacctccaaacaccctggctgaatatgcacttaaccaatttggaaacatggatttctacgacattttcttagttgatgggtttaacatccccat

SEQ ID NO: 23533 - DNA, 210 bp, Gossypium hirsutum
  Clone ID: LIB3272-026-P1-K1-F8
ttcttcgaccatgaccgtcggtggcacaaccagctggtcggattgtgatgggagctctttgccgattgcactccccggactgctgagaacttccgtgctctctgcaccggcgagaaaggggtaggccgtaacggcaaacctctccactacaaaggctcatccttccaccgggtgatccccaatttcatgtgtcaaggaggcgactttacc

SEQ ID NO: 23534 - DNA, 357 bp, Gossypium hirsutum
  Clone ID: LIB3272-026-P1-K1-G10
gctctttgctctatccacttacaacgatggaccgcttctgtcttctcttcctcctactttcctccgtcgttgcttcggccgcctgtttccaacgttaatagcaacgggaatcctttaatcctcaagttgtttccgatggtggtgtcgaggaggacttcgatgaccatctccttaacgcggaacaccaattgacgctggtgaaattcaaatatgggaaaacctacacatcccaggaagagcacgagtaccgactgggagtcttcaaagctaacctgcgttgggccaagcgtgataaggtgctggaccccagtggcgtacatggcgtgacaaagattttcgatataactccatatgagt

SEQ ID NO: 23535 - DNA, 411 bp, Gossypium hirsutum
  Clone ID: LIB3272-026-P1-K1-G11
tctctctctctgcattttcatctcttgtttctttctcttttacaatctcatacatgggtgaggagactcaaaagcctgaagctgctgcaccccctgctcctgctgaggaagtggtggtggagaaggagagtgaacaggaggctgcttccgagaagcctactgatgctgttgttgaagacaaacctgctgaggctgttgaggaggagcctaaggttgaagctaaggacactaaggtaactgagtctgcttctttcaaagaagaaaccaatatagccggtgaacttcctgacccacaaaagaaggctcttgatgagcttaagcaacttattcaagaagcccttaacaagcacgaattcacaccccctcctgccaaagataaagataaaccagctcccgaggaaaagaaagagg

SEQ ID NO: 23536 - DNA, 416 bp, Gossypium hirsutum
  Clone ID: LIB3272-026-P1-K1-G12
ctcggggaaagatcgattcatcagtcttcttctctgagtagaggttttggatttgtaagcatttacaatgtcttcgtcctatctcccagcaaccactgactcaattgctctggccttagaagccaaaacaccatctgaagccatctcaatcctttaccgtgtactagaaaatcctgcatctgctcccgatgctctacggattaaagagcaggccataacaaatctatctgatcttcttagacaagagaaccgagcagaggagctcagaagccttctgacccaactgaggcccttttttgcactaattccaaaggcaaaaactgctaaaattgtccgtggtataattgatgatgtagctaagataccaagaacatcagatctccagatttctctttgcaaagaagtggtgcagtgga

SEQ ID NO: 23537 - DNA, 405 bp, Gossypium hirsutum
  Clone ID: LIB3272-026-P1-K1-G2
aaaaaacatctttctgttcaattcaatcctcctttttctattcaaccataatgtcttgcttcattagcaaatacgccgatgagttggctaaaaacgctgcttacattggcacccctggaaagggtatccttgctgctgatgaatccaccggcaccatcggcaagcgtctttcaagcattaatgtagtaaatattgaagaaaacaggcgtgctctccgtgagctcctcttcactgctccaggagctcttcagtacctcagtggtgttattctcttcgaggaaaccctttatcaaaaaaccgcttcgggcaagcccttcgttgatgttttgaaagaaggtggtgtcctccctggcattaaggtcgacaagggtaccgttgagcttaacggaaccaaccgcgagactt

SEQ ID NO: 23538 - DNA, 394 bp, Gossypium hirsutum
  Clone ID: LIB3272-026-P1-K1-G3
gaaaatctgaagatatagaacctggagttggtaagtgggtttcatacctcaatcgtgagaagaagttggattcacttgttggtcgccgtcctactgctcctccagccccaaaaggactctatatatatgggaatgttggaagtgggaagacaatgcttatggatatgttttatagtgccactgagggaatagttaaacatagacaaaggttccattttcatgaggcaatgctcaaaataaatgaagctatgcataaattgtggaaaaatcaagttgaggaaaagtctattcagtcaagcatatcttcttggattatgaatctttcctttgatatcaaagccaaggagtggttagctgctgaagaaagatataaacaagaggttcagatgaaaaa

SEQ ID NO: 23539 - DNA, 349 bp, Gossypium hirsutum
  Clone ID: LIB3272-026-P1-K1-G4
gagctatcagccattagctcccttgctgcacatttgtgagcaagtaaaaatgcttcttgcaccttgcttcatgttctgggctcttgttctctcttttgtggctgcatcttgcaccaacaattaccctggtggcttggtaaatttgccgaagttgaaaggtctattttaaataccgcaccctgtcatttccttcttaagataccatcattttcatttctttcaaaggatggccttgaaaaatattaatctggagaggtccaagctggtggatacaaatggaaacccgtactgtgtcccaatgggaacacgaacacaaatgtgtaagaacacccttctctatacctgggtt

SEQ ID NO: 23540 - DNA, 359 bp, Gossypium hirsutum
  Clone ID: LIB3272-026-P1-K1-G6
gctgtgtgtctgatagggtttgtaccctttttcagccgccgccgttgtatcaggccgatccacgaccttattcacccccttttccgatcgctactgagatgggatgaaccgcgacaaagcccgtatgaatccgcaggggaacgtggagcaaacggcgcgcatgggatggtcgattccgagacgtgcggcgcctgtgaactgatggaggcggagttgaacagacatgcgtcttctgagtgcattcgaggctagagttctgcttttcttttttgtttctgaagtattgagcttgtgcaggcctgtatttgcgggactgctaactttatttggactcgggtcaatagggccctattacatta

SEQ ID NO: 23541 - DNA, 295 bp, Gossypium hirsutum
  Clone ID: LIB3272-026-P1-K1-G7
cactctggatgagaagaaccctcgtcgtatttttgaaggtgaagcccttcttcgtaggatgaacagatatggacttttggatgagagccagaacaagctcgattatgtgttggctttgactgttgaaaacttccttgaacgtcgtttgcaaacgctcgtgttcaagactggtatggccaagtcaattcaccatgcacgtgtgttgatcaggcaacgacacataatggtcgggagacaggttgtgaacataccgtccttcatggtgagggtcgactcccaaaagcatattgatttc

SEQ ID NO: 23542 - DNA, 343 bp, Gossypium hirsutum
  Clone ID: LIB3272-026-P1-K1-G8
cttcctttcattccttctacctcctcttcattattatctttcctttaagctttggcaattaatttctttgctttcaaagagatgtgtggtggtgctatcatttctgaattcatcacccggaaaggcgcccatggcgtcactgcttctgacatttgtcccaattcccctttcgcaaaaatgggtttagctctgactcaactcaatcctttcatgatgactcactcgccctctgtaaaaggaaccgaccccaatcctcagatggtgtgcatgtggagaagaaagtgaaaaggcagagaaaaaacctatacatgggcatacgccagcgtccatggggcaaatgggc

SEQ ID NO: 23543 - DNA, 382 bp, Gossypium hirsutum
  Clone ID: LIB3272-026-P1-K1-H1
agaaaatcccagttcttgttcacaatgggaaccccatctctgaatcccttgtgattcttgaatatattgatgagacatggaagcaaaatcccatattgccccaagatcctctacacagagccagggaacggttctgggccaaatttagtgatgaaaagctactaccatcagtatggggtgctttcaccaaagaagggaaagaccgagaggaagctatggctgcaacgatggagaacctgaaattcgtagaagaagagctgaaaggaaagaaattcttcagtggagagaagataggcctggtagatcttgttttcggttggcttgctaacttgatctctatttttgaagaggtatctggcttcaacatagttggtgagggata

SEQ ID NO: 23544 - DNA, 417 bp, Gossypium hirsutum
  Clone ID: LIB3272-026-P1-K1-H10
agcgctttgtttgcgagctagccgacgcaccgtcccttcctcctccgcagtttgcttctaaaggtaaaaatcttgtggctgacgtggataaagggaagttgctgcaatgggcgttcaagattatgcagagtcaaagttgaagccatctgttgatttaactggatctgcaaaagaatgtagtaacgggccatctattggtgttatagacatcggggtcagtcaaagtgccttccttttccgagttgcattgccgggcatcaggagcgatcaaagtaagttaaaatgtgagatccaacgtgatggaaaggttctgatacacggtatagtaacgcaaggcagtgaagtgctgcagggattatcgagtgcgtgccagatgacagttgacaagttatgctctcctgggccattcaccatttc

SEQ ID NO: 23545 - DNA, 408 bp, Gossypium hirsutum
  Clone ID: LIB3272-026-P1-K1-H11
gaggaaatagaatgagaggagaggagaggaaagtggagttttaaaacttgagagaaaggggagagttaataatttccaaagacatggggaacagtttaagatgttgtttggctcgtgttcttccctgtggagctctagacttgatccgtatagtccatttgaatgggtacataaaaaagcttactgttcctatcacagctgctgagatccttaaagccaaccctaaccttgtcctaagcaaaccaacctttcaaggtgttttacgtaaaatcttgatcctctctcccaattcccagctcaaaagaggcaacatctactttttgattccatccacaccgtcactgtcgaagaagaaaaaaactgttgtgcaccacatgaaatcttccaccaaaatgcaaagcaacattt

SEQ ID NO: 23546 - DNA, 412 bp, Gossypium hirsutum
  Clone ID: LIB3272-026-P1-K1-H5
caggttctctcattagctctttgaatttctactctctttttttttttttttaaagtttgtatggatacccttttccaagatttacctggttccatgtatgggttcaaatttgatcacggctcagtgccaatgccagtgtatgcaaatcacaaccttgataatgggtctaaagagagtcccattgattcatcttcatcatcaccatcatcaggcgtgagttcagatagtcctttccctaatgaaatgcttaaatacataaaccagatgttaatggaggaagaccttgaagaaaagacctgcatgttacaggtgctctaatctacacaagctgctgaaagatccttctatgaagtcctctgccacaattatccgattccggctggtctaaatcattattacccagatgatgatt

SEQ ID NO: 23547 - DNA, 315 bp, Gossypium hirsutum
  Clone ID: LIB3272-026-P1-K1-H6
tttttctccattttggcaaaacccattggcctaaagaagaaaaagcagattctttgaaaccgataaaacattgttacagactcactgaaagctttcagttttgcttatctcagttgactcttcaatggcttctccaatgaggtctgaaaggacaaaaggtgacaattatgaacctaatcgcatgaatcctcagcagccggttcttgatgtggcgcctctcaattgtgtgccatacatgggtccaactaatgcagatgatatgttttcttcaccaaccaaagagaatactgaggctgtggaagcaatcggtccagc

SEQ ID NO: 23548 - DNA, 297 bp, Gossypium hirsutum
  Clone ID: LIB3272-026-P1-K1-H9
aaaaccacggattcttcttcttccatttaccttcgaaccccataaggttctctattgctacgtttttgaattgttagtgagcgaaaatgagagagtgcatttcagtccacatcggtcaggctggtattcaagtcggaaatgcctgctgggaactttactgccttgaacatggaatccagcctgatggccagatgccaagtgacaagactggcggtggacgagatgatgcctttaacacctgtttcacagaaactggcgcaggaaagcacatgccttgaccgtgctttgtggatcttg

SEQ ID NO: 23549 - DNA, 88 bp, Gossypium hirsutum
  Clone ID: LIB3272-027-P1-K1-A1
tcgatactgcgagggctaaacatgcatcagtatatttgcccgggaaggaatctcgggtcgaccctataacatggactgcatataaagg

SEQ ID NO: 23550 - DNA, 427 bp, Gossypium hirsutum
  Clone ID: LIB3272-027-P1-K1-A10
ggaattctgggttttgagtatggaattgttcaaggacctttgggaccggatattgctggtccggagctagttgctgctgttgcaaacgctggtggacttggccttcttagagctcctgattgggaatcaccagattatgtgaaagagttgataaggaagactcggaagttaaccgacaaaccctttggggttggtgttgttctggcatttcctcacaaagaaaatgtaaaggctatactagaggagaaggtagcagtgttgcaactgtattggggagaatgctcaaaggagcttgtaatagaagctcataatgctggggtcaaggttgttccccaagttgggagtttggaggaagcaaaaaatgcaattaatgtgggcgtagatgcaatcattgtccaaggccgtgaagcaggagggcatgtaatcg

SEQ ID NO: 23551 - DNA, 358 bp, Gossypium hirsutum
  Clone ID: LIB3272-027-P1-K1-A11
ggaattctgggttttgagtatgaaattgttcaaggacctttgggaccggatgtgtggtggtccagagcttgttgctgctgttgcaaactctggtggacttggccttcttagagctcctgattgggaatcaccagattatgggaatgagttgatatggaagactcgtatgttaaccttcaaaccctttgggggtggtgttgtcctggcatttcctcacattgaaaatgtaaaggctatactagaggagactgtagtaccgttgcttctgtattgctgagaccgctcaaaggagctttgtattacaatctcatgatgctgctgtcaaggttgttgcccaagttttgtgtctggaggaagc

SEQ ID NO: 23552 - DNA, 436 bp, Gossypium hirsutum
  Clone ID: LIB3272-027-P1-K1-A2
ctgagactggccaaatttgaccaattggggctctgaattttagttcctttttttttttccctcttttatacagtcatctgctccaattctgaatacccattgtctagtttgtttaaagatcagatctttgatacatcctcggattttttttgggtcttttttctctatcaaaacagagaagatcgaaagggagaaacatggctccacctacaaggatagggcttgctggtttggctgttatgggccaaaatcttgcacttaacattgctgagaaaggctttcccatttctgtttataacagaactacctctaaagtcgatgagactgttgaaagagctaaaaaggagggagatcttcctgtatatggtttccatgatcctgaatcttttgttcagtcaatccagaaacctagagtggtaatcatgcttgttaaggc

SEQ ID NO: 23553 - DNA, 438 bp, Gossypium hirsutum
  unsure (1)..(438): unsure at all n locations
  Clone ID: LIB3272-027-P1-K1-A3
gtttggtgtctgttttttgggagattttaaagaaacccacaattggagatgtggtgagggagttactggtttttatagctcctttatgggttgctgtaattgttggggttttagttggttgggcatggaagccgaagtgggcaactataggcagggagatgttcatggattgttctggttctaaggattcggctcctgcagaatcttctgagtcttctttcagtggttttggttcccttccgagcttgaatttgatcaagtttcagttgcctagtgttatctcttggatttcagatgacggggctcaaaaagattctttctttttgncacctactcttcattccaattgcagttcatcacagaacgagatgcataaactgtgttttctggacagatgatgatttagagcatttatatataataggcggagaaaaagat

SEQ ID NO: 23554 - DNA, 436 bp, Gossypium hirsutum
  Clone ID: LIB3272-027-P1-K1-A4
gccgcagccagcaagcaacagtagcaacagcaggagcggaagaatgtctcacaggaaatttgagcacccaaggcatggttccctcggatttcttccaaggaagcgagcctctcgtcacagaggaaaagtgaaggcattcccaaaggatgaccctaccaaaccttgcaagctcactgcctttttggggtacaaggctggtatgacacacattgtcagagaggtcgaaaaacccggatctaagcttcacaagaaggagacatgtgaagctgttacaatcattgaaacccctcctatggtgattgttggggttgttggatatgtgaagacaccacgtggccttcgctccttgaacaccgtctgggctcagcatctgagtgaggaagtcaagcgccggttctacaagcactggtgcaagtccaagaagaaggcttttgtc

SEQ ID NO: 23555 - DNA, 428 bp, Gossypium hirsutum
  Clone ID: LIB3272-027-P1-K1-A5
tgcactgccggtatctctgggggacacatcaacccagcagtaacctttggacttttcttggctaggaaggtgtcgttggttcgagccatattttacatgggtgctcagtgtttgggagccatatgtgggtgtgggctggtcaaggccttccaaaactcgtactacaaccagtatggaggaggagccaacagcctggctgaaggatacagcactggaactggtttggcggctgaaatcatcggcacctttgtccttgtctacactgttttctctgcaactgatcccaagaggaatgcaagagactcccatatccctgtcttggcaccacttcccattgggtttgctgtgttcatggttcacttagccactattcccatcaccggaaccggtatcaacccggctcgtagtttgggggctgctgttatctt

SEQ ID NO: 23556 - DNA, 433 bp, Gossypium hirsutum
  Clone ID: LIB3272-027-P1-K1-A6
tttgctctggaattttgcagcaacttgattacggtatagtccaatgccaggctctggttttggcacccactagggagttggctcaacagatcgagaaggtgatgcgggcacttggtgattaccttggtgtgaaggtccacgcttgtgttggtgggactagtgttcgcgaggatcagcgaaatcttcaaagtggtgttcatgttgttgttggtacacctggtcgtgtcttcgatatgttgagaaggcaatcactccgtccagattatattaagatgtttgtcttggatgaggctgatgaaatgctctcccgtggttttaaggatcagatctatgacatcttccagctttttccgggcaagattcaggttggggtattttctgctacaatgccacccgaagccctagagatcactcggaagttcatgaacaaacc

SEQ ID NO: 23557 - DNA, 371 bp, Gossypium hirsutum
  Clone ID: LIB3272-027-P1-K1-A7
ttcgtcttcaagatctcagttctcaaatcgtagcgctcttttctatcaagccatggctctgatcttgcatgcaggaaaaacaaacaaaaatgcctttaaggcactcattgctgcagaatatagtggtgtgcaggtcaaaatggttgagaattttgagatgggtgtgtcaaataagactcctgagttcatcaagatgaaccctttggggaaggttcctgtgttggaaacacctgagggtccggtatttgagagcaatgccattgctcgttatggtgctcgctcaaaggttaacaaccctatatgtggttctacattgattgattatggtcatatcgagcaatggattgattttgcagccttggaattgatgc

SEQ ID NO: 23558 - DNA, 410 bp, Gossypium hirsutum
  Clone ID: LIB3272-027-P1-K1-A8
cactgagtctcgatgaaattgccgactctgtggttagtgatttcttaaagatgctggaaattgaacacggtccatttagcttgaattctgacaatgctgttgagtctcctagagaacgtctgttgagagaatttgagaatgaagccttagattccggtgacttcatcttaaattttgaagctgggggagaagaggaggaagttggatccaccactcctggtgcttgtcacggggataattatgatgattttgctttctcttcatttattctgcccaggcaggagcaggaggaaagtcggtcactggcaaacagaaagtcaatcaaaatgcttgaatacttggagactgtagccttgatgtgtgagtggggcttagatggaaggcatttcaaagttcttcgtgtgttcaga

SEQ ID NO: 23559 - DNA, 132 bp, Gossypium hirsutum
  Clone ID: LIB3272-027-P1-K1-B1
actgatctaatttgagcatcttcatatacagctgatccctatatgaagctaatggggggggttccttctactttttgtgagtacaagctctatttcgttgacctaacacaagcttttgacatcttaagacaa

SEQ ID NO: 23560 - DNA, 226 bp, Gossypium hirsutum
  Clone ID: LIB3272-027-P1-K1-B10
gtactaagttaggtagctaaattcttaaaaaatgcacagcttattaacgtgaagtctaattttatatgctttgaagaactcatctattcgttcatcgtagggcatccctatataacacaagtgctcaaataggtgttcgcgatggaccgctaggcatcaaaccaccactatggccaaggatgattttcttgtacatacagagaaacatttgttgtgcgcgacccta

SEQ ID NO: 23561 - DNA, 428 bp, Gossypium hirsutum
  Clone ID: LIB3272-027-P1-K1-B11
ttcccaaacatgtctaaagcctgcttgcttttgtttctcgttggagtggtggtttttatcatcactccttctctagctaaccaacatcatgataatgagcttcccaaggggaagcctttcccaggtgagaagcaaccacaacacatgccattccctgaacaccgaccgccaatacacagtggacctggcggtaaaggacaggagccaccacatggggaaaaacctcctcatagaaacttattgagtgtggaagttgagggcacacataaacctccacgacattcatgtggtaaacctccaagacactcggggggtaaacctccacatgttgaggggttccctaccgataaagcacccatgaagccattccctggtgaaaaaccatccaagggttagggaaagggagcaccttatgaacccaaaccttc

SEQ ID NO: 23562 - DNA, 427 bp, Gossypium hirsutum
  Clone ID: LIB3272-027-P1-K1-B2
aaaaaacttgtccgtcagtgaaaaacagttgattttctttttttcttctttataaagaactagtaatcaaatcgaatggcgggaatttgctgtgaagttgttggagaaagtgaagcagcggctccggttgaaccaacttcaagagcttctcgtcgccggataatggagcttctaccgtttaaattagtggccgaagctgctgttcgaccgccgttagagaacggccggaaacgtcagaagctcgatctcgttcgcccgacttctcgtgattgtgataacgctgttcaaaactcggatactgataagcttgagaaagatcaagaacttaatggaagtctaaagtttaatggagcagtaaaatcagaagccgtagaagaagaaaaggaatcgccgaagttcggcatgacatccgtttgcggatggcgac

SEQ ID NO: 23563 - DNA, 380 bp, Gossypium hirsutum
  Clone ID: LIB3272-027-P1-K1-B3
atcatgagtgctgtcacttatgactattaaaatccctaaccagtcacgcctaccaggcttctcaaggccattactagacacactccgaaagtctgccccacggactcacctaatgcagtaaaaaagccttgaacgctgaagctactcactagctctggaagtatgacagaaactatctatgctgaaggcctctcattccaacttatgaaacaccagatgcgctgacatgagacaaaggattttcaatacagtatcgatttaatcgcacatgctccgtggatggatatgcttaaaaaaatgaactatgaaaacagggtggcggctcctgcatgtggagggcgtatacacttgagctcaatgaaatacaacactatatgcga

SEQ ID NO: 23564 - DNA, 439 bp, Gossypium hirsutum
  Clone ID: LIB3272-027-P1-K1-B4
cagatttgcaggttgttttctgggaattttaggggaaacccaatgtcgaaacaaacatacagggtgtgcttttgcttcaggaggaggtttagggttgcagtgtcagaggcaccagaggagatcaagcgggtgtttgagcagtactctgagaatgggatgatgtccattgatgcactccacaggttcttagttgaattccagaaagaagataaggctaccagagaagatgctcagaaaattgttgatagtgttaagcattttcatagaaagggtctaaatcttgaaggcttttttaagtatctctttgctgatatcaatcctcctctggcttctcttggggtccaccatgatatgaatgctcctttgtcacattatttcatacataccggtcacaattcctatcttactgggaatcaactcagtagtgactgcagcgatg

SEQ ID NO: 23565 - DNA, 411 bp, Gossypium hirsutum
  unsure (1)..(411): unsure at all n locations
  Clone ID: LIB3272-027-P1-K1-B8
gcacaacttgggcctgagttggcttctactcttgtaattgtgatttcaaagagtggaggtacccctgaaacaagaaatggtctattggaagtacagaaagccttccgtgaagctggtctggattttgcaaaacagggtgttgctataacacaagaaaattctttgttggacaacactgcaaggattgagggttgggtagccaggttccctatgtttgattgggttggtggcaggacctctgaaatgtctgcagttggtttgcttcctgcagcacttcagggagttgacataagagaaatgcttattggtgcatccatgatggatgaggccactatgagcacagtcctgaggaagaatcctgcagcattgcttgctttattgttgtactgngcaactgatgggattggatct

SEQ ID NO: 23566 - DNA, 438 bp, Gossypium hirsutum
  Clone ID: LIB3272-027-P1-K1-B9
ctttttcgttttttaatttgctttctgtaatggctaaatcttatttacctgcaaactttgggtttatggcttcaagaatgctgctttttgggctgtttatggtatccctatataccacaagtgctcaaataggtgtttgctatggacagctcggcaacaacttaccatcaaggcccgaagttatatccatcttcaaccagagaaacattagaagaatgcgactctacgcgccagaccaacctagtctccaagctctcagaggaaccaacattgagctgatgctcggcgttccgaattccgatcttcaacgtatcgcggctagccaagccaatgcaaacatctgggtccagaacaatgttagaaactttggcaacgttaagttccgctacattgctgttggaaacgtagtccaaccttcgatccggcggctcaatttct

SEQ ID NO: 23567 - DNA, 366 bp, Gossypium hirsutum
  Clone ID: LIB3272-027-P1-K1-C1
ttaaaatcccagaattacttaaacaacaatggctacctatgaaggtaaagttttcactgaagaacaagaagctttggtggtcaagtcatggactgtaatgaagaagaatgcagctgaattgggtcttaaattcttcttgaagatatttgagattgcaccatcagccaagaaactattctcattcttgagagactcaaatgttccattggagcaaaacacaaagctgaagccccatgccatgtctgtctttgtcatgacatgtgaatctgcagttcaactgcgtaaagcatgcaaagttacagtgagggattcaaatttgaagattttaggagctacccattttaagtatgtgggagttgatgaaca

SEQ ID NO: 23568 - DNA, 56 bp, Gossypium hirsutum
  Clone ID: LIB3272-027-P1-K1-C10
gggaaaccattgggatgcaagctttatgcacaagtatgctaaacgctagatagggg

SEQ ID NO: 23569 - DNA, 436 bp, Gossypium hirsutum
  Clone ID: LIB3272-027-P1-K1-C11
ttcatattcaaggtggccaatgcggcaaccaaatcggagccaagttctgggaagttgtttgtgctgagcatggcatagatgcaactgggcgttaccaaggagacttggatcttcaacttgagcgaatcaatgtctactacaatgaagccagttgtggtagattcgttcctcgtgctgttctcatggatcttgaacctggaaccatggacagcatcagatctggccccgtcggtcagatttttagaccagataacttcgtttttggtcagtctggtgctggtaacaactgggctaagggccattacactgaaggtgctgagttaatcgactccgtacttgatgttgttcgtaaagaggctgaaaactgcgattgccttcaagggtttcaggtttgtcattccctgggaggaggaactgtatctggaatgggaacact

SEQ ID NO: 23570 - DNA, 358 bp, Gossypium hirsutum
  Clone ID: LIB3272-027-P1-K1-C2
gtataccaaatctgaagcactctgaattatcgaagctgcacctcacatgggatctagtgcatggttagtgacctcggttcgagtgtggagatcaggaaaatcatggatgccaaagttctcttcttttttgctttgctttccttttaaggtgtctggtcttttgcacactgtgtactataccaaagccttgctatgaacttctacaaggatccttgtccttaggctgactacattttcaatggggcaagttaagctactttccaagcgacacacaaacactggtgattattggctgagaaacatttcccatgactgggctgtccagacatgtgatgcttcactggtgctggactgcaca

SEQ ID NO: 23571 - DNA, 445 bp, Gossypium hirsutum
  Clone ID: LIB3272-027-P1-K1-C3
ggttaacttaactcgtgccgtgttaggctaccgctaggtgtcgctgggtgacgattatttgttgcagaggaggagcaggagcttgtaggaagttcaaactttaatttcaaacaccaaatctgaaacagttgactgttggttttgaggtttttgcaaatgtcgactttaagcctttcgccggttcttacatctcctagagacgatgctattcagctttaccgtgctttcaaggggctgggatgcgatactgcagcagtggtcaatattcttgcccatcgagatgcaactcagcgttctttaattcaacatgagtatagcgcaatgtattctgaagaccttctcaaacgacttgtttcggagcttcgtggaaaattggagacggctgtcttgctatggatgcatgatcctgcaggacgtgatgcaatagtcattatgcaggcacttt

SEQ ID NO: 23572 - DNA, 413 bp, Gossypium hirsutum
  Clone ID: LIB3272-027-P1-K1-C4
aagaagtagaataagaatggataacagcgagggcaacaattcccccagcttgatctctcgtgagaagttgggagaggtggcaacctgggtcagcgccactgtggtctccgcctttttctcctctctcgagcgcttctcctgcgttaacctctccaccaacgaccctgacgatgacgacaatcccgacgaggccaaggaccgccctctcacctactcctgaatatctctctcggtacttgccacgtcatagactctcttgctttctcttgatttagggtctttgtatacagaaccaagaaaaaagtattaaggaaactttaaatgctctctatatgtgttggtcctcctgattgaaaagggaactcttgtgtaataaaggcctttttttttttggatatttaatcatctaagtc

SEQ ID NO: 23573 - DNA, 442 bp, Gossypium hirsutum
  Clone ID: LIB3272-027-P1-K1-C6
gaaaaagggggaaaaaagtgaggatcaagcatagatggaaaacatgggagttctaggcaaggtggtggattaccttctattgttatcattcttcagcatcacattaacagctcagttggacatccccgagtccatcctcccccacgcctacaatcccttctatcaagtttataccacgttaacccaagattatttggtgcttgagcagcctgcttttttcaaggcacttatgacgttggaacttgtttaccaactccctctcgctttgcttaacatctatgggttgttatactctaagccctggttcaacaccacctgcctcctctttggtgcctctatcgttgcctctacgacagctatggtgggagacattctcaattcccagaaggcatcagccaatttgatggccatgtattatccaccgtttcttccattaggggtt

SEQ ID NO: 23574 - DNA, 440 bp, Gossypium hirsutum
  Clone ID: LIB3272-027-P1-K1-C7
gtcagaacaataatcagcaaagacaaaacagttacttggatataatttccccttgtcaaacctaccctctgtaagcaatccgccatggacacattaacagctcgattcaagctcatcgttttgccctttctatgcatttgtttgcttttcttaccttttctccaggccactgatttcgattactgcgataataaaggtaattacgttgtaaaagtcgatggagtcgacatatcacctaatcctgtgattagcgggaaaccggccaccttcacgatctcagcttctactggtcaagctatcactggtggcaaagcggagattgacgtttacttcttcgggtttcatatccatcaagaaactcatgacctttgtgaggaaacatcttgccctattactgttggcaacgttgtgctctctcacaatcaaggtttacctgggtt

SEQ ID NO: 23575 - DNA, 73 bp, Gossypium hirsutum
  Clone ID: LIB3272-027-P1-K1-C9
taggaaacctggtgggaggccccaacggttcctgcctgccaaatggtccgctggccttggttttggggccaaa

SEQ ID NO: 23576 - DNA, 433 bp, Gossypium hirsutum
  Clone ID: LIB3272-027-P1-K1-D1
gagatatattcccaaacatgtctaaagcctgcttgcttttgtttctcgttggagtggtggtttttatcatcactccttctctagctaaccaacatcatgataatgagcttcccaaggggaagcctttcccaggtgagaagcaaccacaacacaagccattccctgaacaccgaccgccaatacacagtggacctggcggtaaaggacaggagccaccacatggggaaaaacctcctcatagaaacttattgagtgtggaagttgagggcacacataaacctccacgacattcaggtggtaaacctccaagacactcggtgggtaaacctccacatgttgaggggttccctaccgattaagcacccatgaagccattccctggtgaaaaaccatccaagggtaagggatagggagcaccttatgaacccaaacc

SEQ ID NO: 23577 - DNA, 424 bp, Gossypium hirsutum
  Clone ID: LIB3272-027-P1-K1-D11
cctcactccgccatcttcaataatttcttccgttgatctttgttagagattagctttttaatttttcattatgggaaagatcaagatcggaatcaatggatttggaaggatcgggcgtttggttgcgagagttgctctccaaagcgatgatattgagctcgttgctgttaacgatcctttcatcaccactgaatacatgacgtacatgtttaagtacgacagtgttcacggtcaatggaagcatcatgagcttaaggtgaaggactcaaagacccttctctttggtgaaaagcctgtcacagttttcggtatcagaaaccctgaggaaatcccatgggctgaggctggagctgagtatgttgttgagtctactggtgtttttactgacaaggacaaggctgctgctcacttgaagggtggcgcg

SEQ ID NO: 23578 - DNA, 403 bp, Gossypium hirsutum
  Clone ID: LIB3272-027-P1-K1-D12
cctcactccgccatcttcaataatttcttccgttgatctttgttagagattagctgtttaatttttcattatgggaaagatcaagatcggaatcaatggatttggaaggatcgggcgttaggttgcgagagttgctctccaaagcgatgatattgagctcgttgctgttaacgatcctttcatcaccactgaatacatgacgtacatgtttaagtacgtcagtgttcacggtcaatggtagcatcatgagcttaaggtgaaggactcaaagacccttctctttggtgaaaagcctgtcacagtttttggtatcataaaccctgaagtaatcccaaggtcttgggctggagcttgtgtatgttgttgtgtctcatggtgtttttactgtcaaggacattgtttt

SEQ ID NO: 23579 - DNA, 442 bp, Gossypium hirsutum
  Clone ID: LIB3272-027-P1-K1-D2
ggcagagcccttagctcttagcccagttcttcattttcattttcttgttccttccttcgccgtctattgctttttgttacctcgatttcaagtgaatcagaatgggtaaggaaaagactcacattaacattgtggttatcggccacgtcgattctgggaaatcaaccaccactggccacctgatttacaagcttggtggtattgacaagcgtgtgattgaaaggttcgagaaagaagctgctgagatgaacaagaggtcattcaagtatgcttgggtgcttgacaagctcaaggctgagcgtgagcgtggtatcaccattgatattgccttgtggaaatttgagaccacgaaatactactgcactgtgattgatgcacctggacaccgtgactttatcaagaatatgattactggtacgtcacaggctgactgtgctgtttt

SEQ ID NO: 23580 - DNA, 394 bp, Gossypium hirsutum
  Clone ID: LIB3272-027-P1-K1-D3
ccaaccttttaattaccccttttttctctttgtttcctttcttcctgtcttcctcacaggtcacttcaacgaatactatggtgatagcaccattaactgcaacttctcttctgctgtttgtcttcagttttttcctgcaaggcacctttggtgactatgggggaggatggcaaggtggccatgccacattctatggtggtggtgatgcatctggcacaatgggaggtgcttgtggatatggtaacctgtatagccaaggctatgggactaacactgcagcacttagcattgccttgttcaacaatggtttgagctgcggttcttgttatgaaatgaggtgtgacaatgaccccaaatggtgcctgcccgggtccattaccatcacttgcaccaa

SEQ ID NO: 23581 - DNA, 434 bp, Gossypium hirsutum
  Clone ID: LIB3272-027-P1-K1-D4
cacacctcctttccctcttggtaagctgttgcaattaataagaaacccccaacgtagataaaacagaccgtaaatggcagcagcagcagattctgaatgcaaacgcagcctggatagaaggccctcgtcttcgtcatttcgtctacgctgctccagtctaaactcactccgtctgcgacgcgtatttgatatctttgacaagaaccgcgatggcctcatcactgtccaagagatccatcaggcccttactcgtctaggccttgaaaccgatgtttcagatctagattcaaccatcaggtcgttcataaagtcgggtaacatcggcctcacgtacgacgggtttgttgctttgcatgagtcattggaccaaaggttgttcgggttggagatggaggaggttgcagaagaggatgaatcagaatcagatttgacgg

SEQ ID NO: 23582 - DNA, 439 bp, Gossypium hirsutum
  Clone ID: LIB3272-027-P1-K1-D5
tccctttctttctctctcctctacttactattcatttttctctcttgaattttctcgaaaaattttggcaaaagccttgtgagatgtgaaaggaaagggaagtctgggtgttgttttgtctgacttcaaaaatggcttctttgtactgcaataatcaggtaagagattcttgttttaccaacgcacgccatggaagatcatgttccaaagctcaagcttgtctcgaaaagattcttcatttaatttcaagcatcccaccaccatgtgaaattaacccaaaccctttcaagaagagagggttcgatattgatttaaacttgagattaggctcttttgtcgacgatgatgacgagagcgaagaaaaatccgattgttttgctgagaatagtttcaatgaagagaaaacaggtaccggtgaagctacagcgacggatgtttc

SEQ ID NO: 23583 - DNA, 442 bp, Gossypium hirsutum
  Clone ID: LIB3272-027-P1-K1-D6
ctttctttttattgtggtctccagagcttctctgttacatcgtttattttctctcaagaactgaagaaaaaatccgaatagattaaaacttaagaaagatcaaaagatgtttggaagagcacctaagaagagtaataacaccaggtactatgagattctgggtgtttcgaataacgcttcccaggatgatttgaagaaagcttataaaaaagccgccattaaaaaccatccagacaaaggcggtgatcctgaaaaatttaaagagttggcgcaagcttatgaggtattgagcgatcctgagaaacgtgagatatatgatcagtatggtgaggatgcactcaaggaaggaatgggtggtggtgccggtgctcatgacccgtttgacatcttctcctccttctttggtggtagcccgtttggaggtggtagcagtcgaggtaga

SEQ ID NO: 23584 - DNA, 371 bp, Gossypium hirsutum
  Clone ID: LIB3272-027-P1-K1-D7
cttaaagcctgccatataatcatataaccaggctccgtcgtggtactcttcgggcaccacaatgccgaaaatcgccttgggaacaagccaagaggctgctcagcctgactgcatcaaagcccttgtggtcgagtttatcaccactttcctcttcgtattcgttggagtaggagctgccatggccgccgatgagtcgggggcaaatgcgctggtgggattgtttgctgtggcggtggctcatgcccttgtcgtcggcgttatgatatcggccggacacatatcatgcgggcatcttaacccagccgtcacgcttgggttgctattcggtggtcacatcacggtggtccgtgcgatcctctactggatcgatc

SEQ ID NO: 23585 - DNA, 439 bp, Gossypium hirsutum
  Clone ID: LIB3272-027-P1-K1-D8
cttgttttttcatttctcctacaaaagaaaaagcttgtaatcggccatggatttgtccaaagaacgtgaaagattcgtttacatcgccaagctcgctgagcaagcagaacgctttgatgatatggtgacttccatgaaaaagctagcggagcttgatgtggaactgaccgtagaagagcggaacctgctctctgttgggtacaaaaacgtgatcggtgctcgaagagcatcgtggaggatcctgtcttcgattgagcaaaaggaagagagcaaagggaatgagcaaaatgttaagaaaatcaaaacgtctaggcagaaagtagaatcggagttgtccaatatttgtaaagatattatgggtgtcattaatgagcatctcattccttcttgctcgggtggagagtctactgggttttattataaaatgaaaggagattat

SEQ ID NO: 23586 - DNA, 421 bp, Gossypium hirsutum
  Clone ID: LIB3272-027-P1-K1-D9
gccccccattagccttctattttctcaaatcaaatttggtttcccaattctctttttaccttaaagtcctcaccttttgtttttgttctgcttaactcagtaagccgccatggctacgacgattcagtccccttctcctcccaattccaacgatgataagccccaaccaagctcagaggtggtagaacaagctaatggggttcaacaagatgttaggccagaagctactaaacagaatgttccagcatctgtgtttgtgaactctgaaccaataagagaagaccaagtttccaatgctgttaaattcctttcacatcccaaagttaggggttcacctgttatttatagaagatcctttcttgaaaggaaaggccttacaaaggaggagattgatgaagcttttcggcgtgtgcctgatcca

SEQ ID NO: 23587 - DNA, 427 bp, Gossypium hirsutum
  Clone ID: LIB3272-027-P1-K1-E1
attttcacaggtttgttcgcgtctgaaaagctcgtgaaacaagtttaccccggcaggccagccaagtacgggctgttcatgggcggcggagggaagctgttcgcggcgcagatcatccagattctggttatcgtcgggtgggtgagtgccacaatgggaaccctgttctatttccttcacaaattcgggcttttaagaatctcagtcgaagatgaaatggctggcatggacttaaccaggcatgggggacttgcttatgtttatcatgatgaagatgaatcccaaaaaaatggcattcaaatgaggaaaattgaaagcttcccaactcctccttcagtctaaattttttttttattaaatccaaacttgttcagaatattttatcatattggatagattatatttttatatacatatgaattccctg

SEQ ID NO: 23588 - DNA, 387 bp, Gossypium hirsutum
  Clone ID: LIB3272-027-P1-K1-E10
aaactaaatactgaagtcatttgttttgggggagtgccggagaaaatggcctgttttcaatatatagtagctgctctatgctttgcagttgtacttgagggatcgttatcaaaagctcaactgaccccgacattttacgatggaacatgcccaaacgtgacagccattatccgacaagtgctcgtgaatgcttcgttttcagatccaaggattggtgccagtctcatcaggcttcacttccatgattgttttgttcaaggatgtgatgcgtcgattttattggacgatcctgtaaatggtgagaaagaagctattccaaataataattcagctaggggttatgaagttatcgatgccatgaaggctgccttagagagtgcttgcccc

SEQ ID NO: 23589 - DNA, 382 bp, Gossypium hirsutum
  Clone ID: LIB3272-027-P1-K1-E11
gtatctgaagagggagctttgatcaacgaaattccatcgatggcgaaggtttctttgaagtgtggggactgtggggctctgttgaaatcggtggaggaagcccatgaacatgcggaactcacctcccattccaacttctccgagtccactgaagctgttctcaatcttgtttgctcttgttgcggcaaaccgtgccgatccaaaatcggaagtgatttgcatacaaaaagaacggtgcatacagagtttattgataagactctggaggcagcaaaactaatcagtttggaggttccaaaggtagctaaggagtcacaggaggctattgctgcatgtagcaccagtgagcctgaagagatggctgcgccagaggttgacaaaa

SEQ ID NO: 23590 - DNA, 383 bp, Gossypium hirsutum
  Clone ID: LIB3272-027-P1-K1-E3
ggcactgaagcattgtctggataactcctataccgatcatagaccttggcactttcttcggctaggatggagtccctggctgctgtcatacagttcacgggtgccttttggtcatgcgcctttttgggatgtgttctccatacagcccacccaaacctgtcttacggcccagctcagggatgaacactgccatctaacgtaccagctacgggtcatgtacctggctagccttctaaaataaaagaccactgcggcctcgattactctaggccatctggtactgattctaagaagctttctcgagacgttaatgttcgtgactccgcaccagctcatattgatggtgttggacacttgcaacaatgaggctctattcccatgct

SEQ ID NO: 23591 - DNA, 444 bp, Gossypium hirsutum
  Clone ID: LIB3272-027-P1-K1-E5
tctgagtcttcttccagtggttttggttcccttccgagcttgaatttgatcaagtttcagttgtcgagtgctatctcttggatttcagatgatgggcctcaaaaagattctttctttttgtcacctactcttcattccaattgcagttcatcacagaacgagaaggaaaaactgggttttctgacagatgatgatttagagcatttatataaattagttgaagaaaaagatggaggtcctgcttggattcacatgatggataagtccaccccaactatgggatatcaggcttggcaaagagatcttgagattggtcctacacaatatcgtagccggactgttttcgatgatgccactcctgagatggtgagggatttcttttgggacgatgaattccgatcaaaattgaagtgggatgaaatgcttcttagtgccgaaactctc

SEQ ID NO: 23592 - DNA, 433 bp, Gossypium hirsutum
  Clone ID: LIB3272-027-P1-K1-E6
gtgggggccaacattttggcaggaggtgccttcgatggagcctcaatgaacccagctgtttcattcggaccagccttggttagctggacatgggacaaccactggatctactgggtcggaccccttatcggtggtgggctcgctggtctcatctacgagttcatcttcatcagcaacacccacgagcagctcccaaccaccgattattaagcctaatcagggtttaattgatttgtctgtcactttgaaaccggattttctccgatcacatttgagtctcctatctctttccttgtattttgtgtttaatttgtggccgtcgatcttgtttacttttttgttttttttcattcccatcctctatcatgatcatcatgaatggcagatgtttacaattgcatgccctgaaaaaatggtatatgagtgactcact

SEQ ID NO: 23593 - DNA, 419 bp, Gossypium hirsutum
  unsure (1)..(419): unsure at all n locations
  Clone ID: LIB3272-027-P1-K1-E7
cagagacaatggatcaatttgagaagcagtttgtgaatatggaggtccaggcagaatttatggagagtgctatggccggttccacttcattgtccacaccagaaggtgaggtcaacagcttgatgcagcaagttgctgatgactatggcttggaggtctctgttgggttgccacaacctggtgctcatgctgtgtcgaccaagacagaggagaaggttgacgaggatgatttgtcgaggcggcttgcagagcttaaggctagaggttagagaaatgatggaattgatttggatgatcttgtgatatataatagtactatgatgtttgggattgtaagtgctggttgaaacatctcattccatatgntaaattgtctgaattgggtttccctttataattttaaatgctgcatttgtctc

SEQ ID NO: 23594 - DNA, 168 bp, Gossypium hirsutum
  Clone ID: LIB3272-027-P1-K1-E8
gggaatagcaacattgttccaagcatcgtcgtctatgttactgttcctaacagagaaacacgtaggaagttggctggaagcatctcgaaagagaaacttgcagcttgtgtaaatatattaccaggtctggagtcggtgtatctatgggagggaaagataaactcagat

SEQ ID NO: 23595 - DNA, 433 bp, Gossypium hirsutum
  Clone ID: LIB3272-027-P1-K1-F1
cttcaaatcgcagggcttttttaacctctccctctctctctagaaccctcactattcttttcttttgtttgtttatatggcatctcaagccagcctcctccttcaaaaacagctcaaagatctttgtaagaatccggttgatgggttctcggccggattggttgatgaaaacaatatctttgaatggagtgttacaattatcggaccacctgatactctttatgaagggggatttttcaatgccatcatgagctttccgcccaattatccaaacagccctccaacagtgaaatttacatcagagatttggcatcctaatgtttatcctgatgggcgtgtttgcatatcaattcttcatcctccaggtgatgatccaaatggttacgagcttgcaagtgagcgctggatgccagtccatacaagtgaaagtatt

SEQ ID NO: 23596 - DNA, 440 bp, Gossypium hirsutum
  Clone ID: LIB3272-027-P1-K1-F10
gaaaatcatgggtgccaaagttcttttcttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagactggagctttggcctaaggaatttcaggtacattgagaccatcaaagaatctgtagaaagggaatgccctgtatgttgttcttgtgctgatatcctcgttctgtctgctagggaaggcatcgtttcgttgcgaggcccttatattcctc

SEQ ID NO: 23597 - DNA, 439 bp, Gossypium hirsutum
  Clone ID: LIB3272-027-P1-K1-F11
atttcttccgttgatctttgttagagattagctttttaatttttcattatggaaagatcaagatcggaatcaatggatttggaaggatcgggtgtttggttgcgagagttgctctccaaagcgatgatattgagctcgttgctgttaacgatcctttcatcaccactgaatacatgacctacatgtttaagtacgacagtgttcacggtcaatggaagcatcatgagcttaaggtgaaggactcaaagacccttctctttggtgaaaagcctgtcacagttttcggtatcagaaaccctgaggaaatcccatgggctgaggctggagctgagtatgttgttgagtctactggtgtttttactgacaaggacaaggctgctgctcacttgaagggtggcgcgaagaatgttatcatttctgctcccagtaaggatgctcc

SEQ ID NO: 23598 - DNA, 177 bp, Gossypium hirsutum
  Clone ID: LIB3272-027-P1-K1-F12
atttatagccctaatatgcgcaagactttagctctataagtctcaaacatgtatgggccaagatttagatacaaacgatcgccaaagattttgtgagttgagtgctagagtttgtcgacaacctgttcatattgtcacccccaaaattaacgatctttccataacaattgggtacat

SEQ ID NO: 23599 - DNA, 436 bp, Gossypium hirsutum
  Clone ID: LIB3272-027-P1-K1-F2
tggtagctatgttttcaataaagggaaggttcataaggtgccagcgactgacatggaggcactcaagtctccacttatgggaatatttgagaagcgtcgtgcacggaagttcttcatatatgttcaagattatgatgaaaaggatcctaaaactcacgagggaatggacttgacaagggtgtcaactagggcactaattgcgaaatatgggcttgatgataacactgtggatttcattggtcatgcattggcacttcacagagatgaccgctacctggatgaacctgcattggatactgtaaaaaggatgaagctttatgcggagtctcttgcccgttttcaaggtggatctccgtacatatatccactgtatggattaggcgagctgcctcaggcttttgcacggcttagtgctgtttatggtggaacatatatg

SEQ ID NO: 23600 - DNA, 433 bp, Gossypium hirsutum
  Clone ID: LIB3272-027-P1-K1-F3
ggcggcttctgcttctatttactattttctcactctcctactcctttgtgccatcccttttaccttctccgagctcgttaaagagcagcctctggtgttgaagtaccacaatgggccactcttgaaggggaagatcaccgttaatctcatctggtacgggaagttctccccaacccagcgctccataatcgtcgatttcatcaactctttgagctctgccgtcaaacccaagattccgtcggcgtcgttttggtggaaaacgacggagaaatacaagtccggttcctccactttggtcgtgggcaaacaaatcctcctcgaaaattacccgctcggtaaaatccttaagaacccacacttgccagcgttggccgggaaattcaacggcgtatgtacggttagcgttatcctcacggccatagacgtcgccgtc

SEQ ID NO: 23601 - DNA, 448 bp, Gossypium hirsutum
  Clone ID: LIB3272-027-P1-K1-F4
ctttgctttatccccttccaaagatggaccgcttctctcttctcttcctcctcctttcctccgtcgttgcttcggccgtcgtctccgacgttaatagcgatgacgatcctctcatccgtcaagttgtttccgatggtggtgtcgaggaggactccgatgaccatctccttaatgcggagcaccacttcacgctgttcaaatccaagtatgggaaaacctacgcatcccaggaggagcacgattaccgactgggagtcttcaaggctaacctgcgtcgggccaagcgtcatcaggtcctggaccccagtgccgtccatggcgtcacaaagttttccgatttaactctatcggagttccgccgccagtatctaggcttgaaaccgctcaagctcccagccgatgctcaaaaggctcctatccttccgactgacaacttaccggatgactt

SEQ ID NO: 23602 - DNA, 372 bp, Gossypium hirsutum
  Clone ID: LIB3272-027-P1-K1-F5
ctttgctttatcccctaccaaagatggaccgattctctcttctcttcctcctacgttgcgttcgtcgttgcttcggccgtcgactccgacgttaatagcgatgacgatcctctcatccatcatgtagtttccgatggtggtgtctaggaggactccgatgaccatttccttaatgcggagcaccacttcacgctgttcaaatccaagtatgggaaaacctacgcatcccaagaggagcacgagtaccgactgggagtcttcaaggctaacctgcgtcgggccaagcgtcatcaggttctggaccccagtgccgtccatggcgtcacaaagttttccgatttaactctatcggagctccgtcgccagtttcta

SEQ ID NO: 23603 - DNA, 335 bp, Gossypium hirsutum
  Clone ID: LIB3272-027-P1-K1-F8
aaaaatcatatcctcagaaaaaagtaaataaacgcacagaaaagagaaaatgggtgctttgggtggaattagacaggtcgatggaagcaccaatagcctggagattgaaaacctatctcgttttgctgttgatgaacacaacaagaaagggaatacgatgctacattttaagaaggtgacgaatgtaaaacaacaagtggtttctgggactatgtattacataacatttgaagcgatggatggtgacaagacaaaagtttatgaagccaaggtgtgggacaagccatggatggatttcaaggagttacaggattttaagggtattggcgatgctt

SEQ ID NO: 23604 - DNA, 438 bp, Gossypium hirsutum
  Clone ID: LIB3272-027-P1-K1-F9
gaaaacatgagtagaggttggagctacggtggcggccaaagttccttgggctacctctttggtgccgatgagcagccaagcgcacccaccgtcacaccagcgatccagcctccatatggcatagatattaccccagagaaccctccccctcaatataaaccaagttcagagcaacagactgagaaaaacaccaccaacaactatcagagggctaaaggacagaatgcaggcaacttcataactgatcgaccatcaacaaaggtgaaatcagttccaggtggagattcctccctgggttacctgtttggagacaagtgatgcaatgattaattccttcttacaagtttttaagaagaaaattggtgaactgcttccgataaggaattgaagataaacagataagtgggtttttttagttaaatacatgtgcagaagttg

SEQ ID NO: 23605 - DNA, 396 bp, Gossypium hirsutum
  Clone ID: LIB3272-027-P1-K1-G1
gaaaaaaagaatatggaaaccgtaactttgacaggattacttcacaaggctgcggccgagttccctaccaggcgagctttatcagtttccggcaagttcgatttgacgcatgctcaattacaacacatcatcgatcatgctgcttctctcctcatcgcctccggcatccatcccggcgatgtcgtcgctcttactttcccaaacaccgtggagcttgttattatgttcttggctgtaattcgttgccgtgcaaccgccgcgccgttaaactcagcttatactgccgaggagtttgagttttacctttctgattcagaatccaagctgttattaatcccagccgaaggcatcaagccggctgaagccgccgcttccaagttgaacatccctctcgta

SEQ ID NO: 23606 - DNA, 436 bp, Gossypium hirsutum
  Clone ID: LIB3272-027-P1-K1-G10
gtgttgctcccgaggagcacccagtgcttctcacagaggcacctctcaaccccaaggccaacagagaaaagatgactcagatcatgtttgagaccttcaatgtgcctgccatgtatgttgccatccaagctgttctctctttgtatgccagtggtcggacgacaggtattgtgctggattctggtgatggtgtatctcacactgtgccaatctatgaagggtatgcccttccacatgccatcctccgtctagaccttgctggtcgtgatctcactgattctttgatgaagattcttactgagagaggttacatgttcaccaccactgctgaacgggaaattgtccgtgacatgaaggagaagcttgcttacgttgccttggactatgagcaggaactgtagactgccaagagcagctcttttgttgagaagaactt

SEQ ID NO: 23607 - DNA, 432 bp, Gossypium hirsutum
  Clone ID: LIB3272-027-P1-K1-G11
atcaatatcctctaattctaaagctaagagttttaagttaacgaagcatttgggtcgtttcgaagtaatggaaacttcaggaaaagtaaagaagggagccggaggaaggaaaggtggtggcccgaaaaaaaagcccgtttcaaggtctgtcaaagctggtctccaattccccgttggtaggatcggccgttacttgaagaaaggaaggtattcacagcgtgttggaaccggagccccggtttacttggctgctgttcttgagtacttggctgctgaggtcctggaattggctgggaacgctgcacgtgacaacatgaaaaacatgttcatcccaaggcacgttctacttgccgtgaggaacgacgaataattatggaagcttttcgccggcgtaacaatcgctcacggtggtgtgttgccgaacattaaccc

SEQ ID NO: 23608 - DNA, 411 bp, Gossypium hirsutum
  Clone ID: LIB3272-027-P1-K1-G12
ctcaatagccctatcaggcgccgccctcaagctctatctgactcaaaactctaaaaccatggcaatcgacaaaaacgaacccagcaagctccgttggggagagcttgaggaagacgacgacctggactttttgttacccccaaaagaagtgatcggcccagacgaaaacgggataaaaaaggtgatagaatacaggtttaacgatgaaggtaacaaggtgaaaataacaacgacgacccgcgtccgaaagctggcgaaagcccggttgagtaaacgggctttggaaagaaggaattgggacaagttcggagacgccgtgcgtgaagatgttgggagtcggctcaccatggtgtctactgaagagatccttcttgaacgacctagagcccctggtaccaaaccggaagaagc

SEQ ID NO: 23609 - DNA, 429 bp, Gossypium hirsutum
  Clone ID: LIB3272-027-P1-K1-G2
caaaatcgatccccccagaaatggcgcctgaaatttcttcttcttttttccccattttattttttcccaaaccatattgttgcaaactcgtaagaagattcaaaagaaattgaagataagaggatacagcttgaagacggatggtcttgatgagatctctcattcgtcagtcgcttccaagatgctgaagatgaagctattgatctcctcctcgactagctcgatcaccaatccttgaattcttccataatcgacaaggaggcggtgcaccaagtagtcaatcttctattggatgttggagcagctgaggaggagatctgtttgaatatgcggatgtaattcttgcaaaaatctccttgttggaaatccagagacttaattcgttacggaatactttgataattagtaaaaaccctgtttttgatatat

SEQ ID NO: 23610 - DNA, 428 bp, Gossypium hirsutum
  Clone ID: LIB3272-027-P1-K1-G3
cccaaatctccaattgatctgtttcatttttcagcaaagctagaaaaacaatgactaaggatatcgagactgcagagcaacatggaggggagttctcggccaaggactaccatgatccaccacctgctccattgattgatgctgaagagttaaccaaatggtcgttttacagggcagtgattgccgagttcattgctacacttctcttcctgtatgtcactgtgttgaccgtgattggttacaaggtccaaaccgaccctgctaagaacactgttgaccccgattgcggtggcgttggtattcttggtattgcttgggctttcggtggcatgatctttattcttgtttactgcatcgctggtatctctggagggcatatcaacccggctgtgacattcggtttgttcgtgggacgcaaggtgtcactc

SEQ ID NO: 23611 - DNA, 452 bp, Gossypium hirsutum
  Clone ID: LIB3272-027-P1-K1-G5
cttgagtgggatcattaaagaaaagaaaaaaaaaatcgaagatgccgccttctttgggcggtgattaaaaggagagaggcttgagtgggatcattaaagaaaagaaaaaaaaaaatcgaagatgccgccttctttgggcggtgattaaaaggagagaggcttgagtgggatcattaaagaaaagaaaaaaaaaatcgaagatgccgccttctttgggcggtgattaaaaggagagaggcttgagtgggatcattaaagaaaagaaaaaaaaaatcgaagatgccgccttctttgggcggtgattaaaaggagagaggcttgagtgggatcattaaagaaaagaaaaaaaaaatcgaagatgccgccttctttgggcggtgattaaaaggagagaggcttgagtgggatcattaaagaaaagaaaaaaaaattcggaaatgccgccttttttt

SEQ ID NO: 23612 - DNA, 436 bp, Gossypium hirsutum
  Clone ID: LIB3272-027-P1-K1-G8
gtttaagcatatcaataagcggaggaaaagaaacttaccaggattcccctagtaacggcgagcgaaccgggaaaagcccagcttgagaatcggtcgccatcggcgtccgaattgtagtctggagaagcgtcctcagcgacggaccgggcccaagtcccctggaaaggggcgccggagagggtgagagccccgtcgtgcccggaccctgtcgcaccaagaggcgctgtctacgagtcgggttgtttgggaatgcagccctaatcgggcggtaaattccgtccaaggctaaatacgggcgagagaccgatagcgaacaagtaccgcgagggaaagatgaaaaggactttgaaaagagagtcaaagagtgcttgaaattgtcgggagggaagcggatgggggccggcgatgcgccccggtcggatgtggaacggcgaga

SEQ ID NO: 23613 - DNA, 419 bp, Gossypium hirsutum
  Clone ID: LIB3272-027-P1-K1-G9
attttctgctctttcaattttaagaccaaatcacgagcgactctcagactcagctgagttaagatcgctaaagcgatatggctttgcagctatgggaaacgttgaaggaggcgataacggcgtatacgggtctatctccggccacttttttcacggttctagctctgttatgggctgtttactatgtagcaacgggtctattcgggtcatccgatgaccatatccatcaacggtctacggctttcgaggagcagatggagccgctaccgccaccggttcagctcggcgagattaccgaggaggaacttaagcagtatgatgggtcggattcaaagaaaccactccttatggccatcaagggccagatctatgatgtttctcaaagcagaatgttttatggacctggtggaccttatgcg

SEQ ID NO: 23614 - DNA, 438 bp, Gossypium hirsutum
  Clone ID: LIB3272-027-P1-K1-H1
gggaaaaggaatactgcaaccgcatactttgatcgatgaactggaaaatgttgtaggcgacgacaaagctagagagaagctaagtgatggtccctttagcgaagtccttaaatctgcacaggaggccataattctgcctccatacgtggctatagcagttcgcccaagacctggtgtttgggaatacgtacgagtcaatgttcatgaactcagcgtggagcaactggatgtgtccgaatatcttcgcttcaaagaagcacttgcagatgtgggggaggacaaccattttgtgcttgagcttgattttgagccattcaatgcatcctttcctcggcccaaccgctcttcatccattggcaatggcgtccaattcctcaaccgtcacctttcttcaaacatgttccgtaacaaagattctttggagcctttacttaattt

SEQ ID NO: 23615 - DNA, 285 bp, Gossypium hirsutum
  Clone ID: LIB3272-027-P1-K1-H10
caacaatgtctcttcactcttctctcaccatgtcattgctgtctttctccttcttgttgctgtttacttttagtgccaaagctgttgttcctccatctgaaacttttaggtttgtcaacgacggacaatttgggccgtttgttgttgaatatgatgcaaattaccgtgtcataagcatagctaatgcccccttccagcttgcgttttataacaccacctctaatgccttcacccttgcgttacgcatggctacaacgcgtttcgagtcgctctttcgttgggttt

SEQ ID NO: 23616 - DNA, 408 bp, Gossypium hirsutum
  Clone ID: LIB3272-027-P1-K1-H11
cttgcattaagtctcaaagatatcactgcaagaaaaaaaaaaaaccagacatggcttccaacactgttgcatccgctgctcttattcttaccttgaacttgttgttcttcactttggttagctctacctacgtgccttgcccaccaccaccaaagagccacaagcctacccacaaaagcccaccctcggcacctgaacagccaggcacttgccccagagatgcactgaaactaggcgtttgtgctgatttgttgggctcattgcgcgttgttgttggaccgtcgaggaccaaatgctgctctcttatttcgggtttggctgatctcgatgctgctgtttgcctttgcactgctattaaagctaatgtgttgggggttaacctaaaacgttctgtttcattgactttgc

SEQ ID NO: 23617 - DNA, 342 bp, Gossypium hirsutum
  Clone ID: LIB3272-027-P1-K1-H12
acaaccagtaactttgacaggattacttcacaaggctgcggccgagttccctaccaggcgagctttatcagtttccggcaagttcgatttgacgcatgctcaattacaacacatcatcgatcatgctgcttctctcctcatcgcctccggcatccatcccggcgatgtcgtcgctcttactttcccaaacaccgtggagcttgtgattatgttcttggctgtaattcgttgccgtgcaaccgtcgcgccttttaactcagcttatactgccgaggagtttgagttttacctttctgattcagaatccaagctgttattaatcccagccttaggcagcaagcc

SEQ ID NO: 23618 - DNA, 382 bp, Gossypium hirsutum
  Clone ID: LIB3272-027-P1-K1-H2
tatgaaaagaagtgttgcgatgtgcaaaggactaccaattcttggtgttttcaggactttttgtgctgttggtgtggatcctgctatcatgggtgttggcccagctgtggcaattccagcagcagttaaatctgctggtctagaacttgatgatgttgatctttttgagataaatgaggcatttgcatcccagttcgtatattgtcaaaagaagttggagctcgatccacaaaagattaatgtaaatggaggcgcaatggcaattggacatccattgcgcgcaacaggtgctcgttgtgttgctacgcttctgcatgaaatgaagcgtcgtggcaaagactgccgattcggagtggtttcgatgtgcataggcacaggaatg

SEQ ID NO: 23619 - DNA, 441 bp, Gossypium hirsutum
  Clone ID: LIB3272-027-P1-K1-H3
ccaagatgcccgattcaacgacgagcagccggtgctacctccactaacatccccgggaccctcctcaaggggaggatgcgtgagggtgaaattcgggcagatgccagctgctgtacgaatcgagggatttgattgcctcaccagagatggccgccatcgcagaatctccgccgtggcttaagaaataccgaggggaagaaaattttgatatgagaaaaaaaaattgagaggagagagggagatgataaaattaagttacaacttggaatagtgtgggtagtgttggatttgtaaatagaagattaaaatgagatgatgggtgttaaattgttgggtctttgatgattttgggatgggattttccttgcataaaagaactagaggggagcaaaaacatggtttattgcccccactcttgttagggttccttttttttttttt

SEQ ID NO: 23620 - DNA, 154 bp, Gossypium hirsutum
  Clone ID: LIB3272-027-P1-K1-H4
ccaagatgcccttttcatctacgagcatctcaccatgtcatgcgctgactttcccgggtgttgctgcttgattacttttagtgccaaagcttgatgttcctccaactgtaactttttggcttgtcaaccactgtcaattggtcccctttgttgt

SEQ ID NO: 23621 - DNA, 432 bp, Gossypium hirsutum
  Clone ID: LIB3272-027-P1-K1-H6
agcctacccacaagagcccaccctcggcacctaaacagccagccacttgccccaaagatacactgaaactaggtgtttgtgctgatttgttgggctcggtgcgcgttgttgttggaccgtcgaggaccaaatgctgctcactcatttcgggtttggctgatctcgatgctgctgtttgcctttgcactgctattaaagctaatgtgttgggggttaacctaaacgttcctgtttcattgtctttgctcctcaattcctgcgaaaagcaaatgcctgctggttacaaatgtgcttaagcaatgtttgggtttttcttttacgcgtactttttttttctgggcgtggtaaatttggtgttttgaaatggcaagggttagataaaatggttaaggtctcttaccttaaacaatactcaattctgatctatttata

SEQ ID NO: 23622 - DNA, 242 bp, Gossypium hirsutum
  Clone ID: LIB3272-027-P1-K1-H7
agcctacccacaagagcccaccctcgttttttaaacagccagtctcttgcggagggatacactgtttctaggtgttagtgctgatttgttggactcggggcgcgttgttgtttgtaccgggaggaccaaatgctgttcacttattttgggcgtggctgatctcgatgctgcaggatgcctctgcactgctattaaagcttatgtgatgggggttaacctatacgtgcctgtttaattgtctt

SEQ ID NO: 23623 - DNA, 425 bp, Gossypium hirsutum
  Clone ID: LIB3272-027-P1-K1-H8
tccgattcctcttttgggtttgttgtgtttcgaatcatcgtcttcgcctaacttggtctccttcaatttttcagatgtgggctgcttcatgccttgcatcgtgctgtgcggcgtgcgcctgcgatgcgtgccgcacggtggttgcggggataagccggaggtctgcaaggatggcctattgtggactatttgccctttctctgtttgtttcgaggatcctccgtgaggttgccgcccctctcatggagcagctgccttggatcaatcattttcacaaaacacccaacagggaatggtttgaaacagatgcggtgctgaggggcagcttgggaaattttctctttttcactatcctatcatttttaatgattggtgttaaaaatcagagggatcctcgtgatggtttgcaccatgggagatggatg

SEQ ID NO: 23624 - DNA, 436 bp, Gossypium hirsutum
  Clone ID: LIB3272-027-P1-K1-H9
cggacgcgtgggtgagaactaaaggaaacaaaggccttcttcttagcactccgccgcccgttatctcatcgcaatcatgatcatcccagaaaagaaccgcagggagatatcaaagtatctctttcaagagggtgtttgctacgccaaaaaagattacaacttggcaaaacacccagaaatcgatgttccaaatcttcaagtaataaagctgatgcaaagcttcaaatccaaggaatacgttcgtgaaacttttgcttggatgcattattactggtaccttaccaacgatggcattgaatttttaaggacataccttaatctcccctctgagattgttcctgctactttgaagaagcaaactaggcccggtggtggtcgtcccatgggtccttctgataagccgccacgtggtccgtcacgctttggcgacggtgag

SEQ ID NO: 23625 - DNA, 419 bp, Gossypium hirsutum
  Clone ID: LIB3272-028-P1-K1-A1
aacgaacccaccgtcatggccacactctctacctcttctctcctttggatccattcgcccaaaccgatttctcccaaactcgctcttttcactgctacacgctttttcactccaaagaagtccacctccattgttatggctgctccccctacgactactgctaccgaggtggtgccagcaattattgttggtggtggaagagtgggaaaagcattgcaagatatgggcaagggagatgattcgctggtgaagagaggtgaagcagtaccgcttgattgtgaaggtcctatattggtttgtactaggaatgatgatcttgaggctgtgcttgaggccactcctaaatctcgttggaacgatttggtttttttccagaatggcatgctggagccatggcttcaaagcaaaggtcttaatga

SEQ ID NO: 23626 - DNA, 408 bp, Gossypium hirsutum
  Clone ID: LIB3272-028-P1-K1-A10
cgccgattctaccaccaccatcaccacctattgtgaacccaccaacgcctcctatcgtgaagccaccttcaccgggaacaccgtgtcctccaccaccacctccggcacaacaaacatgccccatagacactctcaagctaggtgcatgtgtggacgtgttgggtggcttagtacacatcggcataggtagcagcgccaaagacacttgctgccctgtactacaagggctgttggatttagacgctgccatttgtctctgtactacgatcaaagccaaccttttgaatatcaatattataatccccatagctcttcaggtcctcatcgactgtggcaaaactccacctccagggttccaatgtccagcacaatgatgaaaaacataaaaaccccatgtttttttttctt

SEQ ID NO: 23627 - DNA, 406 bp, Gossypium hirsutum
  Clone ID: LIB3272-028-P1-K1-A11
gttatatcccgcagcaccgcttttattgcctcattgcccatctgaagattgtgtggtggatggatatgagatacctaaaggcacaatgctcttggtccatgcttgggccatccaaagggatcctagcatatgggaggagccaaccaagttcaagcctgaaagattttatgagggaactttggaagacaaggaaggattgaaatatcttccatttggacttggaaggagagcttgtcctggcagaaacatgggcttacggtccgttttgttggcaattggtgtttttatacaatgctttgaatgggaaaacgtagggtcagacaaggtggatatgacaccaaatactattggattgactatccacaaggctaggccattggaggctttgtgtcgcccacggcctgat

SEQ ID NO: 23628 - DNA, 394 bp, Gossypium hirsutum
  Clone ID: LIB3272-028-P1-K1-A12
aaacactacaccatggatgaagtgaagctctttgggttttggccaagtcctgtgagtagaagggtcatttgggcattaaagctaaaaggcgtggaatatgaatacattgaagaagatctgtcttataataagagtgatctgttgttgcagtacaacccacttcataaaaagatcccagtgctcgttcatggaggaaagccaattgcagagtcattggttattctggaatatatagatgaagtgcggccacataatcctttgttgccaaaagatgcttacgagagatccgtagctagattctgggccaaattcattgaggaaaagactcaaccaatgtgggaattctttcgttaattcggggaagaacagtaaatggcaatcgagaacaactatg

SEQ ID NO: 23629 - DNA, 394 bp, Gossypium hirsutum
  Clone ID: LIB3272-028-P1-K1-A2
caggtgccgtaccgattcggcgtgtccggctcggcgtacccgaccgatcaactctaacccacactccattcatgtacgtcactaatacccaaaaggtcagaaaaaaaactgggattcgtctctcattttttatcggagacatgtgtgctattattttactctgaatatgagtatttaagcgtatctttggcatttcctttatttgttacaattcgcaataccttcttccattactggctgctgcttcaaccactaagcttggaagatgggaggcgacaatggcatcagtcttgaggagatcaaaaacgagtccgctggtctggaacggattcctattgacgaagttttcgagcagctgaaatgtacaagggagggctcgtcaaccgaggaaggc

SEQ ID NO: 23630 - DNA, 418 bp, Gossypium hirsutum
  Clone ID: LIB3272-028-P1-K1-A3
cgatgatgaagagttttctaaaaagcctgttgttgttaagaaagctgtaccggctcctacaaatgttacatcatattcgatagcagaccttcagatagctactgggaggttcagtgtggaaaatatttttggggaaaggggatttgggcgcgtgtatatagctctaattgctgttggggagggtttttcggggaaaaaaatatactcatagggtctttccagtaacatgtgtgacaatttcatggagatggtgtcaaatatatcccagttgcatcacacaaatgtaaccgagttggttggctattgttcagagcatggacaacacctgcttgtctacgagttccacaaaaatggctcactctacgatttcctacatatatcagatgagtacagcaagccattgatttggaacacccga

SEQ ID NO: 23631 - DNA, 408 bp, Gossypium hirsutum
  Clone ID: LIB3272-028-P1-K1-A4
ttccaattgatctgtttcatttttcagcaaagctagaaaaacaatgactaaggatatcgagactgcagagcaacatggaggggagttctcggccaaggactaccatgatccaccacctgctccattgattgatgctgaagagttaaccaaatggtcgttttacagggcagtgattgccgagttcattgctacacttctcttcctgtatgtcactgtgttgaccgtgattggttacaaggtccaaaccgaccctgctaagaacactgttgaccccgattgcggtggcgttggtattcttggtattgcttgggctttcggtggcatgatctttattcatgtttactgcaccgatggtatctctggagggcatatcaacccggctgtgacattcggtttgttcgtgggacg

SEQ ID NO: 23632 - DNA, 409 bp, Gossypium hirsutum
  Clone ID: LIB3272-028-P1-K1-A5
gcggaaacatccctaacgtaatctgctttgaatccgacccgggtttggttaacaaattaggaggctcttatgtccacagtgaaatgaaaggaagtatctttgacaaagtggtgggaatttctcaactgaagaaaacagatgaaacaaaggaagttgtgcaaaccgtatcggaggcatgggaccggtgtaattctgacgatataaggttctgtttgttggttattatcaatgcttatattcagccagtcccgaccttgaagaacttgagatcaaagggcttttcaaccctgaactgtatggtgaagaattgtggacctcagatattggattgtcttatggatccgaattgtaggaaagcacttcaatgcttgaacaaatgcagccctgtagatcaggtgtgtaattatcg

SEQ ID NO: 23633 - DNA, 408 bp, Gossypium hirsutum
  Clone ID: LIB3272-028-P1-K1-A6
ttcggatttttctcagacgtgaaaaaaatggggctgtctttcaccaagctattcagccggctatttgccaaaaaggagatgcgtatactgatggttgggcttgatgctgctggtaaaaccaccattctttacaagctgaagttgggagagattgtcactaccattcccaccatcggtttcaatgttgagaccgttgaatacaagaacatcagcttcactgtttgggatgttggtggccaggacaagatccgaccattgtggagacactatttccaaaacatgcaaggacttattttcgtggttgatagcaatgatcgtgaccgtgtggttgaagctagagatgagttgcacaggatgttgaatgaggatgagttgagggatgctgtgcttctagtatttgcaaacaag

SEQ ID NO: 23634 - DNA, 414 bp, Gossypium hirsutum
  Clone ID: LIB3272-028-P1-K1-A7
cttcaatttccttcgctctcccactcgatattgaaatggcggaatcaaagtcattgaggaaacctgtttttaccaaggtggaccaactccgccctggcactattggtcacactcttactgtcaaggttgtcaatacaaagatggtattgcagaagggtcgggctgatggtcctcaggtgcgtcaaatgcgaattgctgaatgcttggtaggagatgaaactggaatgattatctttactgctagaaatgaacaagtggacttaatgaaagagggtactaccataactcttcgcaatgcgaaaattgacatgtttaaaggatcgatgaggcttgctgtggacaagtggggtcgtgttgaggttgctgagcctgctaatttcaatgtgaaggaagacaacaatctgtcactgatcg

SEQ ID NO: 23635 - DNA, 329 bp, Gossypium hirsutum
  Clone ID: LIB3272-028-P1-K1-A8
aataatgataaaaaaatggcttttaccatttttcttcatggccttagatggaaatctccaggtttttttttaatatccagttcaaattgtggggattggctatcactcttatgtagtagaaggaaattggagcctttctaatacttaaaataatacatatcccttgcatcggcttagattgaaaatctccaatttttcctttgattgttagctgtatttatttctcaacaaaactagggcttcggtttcaaatagtggtgattgtgcgatcaagcgacgcagtagaggaagctcgggcctttatgaaagaaatatacccagacctggct

SEQ ID NO: 23636 - DNA, 382 bp, Gossypium hirsutum
  Clone ID: LIB3272-028-P1-K1-A9
ctaagatatcactgcaaggaaaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaagagcccaccctcggcacctaaacagccagccacttgccccaaagatacactgaaactaggtgtttgtgctgatttgttgggctcggtgcgcgttgttgttggaccgtcgaggaccaaatgctgctcactcatttcgggtttggctgatctcgatgctgctgtttgcctctgcactgctattaaagctaatgtgttgggggttaacctaaacgttcctg

SEQ ID NO: 23637 - DNA, 359 bp, Gossypium hirsutum
  Clone ID: LIB3272-028-P1-K1-B1
gggaaatgaacataacttaccgagattccgctctttgctctcagccatcttcctcaggtcgtgtctcgagggtgcaataaacctttttcttttcttttctaccaagagctattacattgaactgcaaggatggctgaggaggctcaaaacgtcatattgaatctgaatgacttgagccaagcacttgctcgctagctttaaatgaccttattagcgaagcctattggcggaatatggcacacaggaggcgtggttgatggcactgaatactatcaaggcggatgaatccaacattcttctgctgggacgacaccatatgggacaccaattactgtgattgattgatgagtcacccatgt

SEQ ID NO: 23638 - DNA, 408 bp, Gossypium hirsutum
  Clone ID: LIB3272-028-P1-K1-B10
gggagagccaataagcaatgtctgtaatatcttcatcgaacctgacgatctccctcaacacaactatctctctgtcatggcgctcttctcttccttctcgagccatctttccccgccccaaaaaaacccaaaaccctcgtagtcctagccaccgctttgggcgcaaaacccaccgtcctcgtggctgaaaagatcggtgacgccggtatccaactgctcaaaactttcgccaacgtcgactgctcttacaacttaagtcccgaagagctttgtaccaagatttcactttgtgatgctctgatagtgaggagtggaaccaaggtgacccgagaagtgtttgaatcggctatgggtaggctaaaggttgtgggcagagctggtgttgggattgataatgtggatatatcg

SEQ ID NO: 23639 - DNA, 409 bp, Gossypium hirsutum
  Clone ID: LIB3272-028-P1-K1-B11
tactcactcaacattcccatttccaatctccagctcccaaggtaaatatgccgatcagaaacatagcagttggccggcccgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaggtggccacgtcaaccccgccgtcaccttcggtgctttcgttggcgggaacatcactctcttgcgcggcattctttactggatcgcccaactcctaggctcaaccgtcgcttgcctgttgct

SEQ ID NO: 23640 - DNA, 397 bp, Gossypium hirsutum
  Clone ID: LIB3272-028-P1-K1-B12
gaagaacaaaggccatagcaattctctttcggcaaacacagaagaattttggttagatcaacgatgcaacaaggagattacggctcctattatcaatatccttacctttcaaaccccaaccccaaccccaaccctaaccccaaccccaatccagtacccttcgaatttcaccaaccaccttacgcatctgcaccaccttttagctccggttatgcctcctctgattactccgtttaccccccaaattaccctccctattcccaaaatcttgatgctgcccctaccactgcttctgcttttactcctccaccctgagacacaaccactccaccggctccggtcatagctccacaatcgtctttcaatcaacaacccattgcgccacccttcgcaacca

SEQ ID NO: 23641 - DNA, 402 bp, Gossypium hirsutum
  Clone ID: LIB3272-028-P1-K1-B2
gagggaagaagggacccggaggtgttactgttaagaagaccaatatggccttgattatcggaatctatgatgaaccaatgacacccggccaatgcaacatgatcgtcgagaggctcggcgattatctcctcgaacagggtttatgattctcttcagtgtgtgtccttatttgaatgcatttcttctcgggtcttttttctatatgaaaaaaagaaacatgcatcgtagcgtctccgtattactcgtatttacatggaaaaagtttgtaatggttatgttttatgatctctttgctttgtttttatgtattttgtttgatggatactatgaaggttgtggagtgaggtacttttggtttttcttcttttacatttacagtggataattctactggatttgttt

SEQ ID NO: 23642 - DNA, 417 bp, Gossypium hirsutum
  Clone ID: LIB3272-028-P1-K1-B3
gagctacctttttttctccttttccaccgccgtcgatctcgatccttatcctcggtttcaaacaagctcaaaaaagatggccaacgctgcatcgggaatggctgtgcatgatgattgcaagttgaagttcttggagctcaagacaaaaagaacccaccgcttcattgttttcaaaatcgaggagaagcaaaagcaagttattgtggagaagcttggtgaaccaaccgaaagctacgaggattttactaaatgtctccccgctgatgaatgtcgatatgctgcgtacgattttgattttctaacggccgagaacgtcccgaagagcagaatctttttcatcgcatggtctcccgacacgtcaaggatcaggagcaagatgatttacgccagctccaaagacagattcaagcgagaact

SEQ ID NO: 23643 - DNA, 358 bp, Gossypium hirsutum
  Clone ID: LIB3272-028-P1-K1-B4
aaaacactatgtccccacctttttttttttgcttctaggggtttgaaaccgatcagcgccgccatcgtcatgcccgcttgaagccactcgtggttttcactgtagacggtgatcgggaccacgtgaaatcgggtttttaaccccttttgaagcgagctcgacggcgagggtttaccagaccgaagaagatccaaaagaagaggcacccgcacgacctctttgggccgaatccgacactggagaagtggtcttcgatgacggcgttgcgtggattctggtgtcaatggtgcatgatggctgatggttggcacgtcggggcagcagacagacatgcgtggagggaagcatccgctgcagc

SEQ ID NO: 23644 - DNA, 437 bp, Gossypium hirsutum
  Clone ID: LIB3272-028-P1-K1-B5
aaatcccgggggcgcccccgcctccgagaaacttgaggggaagaatctcgctatcccttgcttttctctcgcaaaaaattctcaaacttgtttttaacgttcgctgaatactatcgctcatttcttccctcagaaccctaatcgataactgaagccatttaatcatgtttgggcgtgttccaaaaaaatctgataacactaagttttacgaagtacttggggttcccaaaagtgcaagtcaggatgaattaaagaaggcttataagaaagctgcaattaagaatcatccggataaaggtggagaccccgagaagtttaaggaactggctcatgcttatgaagtacttagtgacccagagaagagagaaatatatgatcaatatggtgaagatgctcttaaagagggaatgggaggaggcggttcttctcacaaccca

SEQ ID NO: 23645 - DNA, 390 bp, Gossypium hirsutum
  Clone ID: LIB3272-028-P1-K1-B6
tgccccttcttatatacctttttgggctttgcgtttttttccatctgatacaatactttaatcaaagtctgttcttttcccattcttgagagggagaaaacaaataaaggtgatagatcaactcaagcaaaggacactcttttaatcccactcattcttgggtcattgatagatctctgcttgattttctacaatcctttttttttctttacacgaaagagacaactcagaaacaagatctaccaggatttagacattggctttagagaaaaaccaagacaatgctgcctcagaagcaagctgaagaagcaatagtctcaaacttaaccgagatggagcttgaaaccagagaagaagagaaagatgaagaagaacaacaatcattgttta

SEQ ID NO: 23646 - DNA, 410 bp, Gossypium hirsutum
  Clone ID: LIB3272-028-P1-K1-B7
gcgtttccagataacctctactttactctcagtgtaagtcttgtttctttttcggattgtagtttttgggtatcgtttttttcaaatattctcttaacatgtacaagtcttggtgcaattttacttcaagtcctgcttgacataaaacttcaagattttgaatattttcccatttaaccaaagttcaagttaatttactccatctcatgaaaatgggaatttcttttcctgcagtaaatgagtaggttgttagagtttccattcctttagggttttacgttttccttgtttggtttccgagaaaatttttgttgaaaaagacgaattaaaaatggaagaatttaatcgagtaaacgggaacagtatcccgaagggaaatttcgtgtatgcatctccagttgtagcaactg

SEQ ID NO: 23647 - DNA, 368 bp, Gossypium hirsutum
  Clone ID: LIB3272-028-P1-K1-B8
ttccagagatttgttcttttcgcttctttcgttatggggaagatcaagatcggaatcaacggatttggaaggatcgggcgtttggttgccagagttgctctccaaagtgaagatgttgagctcgttgctgttaacgatcctttcatcaccaccgattacatgacctacatgtttaagtatgacagtgttcacggtcaatggaagcaccatgagcttaaggtgaaggactcaaaaacccttctctttggtgaaaagcctgtcactgttttcggcatcagaaaccctgaagaaatcccttggggtgagactggagctgattatgtcgttgagtctactggtgttttcactgacaaggacaaagctgctgc

SEQ ID NO: 23648 - DNA, 351 bp, Gossypium hirsutum
  Clone ID: LIB3272-028-P1-K1-B9
gttgtggagaccttctctgagtacccacccctgggtcgttttgctgtgagggacatgcgtcagaccgtggctgtgggtgttatcaagagtgtcgagaagaaggacccaaccggtgccaaggtcaccaagtctgctgctaagaagaagtgaagaggccaaaaggttttagccgtgaagcagattgagtgttttatctttggttatatgtggtttgaagtttttgcctgttttatgtaggatttttaaagtttgagatgctttggtttgccaaggcgtcttagtcaagttttgtgtctgatcttgcggaactatactttgtttttttctatatatttgtctggttcatttttc

SEQ ID NO: 23649 - DNA, 384 bp, Gossypium hirsutum
  Clone ID: LIB3272-028-P1-K1-C1
gtgagaatggagagcaccacaaatggcggttgcaaaagtggaccggggaatcaaggagctgttattgacaatgacttaggcactaacgcttaactttaccaccagaaagagatgtttagcgatcgagtccatgtggactcttataacaacgctgggttatagaacaagcctacttttcaaggaagggctagatgggatgtatgaacaggatgtgatattattgcaatcaggactgcccagtgctggcgcaaggaaggtctatgacggtgaaccaactaagatgacatatcctgcaacggctatagctgaggcataacaatctggatgacatagtatgaattatttgaagactctatggaagaagcttgcaccaaaactggatgc

SEQ ID NO: 23650 - DNA, 408 bp, Gossypium hirsutum
  Clone ID: LIB3272-028-P1-K1-C10
ttatcggccatgtcgccggacctataaagtttatcccgattttagcctttctctgtctaaaaacccctctgcaccatttctctttctctctttggcgattttttttaaaaaattaataaaattgggtttagcttaaacattttagcacttcagctccatctctctgaaataataaagaagaaaatagagagaatcctagatttttgggcctagggccatttgcgtcatttcgcgagaacggaagcgattattatcatcgacaaataaaggagggatagataaaaagggaagatgtacagaggagagagagcggccggtggctctaagggagaggtggggtcggtggatcggaagcgtatcaacgagacgcttgataagcaactggtgcgatcatcgccgtccactttg

SEQ ID NO: 23651 - DNA, 407 bp, Gossypium hirsutum
  Clone ID: LIB3272-028-P1-K1-C11
attaagcttcttcccttcagaaaacttcgactgaagctgctccaagattaaagaagcttcaatttataatactctgccccttaaactagcaagcctgatctgctgcataatcgtctaaagaaaatttgatggggataaataagttgctgtgttggtttgcagttttcttctttttgttgggtttctatgcttgcacttcgatttctgatggtgttttcgactctctcacttctactggaaggcacctgcttcaagctaagaaagctcgccctgtgaactttgagtttctgcactacacaattatcacaagccaatgcaaaggaccaaagtctccgcctcaaagttgttgttctgcattcaaggaatttgcttgtccttatgcagaacagatcaacgacttgacgact

SEQ ID NO: 23652 - DNA, 406 bp, Gossypium hirsutum
  Clone ID: LIB3272-028-P1-K1-C12
cttcgttcaaccacgcctaataaccgctcggatttttctcagacgtgaaaaaaatggggctgtctttcaccaagctattcagccggctatttgccaaaaaggagatgcgcatactgatggttgggcttgatgctgctggtaaaaccaccattctttacaagctgaagttgggagagattgtcactactattcccaccatcggtttcaatgttgagaccgttgaatacaagaacatcagcttcactgtttgggatgttggcggccaggacaagatccgaccattgtggagacactatttccaaaacacgcaaggacttattttcgtggttgatagcaatgatcgtgaccgtgtggttgaagctagagatgagttgcacaggatgttgaatgaggatgagttgaggga

SEQ ID NO: 23653 - DNA, 389 bp, Gossypium hirsutum
  Clone ID: LIB3272-028-P1-K1-C2
cttgcattgagtctctcagatataactgaaaggaaaaaaaaaaacaaccggtcttggtgttcaacactgatgcatacattgctcttattctcacatagaacttgatgcgctgcacttagggtagctttaccaacgagcgttgcccgccaccaggaaagagcgacatgcgtactctcaagagcccactttgggaacctaaacagtctgccgcttgcccggaatgtacactgacactaggtgtttgtgctggatagtggggctcaatgcgcgtagttgttggaccgctcaggaccaaatgctgtatatttattcggggtttggctgatctcgacgctgctgtgtgcctttgcactgctataaaagctaatgagtagggggttcacctaaac

SEQ ID NO: 23654 - DNA, 411 bp, Gossypium hirsutum
  Clone ID: LIB3272-028-P1-K1-C4
cgcagctgccattttcgtaagtctaccaccgttgctctcaatcccttccacttcgccatggcatcagagaagaagctttcgaacccaatgagggagatcaaagtccagaaacttgtcctcaacatctccgttggtgagagcggcgatcgtcttacacgtgcggccaaggtcttggaacagctcagtggtcaaaccccagtcttctccaaggctagatacactgtgagatcttttggaattcggcgtaatgagaagattgcttgttatgtgactgtgaggggggagaaagctatgcagcttcttgagagtggtttgaaggttaaggaatatgagcttttgaggaggaacttcagtgatactggctgctttggatttggtatccaagagcacattgatcttggtatcaagtat

SEQ ID NO: 23655 - DNA, 245 bp, Gossypium hirsutum
  Clone ID: LIB3272-028-P1-K1-C5
tttaattttcaacttaagggttttgattctgagtgaaaaggggaaaaaatgaaagcttcactgaaatttcgcgaagagaaaaggcccgtgttaagagcgaaaatacctttaagcatattcggctcgccgtttcaatcaggactcctcgccggcgaaactaaggagcttactttagatctttctaccttcttcgaatctggaccgtccatcaaggtcgcctaccgacctaatgacacgtggaaccc

SEQ ID NO: 23656 - DNA, 365 bp, Gossypium hirsutum
  Clone ID: LIB3272-028-P1-K1-C6
gacaaatatcataatggctttaatagagtttgataatttcaagtactatttgcaacaaatttagagcgaatttgaagatattaaacctcaaatatttataatccaaatccaattaatttctcaatctaccttccatgagcagttttgattttcatacagcggagaacatacattgaggaggcttgcttgattcagtgcttcaccagcattctattgatcattgagaagagatgggatcaaatattcaaactgctttggcgatagaaagaaattatccaacgttggatggcaagtcattcaatctttcaaatgaacagaagagtcctttgtttactgaggatttcgaatactaacggaatgatatt

SEQ ID NO: 23657 - DNA, 409 bp, Gossypium hirsutum
  Clone ID: LIB3272-028-P1-K1-C7
ctcaattctctgaaaatttttgtgctgaacttcttttttctctttgtaccaccatgtgtggaggtgctattatctccgatttcataccgccgtcgcggtcgcgacgattgacggccgatttcttgtggcccgatctgaaaaaatccgggttgaagaaggggtcgggtaagagatactcgaagcccgtgatcgacttgggcgatgatttcgagactgactttcaggagttcaaagatgaagaatctgatatagatgattatgatgttgatgatgttttggctgatgtaaagccctttgcttttaacgctacaaagaaacctgcttctgctgtatctcatggttcgaactctgaaaaatccatgcaattcaatggtcaagctgagaaatgtgcgaaaagaaagaggaagaa

SEQ ID NO: 23658 - DNA, 316 bp, Gossypium hirsutum
  Clone ID: LIB3272-028-P1-K1-C8
atcggatttttcttagacgtgaaaaaaacggggctgcataccaccaagctagtcagacggctatttgccaaaaaggagatgcgtatactgatgggcgggcttgaagctgctggtaaaaccaccattcattacatgctgaagatgggagagattgtcacataccatacacaccatcggtttcaatgttaggaccgtggtaaacaagaacattagaatgactggaagggatggtggtggccaggacaggaggccgccatagaggagacactctcatactaacatgcagggacttatttttgtggttgatagcgcagat

SEQ ID NO: 23659 - DNA, 409 bp, Gossypium hirsutum
  Clone ID: LIB3272-028-P1-K1-C9
ttttgcccgtgaggtcaaagagtgcccgtggacagcagggttcatatcctatcaagctgttctacacctctaacatgcccatcattctacattctgctcttgtttcaaacctttacttcatctctcagttactgtacagaaggtacagtggaaatttttttgtgaatctcttgggcaagtggaaggagtctgaatattcaaatggtcaatccattcctgttggtggccttgcatattatatcactgcaccatcaagcttagctgagatggctgccaatcctttccatgcgttgttctatcttgtgtttatgttatcagcatgtgcattgttctcaaaaacttggattgaagtctcagggtcatctgctagagatgttgccaagcagctcaaggaacaacaaatggttat

SEQ ID NO: 23660 - DNA, 414 bp, Gossypium hirsutum
  Clone ID: LIB3272-028-P1-K1-D1
aacagggaaagaaaagcagcgtaatgggtgaagaagtgaaggtttttggatactgggcaagcccttacagctacagggcagagcttgctttgaagttgaaaggtgtttcttatgagtacataaatgaggatatctttggcaacaagagcgatttgcttttgaaatacaatccggttcataagaaagtcccggttcttcttcacaacgggaaaccaattgtagagtctcttgttatacttgaatacattgaggaaacttggaagcataatccctatttgccacaagatccttatgacaaagctaccgctcgattctggatcaagttcatcgacgaaaagtgctttcctaccctttggctagctgcatggagcgccgagaatgagcgagaaaaagtgacgaatgaagcttgcgagt

SEQ ID NO: 23661 - DNA, 407 bp, Gossypium hirsutum
  Clone ID: LIB3272-028-P1-K1-D10
tttaacgcaaacccatttttaagtgggggaaaggtttaagttcagagtcataagcaacatcaatggctccttcaactctgacggctcttgcggaagagaaaaccttgcaggcaagcttcgttcgtgatgaagatgagcgtcctaaggttgcttacaaccaattcagtaatgatatccctgtcatctctcttgctggtatcgatgatgttgatggcaagaggggtgagatatgcaagaagattgttgaggcttgtgaggattggggtgtcttccaggttgtggatcatggtgttgatactaaactcgtgtccgaaatgacccgttttgccagagagttttttgctttgcctgctgaagagaagcttcggttcgatatgtctggtggcaagaaaggtggtttcatcgtc

SEQ ID NO: 23662 - DNA, 408 bp, Gossypium hirsutum
  Clone ID: LIB3272-028-P1-K1-D11
gccgccgcctgcgtctctctcttcatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctattgatgttgacattggtgccaatccttcagccgaagatgctgatgaggatgaaggtgttgatgaccaatctgtgaaggttgttgacattgttgacactttcaggcttcaggagcaaccccctttcgacaagaagcagtttgtcgtgttcatgaagaagttcatcaagaacttgacaccgaaactggatgcggaaaagcaagagtccttcaagaaaa

SEQ ID NO: 23663 - DNA, 408 bp, Gossypium hirsutum
  Clone ID: LIB3272-028-P1-K1-D12
acttgcaacaattgtgtctttcatctccatccctccaccacttcctcaaaagtccatcttcctcagtttatcccttctttttccttcatagcttcaagacaggtccagggaatgcagaaagatgtgcttgcatgctgtgaactttttatctgaagcacataaagttgtatccggttctgaattacccgcattcattcccgatgatgttggatgctcaacagacagcaaattcattccctgtatccatattgtaaatagagttgaaagtaaaatctctgccatgttgaagggtgacctcgttgaagacggttgagcactccggttatagccactcctgctctttagatgttatacatatatatagttactgcaggaggtaaaaatttatctaagggtgttaagatttga

SEQ ID NO: 23664 - DNA, 413 bp, Gossypium hirsutum
  Clone ID: LIB3272-028-P1-K1-D2
gcaagttaaggcaaatgcacaagcccccccaaagataaatggtaccacagttgtgatgactccagtagaaggtttcccgagcgaagatgctgcaagttccctacctcccaggacgtttatcaatcagctacctgattggagcatgcttcttgctgctatgacaaccattttcctggctgctgagaagcagtggatgatgcttgattggaagccaaagcggcctgacatgctcattgacccatttgggatagggaggattgttcaggatggtcttgtttttcgtcagaacttctcaattaggtcttatgagataggtgctgatcgtacagcatccatagagacgctaatgaatcatttacaggaaacagcgattaatcattgtaaaagtgctggactgctaggagatggttttg

SEQ ID NO: 23665 - DNA, 411 bp, Gossypium hirsutum
  Clone ID: LIB3272-028-P1-K1-D3
cgcagagccaaataacatcatcaaaataatttgaaaaaaaaaaagaaaaaaatggaaggagcttcgtaccagcgattcccaagggtcaaaatccgggaactcaaagacgaatacgctaaattcgagctccacgacaccgatgcttccatggccaacgccctccgccgcgtcatgatcgccgaggttcccaccatagctatcgatctcgtcgaaatcgaagttaactcttccgtcctcaacgacgagttcatcgcccatcgactcggtctcatccctctcactagccaacgcgccatgtcgatgcgattctcgcgtgactgtgacgcctgcgacggtgacggacagtgcgagttctgctccgtcgagttccatcttcgcgccaaatgcataagcgatcaaacactggatgtc

SEQ ID NO: 23666 - DNA, 410 bp, Gossypium hirsutum
  Clone ID: LIB3272-028-P1-K1-D4
ccaacacccggtgcacctgaaccggaagggatccggttcattcctcctgttaatttcaccgaaaaaccagtattttcgttttcgtttcctttctttctcttcctgaaaacaaaatccaaaggaaacctgatttttgtaaaatacagaggaagagaggagactacaacttttaaacgacaccggcaagaccaagttccaatttttattacttctgtgtgtttcctttgaaattcaccctcccaaataaattccccaactcgtccgagctcctgaaacagctgagaatccgatggactctttgggtccgaatcgctttgatatctttgaaatttaccggcaattttgtgaacttagaagaggagatacttatgtttgtggcgaagaaggttaccgacaagatgaggaatcac

SEQ ID NO: 23667 - DNA, 411 bp, Gossypium hirsutum
  Clone ID: LIB3272-028-P1-K1-D5
attcccccaatttgttccccggaaaagttctcatttccacccaaatgcaaaaccccagatttctgttctcccttttgttttctatattgatctcaattctgttcttcaacaatataatcgctgaatcaaccttcggccctgaaacaatggcgacaaccactactttgggcggagtccacccttcccaaggctcccaaaacagcgtcgagctcgaaaacctagcacgctttgccgtcgacgagcacaacaagaaagaaaatgcaatggtggagtttgtgagggttgtgaaagcaagcgagcaagttgtggcggggacacttcaccatttgacggtggaagctgtcgacgccggcaaaaagaagctttatgaagccaaagtttgggttaaaccttggatgaattttaaagaat

SEQ ID NO: 23668 - DNA, 406 bp, Gossypium hirsutum
  Clone ID: LIB3272-028-P1-K1-D7
ctctgagtgaagatgactactttgagccttacttccccttgcattgttaaaggtgcaattcccgaacgattttcaagtgctattgtcaaagccccaacatctcttggatctgttaaaagcatctccaagtcttttggcttgaaatgttcctccaatttcagaacctcaatggcaacttacaagattaagcttgtaggaccaaaaggtgaggtgaacgagtttgagtcccctgatgataagtacattctagatgcagctgaggaagcaggggttgagctaccatattcttgcagagctggagcttgctgcacatgtgccgggaagatgatttcaggttctgtggatcaatctgatggttctttccttgacgataaacaaatggaggaaggttatctgctgacttgtg

SEQ ID NO: 23669 - DNA, 410 bp, Gossypium hirsutum
  Clone ID: LIB3272-028-P1-K1-D8
attttcccaccctctttcccgaaaaaatttaatctcaaaattttctcgggaaagcgagggtttattacaaacacagctatatagtggagcagtaatcatgagctttcgagatctggaagccggacggccattggtgtcgaggcaaaacctaatcaacggcaagcaagacgccacgcaagcagttgcctctggcattttccagatcaacaccgcagtctccacctttcagcggctcgtcaacgccctcggtactcctaaggatacgcctgagctccgagaaaagctgcataaaacaaggctacatattgggcaattagtgaaggacacttcggctaaacttaaacaagctagtgaaacagatcacagtgccggaattagtgccagcaagaaggtagcagatgctaaacttg

SEQ ID NO: 23670 - DNA, 408 bp, Gossypium hirsutum
  Clone ID: LIB3272-028-P1-K1-D9
cttccctcaataatcaaaagcttcttctttctttctttttctgtgcgtgcactctcaaaccacaacaaaccaagatgagtgaagaagataaaaatgaagctaaggtagtggaaactccacgcaaaccaccccgtctgaacgagaggattctttcgtctatgtcacggagatcagttgctgcacatccttggcatgatcttgagattggacctggagctccagcaattttcaactgtgttgttgagataccaaaaggtagtaaagtaaagtatgaacttgacaagaagacaggattgattaaggttgatcgagttttatattcatcagtggtctaccctcataactatggtttcatccctcgcacactttgtgaagacaatgatcccttggattgtttggttatcatgc

SEQ ID NO: 23671 - DNA, 409 bp, Gossypium hirsutum
  Clone ID: LIB3272-028-P1-K1-E10
gccgtgcaaccgccgcgccgttaaactcagcttatactgccgaggagtttgagttttacctttctgattcagaatccaagctgttattaatcccagccgaaggcatcaagccggctgaagccgccgcttccaagttgaacatccctctcgtatccgccgctctccaggatgaaaattccaaaataactctctcctccaaccccgagtcaaatattgattcagtcaaacaactcgttaacgaccctgccgacgtctctcttttccttcacacttccggtaccaccagtcgtcccaagggtgttcctttgactcagctcaatttggggacttcagttttgaacattaaatcggtttacgaactcactgagtcagactcgacggtcattgtgctcccgttatttcacgtgca

SEQ ID NO: 23672 - DNA, 410 bp, Gossypium hirsutum
  unsure (1)..(410): unsure at all n locations
  Clone ID: LIB3272-028-P1-K1-E11
ctgaaaagcgcgggagtggaggggataatgattgacgtttggtgggggctggtggagagggaagcgccgggtgcttataattggggtggctacgccgagcttctcgagatggcaaagaagcatggccttaaagtccaggctgtcatgtcattccatcagtgtggcggcaacgtcggtgactcttgcactattcctttgcccaagtgggttacaggggagatcgagaaggacccagacctcgcatacactgatcaatggggaagaaggaactacgaatacctttcacttggttgcgatacccttcctgtcttgaaaggccgtacgcctgttcagtgttatgctgatttcatgcgtgcctttagggacaatttcaaacacctncttggtgataccattgtggaaatccaagt

SEQ ID NO: 23673 - DNA, 415 bp, Gossypium hirsutum
  Clone ID: LIB3272-028-P1-K1-E2
caagttagtagcgatgaaccccatgaatcttagccgatgcagatctccccttgcccttccctttaataaactccattctcgctcttccctcagaaatcatctacagagacgaaagtccaaaaacattcggaagcgcatgaaaagactacgatcagatatgcaagaaataagtagggaacaagggaagatcaaagaagggcaaagacaagtacgagaaaaatttgaagccgttgaatccgaatgcgaattgcttcggaaggagactaacatcataatgcagcagagtatgagcacacaactccgccttgctttcatgttacaaatcttgaaagcaagagaaaaccacgacctcgaccaggctgccaaactcacttccgctcttcgggagctgatagcgagagagaatcagcaaaag

SEQ ID NO: 23674 - DNA, 411 bp, Gossypium hirsutum
  Clone ID: LIB3272-028-P1-K1-E3
cttgggttgagtgtagagatgaggaaaatcatgggtgccaaagttcttttcttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatcctt

SEQ ID NO: 23675 - DNA, 402 bp, Gossypium hirsutum
  Clone ID: LIB3272-028-P1-K1-E4
gtccaattatgcaaacgagggctatctattctacatcaatggctgctatgctccgtggtgtagggctctgcgatgcaaacttggatcctactgctgcacagatgggcgtttgctatgggatgcttggcaataatctcccaaatgcatgggaagtcattcaactgtacaaatcaaacaacatccggcgattgaggctgtacgatccaaatcaacaagcattacaagctcttagcggctgcaacattgaagtaatgcaaggtgttccaaatgatcaacttcaacacctctgtgacccttccaaagcacgatcatgggtccaatcaaatgttggagcttactggccgagtgttcgggaccgatacattgctgtcgggaatgaagtccctcattcatcttgggtag

SEQ ID NO: 23676 - DNA, 411 bp, Gossypium hirsutum
  Clone ID: LIB3272-028-P1-K1-E5
gctaaccatgagctacttaaccatttcccaaatctcctccctcctcttctttagcgtccttttcatttccgctcatgcagcgcgctttgaaatccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccggtgattgtggtggactccttcaatgcaaaggttggggtgtacctccaaacaccctggctgaatatgcacttaaccaatttggaaacatggatttctacgacatttccttagttgatgggtttaacatccccatggtgtttggtcc

SEQ ID NO: 23677 - DNA, 380 bp, Gossypium hirsutum
  Clone ID: LIB3272-028-P1-K1-E7
ccttgggttgagtgtagagatgaggaaaatcatgggtgccaaagttcttttcttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaat

SEQ ID NO: 23678 - DNA, 408 bp, Gossypium hirsutum
  Clone ID: LIB3272-028-P1-K1-E9
cgaaaagaaaaaatggctttgaattttaatgccatcgcctcgaaatctcagaagctcccttgctttgctcttccaccaaaggccacccttagatctcccaagttttccatgatctccaccattccttctggctccaaagaggttgggaatctgaaaaagcctttcacgcctccaaaggaggtgcctgttcagatcacccactccatgccgcctcacaagattgagatctttaaatctttggagggctgggctgagaacaacattctgactcacctcaaaccagttgagaaatgttggcaacccgccgactttcttccagatcctaattctgatggatttcatgagcaagtcaaagagcttagggaaagggcaaaggagatcccagatgattactttgtagctttggtt

SEQ ID NO: 23679 - DNA, 410 bp, Gossypium hirsutum
  Clone ID: LIB3272-028-P1-K1-F1
ctgggagatatgcctctaaagaagaggccaagaagaaggggaataaaattaacaatgtaggttggtggtttaaaccctggttctaccaacatgcgcaaacggccttaaagaagggagagtttgtagagtacattcctacaagagaatattaccacaggcacacaagatgtttgtattgggaggggaagcttatacttccattcggagatcaatggtggtttaggtttcttttgggctggttgatgccacccaaggtttccttgctcaaggctactcaaggtgaatctataagaaactattaccatgagatgcatgtcattcaagacatgcttgttcctctttacaaggttggggatgcccttgagtgggtccaccatgagatggagatctatcccatttggctctgcccg

SEQ ID NO: 23680 - DNA, 410 bp, Gossypium hirsutum
  Clone ID: LIB3272-028-P1-K1-F10
cctgttttgagggtttattcatttgtagccatgaaattcagaagcttttgtttgtgcatcccaggatcaaagcaagaagattcagacagttcttctaacaaagcaaaatcccataaaaagtccgacaaaagtgggaaaaaggaagggaatgtggatgatgctgattatcagggtgccactactactactacggcagccagcagtgatgctggaatggctgctgctgtagcagtgggtgccactacagcacatgcctccgctgtggaatgaagcggttgcgatggttgtcatgcatgtggtggtggtggcggctgatagccggacactatttcaaaaaagctggttcagtatttggcctttggcgttcttcatcatattgatttcagaatctttctttcatcttgcatgaa

SEQ ID NO: 23681 - DNA, 413 bp, Gossypium hirsutum
  Clone ID: LIB3272-028-P1-K1-F12
caacgaccagccagttcggtccctcagatggcaacttagccatcaaactgagctttgtgattcgaaagcagggagtgatattttggatatgattcttacaaagggtggttgtagagcagaacaagtagcgtcgtcgcccccatttttttgtgggtcgccgccgagtagagtagctaacccattaatacaggatgctcgatttggggatgagaagatggtcaacccgccgtctccaaatccgcctcctccttcgtctccgtcatcatcttcaaggaaaggagggtgtattcgggccaattttggtaacaaaccagcagtgagagtggaggggtttgattgttttgcactggcttagaacccatttctatcaacaaaagagtacatagataaaacaagaggagctaccaaaacag

SEQ ID NO: 23682 - DNA, 371 bp, Gossypium hirsutum
  unsure (1)..(371): unsure at all n locations
  Clone ID: LIB3272-028-P1-K1-F2
tttagagtaaacctttttataaagcgattggccaggcggaaggaactagccctggggggggatttttcagtccggtgaatttgttatctcgaatttcgatcgaacccaatcccgtataccattgcaaatctgacgttgatgttaggaagatacatcctcatgtaggggaagcgaccgactagggacgaagctgtttagggttctaagagcacctgtactgcnatgcgtgaagagcatccaacccctatgaatgcatccgcgttaagttttatgtcaaacgagttaaaccttgtggacctgcttgatgcgatacacgcttttaagagagatgcatggtttacatctacacgtgctgctaatgagattgtgca

SEQ ID NO: 23683 - DNA, 415 bp, Gossypium hirsutum
  Clone ID: LIB3272-028-P1-K1-F4
taatgaagtcgatgctgatggaaatgggaccattgattttcctgaattccttaacctgatggcaagaaaaatgaaggatacagactctgaggaggagcttaaagaggcattcagggtgtttgacaaggatcagaatgggttcatatctgcagccgagctgcgccatgtcatgacaaaccttggtgaaaagcttacagatgaggaagtcgacgagatgatccgcgaagctgatgttgatggtgatgggcagatcaactacgaggagttcgtcaaagtcatgatggccaagtaaaggacctctccaactataaccaggatttaaaattggggtttaaaaaaaaaggaagaaaggaacagggcagataagtttgctaagatatctattaatgaataggacatctatgtttttatgtta

SEQ ID NO: 23684 - DNA, 415 bp, Gossypium hirsutum
  Clone ID: LIB3272-028-P1-K1-F5
cttcaagtgccaaaatctagggatttgcgggtggagaagacgagagcccatctctctgcttcaaagctcctgtccaggtagaattctcttcttcccttgcgttgtgttctttcctgttcaatcgccatggcttcaaagcggattttgaaagaactcaaggatttgcagaaagatccacccacttcttgcagtgctggtccagtagctgaagacatgtttcattggcaagcaacaatcatgggaccctcagatagcccttatgctggaggtgtgtttttagttactatccatttccctccagattatcctttcaagcctcctaaggttgcatttaggaccaaggtcttccatcccaacatcaacagcaatggaagcatttgtcttgatatcctcaaagaacaatggagccctgcac

SEQ ID NO: 23685 - DNA, 416 bp, Gossypium hirsutum
  Clone ID: LIB3272-028-P1-K1-F6
ctctctatatctttcatcccatagcttttttttggtaaaaggccatggatgggaatggaagagttcacccagattgtcctaatgctgcaaatccctaccatgaatgtggtggactctgcttagagaagattgctgaaggcaaaggaccaaaggcaaaagaaactaaaaagtcattaagttcaaaatttcttgatgcttccagaagctttggccggaaaaagaagggatccgactctctgctgagatcccctaaagcactcgagactacccctgcaataggtgcagtttatcctggtggccctaggtcacctcgttctcatttttctagaaagaaaatggaagcagaaaacggtgagtcgtattcatcttccgagcaacactctggcgagatatattcccaagatcaatcattcgag

SEQ ID NO: 23686 - DNA, 410 bp, Gossypium hirsutum
  Clone ID: LIB3272-028-P1-K1-F7
catgttcgctttgagattagatccaaaattctcctttcctcttatttccgattcgccaatttttcctgaaaccctaatcctaatcccagattcctcctgtctacatcgattagcaaatggcaaccgaggacccggcagtcgtggcagaccccgcacccgagacgggggaggacaagactgctgagaccaaagctacttcaaaatccggcagagcaaagaaagccaaagaacccaaaaccaagaaagctgcagctcctaggaaaccacgggctgctcctactcatcctccttacgaagagatgatcaaagatgcgatcgttactttgaaagagaggacaggttcaagtcagtacgccattgctaagttcattgaagagaagcagaagaatcttcctggaaatttcaagaag

SEQ ID NO: 23687 - DNA, 405 bp, Gossypium hirsutum
  Clone ID: LIB3272-028-P1-K1-F8
atcgacctctggaccatcctatccgaatccaggcgcatactcaaagcccacagtggccacttccaagctctcacagtcctctttctcctcccttcctcttgttttttatccatttatcccttcatctatcaacacttctctcccaccattgaatcccacctcagcttccttgaacaaaatccccccatcttccccattaaactccccatcttcaatctcctttacaccctcatcctctccatcttttctttcttcgctatcggttccatcacttacagcgttttccacggcttttacggtcgacccctcaaccttttatcctcttttaaggcagcttccacttccttcttccctctcctcttgacttcccttgtaacccagtttatcgtttatggaatcagttta

SEQ ID NO: 23688 - DNA, 406 bp, Gossypium hirsutum
  Clone ID: LIB3272-028-P1-K1-F9
gttttcattgaaaaccctagacctcccaacgaagtagcagagccgcagtttctctgtcgatatccgaaacaagaaatggctgtcacattcaacgacctgggttctgctgctggcttgaagaagctggatgagtatctccttactcgcagctacatctctgggtaccaagcttcaaaggatgatattaccgtctacgcagctctatctggtgccccatcgtctagctatgtcaatgtttctcgatggtacaaacacattgatgcccttttgagaatctcaggtgtttctgaagaaggctgtggtgtgactgttgagggatttgctcccgctgaggctgttgccactccttcagttgctgattccaaggctgcagctgctgaggatgacgacgacgatgatgtagatc

SEQ ID NO: 23689 - DNA, 407 bp, Gossypium hirsutum
  Clone ID: LIB3272-028-P1-K1-G1
gcaaaaggcaacagcatattaacatgttgctttttgcagtttggtccgtagtcagcccgccctcctcgcgataaacgatatgatgctacttctcaaactctctcattaaaaccaataattcacactatctgttttactctttgatcgaatgatggagagcagtgaagaagatgatgacttcccttccattgagagcatcactccccagtccaagattgattctgttcaccaatcccatactgaaaaggggatcagaaaactttgctgtgagcttttggatttgaaagatgctgtggaaaacttatgtgggaataggcgcacaacatacttggctttcttgagaatgtctgaagaagttgttgaaatggagcacgagttggttgagctacgaaagcatatctcttctc

SEQ ID NO: 23690 - DNA, 404 bp, Gossypium hirsutum
  Clone ID: LIB3272-028-P1-K1-G10
attttcagcagcaactttttccttttggcagttaagtgaaacgatgccatactactcgaggggtggcgaagatgacgttgacgagttcgacgaattcgatccgacgccttacggtggtggatacaatctcgaactaacttatggtcgtcctttggaaccctacgatgagacttgctacccttccggtacacccttcgatggcgactttgattacgcacgtgccgatttctattccggttacgcgcacttagcttatgccgacaaagcccttgaaactgaatacagttgctatcttaaacccaagccccgacctggacgattcgaacctgcacctgcttttggtgactatggaagggaacctgaatatgagcaatttgaatctcgtcatggacgcaaaccggagt

SEQ ID NO: 23691 - DNA, 403 bp, Gossypium hirsutum
  Clone ID: LIB3272-028-P1-K1-G11
aacgagacgaggttatcacggttggttcaatctttgcttctacggtgttaagaggtatcaagtttctagaaaatcactggcacgagctatgctatgacataaaaacaggtcgattaagcgattggatcaccgactcaggatgcagaaatgcggcatcattggtcatgaagcctaatccagaacaggctggtttgatagaaaatatatgtaattgtaaatcatgggaaggaatagtcagaaagctatggcccaaagcaaggtatattggttgtgtttgtactggcgttatgagacagtatattgcagaactcgagttctattgcagagggctccctttagtttcaacttcttatgcttgctcggaagctatttgtgggattaacttagaacctctatgtaaacc

SEQ ID NO: 23692 - DNA, 413 bp, Gossypium hirsutum
  Clone ID: LIB3272-028-P1-K1-G12
ctctgagtgaagatgactactttgagccttacttccccttgcattgttaaagttgcaattcccgaacgattttcaagtgctattgtcaaagccccaacatctcttggatctgttaaaagcatctccaagtcttttggcttgaaatgttcctccaatttcagaacctcaatggcaacttacaagattaagcttgtaggaccaaaaggtgaggtgaacgagtttgagtcccctgatgataagtacattctaaatgcagctgaggaagcaggggttgagctaccatattcttgcagagctggagcttgctgcacatgtgccgggaagatgatttcaggttctgtggatcaatctgatggttctttccttgacgataaacaaatggaggaaggttatctgctgacttgtgttgcgta

SEQ ID NO: 23693 - DNA, 390 bp, Gossypium hirsutum
  Clone ID: LIB3272-028-P1-K1-G2
gtccgttttttttttttttttttttttttttttggagggatataattaacagaaatactagtgtttcgtagagttaattgcaataagtatctataaaataaacgacaaaatttaagctcctctttatattataagtatcaccgaaaaaccaacctctcggagaaagcaaacccaggcttgaaaagcaaaaggcaccaaatgcctgctttgcgaaacccaccaaacagaggtcacgaaaactcgatggcttcaaacaataacaaagcctttcctcgttacctctgctctataaaaatactaaatagcagctacttagcttaatccaccgcgcgagaataacccatctgggatggtggacaccatctgctttaaagttatatgctaattacc

SEQ ID NO: 23694 - DNA, 410 bp, Gossypium hirsutum
  Clone ID: LIB3272-028-P1-K1-G3
aaaaaaaaaaaaaaccccaaacagacaatagcctaggacaggaggatctctcagggtttaggtgatggcttcaaagcggatcttgaaggagctcaaggatctccagaaagatcctcctacctcttgcagcgcaggccctgttgctgaagacatgtttcattggcaagcaactattatgggtcctcctgacagtccttatgctggtggagtgtttctagtcaccattcatttccctccggactatccatttaaaccaccaaaggttgcattcaggacaaaggtctttcacccaaatattaacagcaacggtagcatttgccttgatattttgaaggagcagtggagccctgccctcaccatatccaaggtattgctatctatctgctcactattgacggatccgaatcctg

SEQ ID NO: 23695 - DNA, 414 bp, Gossypium hirsutum
  Clone ID: LIB3272-028-P1-K1-G4
ggtaaatgctctataagctattcattgaagccaatcattcatagggaaaagctgtgtgggaggttgtctctcatctcccaaaatttgctgccatgaacctaatgattctcttccttttttcttctctggtcattaaggcattctctttgaaacctgagccagccaaaaataatgcccagatcactgtcatgggccttgtttattgtgacattggttacaccagcacctattccagtcacagttactcgttaccaggtgcagaagttcaaatagcctgcaacttcagggcatttgttccaaaaacaagagaacaagtttcattctcagtcaacagaactacagataaacatggagtttacaggttggaaataccatcagttgatgggatcgcatgtgcagaggcagccattgcat

SEQ ID NO: 23696 - DNA, 107 bp, Gossypium hirsutum
  Clone ID: LIB3272-028-P1-K1-G5
caacgaaaagctcagtgtttgtaatggcgatgttattgatctcttagtttgtatttgtgctttgtttgatgtatggtatcatgaagattgtttaggtacatttgcct

SEQ ID NO: 23697 - DNA, 422 bp, Gossypium hirsutum
  Clone ID: LIB3272-028-P1-K1-G6
ccacgcgtccgaacaaaaccaaccccaacctcccttctcccccaccaaataaagcagaagaaaaagaaaaaaaaaccagagagtctccgtttcgagtttggttttttaatatttgtttcactttttcagtttcgtccttgtgtctcccctcctttcggtttctctccgcccccccccccaataaaaacgaaattcagggaattaaattccctataaaatcgtttctcgtaaatttccttttcgttttaaatcaaacccgatttcctggtttctttttcttcatcgatcgtcgccggcggaaaaacaagaaaaatcaaaagcaaaaagcttgcagaattagaaaaaaaattatgggttctgaacagaatgaaggaacaagctttccaccatcggagccaaagctttgtgccaacggttgtggg

SEQ ID NO: 23698 - DNA, 388 bp, Gossypium hirsutum
  Clone ID: LIB3272-028-P1-K1-G8
gctttatcaaactcaaatcttagtctgaacaacatggtcaaaacacccatcagatactatctggttgatgcatgcaccgactcaaccttcaggggaaacccagcagcggtttgtttgttggaggaagaaagagataggaaatggatgcaagcagtggctgctgagtttaatatctcccagacttgttacttgactcggatccccaattgcacctctacaaacaccaggtttcgatttatatggtttacccctgtcaccgagggtaagctatgtcgtcatgcaaccttagcatctgctcatactctctttacaaatggttgggtgaatgtaaacattatcgaatttgatacattatgtggaatcctaactgctacaaaggttgcagatg

SEQ ID NO: 23699 - DNA, 403 bp, Gossypium hirsutum
  Clone ID: LIB3272-028-P1-K1-G9
ggcggcttctgcttctatttacaatcttctcactctcctgctcctttctggcatcccttttaccttctccgagctcgttaaagagcagcctctggtgttgaaataccacaatgggccactcttgaaggggaagatcactgttaatctcatttggtacgggaagttctccccaacccaacgctccataatcgtcgatttcatcaactctttgagctccgccgtcaaacccaaggttccgtcggcgtcgttttggtggaaaacgacggagaaatacaagtccggttcctccactttggtcgtgggcaaacaaatcctcctcgaaaattacccgctcggtaaaatccttaagaacccacacttgccggcgttggccgggaaattcaacggcgtaggtacggtcagc

SEQ ID NO: 23700 - DNA, 408 bp, Gossypium hirsutum
  Clone ID: LIB3272-028-P1-K1-H1
aatgggagttggtttaggttattgcattgccgctgctgtggctaatccagaacggcttgtggttgcagtcgaaggggactcgggattcgggttcagtgctatggaggttgagacattggttcgatacaagttgcctgttgttgtgatagtctttaacaacggtggtgtttacggtggtgaccgaaggagccctgaagaagtaagtggccctttcaaagatgaccctgcgcccacttcctttgttcctggtgctgcttaccatactttaatcgaagcttttgggggaaagggttaccttgtcgggacacctgacgaattaaaatctgccctttctgaatccttctctgcaaggaagccggttgtgataaatgtgataatcgatccctttgccggtgcagaaagtgggag

SEQ ID NO: 23701 - DNA, 415 bp, Gossypium hirsutum
  Clone ID: LIB3272-028-P1-K1-H10
gaaaaacttaatcatggctcggttgacgttcgtgacctccatcatccttctgctatgctccgttgccgctggatcaactttcgacgactccaaccccatccagatggtatccgatggcctcaccggcttcgaatcctccgttcttcgtgtcatcggtcacactcgccatgctctctccttcgcccgttttgcatacaagcatgggaagaggtatgaaaacgtggaggagatgaagctacggtttcagattttcgaagacaacttggatttaatcagatccactaacaagaagggactgccttatactcttgctgtcaatcagtttactgattggagctgggaagagttccagaaacacagattgggggctgctcaaaactgctctgctaccacaaagggcaatcaccagctcact

SEQ ID NO: 23702 - DNA, 416 bp, Gossypium hirsutum
  Clone ID: LIB3272-028-P1-K1-H11
cggacgcgtgggtttccaagttgaagggcgaaatatgcttggataatttatcaattaaagaacttcatgaggtttttaaggcaacatttgggcgagacactactgttaaggacaagctgtggcttaaaaggaggattgctatgggattgaccaattcctgtgatgtttctactacaacttttgtaattaaagacaacaaattggtgaaaaaggataatgaagatggttttaacaatgtgaatcttggtgctggaaaagaacacctggcagttgcagttgaatacaatgaggacttgctcaataaccttagcagtcaaattgatgaacatcaaactacttcggaggtgagactgggaaataatgttgtggaaaacaattttgcaagtgaagatcttgctgcagatcagagagctgca

SEQ ID NO: 23703 - DNA, 130 bp, Gossypium hirsutum
  Clone ID: LIB3272-028-P1-K1-H12
gaaggaattaagggaggaggagccattggccatttttacagggcccacgacagttccttcggggtctgaaaattgtgaccaattaaaaaaagccttttaaggatggggaactatggagggcttaataaaa

SEQ ID NO: 23704 - DNA, 411 bp, Gossypium hirsutum
  Clone ID: LIB3272-028-P1-K1-H2
ccaaatcgaaatttaaggccaaaaagacacaagggttactaattaaattaatcttcagcgaatatgttggtttatcaggatcttcttacaggtgatgagctcctctcggactctttcccatacaaagaaatcgagaatggaatgttatgggaagtcgagggaaagtgggttgttcaaggagctgtcaatgtagatattggggctaacccttctgcagaaggtggtgatgatgatgaaggtgttgacgatcaagccgtcaaggttgtggacatcgtcgacactttcagacttcaggagcaacctgcttttgacaagaagcagtttgtgaccttcatgaagaggtacatcaagaacttgacacccaaattagagcctgaaaagcaagagtctttcaagaagaacatcgagggg

SEQ ID NO: 23705 - DNA, 408 bp, Gossypium hirsutum
  Clone ID: LIB3272-028-P1-K1-H3
ctcgaacccaacaatttgttgcatttctgggtacacttcatatttcaatttcatcaggtaccaaattttatttctccacgggagggaaagttagtgttaggcgaatcaatatgaaatcgccggcgttagcttcatggaaagcccctctaaagttcaggatgccaacagctgaaaatttaatacccattaggcttgacatagaagtcgatggacagcgctataaagatgctttcacttggaacccttatgatccggattcagaggtggtgatgtttgcaaaaaggactgtaaaagacttgaagcttgcccctggtttccttccgcaaattgttcaatccattcagtcacagcttgccacctttcgatcatatgaaggtcaagacatgtatgttggtgacaagatcattc

SEQ ID NO: 23706 - DNA, 423 bp, Gossypium hirsutum
  unsure (1)..(423): unsure at all n locations
  Clone ID: LIB3272-028-P1-K1-H4
gcgagatcaaaagccagcagcgcagcagctaaaagagcagtcttttgacaattattcgccatgggtaaggttcacggatctctagctcgtgccgggaaggtgagaggccaaactcctaaagtggccaagcaagacaagaagaagaagccccgtggccgcgcttacaagcggatgcaatacaaccgacgcttcgtcacagcagtggttggatttggcaaaaagaggggacctaactcatctgagaagtaagagatctatgtaggtgaagaaggcaagaagccttgttgaaagctttgatggattttaagtctttgttttcttttgataatgtttttatgatattggtttcaaggattggattgaactgccattttgtttgctagatattatgtgatattgntatcaattatcttaatttttggg

SEQ ID NO: 23707 - DNA, 410 bp, Gossypium hirsutum
  Clone ID: LIB3272-028-P1-K1-H6
cttctttcaaccgcgcctaataaccgctcggatttttctcagacgtgaaaaaaatggggctgtctttcaccaagctattcagccggctatttgccaaaaaggagatgcgtatactgatggttgggcttgatgctgctggtaaaaccaccattctttacaagctgaagttgggagagattgtcactaccattcccaccatcggtttcaatgttgagaccgttgaatacaagaacatcagcttcactgtttgggatgttggtggccaggacaagatccgaccattgtggagacactatttccaaaacatgcaaggacttattttcgtggttgatagcaatgatcgtgaccgcgtggatgaagctagagatgagttgcacaggatgttgaatgaggatgagttgagggatgct

SEQ ID NO: 23708 - DNA, 324 bp, Gossypium hirsutum
  Clone ID: LIB3272-028-P1-K1-H7
gcacgactgtggtaatagaactcgaaattccttaaagagtgtgtaacagctcagctgtctaatgagctacacaccgaaatgagcggcgctgaagcgcgcgacctatacccagccgaccggcaagggccaggctatcgatagtaagacgcgcggagttcgagctagacctgcacacaagccacgcagggtgactgccttgcagatctcaagcgttgatagcgatattgatatgagatccttggatgccgaatcggggtatggttgcaaggcaacagtactcgcgcatgggtttgttgatcctaaaagacggaacaagccgctgcg

SEQ ID NO: 23709 - DNA, 403 bp, Gossypium hirsutum
  Clone ID: LIB3272-028-P1-K1-H8
cttccctttcttcaatcaatgaaaatgtcttctataaccaaatccatatccatggcggactcatgttgcctcgtttgtatcccttcagtcttcaccacttgttccaaatccccatccctcctctcctttcccccaaaaccaatcaatcttttcctctcatcatcccattcttcaacctctttgaccctcaaaaccagaacccatttctcttctctagtttcctttgttgcccaaacatcagattgggctcaacaaggggaagaaaatgacaccaccatcaccatcgatgaggatgaaagtgaaactgaagaaggggaatcgaaatgggaaaacgatgaaagtgatggagctgaagcaatttggggaactgaaggtgaggatgctggctttgaagaacaaagtg

SEQ ID NO: 23710 - DNA, 424 bp, Gossypium hirsutum
  Clone ID: LIB3272-029-P1-K1-A1
gtttataacaggtagaaccacagagagactaaagttcttcagacttcgtgtggagcagcgaatattagcaaacttcttagtgttgactgacatcatcacatcaccaactcctaggttggtcttggagcacctcaacagatgagatttcaatagggttgacactactttgacaaacgacaacattcttttctacatatatacactgttgacggcgttcgattattgagattcacacggcatgatgcacaaagctgttgagcctcacaatggcagggtagatcaagagctgatcgcactgcctttgagagacaggagacttgatgaattttaccagtcctgcaaagagtataagaggccacttgcttctaggtactacaaagggcctgagcttctggtagattgacaagactatgactattccttg

SEQ ID NO: 23711 - DNA, 112 bp, Gossypium hirsutum
  Clone ID: LIB3272-029-P1-K1-A10
gtctaatctaacgtcatcaacaaatgaaatattttccacgtacttgttggcggtggctgtctaagggggtggctatgaatgtttacgacaaactcaccgcatgctgactttg

SEQ ID NO: 23712 - DNA, 296 bp, Gossypium hirsutum
  Clone ID: LIB3272-029-P1-K1-A11
atcaaatctgtcgtgctaggaaaataaaacaacaaacgccttctttgaggcggacgtagtataagttttagggaatcaggtattggaaaaatgtcaaatatgctgtagagtaggccaaaaacacaggtttaaatgaaacgcctgacagagagctctcttcttcttatgaatcgcacagcctccatcgaaatatttgttaaagcaattataaaacgtgtgttgcaagcagcaggtgttcttttcaagagacacaatgtctacttcttctgctgtttacagctctgacgtatcattaa

SEQ ID NO: 23713 - DNA, 420 bp, Gossypium hirsutum
  Clone ID: LIB3272-029-P1-K1-A12
gttcaatttccttagctcaatctcagtctgcaactacgttgtccgggcgttggtcatggcaaaagccgtgaattcaaatgattttctgatgtactacaaatcattatgggcaaggaaacaaaaggtgtccaccaattcaccaaggtgcttaaaaatttcttcttgtaaaaaatcaatatctgctgccatagatgtatttcatattaattgctgagattgctgcttgcggattcttgttgctccccactataaacagtatgtccttgcaactgattgaaatgaacggagctgtcttttatttgtttaaagaagaaatagttagaactctaatgatctatgcatctataggacttggttttttttgcgctgccctagatacttggattttggttctctgtacaaataggaaatgcagggacc

SEQ ID NO: 23714 - DNA, 425 bp, Gossypium hirsutum
  Clone ID: LIB3272-029-P1-K1-A2
acaggctggttaagaccatcgtcgacgatgaggattacaccatccgcaccgtggagcaagctaaagatgctctttgcgctttgagagaacttaacttcaataaaagatcgacggtgcccaccaccactacaacctcgttcctgaagttacacgaagcgctgttctgtcctgaggagtttaaatgtcctctttctaaagagcttatgagagatcctgtcattgtagcttctggccagacatacgacagactctttatacagaaatggctgaatgcggggaataggacttgccctcacaccgaacaggttctttcacacacgattctaactccgaatcatctaatcagggatatgatattgcagtggtgcaagagtcagggaatagaattgccgaaccctgttatggatgggaaagaggagggggtc

SEQ ID NO: 23715 - DNA, 426 bp, Gossypium hirsutum
  Clone ID: LIB3272-029-P1-K1-A3
caaaaactgaaaccctcaaacgcacgcaatcataaagctggaaatcaagttcactgctgttaagggtcttccatttttctgtggtttaaggaaagtttggttggttgcagggatctggtaaaagtttcctgtttaatcgatctgttggggaggtgtggaaattagaaaaggaaaggggaaaataaaaaggagaaagggatatggtgggatgaggggaaaatggctagagaaagtcgacccaaggctttgggttccgggcagtgctcgtataaaaggataacactgattgtttgcttcgataacataggtattgctctctttgatcttcgctctctttattcttcgctctacatttattcaaataaagatcatgttgtaaagtatacaccagatcagattaggaaaatgggagaatcagataagatt

SEQ ID NO: 23716 - DNA, 363 bp, Gossypium hirsutum
  Clone ID: LIB3272-029-P1-K1-A6
gcagtatctcccaatccttcttgctgcgattaggccttcaagatctcagttgtggaaccgaagcgctctttcctatcaagccatggctctgatcttgcatgcaagaaaaacaaacaaaaatgcctttaaggcactcattgctgcagaatatagtggtgtgcaagccaaaatggctgagaattttgagatgggtgtgttaaataagactcctgagttcatgaagatgaaccctttggggaaggttcctgtggtggaaacacctgagggtccggttttggagagcaatgccaatgctcggcttgttgctcgctcacaaggtaacaaccctatatggggttctacattgaatgagcatggtcatat

SEQ ID NO: 23717 - DNA, 421 bp, Gossypium hirsutum
  Clone ID: LIB3272-029-P1-K1-A7
gggacgcctgggtctagatcgcgagggccgccctttttttttttttgtgttggggaaacaattaaaatttcataacttaatgaaaaatttgattatgaacggaaactaaatcttataattttaattatgctaaaaaacagatcaaaatttcgaattttggctatctttataaactcttttggtttctataattccaaaaggttagcccaaaagaattcaaaatatttacacaatttctgaaattcctttcctggtccatctacatataattttttctttttattgtctcaacccaaatccacccgattgagtcgggcaccgaaacccatacgggtcaatcgagttagagaagttatgactgttcaacacattcgaattgtgttgaactatccccgagttatcagctcgctgagttctgagt

SEQ ID NO: 23718 - DNA, 237 bp, Gossypium hirsutum
  Clone ID: LIB3272-029-P1-K1-A9
gttggagtaaactatagcaaaaatcatcattcacattgcgcactggtggtcaggatcacccttagacagctgctttgccatggtacgatgagatcacactatcgctagaacaaggtgttgggtcactcaccccaaaagcaggaactgcagatctagattctgcttcctgcttgaagttacactgatgtatactactggtagtgtgagggctacactcacttgttccatcgcatactt

SEQ ID NO: 23719 - DNA, 428 bp, Gossypium hirsutum
  Clone ID: LIB3272-029-P1-K1-B1
ccgcgctaccgctaccagtgaaagccgcactattcagtcttcggtcgccgctccccctttctatctattcaatctgaggtatgtcgacggccgtggcagccaccgagaccagcaaagacccaacccaacctacctccgaagtcaagcttttcaatcgctggtcttttgaggatgttcaggttactgatatctctttgagtgactacattggtgtccaagcttcgaagcatgcaacctatgtgccgcacactgctggaaggtactcagtgaagcgtttccggaaggctcaatgcccaattgttgagaggcttacgaactcactgatgatgcacggccgaaacaatgggaagaaacttatggcagttaggattgtgaagcatgccatggaaattatttatctcctgactgatcagaacccaattcaagtc

SEQ ID NO: 23720 - DNA, 338 bp, Gossypium hirsutum
  Clone ID: LIB3272-029-P1-K1-B12
tttcagttcagctgctccgtattatttattcaactactatggctacgggggggtctgttttataggggttttgtattttctcgagtgttagtggtaagattctcagtgaggaagaaaaggctgctgataatatttacattcataaaactgatcgagagaaattggataaactttctcgcatgggacccaagccagagtagaaaccggatgctggttcaggtggtgcttcgaccgatggtagcactacctatacattggttacattctctgagaaagtatcaaccgataagttcctaaactacggggttcttgctgttgttgcaaccccttggtgctgc

SEQ ID NO: 23721 - DNA, 428 bp, Gossypium hirsutum
  Clone ID: LIB3272-029-P1-K1-B3
gcttcatattatcttttttagttccgacaaaagaaaacgaaaaaaaagaagaagaaatacaatcgttttctttttgaagtcgggttttagtttttggggtgaaaaaaatgttgggagtatttagcagtgcgatagtgtctccgccggacgagctggtggcggccggttgccgaactccatcacctaagataacggcggacgctctggtgaaacggttccttgagacgaactccttcggcgtgtccatgcacatcggagaccatgtccaattcgcttattctcaccataaagagtctcctttacagcccagatcatttgctgtgaaagacgaaatcttctgcttgtttgagggagcccttgataacttggggagtttaaagcagcaatatggtctggcaaagtcagcaaatgaagtgatattggtcatt

SEQ ID NO: 23722 - DNA, 431 bp, Gossypium hirsutum
  Clone ID: LIB3272-029-P1-K1-B4
aaaggatcttgctttgcctaatttgtaagctttgaggttgactgaaaaaactatggcggaagagggacaagtaatcgcctgccacactgttgattcatggaaccagcagctcgagatgggaaaccagtccaagaaactggtggtggtggatttcacagcatcatggtgcgggccatgccgttttatatcaccaatcctggtggatcttgctaagaagctgcccaacgtcatattcttgaaggtggacgtggatgaactgaatactgtggctcaggagtgggctattgaggcgatgccaacttttgtgtttctgaaagaaggcaccataattgacaaggttgtgggtgcaaggaaagaagaattgcagcagaaaattgcctttcattcatctaacccggtgcaaacagcatgaatcaacatttaaatgtact

SEQ ID NO: 23723 - DNA, 432 bp, Gossypium hirsutum
  Clone ID: LIB3272-029-P1-K1-B6
ctcaaaaagaaaaatgctacctcgatggagcagggctgtaatccatctctcaaagctacgatcattcaattccattgaattaggcaaagatttcagtttgattcatcgccaaagctatgcagctgtggcacctgcacctgctccttctgctgattccttcccacctaccagatcatcggtaaatttggataaaatgttttggtctaagccttgttcattggctttggccccagattctccccttagagtggaagacccaaagtatgaaggcattaggcgtattgttctcaagatgatgcttttctatagtaaacaaagcaagtcaattcgaggggctaatgttatatataggcgtgtcctttcccaagttgataaacctgctatttatgaagtatttagcttggagaagacattcaggatgacgttttcact

SEQ ID NO: 23724 - DNA, 381 bp, Gossypium hirsutum
  Clone ID: LIB3272-029-P1-K1-B8
gtcatcaacgtgtgcggaagattatgtatgtttttgaacaaaagagaggtgagctttcacctgagggagagaccatgtcagcttatcataaatttatttagaaggacaagcttctttatgactcattaaattacatggtaattgataatgctatcctcactgtatgtcaaaggcaagtgagctgtgcaaggtgcgtattgatgttcaccatgaacgcccatgcttcagctcataaaagcttagtttggtggatgtgatgacatactcacatgccttgtatgtaggagcttgaacaacatatttatgctgtataaacaacctggtctttacaaaaagcgcattgaggcgttgatggagaatgcagcatataactcactaccg

SEQ ID NO: 23725 - DNA, 428 bp, Gossypium hirsutum
  Clone ID: LIB3272-029-P1-K1-C1
cgaaaatatttcttttcttgttttgagagagagagacagccggcgggaaggcgtcgagatcgatttaagctagtcagttgaagctgccaggcattggaacacgatgtctacggttgaagcaccactatatccaatagctgtcctgatagatgagctaaaaaatgacgatattcaacttcgtttaaactcgatccgtaggctttcgacaattgcacgtgctctcggggaagagcgaaccaggtcggaattaattccatttctcagtgaaaacaatgatgatgacgatgaggtgcttcttgcaatggctgaggagctgggagtgtttattccctatgtcggcggtgttgagcatgcccatgttttgctgacgcctttggaaaccctttgcactgttgaggaaacctgtgtaagggacaaagctgttgagt

SEQ ID NO: 23726 - DNA, 385 bp, Gossypium hirsutum
  Clone ID: LIB3272-029-P1-K1-C10
aaatatcataagaggattctgtatctgtgatctgggcccctctaaggagaaaagttgcaattgaaggctgttcatcctctgtattagggaaagctattcagccaattctttcagcatctagagtttctatcaatgctgcaaaagagattctattacttgagcctataggaattgcccatattcgtaactcttctcatgtcattctcccaagatgttctactgatttaccaaatacaaggcatgcttgttatagcactcatttacagactatcatgcaaaaatcatgcttggctctttcttctggagggggggatctggtcgctgttattagccctcttatgggagaatcaattagtgatggcactatagcaacattcttgaaaaa

SEQ ID NO: 23727 - DNA, 386 bp, Gossypium hirsutum
  Clone ID: LIB3272-029-P1-K1-C11
aaataacataaagtattcaatatcttttatctttgcccctctaatgagaaagagttgctatttaaggctgtgcatcctctgtttcatgattaacttttctatcaattctttcatcgtctaaagtttttattaatgtcttcaaaagattttttattactttatcctaaaataatttccctaattcttaactcttcttatcttaatatactaatttgtcctatctaaataccatattcataacatactttcattatcacttatttaaatacttaatatacataaaaatttcatgcaatattcttctttaccctattatatggttcatttatttattcctcactaagtaaattcaatcattgttttcacttttaatcattttattaaaa

SEQ ID NO: 23728 - DNA, 358 bp, Gossypium hirsutum
  Clone ID: LIB3272-029-P1-K1-C12
caaaaatctctctcagtttcttctctatccccctaaaactctttagcaggaggcctttgttaaccaaagtgagagagtgcatttcagttcacattggtcaagctggcatccaagttggtaacgcctgttgggagctctactgtcttgaacatggcattcaccctgatggacaaatgccgggtgacaaaacagtcggaggtggggatgatgctttcaacacctttttcagtgaaaccggcgctggaaaacatgtccctcgtgctgtttttttggatcttgaaccgaccgtaattgatgaagttagaaccggggcttattgtcaattatttcaccctgaacagtttattagtggcaaaaa

SEQ ID NO: 23729 - DNA, 420 bp, Gossypium hirsutum
  Clone ID: LIB3272-029-P1-K1-C2
attagaactcaaagtcccagctaatattagaatcatgggtgttgtcacttatgactatgagaatacctgcccagtcgcccctgccaggcttttcaaggcctttactgttgaagctccgaaagtttggcccacggctgcacctaatgcagtaaagagccttgaggttgaagctaatcctagctctggaagtatcgtaaaaatcaactttgttgaaggccttccattccaatatatgaagcaccagatcggaggacatgatgaaagtaatttttcatacagttacgatttaatcgaaggtgggcctttgggggataagcttgaaaaaattagctatgagaacaggtttgaggcagctgcaggtggagggagtatttgcaagagctcaatgaaattctacactataggcgataatgttatcac

SEQ ID NO: 23730 - DNA, 364 bp, Gossypium hirsutum
  Clone ID: LIB3272-029-P1-K1-C3
ggcggcttctgcttctatttactattttctcactctcctactcctttgtgccgtcccttttaccttctgcgagctcgttaaagagcagcctctggtgttgaagtaccacaatgggccactcttgaaggggaagatcaccgttaatctcatctggtacgggaagttctccccaacccagcgctccataatcgtcgatttcatcaactctttgagctctgtcgtcaaacccaagattccgccggcgtcgttttggcggaaaacgacggataaatacacgttcgctttctacactttggtcgtgggcaaacaagatctgctagaaaataacccctttgataacatgcttgaggacccacacttggca

SEQ ID NO: 23731 - DNA, 428 bp, Gossypium hirsutum
  Clone ID: LIB3272-029-P1-K1-C4
caattttccttttgcttttgttgtatgtagtcgtaggatcagctgagcagtgtggaaggcaagcaggcggtgctctttgccccggtggtctatgttgtagccaatttggctggtgtggcagtactgctgactactgcacagttcctggttgccaaagtcagtgcagcggtagtggccctgcccctgggcctggtgggctaaccaatcttatatcaagagagacctttaatcagatgcttttgcataggaacgatggggcttgtcctgcccgtggcttctatacatatgatgctttcattgctgctgcccgttcttttcctgcatttgctacaactggtgaccaagctactcgcaagagggaaatagctgccttcttagcccaaacttcccatgaaactactggtggggcagggtgggctgcaccggat

SEQ ID NO: 23732 - DNA, 144 bp, Gossypium hirsutum
  Clone ID: LIB3272-029-P1-K1-C5
cctcgatactttttgtacaccgtgagaatcgtagaccgagaatccgtctttgtagggtttgatcaggcggtgctttttcccctcctggtctattttgtacccaatttggctggtgtggcaattctttcttactactgcacagtt

SEQ ID NO: 23733 - DNA, 376 bp, Gossypium hirsutum
  Clone ID: LIB3272-029-P1-K1-C7
caagaaagcaatacaaatggaaccggtagacgctgaagcacacaataaatatgcgatttttttatggaaagcgaataaagatatgtgggcagcggaggaaaatttcttggaagccattgaagttgatcctaataactcatattatccggcgagctatgctaattttctatggagtaccggtggggaagatacttgtttccctcttggttcatcggatggtattgcttaagaaacaatggccaacactctgttttttctttctttttctggaattttgctcagataaatgaaaacctttctttcccaatgattttaggtttgtttttattgcaccaatccatgtgagaaaatgtaattagtaataatatatattgtt

SEQ ID NO: 23734 - DNA, 427 bp, Gossypium hirsutum
  Clone ID: LIB3272-029-P1-K1-C8
aaagaaaacaaggaattcaagatcattgatttatatgttggttttgcaatcttcaccgctctgatccaggtagtttacatggcaatggtgggatcatttcctttcaattcatttctttctggagtgctttcttgtgttaggaacagcagtccttgccgtttgtcttcgtattcaagtgaataaagaaaacacggaattcaaggatctaccacctgagcgagcttttgcagattttgttctttgcaatttggtgctccatttagtgatcatgaatttccttggctaaatcgcgcctccaggtttgctgtggactgctggctgtgattcatatttaaagcatgaaatgaaattcttaggtcattactatgagtttatgcatatagcgtatatgatcaggaattgtagtaagaattcagtggtgtctttt

SEQ ID NO: 23735 - DNA, 427 bp, Gossypium hirsutum
  Clone ID: LIB3272-029-P1-K1-D1
gctagcaaaatagaaatcaatcgaatttccagctttgggaaatttttaaagaaagtcggtacttcaagccactgattcagaaaacggcacaccggatctccgccattcgccgttgttttgaagcgtttctcaaccatgaatcttctcggccatgtcgattccctcaaaagccaaacgtggatcaaattcgcggcctttatttttatttccgacgcttccttttacttaggcaaacactggtccgacggttcccgccaactcatcttcttgtgccgacaatgcccttctggaacgacgtcgtcttcaccttccatcgctctttctcctaatctcaataaagaattcaatgtctccgctctcattgacactccggaaccttctcgttcagctaaaagcgaaagaacgtgggcgtcggggtctttgaaag

SEQ ID NO: 23736 - DNA, 407 bp, Gossypium hirsutum
  Clone ID: LIB3272-029-P1-K1-D10
ggcggcgggagcggcggcggaaagtgaaccacctcaaaagcaatctccttcgtccaccggaacatcggtttccttccactcccgcccttcctctctccgaataccttttttttctctttcaaaaaaatttcaaattaacagtgaaatatccaggtttaaattgccaatggcgaaagttagcaaagtgcggaagtctgattctcagcataaaagagtgccttatccattgccctctcatcctaagagggctggaaaaggttccagaaagaagagatgttccaaagctttggagaagaaagattgggaagctgcaaaatgttccgtttgtctggagttcccacacaatgccgttctcctcctttgttcctcttacgataagggttgccgcccttacatgtgtgcgacta

SEQ ID NO: 23737 - DNA, 408 bp, Gossypium hirsutum
  Clone ID: LIB3272-029-P1-K1-D11
gttcgtcggactgaaacaagaaagccaataagaaaaccccttggtgctgccggagatactcgcggtggtcggaataatggtcaccatgaaatctcaaagcaaagaaatgctactaacaatgagggagcgtcaaatccatctactgatgcactggaagagacttctcatgtaaagcatgaatcccaaggtgatattcccttttcaggtccattacaagttgcttcatcgagtggctttgcatgggcaagaagacgaaaagatgatgcatccggaagatcacttagtaggtctatctcaagagggcacatttgcagttctttagaaccttctgctccattacatacacgaaatgataatgatttgaaacggcatgaaaatgaagatgttataaatggaggtcgaactgat

SEQ ID NO: 23738 - DNA, 350 bp, Gossypium hirsutum
  Clone ID: LIB3272-029-P1-K1-D12
gacagaggtagcggctccagaaagttctccacctcaaaagctatctggggcggccacctcaacaggggggagcttccactccctcccttcctctctccgaatacctgttctttctctttcaaaaaaatttcaaattaacagcgaaatatccaggtttaaattgccaatggcgaaagttagcaaagtgcgtaagtcttattctcagcataaaagagtgccttatccattggcctattatcctaataggtctggaaaagattccagaaagaacagatgttccaaagctatggaaaataaagactgggtagctgcaaaacgttcagtttgtctggagtatctcacacaatgcc

SEQ ID NO: 23739 - DNA, 393 bp, Gossypium hirsutum
  Clone ID: LIB3272-029-P1-K1-D2
gtcagcaatttgtttagaagatcatgttgcctcttgtacacaagggatttgatgatctaccttaggagctgaacatttcagcttctcataaatctactaacgcgcctaaacagccttgagacaccctccacgacttggtatctcatcacgctgacgacacttgctgcatgggcaaaggcaaccgtgctcggtgcggcttatgtccgccatgaacgtgctgcttcagttcatcaaagcttgtttggtgggtttgatgacatacactgccttgtcttagggagcttgaacaatccatctatgctgtataggcagcctggtctttccaaagcgtgcaatgaggcgatgattgtgattgaagtcaatagcacactaagggatctgggtgcataccct

SEQ ID NO: 23740 - DNA, 427 bp, Gossypium hirsutum
  Clone ID: LIB3272-029-P1-K1-D3
ctaggcttgtagctaagctaagctaaacgagacttctaagacatggatcttcttgactcctttagctcattagctcttattctgtatctcattgtcttaactctgaactctaaaggtgcattaggtgcttctttcacatttgtcaatcgatgtggctacacggtgtggcctgggatattagcaaatgcaggcagtcctacactcgacagcactgggttcgagctaccaaaggactcgtctcgttcatttcaagccccaactggctggtccggtcgtttttggggtcgaacgggctgcacatttgacggatccgggtctggtacgtgcgtaacgggcgactgcgggtcgggtcagatggaatgtaacggactcggagctgctccgcccgtgactctggctgagttcactctgggaacgggtgggcaag

SEQ ID NO: 23741 - DNA, 426 bp, Gossypium hirsutum
  Clone ID: LIB3272-029-P1-K1-D4
atttcgtacctctaactggcaatcaatcactttcatggtttttttagagagaaaattgtatgtccagcgagagagttcccgttgagttattcaacggcgtttacgggcttgaaaaaatcatgctactctagactcgaggcagctctgtcctggcgtatttgtatggcggacacctgacatcttggaagaatgagcttggagaggcgtttcttttcttcagtcgtaaggcattgttctagccttcaaaagcaattttaggaagaattactatatgttgtccccaattttcaaattatggtcctcttgagccgtatggctatgccagaaattaacattggagcattgacactgacccttctgcttttccgacaaactcatccagcaaagcttacattgatttgatccttaagccttctgaagaagata

SEQ ID NO: 23742 - DNA, 295 bp, Gossypium hirsutum
  Clone ID: LIB3272-029-P1-K1-D5
gctggagcccatatcaagttttatcgggtcaagccaatgattataggcatcaggggcacaacgccctcgagctatgctcaaactttaaatcaggaagacggcacatgatcctagattggatttgacaattaccaactaggtctacgatcagattctgtgtgtagttcatatgaaaagataagatggcctcagatcttggtaaactgttcattggtgggatatcttgggacactgatgaggaacgtgtcaaggaatatttcaggacatatggcgaagtggtggaagcactgttcat

SEQ ID NO: 23743 - DNA, 433 bp, Gossypium hirsutum
  unsure (1)..(433): unsure at all n locations
  Clone ID: LIB3272-029-P1-K1-D6
gttattttgccttttcgctatcgtctttgcctatcaactccacggcgcagatccgaggagtctctatttttcaatccaaacaacccctctaaacactctcttcttttattgctcctactcttccagtcatggcaggcttggcaccagaaggatcccaatttgatgctcgtcaatatgaccagaaaatgactgagctgctccagactgatggagatgactttttcacaagttatgatgaagtttatgacagttttgatgcaatgggacttcaagagaaccttctgaggggtatctatgcatatggttttgagaagccttctgccattcagcaaagaggaattgtaccattttgcaagggtcttgatgtgattcaacaggcacaatccggaactgggaaaacagcgactntctgctctggaattctacagcaact

SEQ ID NO: 23744 - DNA, 419 bp, Gossypium hirsutum
  unsure (1)..(419): unsure at all n locations
  Clone ID: LIB3272-029-P1-K1-D8
gcagatcccgatcccactggaagaatctggaattaaaaagcgatagggtttggttcgttgttaaaaagataggcagaggcatttaaaaagttttagaaattacttaggggaagcctaatcagagagatccatggagtttttagctaaagaatacgggtacgtagcgttagtggtggtggcttactgctttctcagcatatggatgggtatccaagtagggatggctcgcaagaagtataaggtttattaccccaccctttacgctcttgaatccgagaacaaagatgcaaagctcttcaactgtgttcagagagggcatcaaaactcgctggagatgatgcctatgttctttgtactgatgattttgggagggatggctcatccttgcatctccggtgcgcttggactnttttacaccg

SEQ ID NO: 23745 - DNA, 395 bp, Gossypium hirsutum
  Clone ID: LIB3272-029-P1-K1-D9
cagagagcagcacagaccaacaaatgcttatgcttataaatactccatacgccctctcactttctagctcattagcttctttctctttcccttctgctaccacgcgccggcttctttttctttcttacacttttacccttcctccccctagattcccccattcctccctggtttcctggagggtatccccgtctttttgcacccaagcttcaaccgccaccgggaccatgggtgacgctccccacgttggtatggacgctgtccaaagacgcctcatgtctgaggatgaatgtattttaatggacgagagtgataatgttgttggccatgaatcgaagtacaactgtcatttgtgggaaaagattctaactggaaagatgctgcatagagcattc

SEQ ID NO: 23746 - DNA, 258 bp, Gossypium hirsutum
  Clone ID: LIB3272-029-P1-K1-E1
gatgaagaaaattatgggttccaaaggcatttatatctttgctgagccttgagggtcagctgtgttggcattcgcacaggatggggtagatcaagggcttgttatgaacttgtacacagatttttgatcttaaggtaaagtcattataaaggaccaagacaagctactattcacgcgacacaaaaacactgattcttttggggtgtgaaacaaatttaattactgtgctgtccagtcatgagttgcttcactgttact

SEQ ID NO: 23747 - DNA, 420 bp, Gossypium hirsutum
  Clone ID: LIB3272-029-P1-K1-E10
cggacgcgtgggcggacgcgtggggtcagaaatcataactgaaagaactggatacgactttacaaagataaccaagcactaaacatcgtataagggggagtaaggtaagattttcgtcttattttttggtttttctacacaatggcttcgatgtttggacctggaagctcaacagcaaacatatatgtaccagaagagtggtcggaggctgctaattccatagcctatgattcagtaacttccccacctcctttttcttttatctgcggcagccaaaaactctgggaaaaccactttgtcccgtcacctacttaacattcttctccaaaggtatggaaaagtagcttatttggacacagatgttgggcagtctgagttcacggttgcaggtttagtgtcccttacaattgttgacaaaat

SEQ ID NO: 23748 - DNA, 436 bp, Gossypium hirsutum
  Clone ID: LIB3272-029-P1-K1-E12
acgctttcccactatctgaactgaaaccgtgtgggaaaagcctgagagaggagaaaaaaatcaaaaggcaaaagcaactgaaatgagtggagcctcgacggcggcgtatttagctcgaagagcggcgcaaaaggagagggttcggatcctctaccgccgtgccctgaaagacacactcaactgggccgtccatcgccacctcttctatcaagatgcttctgaccttcgcgagaaattcgaagccaacaagcatgtggaagatcttgatacaattgacaaaatgatagatgcaggtgaagcaacttataataagtggcggcatcccgatccttatatcgttccttgggctcctggtggttccaagtttactcgaaaccctgtcccaccttctaggatcgagatcttgtatgattatggtcaagaagaaaatgactaa

SEQ ID NO: 23749 - DNA, 449 bp, Gossypium hirsutum
  Clone ID: LIB3272-029-P1-K1-E2
tttccggggtgagcccacccgtccggtaaaccctattttgttaccctattttttccagctgtagttgcagtccaagtgggggcatatccagttcaatactcctaccgtaaagatgaacaaggaaaggctcatgaaaatggctggtgcagtccgcactggtgggaagggtagcatgagaaggaagaagaaggctgtccacaagacaaccaccaccgacgacaaacgattgcagagcacccttaagagaataggagtgaatgctattcctgcaattgaggaagtcaacgtattcaaggatgatgttgttatccagtttattaatcccaaagttcaagcttctattgctgcgaacacctgggttgttagtggctctcctcagacaaagaaattgcaggatattctccctggaatcatcaaccagttgggacctgataacttggacaacttga

SEQ ID NO: 23750 - DNA, 420 bp, Gossypium hirsutum
  Clone ID: LIB3272-029-P1-K1-E3
gcttcctttgtcccccatcctccgatccgtctctacccgcattcgtcccgccggatttaacaagttttcaaacgaagaatgagggaaatccttcacgtacaaggcgggcaatgcgggaaccagatcggatccaagttctgggaagtggtttgcgacgagcacggcattgaccctaccggacgttacaccggaaactccagtctacaattggagcgcgttaatgtttactacaatgacgcttcttgtggaaggtttgtcccacgcgccgtgctcatggatcttgagcccgggaccgtggatagtgtgagaaccgggccttatggtcagatctttaggcccgataactttgtcttcggccaatctggagctggtaataattgggctaaggggcattatactgaaggagctgagcttattgac

SEQ ID NO: 23751 - DNA, 437 bp, Gossypium hirsutum
  Clone ID: LIB3272-029-P1-K1-E4
aataaatcggaattccccagcagcaatggctactccaagtgtagagtatttgcctcctccattggatgctactgcacagcaacccgctatctttgatggaacaatcaggttgtatctggcttatccttgcccttacgcacagcgcgtgtggatcgccaggaattgtaagggtttgcaagacaagattaagttggttcctttgaaccttcaaaatagacctgcttggtacaaggaaaaagtttaccctgaaaacaaggtgccgtccttggaacataatggcaaagtcattggggagagtcttgatttgattaaatatgttgatagcaacttcgaagggccgtctcttctacctgatgatgctgacaaaaaggagtactttgagacgacgttatcacacatggacgaatttctagggctggtgtatgctacatttaaag

SEQ ID NO: 23752 - DNA, 438 bp, Gossypium hirsutum
  Clone ID: LIB3272-029-P1-K1-E5
gtagccgccgcctgcgtctctctcttcatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgaaggttgttgacattgttgacactttcaggcttcaggagcaaccccctttcgacaagaagcagtttgtcgtgttcatcaagaagttcatcaagaacttgacaccaaaactggatgcggaaaagcaagagtccttcaagaaaaacattgagggagcaaccaagtttttgg

SEQ ID NO: 23753 - DNA, 436 bp, Gossypium hirsutum
  Clone ID: LIB3272-029-P1-K1-E6
cttctcaatgctggaattcaggctgaattgattttgggatccattgcaaggaaaacaaaaaagaatggtgattttgaaggggattacttggaagatagggttacttttagcgaggataagttgatggactctgatagcaaggctgtgatgatggcttgggagaaaccattgatggaagctcatgctaaagctgtttgctctggaggtggtaacgttctaaatgttggatttggaatgggtcttgtggatactgctattcaacagtatggtccagccacgcacacaatcattgaggctcatccggaggtctatgcacgcatgcttcgcactggttgggacaagaaggataatgtgaaaataatatttgggcgttggcaagatgttctttcaaaacttgaatcttatgatggtattttcttcgacacctatggagaat

SEQ ID NO: 23754 - DNA, 429 bp, Gossypium hirsutum
  Clone ID: LIB3272-029-P1-K1-E7
caagaaaatccaaagggaattgaaaatgaatctccaaatccaaactcagtctttgtcaacacactttccccttccacccttccctccaaaacccaaattccttcaagcaaaacccaaaccctccttcaaattatggtcctcgctctccactgtttcagtcccaccaacaaaaaccagccacaagccatttcccgccgaggtttccaggaccataatggaattgtcttctatggggaccctttccactctagctcaagatgggtggcccttgggcgttggtgtaaggtttgctgtcgatgctgagggcacccctgttttgtgcttgcctcaaccttctcctgataaccgctccacccttcatgttcagttagatcaatgtgggttacggactcctcagtgtacaatacagggcagtcttaccaaaccagc

SEQ ID NO: 23755 - DNA, 422 bp, Gossypium hirsutum
  Clone ID: LIB3272-029-P1-K1-E8
aaaatctccaactttccctttgtcaaaaaagacttctgttctgttcggtatttgcagggaaaaaaaaagataatgtgtttgactgagagtattcaatattctggcgcttatgcatcgatgggaattgataatagttcacgacttgatcgattctctaacaactttagagttgaagtggttcgactcaatgaagatgacatggagtttgatatgatcgttattgatgcagctattgccaattcattcaggaggatccttatagctgatcttcctacaatggcaattgaaaaagttctcattgcaaacaaaacatcaataatccaagatgaagttcttgctcataggttgggcctcgttccaatccgtgttgacccaaggctttttgattatctttcagaaaatgatcagccaaatgaaaagag

SEQ ID NO: 23756 - DNA, 369 bp, Gossypium hirsutum
  Clone ID: LIB3272-029-P1-K1-F1
attttagattaagcaaccgtgcatcctcatttctatctctgacgagccttgtggttctattgaaatggatagctatggctacagcatctctgctacgatcattccgacgaacagacatcgttgcatatactatctatgactatagatgccttactaacaatggccaaacctccgtaggaattaattgaacaagcttttgttgagctgtcaagaaaaaacctgccggctatgatgtcattggtattgattagggcacaaccaactgctgtgttactgacatggagggaaagaatccaaaagttattgacaactgtgaaggtgcatggacaacaccttctgatgttgatttcaaccaaaaaggagagcttc

SEQ ID NO: 23757 - DNA, 434 bp, Gossypium hirsutum
  Clone ID: LIB3272-029-P1-K1-F10
cacttgcatagctagcaaagctaaagagtttgcaagatggggagcatggatagcttttggcagctgggggattatcttcgaggacaatcaaaagcctcagaggataaccaatggctgatggttgcctctaaattggctgagcagacgaggacaaagggtgaacgcctgagcaatcttgatctttcgaagggtccagccgaaataaggacaagggataaatttggtttccgggaagacaacaaattcgagaaccttaacttcaatatgttaaacttggactccaagattggagataatgtaagcaaaagctcattccgaaatggtacctacaatataaatgctgtttaccagaaaaataatagcaatagcctgggaaacctggctggcaacaaatatagcggcaataatcatagcagctaatatgtcaataataa

SEQ ID NO: 23758 - DNA, 431 bp, Gossypium hirsutum
  Clone ID: LIB3272-029-P1-K1-F11
gaggagccctcggaccttgcatctctattcggaaaacaaataatttggtgagggtgaatgagatcggggatggtggtacatatatatggaagctgcgtacacttactagtaaaacatgtattggtttcttcttccaaggaaactatgagcataaacctcaacccggcgctgcattcttggtacaggtcataacacgctatagagatggcaacatgggaattcgaagacgggtgacaaccgctgcaagaagatgggttgcaaagcagtcaccatatatatctcgccgggtttgatcaggaagcagcaacttcagttatggcccgactcgctattcatcgagctgaaacatgtcaagctagagatgttatcagatggttggacgataaccttatttgttgtgcttccaagtttggagactatatacaggaaga

SEQ ID NO: 23759 - DNA, 425 bp, Gossypium hirsutum
  Clone ID: LIB3272-029-P1-K1-F12
cgaaaagaaaaaatggctttgaattttaatcccatcgcctcgaaatctcagaagctcccttgctttgctcttccacgaaaggccaccctcagatctcccaagttttccatgatctccaccattccttctggctccaaagaggttgggaatctgaaaaagcctttcacgcctccaaaggaggtgcctgttcagatcacccactccatgccgcctcacaagattgagatctttaaatctttggagggctgggctgagaacaacattctgactcacctcaaaccagttgagaaatgttggcaacccgccgactttcttccagatcctaattctgacggatttcatgagcaagtcaaagagcttaaggaaagggcaaaggaaatcccagatgattactttgtagttttggttggtgatatgatcactga

SEQ ID NO: 23760 - DNA, 371 bp, Gossypium hirsutum
  Clone ID: LIB3272-029-P1-K1-F2
gctaaagtctgcttttgcctgtcagagcttagatcgatcatgggtcactcgaacgtctggaattctcaccctaagacctacaggcctgactctcgcgcctgtcgcgtgggtggaaacccccatgccattataaggaagaatggtatcatgtagttgcagacagtgcttgactagcaaggccaaggaaattggattcattaagtcccgttgaagaatttatatggtgtgaagtcagaaaggaatttcgacaagtatgaactattattgtaaggttttggaattcaaagaaaaacttctaagaaaatgttactgcagaatttattatgggacattgaagtgtcttacaaagagtacatagatgtttttcaatg

SEQ ID NO: 23761 - DNA, 415 bp, Gossypium hirsutum
  Clone ID: LIB3272-029-P1-K1-F3
gttggattatttattttgtttccctcctcgttcaactgtctcgtttcatttcttaaaaaatgactaccctttcaaattctttggttttatcgacaaatcctccccttcaactattttctggctctcatgggagtgccagctccaccaacttggcattcaattctagtcatttaaggaaactgcatatttctacctctagaaggcctctcactgttcaagcttcatacagtgatggcgaaaggtcaagcagtgctaatgcctttgttggaggttttgttttgggagggctcgtggttggtgcacttggttgtgtatttgcccctcagatcagcaaggcactagctgtagctgatagtaaggaccttatgaagagactgcctaaattcatatatgatgaagaaaaagctttggagaa

SEQ ID NO: 23762 - DNA, 427 bp, Gossypium hirsutum
  Clone ID: LIB3272-029-P1-K1-F4
caaatttctctccttcttttattttattttcctctttatttttcgttctcaattatattaagtctctcagttctctccatcttccgttgtttattttccctaattttgcttcgattcgttcaaggtcgctttactcattctgggctgtgattttttggttcatgattataagctgcaacaaattacaacaacaatttattgaagcagcatgggccaaaggaatatgcgaagccctattgatttagaaatcgatcaacaaggccaggaatacctccagcatgaaccttgcgtctatttgggtgggacaacgaactacccatcacctgatatcccaatgaccgtcacagctccagggaacacaactaaccttgatgcgcatcccttacctgagcattatgacaacagtatgttttatgggatccccatg

SEQ ID NO: 23763 - DNA, 391 bp, Gossypium hirsutum
  Clone ID: LIB3272-029-P1-K1-F5
tttgaatctagggatttgcgggtggagaagacgagagctcatctctctgcttcaaagctcctgtccaggtagaattctcttcttcctttgcgttgtgttctttgttgttcagtcgccatggcttcaaagcggattttgaaggaactcaaggatttgcagaaagatccacccacttcttgcagtgctggtccagtagctgaagacatgtttctttggcaagcaacaatcatgggaccctcagatagcccttatgctagaggtgtgtttatagctaccatccatttccctgcagattatcctttcaagcctcctaatgtcacgtttaggaccaaggtctttcatcctaacattaacagcactggacgcatttttctggatatcctcaaagaac

SEQ ID NO: 23764 - DNA, 271 bp, Gossypium hirsutum
  Clone ID: LIB3272-029-P1-K1-F6
accgcacgtcgcgtggtgtccgttgcgcttccggtagctcttgaatttccggaagaagctcttttcagggaggactttctttctttcttgctttgaattttttgtaattaataattagggcttttaagtatatgtttatgatctctttattttttattattttatctttatttttttattttttattcttatcttttgttttttttttttctatgtattttttttctttttaaatttatttttatttttaattatattattttctattttt

SEQ ID NO: 23765 - DNA, 142 bp, Gossypium hirsutum
  Clone ID: LIB3272-029-P1-K1-F7
gaagaatgatcatgattgatatgcaaacagaacttttttcgatattgaataagatccagttgatgcagaaccctcattctatatttacaaaaagactgtcttggatccagttatatggtgcgtacaaagacattagttttaa

SEQ ID NO: 23766 - DNA, 426 bp, Gossypium hirsutum
  Clone ID: LIB3272-029-P1-K1-F8
caaagagttgccagatgaattctcttggagcacaagggaatattacgccactgctattcgggccaccagaattaaaagagcacctgttcatgcatctgcaaactggtatctcgaaaatgtcttgcctgtactacagagttatgggattgctgcaatttctccattctctcaccgtttgtcttttgacaacttgccaagtgagatccagcaactacgttgtaaagtcaactttaaagcacttgtttttgtcccgcacattagagcacttggagatgccattgtccatcgcctcagatatcctcctggtgaaactgaagcacttagcagtgactatctcagggtgaccactgatcaaaatgacaaacaaaggccacaaaaatttgtcgtcttacatcttcggtttgataaggatatggcagcccattc

SEQ ID NO: 23767 - DNA, 78 bp, Gossypium hirsutum
  Clone ID: LIB3272-029-P1-K1-F9
cttaaagtcactcaattgcttaagcaagtgctcctaatgacgttcaggtagggacaccattcccagcctacgactacc

SEQ ID NO: 23768 - DNA, 337 bp, Gossypium hirsutum
  Clone ID: LIB3272-029-P1-K1-G1
gtttgtaacttttagtgcttacagagcattgttaaccaagaaaagaggaagatattggcttaaccatggcggacaaggtatacactattatgaccaggaagttcaagaccaacactctatctttcagtaaacaactcatcattgatgaattgcatgctgagaggcccaatgtgcctaacgcgcagatcaaggagacgcttgatcgaatgtatgtagcgatagacacagattcgctctttgtgtgcaagttcaggacatacactgtaggtggcaaagctagcggatctgttacgatctattccgcttgggcaagcgctataatatatacagctaaata

SEQ ID NO: 23769 - DNA, 430 bp, Gossypium hirsutum
  Clone ID: LIB3272-029-P1-K1-G10
gtccgccgctcacatcaacctcaaagtcaaaggccaggacgggaatgaagttttcttcaggatcaaaagaagcacacaattgaagaagctcatgaatgcatattgcgaccgacaatctgtggatttcaactcgattgccttcttgttcgatggtcgccgcctgcgaggtgagcaaactccggacgagcttgagatggaggatggtgatgagatcgatgctatgcttcaccaaaccggtggtactgtgtgaagcgagtactactttgccgcatttagtatttgatgagttagttatggtctgattatgtaagatgtttccaatgtttttatatacgaccttattgccatgttatgaagacttgtggaccttgttttgaatcatcttgctcttatagaagagcttgagtttctagtgtttacaaagtgagat

SEQ ID NO: 23770 - DNA, 437 bp, Gossypium hirsutum
  Clone ID: LIB3272-029-P1-K1-G11
tattgatcaacaccgcgaaagtttgctgacttgggagaagttacagtatcctttcaagatggtggaactgcacaacaattgcgatttcacgatgatacctacacctaaagccccaaatggtgctaatggacaaccatcgcctgatgataatctggtcaattcctcaagcttgatgttgactggaccaaagaaaagaaatctggaagctgaaagagaaggcatcaataaacagagccggccccggctaacggttgaatcatcaaatttggtagaagagaatacggaagagcgtattcagagatacaatgaggggactccaaaaaacaaggacaaaactgcactttcggaagctagagtacaaggtattgccattaatgatgttattcctattgatcaagacaatggaagtttgctggctcgaaagatgatgcggcgtg

SEQ ID NO: 23771 - DNA, 395 bp, Gossypium hirsutum
  Clone ID: LIB3272-029-P1-K1-G12
attaaaccttctgcttagcttaaaaaatcttggatctgcactctacgactggcctcggaatcgggaatggctccgcacatgaagattaagatcggtatttacggatttggaagaatcgggcgtttggttgccagagttgcttttcaaaggaacgatgttgtactcggcgccgttaacgatcccttcatttacaccgattacatgacatacatgttcaaatacgacagcgttcacggtcaatggaagcaccatgatcttaaggtcaaagactctaaaaccctcctcttcggcgaaaaacccgtcactgttttcggaatcaggaaccctgaggagattgcatggtctgaagccggagctgagttcgttgtcgagtcaactggagtgttcactgacaa

SEQ ID NO: 23772 - DNA, 430 bp, Gossypium hirsutum
  Clone ID: LIB3272-029-P1-K1-G2
aaccccttccgcttcgccatggcatgagagaagaagctgtcgaacccaatgagggagatcaaagtccagaaacttgtcctcaacatctccgtcggtgagagcggcgatcgacttacacgtgccgccaaggtcttggaacagctcagtggtcaaaccccagtcttctccaaggctagatacactgtgagatcttttggaattcggcgtaatgagaagattgcttgttatgtgactgtgaggggggagaaagctattcatcttcttgagagtggtttgaaggttaaagaatatgatcttttgaggaggaacttcagtgatactggctgctttggattcggtatccaagagcacattgatcttggtatcaagtatgacccttcaactggtatctatggtatggacttctatgttgttctcgaacgagctgggt

SEQ ID NO: 23773 - DNA, 412 bp, Gossypium hirsutum
  Clone ID: LIB3272-029-P1-K1-G5
aatgtctctttacccttctctcaccatgtcattgctgtctttttccttcttgttgctgtttgcttttagtgccaaagctgttgttcctccatctgaaacttttaggtttgtcaacgaaggggaatttgggccttttattgttgaatatggtgcagattaccgtgtcataagcatagctaatgcccccttccagcttgcgttttataacaccacgcctaatgccttcacccttgcgttacgcatggctacaacacgttccgagtcgctcttccgatgggtttgggaggccaacagggggaaccctgttcgcgagaacgccacgttctctctcgggactgacgggaaccttgtcttggctgatgccgatggtcggattgcttggcaaagtaacactgccaacaaagctgtggta

SEQ ID NO: 23774 - DNA, 434 bp, Gossypium hirsutum
  Clone ID: LIB3272-029-P1-K1-G6
gacctggaatcggagggctccaaacagctgcagctgctagggatcaatatcgagcgttgggagaaaatgtagccaagttaagaaccgacctcatgaaagagcagcttgctatttttcgttctcaactcgaagaattcgctcgaaaacacaagaatgatattcgtaaaaatccgtcttttaggtctcaatttcacgaaatgtgtgcaaaagtaggagtggatcctttggcttcaaataagggattttgggctgagcttttaggaatcggtgatttctattacgaacttggagttcaaattgttgagatttgcttggcaactaggcctcttaatggaggtttgattgacctgcaagaactctgcaaattgcttcgtcagaaacgaaaacatgatcgcgaagctgtatccgaagatgattgtttgcgtgctataagt

SEQ ID NO: 23775 - DNA, 428 bp, Gossypium hirsutum
  Clone ID: LIB3272-029-P1-K1-G7
ctctcaacgctatctttttgttccttttccaagggagagtgtgatctgttcgtcttcacttcatttcactaacccatggctctttccgtcgagaaaaccgccgccggccgcgagtgcaaggtcaaggacatgtctcaggctgacttcggtcgtctcgagatcgagttggccgaggtcgaaatgcccggtctcatggcttgccgagccgagttcggccctgcccaacctttcaagggagccaaaatcaccggttctcttcacatgaccatccagaccgctgtcctcatcgaaaccctcaccgccctcggagctgaagtccgttggtgctcttgcaatatcttctctacccaagaccatgccgccgccgccattgcccgtgactcggcagccgtgttcgcctggaaaggtgagaccctccaggaatactg

SEQ ID NO: 23776 - DNA, 428 bp, Gossypium hirsutum
  Clone ID: LIB3272-029-P1-K1-G8
agcgaaaccctagccactctctgctcaactcgccaatgggggcttataagtacgtgtcggagctatggaggaagaagcagtcggatgtgatgaggtttttacagagggtgaggtgctgggaatacggccagcatccatcaattgttagggtcaaccatcctactcgccctgacaaggcacgccgcttgggttataaggccaaacaaggttatgtggtttaccgtgtccgtgttaggaggggtggtcgcaagaggcctgttcccaagggtatcgtgtatggtaagcccacaaaccagggtgtcacccaattgaagttccagcgcagcaaacggtctgttgctgaggagcgtgctggccgaaagttgggaggtctcagagttgttaactcgtactggatcaatgaggattctacttacaagtactttgag

SEQ ID NO: 23777 - DNA, 409 bp, Gossypium hirsutum
  Clone ID: LIB3272-029-P1-K1-G9
ggctcaatcatatactttttctgttaaaatttctacaattagctcttgagtaggcgatggctctaaagcggatcttgcaggatcttaaggatctacagaaagatcctcctacctgttgcagtgcaggccctgttgctgaaaacatgtttgattggcaagctactattattggtccacctgacagttcatattccgggggagtgcttctaagtaccattcatttccctccggactatacatttaagccacccaaggttgcattcaagacaaaggtctttcaccctaatattaacaacaatggcagcctttgcctcgatcttttgaaggaacagtggagccctgccctcaccatatgcaaggtgttgctctcaatctgatcacttttgacggacccaaatcccgatgatcc

SEQ ID NO: 23778 - DNA, 434 bp, Gossypium hirsutum
  Clone ID: LIB3272-029-P1-K1-H1
ccctcttcgaattatccctcaccaaaaaatattcaaacgacgaccaccgtccaccggcgcctaagaggaaagagccgtttaaataaaatatggacacaattcttcataccgaacctctatctctcactcgcttacgcgccacttcgaattccaccgcttccattcaccatatgccttgccagctcatcttcgcgcctttccaccgcctttcctttcctttatccaccgtcaacgccggctccagttctcgcaggtcatccacttttgttgtcgccgcttgcggcactctcaccgccaattccgtctcgccaagaggtggagtatatacagttggggatttcatgacgagaaaagaggatttgcatgttgtaaagccaacaacaactgttgatgaagcactggaagctcttgttgaacacagaatcaccggtttt

SEQ ID NO: 23779 - DNA, 429 bp, Gossypium hirsutum
  Clone ID: LIB3272-029-P1-K1-H10
gagaaatacacaagaaaaaaaaacaagtgatctgataaattgaagactttatttctgttaacatccattatgagtactgctggtcaagtcatccgttgcaaagctgcggtagcatgggagtcggggaagccactgtcaatagaggaagtggaagtggcaccaccgcagaaggatgaagtccgtattaagatactcttcacttctttatgtcacaccgatgtctacttctgggatgctaagggacaaaaccctctgtttcctcgcatactaggtcatgaagctggagggattgtggagagtgtaagtgagggggtgactgatctaaagccaggtgatcatgttctccccatcttcacgggggaatgcaaggagtgtccccattgcttgtcagaagaaagtaacatgtgtgatctccttaaaatcaacact

SEQ ID NO: 23780 - DNA, 430 bp, Gossypium hirsutum
  Clone ID: LIB3272-029-P1-K1-H11
gagaaatacacatgaaaaaaaaacaagtgatctgataaattgaagactgtgggtctgttaacatccattatgagtactgctggtcaagtcatccgaggcaaagctgcggttgcatgggagtcggcgaagccactgtcaatagaggaaggggaagtggcaccaccgcagaaggatgacgtccgtattaagatactcttcacttctttatgtcacaccgatgtctacttctgggatgctaagggacaaaaccctttgtgtactcgcatactaagtcatgaagctggagggattgtggagagtgtaggtgagggggtgactgatctaaagccaggagatgatgttctccccatcttcacggaggaatgcaaggagtgtccccattgcttgacataagaaaggcacatgtgtgatctccttataatcaacactg

SEQ ID NO: 23781 - DNA, 358 bp, Gossypium hirsutum
  Clone ID: LIB3272-029-P1-K1-H12
ggcggcttctgcttatatttacaatcttctcactctcctgctcctttctggcatcccttttaccttctccgagctcgttaaagagcagcctctggtgttgaaataccacaatgggccactcttgaaggggaagatcactgttaatctcatttggtacgggaagttctccccaacccaacgctccataatcgtcgatttcatcaactctttgagctccgacgtcaaacccaaagttccgtcggcgtcgttttggtggaaaacgacggagaaatacaagtccggatcctccactgtggtcgtgggcaaacaaatcctcctcgaaaattacccgctcggtaaaatccttaagaacccacac

SEQ ID NO: 23782 - DNA, 421 bp, Gossypium hirsutum
  Clone ID: LIB3272-029-P1-K1-H2
gtagagatgaggaaaatcatgggtgccaaagttcttttcttctttgctttgctttgcttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgttctgtctgctagggaaggca

SEQ ID NO: 23783 - DNA, 431 bp, Gossypium hirsutum
  unsure (1)..(431): unsure at all n locations
  Clone ID: LIB3272-029-P1-K1-H3
tggaatcagtacccaaggtttcgccgactccaaccctaggcaccggcggccggcacaacggtgatcaagcggcggctaaaacctggtgcggcagcgcctttcagatgccgctgcattacccaaggtacaccgaagctgattacgaagccatgcctgagtggaaagttgattgtttgcttaaagaatacggactacccatcaccggcgacgttgagcagaagagaagcttcgccatgggagcttttctgtggcctcgttagctacaattaatgttgttttatgggtcccaattttcttcctttttttttttttttaaattatgaagtctgaaagggcattngagttatgatcttttgtttgcttcattgccaagtgattatgaaaatatggtaattttgagctatttgtattttaaatattaaataaaattt

SEQ ID NO: 23784 - DNA, 424 bp, Gossypium hirsutum
  Clone ID: LIB3272-029-P1-K1-H4
gtgctttaaagtgtatggatacataagtatgaaacaagggattacctttttgcaagacttcaaactcggtcactacatgaagattcctcctagatccatgttcatagctcaggttggtggtacaataatagctgcattagcgcatttgacaacagcgtggtggcttatggttacagttccagacatatgcgacagagaaatgcttccaacggacagcccctggacttgtcctggtgattgtgttttacgatgcctctgttatctggggtctgattggacctcgaagaatctttggtgatcttggctattactctgccataaactggtttttcttagttggggccatagctcctgtccttgtttggcttgcatctaaggccttcccaaacaagccatggataaaacttattactatgcctgtgct

SEQ ID NO: 23785 - DNA, 153 bp, Gossypium hirsutum
  Clone ID: LIB3272-029-P1-K1-H6
ataaatctgttaaacccctttctttctctattccaagaccagttcaagggcacattaaccctatcttattatttgccaaactccttcactttcatggcttccatatcactttcatccataccgagttcaactactatcgcttgacttcaggtg

SEQ ID NO: 23786 - DNA, 425 bp, Gossypium hirsutum
  Clone ID: LIB3272-029-P1-K1-H7
ttcactccctagaataattttctctttctcacttccaccaacgaaaaagtcgtcgatcggatcacgtattagattgatattgtaaagatgtctccaactgaatcatcacgagaggaaaatgtttacatggccaagctggctgagcaggctgaacgctatgaggaaatggtggagttcatggaggaagttgcaaaaactgttgatgttgaggagctgactgttgaggaacggaaccttctctcagtggcttacaaaaatgtgattggggcaaggagggcgtcttggaggatcatctcttccattgagcagaaggaagagagcagaggaaatgaggatcatgttgcacaactaaaggagtataggggtaagattgaagctgagcttagcaagatctgtgatgggattttgagccttcttgaatctca

SEQ ID NO: 23787 - DNA, 430 bp, Gossypium hirsutum
  Clone ID: LIB3272-029-P1-K1-H8
cccatttcacttcctttctctttttagatcaacacccaagaaaaaaaaacacagttcgaatttacaaaaatcatggtgaagtctcaaaggccgccatctggccgtacaaatctggcatcatgtattgtagcaaccattttcttgatctttcttgtaatcattgttctcattgtttatttcaccgtttttaaacccaaagaccctaagatttacgttaattccatccagctcccttctttttccgtcggcaacaactccgtcagcttcactttctctcaatacgtcaccgttaacaaccctaacagagccactttttctcactacgacagcactattcagctcctttactccggatctcaagtcgggttcatgttcatacccgccgggaagatcgagtcgggtcagactcaatacatggccgccacttttg

SEQ ID NO: 23788 - DNA, 423 bp, Gossypium hirsutum
  Clone ID: LIB3272-029-P1-K1-H9
ggcgtcgtttcgtgtatcccgaatcgtcgcagccattgtgatcggagttctcctcggctgtgtcatcgctttccttttcccttacggcctcttcaatcccgccgcctcagttcaaaatcgtcgaatcgggaaaacgaatttccagattggttcttcgtcatgtgaatcctcggagcggagtaagatgctgaagtctgaaatcgtatccctatcagagaagaactccgaattaaagatgcaagtcagggatttgacggaaaggctgcaactggccgaacaaggaaaagatcaagctcagaagcagtttttggtgttgggtgagcagcataaagctggacctttcggtactgtcaaagctttacgaactaacccaactgttgttcccgacgattccgtgaacccaaggttggctaagatcttgga

SEQ ID NO: 23789 - DNA, 425 bp, Gossypium hirsutum
  Clone ID: LIB3272-030-P1-K1-A1
tttagaagaaaaaaaatggagagaaaatctcaagccaaaccaattctcttcttctttgttttagtttcggcactaatcgaaacttcctacgccggtgacatcgccatctattggggccaaaatggtaacgagggtaccctgagtgatacatgtgccaccggcagatataaatacgttaacataggtttccttaacaccttcggcaatggtgccactcctggactcaacttggccggtcactgtaatccagcatccaacggttgcacctctcttagcggtgaaataaaaagttgtcaaaaccaaggaatcaaggtcatgctctcccttggaggtggcgcgggaagctactcactcgcttctcaagaagacgccaaaagcgtagctgattatctatggaacaacttcttgggcggtacctcgtcttc

SEQ ID NO: 23790 - DNA, 409 bp, Gossypium hirsutum
  Clone ID: LIB3272-030-P1-K1-A10
agtacattgagcagcttggccggtataagaagctctcctaccgtgttgtgttcccactcgagctgaaactgagcaatactgtggaagatgcagattctgagtattctctatttgctgtagttgttcacgttggaagtggacctaaccatgggcactatgttagcctggtgaaaagccataaccactggttattttttgatgacgaaaatgtggagatgattgatgagtctgcagttcagacatttttcgggtctgcccaggagtactcaagtaatacagatcatgggtatatcttattttatgaaagcctttgtgcaaacaagagctgagaaaagagggcttcgattttaccatgagtacaggtatccatttccccaaatctcaattttcttgaaccacctatgctttt

SEQ ID NO: 23791 - DNA, 384 bp, Gossypium hirsutum
  Clone ID: LIB3272-030-P1-K1-A11
gtaaaaggccatggatgggaatggaagagttcacccagattgtcctaatgctgcaaatccctaccatgaatgtggtggactctgcttagagaagattgctgaaggcaaaggaccaaaggcaaaagaaactaaaaagtcattaagttcaaaatttcttgatgcttccagaagctttggccggaaaaagaagggatccgactctctgctgagatcccctaaagcactcgagactacccctgcaataggtgcagtttatcctggtggccctaggtcaccttgttctcatttttctagaaagaaaatggaagcagaaaacggtgagtcgtattcatcttccgagcaacactctggcgagatatattcccaagatcaatcattcgagaa

SEQ ID NO: 23792 - DNA, 405 bp, Gossypium hirsutum
  Clone ID: LIB3272-030-P1-K1-A12
gggagttagtggtgaaggacatccaagatgcctgcaaactttttgagccaatctatgaccaaacagatggaggtgatggttatgtttctgttgaggtttctcccagacttgctgatgatactaatgggaccattgaggcagccaaatatcttcataaagtggttgatcgtcccaatgtgtacattaagatccctgcaacagcaccatgcattccttcaatcaaggaagttattgcgaatggcataagtgtgaatgtcactctcatattttcgcttgctagatacgaggctgttattgatgcttacttggacggccttgaggcttctgggttgagtgatctctccagggttactagtgtagctttcttctttgtcagtagggtagataccctcattgacaaaatgc

SEQ ID NO: 23793 - DNA, 417 bp, Gossypium hirsutum
  Clone ID: LIB3272-030-P1-K1-A2
ccacgcgtccggtagcttctcgttctttcctctcttcttcttctgttccattcacttttcctttgtaatttttttttcctttcgctcatttttgtattctatttccccttatctgtttccgcaatcatcataaaatttgaactttctagaatttaacaatcagatttctcatctctggtgaacgaagcaaacaccttctttaaggaattattaattgttgtctctgatggctccgccgccggtggagcaaaacggagatgcaacgacgggtacggcggaatcacaaaggtctatacctacaccgttcttgactaaaacgtatcaattggttgatgatcacacgattgacgacgtgatttcgtggaacgacgacggatctacttttatcgtttggaatcccacggggtttgctcgtga

SEQ ID NO: 23794 - DNA, 422 bp, Gossypium hirsutum
  Clone ID: LIB3272-030-P1-K1-A3
gcaaactcgtgccgattcaaatcttctcccatcgggtaagtggactgcgcttgcaacaagcgcagtttttgctattctatgtgcttatgagttccccgatctgtgaatatgctgaaaaataatctcttgaaaacacctttttctgttctggatgtcattgataatggctccaatcactgatttatccggtgaagtcgtttgggatttcttaataattgttttagagtctcccatgattgttgccgattgtaaacctagtgaaatccctaattttataccctctaaacatgcatgtgcttctgctgcaaatgaggaggaaatattgttgtgaatgatggactttaaggccatgagattccccgtcatatcgcgaaccaccagacccgtcgcagatgtgaagctactactatcaaatgctccat

SEQ ID NO: 23795 - DNA, 386 bp, Gossypium hirsutum
  Clone ID: LIB3272-030-P1-K1-A5
gggagattcaaacagaggaagaagaagaagagaaaaaaaaaatgaagtctcagatctgtttagcctttggaactttggccttgttattagcttcagctttggccgatgacgtcgtcgtactgaccgaagcgaacttcgataaggaagttggtcaagatagaggagttctcatcgagttctatgctccttggtgtggacactgtaagaagctagctcctgagtacgagaagctcggggcaacttttaagaaggctaaatccgtcttgattggaaaggtggattgtgatgaacataagagtttatgcagcaaatatggtgttcaaggctacccaactgttcagtggtttcctaaaggctctttggaacctaaaaagtatgaaggacca

SEQ ID NO: 23796 - DNA, 407 bp, Gossypium hirsutum
  unsure (1)..(407): unsure at all n locations
  Clone ID: LIB3272-030-P1-K1-A6
aaaccataccagacctctccaaagcctgagttcttcggagaaaatatgtaccatttttctttaaaaacaccatcaccaaactcagaatggtaacacaactcctttaacattccaaaacccttctatgatcgttgacaatgataggctctacttccgatgatacctcttccatccagtagattaggtcagatagattgtgtcctcgtcctactaaggcatgtgttgcttcatatgtattttgagggggcatcaccttccacaaccagatctagaaagcccatttcttccccgaaaataataacttcaagacaagccttcgcttctgctgtaatcggatccccagttcttcctagtggtgccactaagcttgtatcggngattaagagacgtcggaggcatcgatcaca

SEQ ID NO: 23797 - DNA, 426 bp, Gossypium hirsutum
  Clone ID: LIB3272-030-P1-K1-A7
attagggttccttcattattctctttaggaaattttaattttcaacttgttttcgtttattctcttcgattttgggttaaaccctagaaggctcctcgcgaaagtgtcagatggcaactttagctgattcattccttgcggaccttgatgaattatcagacaacgaagccgatgttctggaggaagaaaataatgatgttgcaaacatggaagaagatattgatggtgacctcgcggatatcgaaacgcttaactacgatgatctggacagtgtttccaaattgcaaaaaagtcagagatacattgatataatgcagaaagtggaagatgcgctcgagaagggttctgatatatcaaatcagggcttggtactggaagatgatcctgagtatcagctgattgtggactgtaatggactatcagttg

SEQ ID NO: 23798 - DNA, 196 bp, Gossypium hirsutum
  Clone ID: LIB3272-030-P1-K1-A8
gaagaactaattaacgattcggcagacgtttgccaccctcatcatcatcgtgctatgcatttccgccgatgcatcaagctttgaaatccgcaacgagttccagttcactttctgtgcggtaacctgttctggatgcggccgtcttctagacattgggcacactcggaccactgttttgcctgctcgctctgcatac

SEQ ID NO: 23799 - DNA, 323 bp, Gossypium hirsutum
  Clone ID: LIB3272-030-P1-K1-A9
gtaacagtcaatattgagagagagtgagaaagatgggagagacagacaaagacagggaacaggctgagcatggatggatctaccaactgattctgttgtttctccgcccatgcactgcctcttccctggctctgcctcctccatttttttcttcctttttttttatttaaacttttcaacctaatccaatttgggaattataataatgactgtatttaaatcccaggtcaatgataggtccctttaaccagggtattggggggacctttggtgaaccccaattggcccaagctttttttcctcaatttccctctaatcctttc

SEQ ID NO: 23800 - DNA, 421 bp, Gossypium hirsutum
  Clone ID: LIB3272-030-P1-K1-B1
ctattacgtggagagccttttttttgtgtagcgattctcagttagtcgtttctttaagcttacagcttctctccagagttttataatgggtaaggagaaggttcacatcaaccttgttgtcattggccatgtcgactctggcaagtcgaccactactggtcatttgatctacaagctaggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactttatcaagaacatgattaccggtaccttacaggctgactgtgct

SEQ ID NO: 23801 - DNA, 345 bp, Gossypium hirsutum
  Clone ID: LIB3272-030-P1-K1-B10
gttttctgctctgtttttcagtgacaagtttcaatggcaaaaccagtttccattgtagtgtggaacccaaatgggaaatacagagttattagcaccaaacctatgcctggaactcgatggatcaaccttttaatggagcaagattggcgtgtcgaaatatgtactgagaagaaaacgatttggcccgttgaggatatcatttctttgattggcaataagtgcgatggggtgattggacagtcgactgaagactggggggagactttatttgcagctttaagcagagcatgaggcaaagcattcagtcacatggctgttggttacaacaattgtgatgttaatgct

SEQ ID NO: 23802 - DNA, 359 bp, Gossypium hirsutum
  Clone ID: LIB3272-030-P1-K1-B11
aaaaactggtaacaatggccatatccgtccctattttagccatcatctttgctctggatctcatcgccttcgtcttcgccgtcggcgccgaacgacgccgtagcttcgctgaggtggtgcctgatcagtacgacgagaggacctactgcctctacagtacggatgcgtcgacggtgtacggactatctgcttttggtctgctccttcttagccaggttgttgttaacggcgttactagatgtctctgctttggcaaaggccttgtctccgccacttcatccaccacttgcgccatctttttcttcgttttctcctggttaagctttttgggagctgaagcatgtttactggcgggatca

SEQ ID NO: 23803 - DNA, 296 bp, Gossypium hirsutum
  Clone ID: LIB3272-030-P1-K1-B12
ccgatcatggcggtccaattgactgtgttagctgacggggtttttattgggtgctcagctaaccatgcggtgactgacggtacgtcgtacccggaactctttcaatacttcagctgaaactcgccggaaagtctgtcataacaatgaccagagcgtggaaaaaatttcccggcggtcggatctttcacgggaatcggttctgatttcaactgcagctttgcgtgtaccgacaggagtacccttagcttctttatacgaaaacgagccatctcgtgagagaattggcaggtttagca

SEQ ID NO: 23804 - DNA, 312 bp, Gossypium hirsutum
  Clone ID: LIB3272-030-P1-K1-B2
ttggcttccctcccaaatgtcttcttcgacattaaccgtactcttcgtcctgcttggaactctctgttcctttatctacttcttcagctcaccaaaccgcaacaacaatggccggaaacttccacccggtcctgcccctcttcccgtcgtaggtaacatccacatgctaggcaacctcccacaccaaagtcttcactatctcgccaaaaaatatggacccatcatgtcgataatgctaggcaaagtaccaaccatcgtggtatcatcacccgaagccgctgaactgttcctcaaggtccatgacgtcgtttt

SEQ ID NO: 23805 - DNA, 418 bp, Gossypium hirsutum
  Clone ID: LIB3272-030-P1-K1-B3
aaaaaacttaaaattctctctgaaatgagaggagagagagagagagcttggctccggtctccgtcgagccgagcctcggtcctcggcttcacgcgcccatgcgccgtcaccgactcctccccgttcggtggccgaagacccgaaacctcgatttttctacgcaaataaagggttcgacctttttcttttcattatttacagtatataagtacatatatgtaaaatattttacctttgagtatctcaattaactgtagtatcctactttgtgtacgtatgtaaaaataagatttttattgcatctatgtatgtatttcagaaacctcaaaatcatccctttacatcctctcaatttgggctttttatagccactgaaaaagaaaaagaaagaatctttacaatctttggtttatttctt

SEQ ID NO: 23806 - DNA, 145 bp, Gossypium hirsutum
  unsure (1)..(145): unsure at all n locations
  Clone ID: LIB3272-030-P1-K1-B4
tggtgntaggtggggaaggacatccaagatgcctgcaaactttttgagccaaggtatgaccaaacagatggaggggatggtcatgtttctgttgaggaaacttatacccgggacgcggtttttcaaccttccaatggagcaacca

SEQ ID NO: 23807 - DNA, 365 bp, Gossypium hirsutum
  Clone ID: LIB3272-030-P1-K1-B5
atttattcgacgccatatcttccgtcaacccaaaggcttctttaaactccggtgagaaccatacgcggacgtccggttcacgtggttgctgaaccagctgcgaggtatgggacgaggcctgctatgaagcggatttgtgcctgtcccggcaacgcgagaacgaggagtggattaaagggttgaggcggctgatacttgagagccctgggcttgctttcgatgaatgcgaatccagttggctggtctgagctgaggtggatcgcatggataatgaatatagataccctgatggacaaaacggctattcgggctgggattggaaccggaaggccgacctttgtagccatccaagctgacaaggatgc

SEQ ID NO: 23808 - DNA, 408 bp, Gossypium hirsutum
  Clone ID: LIB3272-030-P1-K1-B6
tttacattagtatcggctgtaatttgcctgggattcctcatccaacatttgctagagatccagtgcccttctttctcgctccaaaggtaagcaatgaattaggattagaagcagctgtggaagctactgccaattttctgaacaaagctgtgaagcctgtccttgtgggtggacctaaattaagggttgcaaatgcaaaagatgcctttgtggagcttgcagatgcctgtgggtatcccattgccgtaatgccttcgggcaaaggattggtacctgaacaccatccacactttattggaacatactggggtgcggttagtactagcttttgtggggaaatagtggaatctgctgatgcctatgtttttattggcccaatcttcaatgattatagctctgtaggctact

SEQ ID NO: 23809 - DNA, 300 bp, Gossypium hirsutum
  Clone ID: LIB3272-030-P1-K1-B7
tcggtaaaccctattttgttacgctatcttttgcagctgtagatgcagaccaaggcgcggacatatacaggtgaatactatctaccgtagaggatgacaaggaaaggctcatgaaaatggctggtgcagtccgcactgctgggaagggttgcatgcgaaggaagaagacggcttttctcacgacaagcacctccggcgacaaacgattgcagagcgctcctaaatgaataggagtgacagctattcactgcaatgcgacgaagttaagcgatgtcctgatgatagtaggtatccagacct

SEQ ID NO: 23810 - DNA, 418 bp, Gossypium hirsutum
  Clone ID: LIB3272-030-P1-K1-B8
gttcaatggtgtatactaagtggaaaaagccattatcctgaagatctgccattactttcaagtgcagctgcaatatttcaagaatgctttgatcccattgttgcaaagtctggttgtgatttgattcctgcgatggtctatgggagaagtatatctgggcaagagtttggtggaatgtattgtgtggttttgattgtcaggtctgttgttgtatcagctggtcttcttaggatatttggtcgggagattgctgaactccctatggtagcgacaactagagaacatcaaggaaaaggatatttccaggcattatttgcttgtattgagaggtttttaagttcactaaatgtggaaagcctcatgcttcctgcagctgaggaagcttttgtcaattggacagagaagtttgggtttacaa

SEQ ID NO: 23811 - DNA, 419 bp, Gossypium hirsutum
  Clone ID: LIB3272-030-P1-K1-B9
agaagctgtagaaagggaatgtcctggagttgtttcttgtgctgatatccttgttctgtctgctagggaaggcatcgtttcgttgggaggcccttatattcctctcaaaactggaagaagagacggtagaaggagcagagcagatgttgtggaggagtatcttccggaccacaatgagaccatctctggcgttcttgacaggtttgccgccatgggtattgacacccctggagtcgttgccctcctaggagctcacagtgtcggcagaactcactgtgtgaagctggtgcatcgtttgtacccagaggttgaccctgccctcaaccccgaccatgttccacacatactccataaatgccctgatcagatcccagaccccaaggccgtccagtatgtgagaaacgaccgtgggagacata

SEQ ID NO: 23812 - DNA, 404 bp, Gossypium hirsutum
  Clone ID: LIB3272-030-P1-K1-C1
gagagatcgaagatcagatattgaagcccctataatgggtgacgtccagacagcggagagcagtaacagagctaggctagccattatggagctggccaacatgataagcgtccccatgtctctcaacgccatcgtccgcctcaacgtacccgatgctatctggcaaggaggcgccaacaccccactctccgtcgaccagattctctcacgggtactcccttccggcggcggagaccctgaaaacctccagcgtatcctccgtatgctcaccagctacggcgttttcgatgaacaccttaattacagcggtgatgactcccactcccctgagagaaaatactccctcactgacatcggaaaaacactcgtaacagacgctgagggtctaccctatgcaccatatg

SEQ ID NO: 23813 - DNA, 312 bp, Gossypium hirsutum
  Clone ID: LIB3272-030-P1-K1-C11
gttttccttcaaaaccctaatagctgtcctctcctcctgaacgtgttcgaaaatggctggttctgagggattgattctacgtggcaccatgcgtgcccacaccgacatggtgacagccattgctactcccatcgataactccgacatgatcgtcacttcctcccgcgacaaatccatcatcctttggcacttaaccaaggacgaaaggacctacggtgtccctcgtcgtcgtcttaccgggcaactctcacttcgtgcaaaacgttgtcctctcttccgattctcagttcgctctctctgattcctgggatg

SEQ ID NO: 23814 - DNA, 408 bp, Gossypium hirsutum
  Clone ID: LIB3272-030-P1-K1-C12
cagctaagtctcccaattcagcacgaaaagttgttgtccatttgagagcaactggggatgcccccatactaaaacaagccaaattcaagttgttgtccatttgagagcaactggggatgcccccatactaaaacaagccaaattcaagatacttggaactgacaaatttgctaaagtaattgattttttgcgtcggcaattgcaccgagatacactgtttgtgtatgtaaacagtgccttctcaccaaacccagatgaattggtgattgatctgtatgataattttggttttgatggcaaactggtggttaattatgcctgttctatggcatggggctaactcttgatgatggatcttcagagagatgagataaaaactggcaactctgtaactgtttcctacaattc

SEQ ID NO: 23815 - DNA, 365 bp, Gossypium hirsutum
  Clone ID: LIB3272-030-P1-K1-C2
aaaaaattatttgataaaaaagtagcttctttttattgggaattctggatattctttctcaagtttgctgagagagaaagaaatggcacaacgatctcatgtacccaagtttggcaattgggagggtgaagaagatgttccttacacagcttattttgacaaggctcgtaagggccgaaccggagggaagattgtgaatccgaatgatccccaagagaatccagacttgcgtcgtgattatgtggctccaaataaagctcctccggcgtcgagaacgaatccggaagcaaatgaactggtaggagatggacctgttagaaggggacatgagtgtggaaagagcaaggatgaagttgactttaaac

SEQ ID NO: 23816 - DNA, 395 bp, Gossypium hirsutum
  Clone ID: LIB3272-030-P1-K1-C3
aaaaccctaagccctgcctttccctttctcaatcatccaaagacagagctgaaactctccgagagccgagacctgacccgaatcgaacgcataggggctcattcccacatacggagcctaggcctggactcctctttggagccccgggacgtctcggaaggaatggtgggccaagcacaagctcgtaaagccgacggtgtcatccttcaaatgatcaaagacggtaaaattgctggccgagctatcttattagcgggacaacctggaactggcaaaactgccattgccatgggcatggcgaaatctcttggccttgaaacccctttctcgatgctgtctggcagcgaaatcttctgccttgagatgtcgaaaaccgaagctttaatgcaagcgtt

SEQ ID NO: 23817 - DNA, 407 bp, Gossypium hirsutum
  Clone ID: LIB3272-030-P1-K1-C6
ccaaaataaaacccccactaaactctttcaaattcagtcacccaaataaacaacaatggctacttcatcatcttcttcaaagctttcccttttcttcttgttttccttcttgtttgcttccactttagctcgtaattccccttcaccaacaacaaaaatcctcgatgtcttagcttctttgaaacaagctcagcatattctttcctttgatcctcaaatttctaatggtttttccaaaagccaaccccttttcgtcaactcttcttcttcatcgggttctggtttttcgattccacttcattcacggggctctttgcgaaaaacccatcatgttgattataaaaacctggtccgatcccgactcgaccgtgattcatcccgagttaacacgctcaccaccgaggtac

SEQ ID NO: 23818 - DNA, 405 bp, Gossypium hirsutum
  Clone ID: LIB3272-030-P1-K1-C7
gtggaattccattcaacaaggcctatggtatgactgcatttgagtaccatggcactgatcctagattcaacaaggttttcaacaggggaatgtctgatcactctaccatcaccatgaagaagattctcgatacatatgatggtttccaagggctaaaaacattggtcgatgttggcggtggtaccggtgccacgcttagcatgatcgtctctaagtaccccaccataaaaggcattaactttgatttgcctcatgtcattgaggatgctcctagctgtcctggtgtggagcatgttggtggagacatgtttgtaagtgtaccaaaaggagatgccattttcatgaagtggatatgtcatgattggagcgacgaacactgcgccaagtttttgaagaactgctatg

SEQ ID NO: 23819 - DNA, 373 bp, Gossypium hirsutum
  Clone ID: LIB3272-030-P1-K1-C8
cccagctcctaatcctgttgttgccaaaccaaagccggcgccaaaacccaaattcactccaacccctggtatattctttgcttctcttttaaatgatttccccataaacattgttggacctactcttaggaattaggacacaatctgctattgatgaaggaacatttggttctgtttctcattatagtagctattaaatttcaagatctgatagtgggggaattttttgtttatttggcagctacatcgtctaatccaattaccatagagcagatgatgacaactttctggtatgccaagggaaaaacctactactggtattccacaattgtgaccaacaaggcttacaagacactgaaggatctcaagcttt

SEQ ID NO: 23820 - DNA, 392 bp, Gossypium hirsutum
  Clone ID: LIB3272-030-P1-K1-C9
ctaaaccaccaaaacatccaccgcatcctcccaagccacctgttgtaaagcctgccgatgtacctaagccacctattgtaaagcctccaccgtatacacccaaaccgccggttgtgaagcctccgccatatacacccaaaccgccggttgtgaagcctccgccatatacacccaaaccgccggttgtgaagcctgcgccatatacacccaaaccgccggttgtgaagcctccgccatatgcacccaaactgccggttgtgaagcctccgccatatacacccaagccaccttactatccaataccgccggtcatctcaccaccaacactgtctgcaaagccaccagtctaccccagtccaccaatagtgaaccctccaccatatacacccaaa

SEQ ID NO: 23821 - DNA, 399 bp, Gossypium hirsutum
  Clone ID: LIB3272-030-P1-K1-D1
ctagtctgttctctcccttattttcttgttcagttaatagtaccttttgttgttgttgtttttttagctaaactagttattctcagttcaagttcagctttgaatttcagcacagaaccagaaaaaaaaaaaacacccaaggctggttttttattttttattttatgatttacagtcaattattttgctatttagtttgtttctagatttgggtttttgttttttggacaattgtactgaatagtaggtgaatatagtggaaaatcttgttgatttattttttcttttgagaagtttgattatatatagcttataattatcattttgggttacttttatccgagttatttgtgtatttttggttgactcagtggacgaaattgaaagagtggaaaaagt

SEQ ID NO: 23822 - DNA, 392 bp, Gossypium hirsutum
  unsure (1)..(392): unsure at all n locations
  Clone ID: LIB3272-030-P1-K1-D10
acaaaaacgccttcttcaaactagttccatgtgccagcgccagcttagcaagatacttgatgattcagaccttagcagcatcattgatggttacttggatcttgaaatgattgaattcaccttgaatgatgtactgattgcttctatcagtcaagtgatgatgaagagcactgggaaaggcatccgaatactgaatgagacagcagaagaagtcatggaggagaccttgtatggagatggcgttagacttcaacaagtcttagctgatttcttgttggtatcagttaattntgcaccaaagggaaaccaacttagtgttggagctagcttaaccaaggatcaactaggacggtccgttcatcttgcacgtttgaaccttaagataacacatg

SEQ ID NO: 23823 - DNA, 296 bp, Gossypium hirsutum
  Clone ID: LIB3272-030-P1-K1-D11
aaaaaaggcaactagacttgagaaagaaaaacagtctcaaactgcagcagaagtcaggcttcctgatcctcttgctctccctcattttccttgctctaatcttctccgacgccagaaaggaggctcccctcggaggatggagtccgatcaaagacaccaaggacccacacgtgataaagatcgcggaattcgccgtcgaggagtataacaagcagtcaaatgggagtttaaagttcgttaaagcggggaaaggcgagacccatgtggtggccgggacaaactaccggttgattttg

SEQ ID NO: 23824 - DNA, 363 bp, Gossypium hirsutum
  Clone ID: LIB3272-030-P1-K1-D12
cccgaccttcctctctgcttatcttcttcttttatgccttgtctgctctttgaaggaggggtatgccttgggacgaagagcaactgttgcagagagtcaccaccttgagcacagccataccatccaagtcagctctcttctaccctcctctatttgcagccttgcaaccaaagtattagacaaaaagtcatctttacaagttgtccacaagcatggtccatgctctcaactctatcatcacgataaagcaaatatccccactcacgccgagatcctccttcaagatgtaacccgggtcaagtccatccactcaaaacttgccaagagcctaagctctaccaaagtcgaccagactgatgcagc

SEQ ID NO: 23825 - DNA, 401 bp, Gossypium hirsutum
  Clone ID: LIB3272-030-P1-K1-D2
gagagagagagagagagagcatttcaatcaccgtgatggcggcggcggctcatatagatatagagccagcaatacccgaagaagaaacgacgtcgaattcccttatacgaaacactcgttgctgcttctgtttcccttgcttcagctcccgtcgtacgcctgccgttggcgtagccttttggcagcggataggttcgtcccacgtccagtccgatactggcttctggtcctcaagtgttagagccttcaagaaggttcgagagtggtccgagatcgtcgccggcccccgctggaagacttttatcaggagattcaaccgtagcaaaagtgggggcggaatcgtctccggcggtaggcatggacaattccattatgatcctttgagttacgctttgaatttc

SEQ ID NO: 23826 - DNA, 377 bp, Gossypium hirsutum
  Clone ID: LIB3272-030-P1-K1-D5
ggaaggtgtccttagttcgagccatattttatatggctgctcaatgtttgggagccatatgtggatgtgggctagtgaaggcattccaaaagtcatattacaacaagtatggaggaggagccaacagcctcgctgatggatacagcactggaactggtttcgcagctgaaatcattggtacctttgttcttgtctacactgtcttctctgcaactgatcccaagaggaatgcaagagattctcatatccctgtcttggcaccacttgctattggatttgctgcgttcatggctcacttggcaactattccaatcaccggcaccggtatcaaccctgctcgtagctttcgagccgctgttatctacaaccaggacaag

SEQ ID NO: 23827 - DNA, 392 bp, Gossypium hirsutum
  Clone ID: LIB3272-030-P1-K1-D6
cccacgcgtccggtaacagtcaatattgagagagagtgagaaagatgggagagacagacaaagacagggaacaggctgagcatggatggatctaccaactgattctgttgtttctccgcccatgcactgcctcttccctggctctgcctcctccatttttttcctccctctttttttatttaactttttcaccttatcccattttggaattattattatgactgtaatttagatccaggttcatgataggtaccttttaacaaggtaattgtggtgacttttgttgagccccaatggccccagctcttttttcttcattttctctctattcttttcaatccaagtatagagattattcgttttactggtaatggaaatttgattttgattct

SEQ ID NO: 23828 - DNA, 397 bp, Gossypium hirsutum
  Clone ID: LIB3272-030-P1-K1-D8
ccttattacactcaccgatcacatttcttttattttccagatctgactccccctcccctctcccttttccaaaaagagagagttcccctctccatctaaaaaaatggaatatcgatcgagatctatccacaaatccacctccatcatgatctccgccatcgtcttcctctctctgatccacacctctcattgcttctaccttcctggtgtcgcccccgaggacttccaaaagggagatcctttgaaagtgaaagtgaacaaattgacctctatcaagacacaacttccctattcatattattccctccctttctgtccaccaaaaaagatagttgacagtgcataaaatcttgcggaagtgcttcgtggtgaccatattgaaaactctccttatgtg

SEQ ID NO: 23829 - DNA, 383 bp, Gossypium hirsutum
  Clone ID: LIB3272-030-P1-K1-D9
gttccatgtgaacggcacttgcacatgggttagtcgatcctaagagacgggggaagcccgtccgacagcgcgtacagcgcgagcttggaaagggaatcgggttaaaattcctgaaccagcacgccgcggctgacggcaacgtcagggagtcctgagacgtctgcgggggcctcggcaagagttatcttttctgtttaacgacctgcccaccctggaaacgactcatccggaggtagggtccagcgtcctgctgagcaccatacgtctcgtggtgtacggtgcgcccccagcagacgtctacattccggaggaccgagtgccgtccctgcccgttcgctctaataacctcatgaagcataccacatggacagcctttgttccat

SEQ ID NO: 23830 - DNA, 411 bp, Gossypium hirsutum
  Clone ID: LIB3272-030-P1-K1-E10
cttccttttattggaatcaccgaaatgggcggaggaggagtcatgagggcggtggggaaggtcgccggggtcggaattgttaactccagccttcgtggtggtgttcagggaactccgctgtctgctgagcaatccgttatgcgtgtcgccgccgcttcccgttctgcttcttccgtggtttctgtttctattgaaggagtttcgtctgttgccgacacgactgcgtcggtcagtcacaagtcatcttgggagatggtggatgattgtgaattcgctggtgattttgaacaggaagctgctctggaaggatccatcgccgcctcaggtagacccgaaccgattgctcgggttttgtttagtggcgttccaagccttgaggaggctaaagaagccactaatgatttgaaagat

SEQ ID NO: 23831 - DNA, 417 bp, Gossypium hirsutum
  Clone ID: LIB3272-030-P1-K1-E11
gaaaatgtcttctataaccaaatccatatccatggcggactcatgttgcctcgtttgtatcccttcactcttaaccacttgttccaaatccccatccctactctcctttcccccaaaaccaatcaatcttttcctctcatcttcccattcttcaacctctttgaccctcaaaaccagaacccatttctcttctctagtttcctttgttgcccaaacatcagattgggctcaacaaggggaagaaaatgacaccaccatcaccatcgatgaggatgaaagtgaaactgaagggggggaatcgaaatgggaaaacgatgaaaatgatggagctgaagcaatttggggaactgaaggtgaggatgctggttttgaagaacaaagtggtgattcagaagaagagggttctgaaccctctga

SEQ ID NO: 23832 - DNA, 340 bp, Gossypium hirsutum
  Clone ID: LIB3272-030-P1-K1-E12
cttttccacttcaatttttttccctctctctaacagcgacgatcgatttttattaattttctttgccgtcggatctttggttttccattttgattcaatcaggattgcttcgttttgaacccaggcgacgatgaagaaggctatcggtcaaactgttagagagcttaagagagaggttaataagaaagttctcaaagttcctggaatagagcagaaggttcttgatgctaccagtaatgagccatggggtcctcatggatcacttcttgcagatattgcaatggctacaagaaactatcatgagtatcagatgatcatgacagtgatctggaaacgtcta

SEQ ID NO: 23833 - DNA, 393 bp, Gossypium hirsutum
  Clone ID: LIB3272-030-P1-K1-E2
caaaatctctctttctcgtcaatatggcagcaaatggcgttgtttctgacaagagcttgatcgtcagcttcggtgagatgctgatcgattttgtccccactgtctccggtgtttctctagccgaagctcccggcttcctcaaagcccctggcggtgctccggctaacgtggccattgctggtgctagactcggaggcaaagcgtcatttgtcggaaaacttggagacgacgagtttggtcacatgctggccgatattctcaagcaaaacggtgtctccggtgacgggatcttgtttgaccaatgcgctagaactgctcttgccttcgttacgttacgcgccgacggagagcgtgagttcatggtctataggaaatctagcgccgatatgctgt

SEQ ID NO: 23834 - DNA, 399 bp, Gossypium hirsutum
  Clone ID: LIB3272-030-P1-K1-E3
cattgacggatcgacggtgtgagccttcgtgactgacgaccaacagttcacgaagagcgtggatgagcgtttcgcagctcttgacctcaacaacgacggtgtcctctccaggtccgagcttcgcaaggccttcgagtctctgcgtctcctggagtcccacttcggtgtcgacgtcgccactccccccgacgagctcactcagctttacaactccattttcgagaggtttgattgcgatggcagcggcaccgttgacctccaggagttcagatctgagatgaagaagattctgcttgctattgctgatggattgggatcttgccctatccatgatgttcttgaggatgatgaccaatgttttctgaagaaagctgctgatcttgaggctgcttagctcga

SEQ ID NO: 23835 - DNA, 416 bp, Gossypium hirsutum
  Clone ID: LIB3272-030-P1-K1-E5
tttgcattgaatcaaaatcgaaactctcaacaaagaagaaaacaacacaaaaaaaaccaaaaaccaaaaaccagaacatatcatcatcttattcaccttcattatgcctgcaataatgattcttggttgcctcacacccgcatgcccctttcaatatccactctcctcccccccccctcccactctttctctctcaatatcctacctataaaaccccatttccctccccacttctctctctcacctgtagtaatcttcttcaacaccatcaaatcccaccatttaaaccaaaaaccaacatctttttctttctacattttctcttgttttttatccctgttttcaagttcctgtctctggttttttgttgttgtttggcaatggcggtttcagggtttgaaggttttgagaagcgg

SEQ ID NO: 23836 - DNA, 411 bp, Gossypium hirsutum
  unsure (1)..(411): unsure at all n locations
  Clone ID: LIB3272-030-P1-K1-E6
aaaaaaaatggcgaaagctccaaggttgaagataacagtgataaacttgctatgtttggtggtgctctgcggggcaactgaatcgccacagtacgaggtggtacacgctgaatccgatttcgaaatcagacactaccgggacgccacgtggatgtctgcaaccgttaacgaactttccttccaaaaagccaccttatttgggtttcacagattattccagtttatacaaggtgcgaatctgaattattctcgggtagccatgacagcgccggtggtgacgagcctagtcccgggagctgggccacttcactcattagcctatgttgtccgattntacttgcctgccaagttccaggacagtccaccaaccccacttccggagctaaacctggaaccttacgcatgggattc

SEQ ID NO: 23837 - DNA, 400 bp, Gossypium hirsutum
  Clone ID: LIB3272-030-P1-K1-E7
gccgccgcaatcctgcgccgccaccaatcggaaaagccaccaaacgatctgcctttgctctttcttttaatccaccgcgccatatcttttcagaacccacttgaaagccattaaaacatcaaatcgacttcgactttctcttgccccgatctaccgccttcgccgtcagatcgacacgggatatcaggggaagcttccctttcctaagatataacctctcaaatatgttctctcttcctctttttcttttctgctgattttttctgctgtaatggttgtgaaatgatgattgagcagtgttggtgaaggaggtggctatggtttagagaggggcggagagtgatcttgatggtgggcggttgtgggcctcgggagttatgagatggtgtaggttctgggt

SEQ ID NO: 23838 - DNA, 413 bp, Gossypium hirsutum
  Clone ID: LIB3272-030-P1-K1-E8
cgtctgctctcgccaaaagacacccaaagacaccactttgaaacccggaaatgtcggacgaggagcatcatttcgagtccaaggccgacgccggcgcttccaaaacctaccctcagcaggccggcaccatccgcaagaacggttacatcgtcataaaaaatcgcccctgcaaggttgttgaagtttccacctccaagaccgggaagcatggtcatgcgaagtgtcactttgttggaatcgatatcttcactgccaagaagctcgaagatattgttccttcttcccacaattgtgatgttccgcatgtcaatcgtactgactaccagttgattgacatttctgaggatggatttgtgagtttgctgactgagagtggagacactaaggatgatctgaggctcccaactgatgag

SEQ ID NO: 23839 - DNA, 411 bp, Gossypium hirsutum
  Clone ID: LIB3272-030-P1-K1-E9
ggaaaaggaaacaactctccttccttccgacgataaaaacccttccccttcctcttgctcttcatttcaattcattcttccttagtcaaaggactgtgatggggcaacaatcgctgatctacgccttcgtggcacgaggcaccgtcgttttagccgactacaccgagttctccggcaacttcacctccattgcttctcagtgcctccagaaacttcctgcttccaacaacaagttcacttacaactgcgacggccatacctttaactatctcgttgataacggctttacttactgtgtggttgctgttgaatctgctgggcgacaggtgccaattgcctttcttgagagaattaaggaggattttaccaagagatatggtggaggaaaagctgcagctgctcctgcaaaca

SEQ ID NO: 23840 - DNA, 375 bp, Gossypium hirsutum
  Clone ID: LIB3272-030-P1-K1-F1
gagatctttatcagcatcgatactgttggtatattttgtgcattatctgactgtattggagctgcgattcatataagcatcctataagcaaatgttggttagggggtgggggtactgaagcggttgagtatttgtgtatggatttttagcatgcaggaatatgcaggctccataaggggtgaagaggtggttttactgggtgtttgtaattgggacatggggtaaggtatctgattcaagcatttgcattcgttatttttgacaaatttctcttattttcattgttttgtgagttagggatagggttttggtctgtggattcccacagtttttctgtacaagggctttaattggtttttcttataaaaatttggg

SEQ ID NO: 23841 - DNA, 406 bp, Gossypium hirsutum
  Clone ID: LIB3272-030-P1-K1-F11
attcttttatcctttgaagcctttgtcttctaaaatggcaatatcagcctgcaataacctattttcaactctaacttttcttcctaacaaagtctccattttcaccaaaactcctcagttcatcaccgctttgaatggttccaaaacgagattatactcttccaaagtaagcatgagcctaagagccggcattgttggtcttcctaacgtcggcaaatcaactctcttcaatgctgttgttgaaaacgggaaagctcaagctgcgaattttccgttttgtactatagagccaaacgttgggattgttgcagttccggatcctcggcttcatgttctttctgaactcagcaagtctcaaagagcttgccctgcttctattgagtttgttgacattgctggactcgtt

SEQ ID NO: 23842 - DNA, 409 bp, Gossypium hirsutum
  Clone ID: LIB3272-030-P1-K1-F2
cccaaatctcctccctcctcttctttagcgtccttttcatttccgctcatgcagcgcgctttgaaatccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccggtgattgtggtggactccttcaatgcaaaggttggggtgtacctccaaacaccctggctgaatatgcacttaaccaatttggaaacatggatttctacgacatctccttagttgatgggtttaacatccccatggtgtttgtccaactaatggctgttgtcacaacatt

SEQ ID NO: 23843 - DNA, 131 bp, Gossypium hirsutum
  Clone ID: LIB3272-030-P1-K1-F3
gcgttcgaaaaaaaaaagaagcaaaaaaacatggccaaagttctgatgttcattgctgtatgtgtgctttcagatttggttagtgctacacgcattttgataccaaatggggtgaaggcttggtctgaaac

SEQ ID NO: 23844 - DNA, 102 bp, Gossypium hirsutum
  Clone ID: LIB3272-030-P1-K1-F4
ccaccctcccggtcaaggccatgttttaagggctttggggggcaaccccccctgcctatttttaaagtttaaataggtggggcggcggcccttttttttttt

SEQ ID NO: 23845 - DNA, 227 bp, Gossypium hirsutum
  Clone ID: LIB3272-030-P1-K1-F5
atagactgtatgcctgtactttaccaaacaccacagatgctgctgagagctggtcgcgtaccatatgggtcttccaacctatgcctatatgcgctcaactctgtcttgtatcacttgctgacgatggcctgctggccaatggtgattcagagacaccaacatacgccgactctccaagcgaggccatatacgatctacccaatgagatccccagctactagcacgaa

SEQ ID NO: 23846 - DNA, 406 bp, Gossypium hirsutum
  unsure (1)..(406): unsure at all n locations
  Clone ID: LIB3272-030-P1-K1-F6
acatccttaagctcttctcctggaccatcatcaacaccaatatctcctcgcacaattcctaatatgagaaccaaaaggcctgaagaagacgagatgaagcaagtctttggctatttcgacggggatggtgatggcaaaatctctgctcttgaacttagggcgtactttgggtccatcggggagtacatgtcacatgaagatgctcaaggggtgatcaacgatcttgactcggacggggatagcatgctgcactatcaggatttcttgaagctaatgaaaagagaacccagcaaggatgatgagggagatgattatgatgatctgaagaaagcgttagagatgtttgaactggagaaaggttcggtgtgcataacacccaaagggctgcanaggatgttgaatcgac

SEQ ID NO: 23847 - DNA, 414 bp, Gossypium hirsutum
  Clone ID: LIB3272-030-P1-K1-F7
cttcttcagatactatctttccctcaaaaatggttactttcaggtttcaccagtaccaagttgttggaagggctcacccaacagagagcgatgagcatcccaagatctataggatgatgctctgggccaccaatgaggttcgggccaaatccaagttctggtacttcttgaggaagctgaagaaggttaagaagagcaatggtcaagtccttgccatcaatgagatatttgagaagaaccctaccaagatcaagaattatggtatatggctccgctaccaaagccgtaccggttatcataacatgtacaaggaataccgtgacactactctaaacggagctgttgaacaaatgtacactgagatggcttctcgccacagagtccggttcccatgtatccagattatcaagactg

SEQ ID NO: 23848 - DNA, 336 bp, Gossypium hirsutum
  Clone ID: LIB3272-030-P1-K1-F8
cgttgagtgtagagatgaggaaaatcatgggtgccaaagttcttttcttctttgctttgctttccttttcagctgtctcgggatttgcacaggatgaggaacaccaaggtcttgttatgaacttctacaaggattcctgtcctcaggctgaagacattatcaaggagcaagttaagctactgtacaagcgacacaaaaacactgctttttcttggctgagaaacattttccatgactgtgcttgccaatcatgtgatgcttcactgctgctggactccacaagaaggagcttgtcttgaaaaggagacagacagggatctttggcctaaagaattt

SEQ ID NO: 23849 - DNA, 330 bp, Gossypium hirsutum
  Clone ID: LIB3272-030-P1-K1-F9
aaaaaaaaaagaagcaaaaaaacatggccaaagttctgttgttcattgctctatgtgtgcttccagctttggttagtgctacacgcattctgaataaccaattggtggttgaaggctatgtgtactgagatacttgccgtgctggttttgaaacccctaagactagaaggctagctgatgccatggttaagctggtatgctccgacaggaagaccggcggagttgttttcgagaaggagggatataccgacaaaaccggaaaataccagattcgtgtatccgaggatcacttggatcagatctgtgatgcaatttttgtgaagagccccc

SEQ ID NO: 23850 - DNA, 379 bp, Gossypium hirsutum
  Clone ID: LIB3272-030-P1-K1-G1
tttctcccgtttctctgcctgtccctccttgaagacaagaatcagagagcatggcagccacactcagcctcctgaaatccccgttattaccccaaaagcctcaccttctacaatctaaactccccctcctttctaaccccacaaagcaatttatctgcaatgagtcttttaaccctccaaaactcttcgctgagactgttcatcacctaaaatcagcttctcttccccttacaacactcgcatttcccttcttatttgacgccgaggatgctcttgctgttggtggagagtttgggattttggagggtagaagttttgcacttgtacaccccattgtcatgggtggtctcttcttttacactttgtgggctgggtattt

SEQ ID NO: 23851 - DNA, 95 bp, Gossypium hirsutum
  Clone ID: LIB3272-030-P1-K1-G10
gcgtgcgtagtctgacatgtgtgcgagtcaacgggctagaaaacctgtacggcgcatggaaggttatcggcagcatccgtgagggctgcaacgtc

SEQ ID NO: 23852 - DNA, 342 bp, Gossypium hirsutum
  Clone ID: LIB3272-030-P1-K1-G11
accattatttccaatccttttcactttatcttctcccctcctatctctatctcgctgtccattgttggacgtagccatgattaccttgcgatagcaaaaattatctgtgaggaaaaaacggagataactaatatcactgaatatgaggccattgcaaaagagaagttacccaagatggtttatgactactatgcatcaggtgcagaggaccagtggactctcaaggagaatcgaaacgcattttctaggattttggttcgaccccacattcttattgatgctagcaagattgacatgaccaccactggcctgggatccatgatttcaatgcctatcatgatt

SEQ ID NO: 23853 - DNA, 103 bp, Gossypium hirsutum
  Clone ID: LIB3272-030-P1-K1-G12
ccggccggaatcccgggcgcccacgcgtccgaatatatatttctccttatcccattaatactgtacacagcttcccctgcgagggcccagttgtgcgagggca

SEQ ID NO: 23854 - DNA, 400 bp, Gossypium hirsutum
  Clone ID: LIB3272-030-P1-K1-G2
tgaaattactgtgttttgaaaggtaaagatccactatttgtttcttcatcgtcgatcaaaacagagcaagactcgaagttttctttctaaaaaaacgtgtttaattgaatccccttttagttttcgtttctcgtttttccttaaaattttcccgagaaaagtgcaatcttcaaaatccagcagggaccgaaaaaatagtttgaattaaaaaaaggttgtcaacttacaaacaagattcttcattttctctcttcagtttttcccctttttccccttaaattttgttgtccaaacgtcaaaaattaggaattttctcgtcaaaattcacattacctaaaatcacgtcaatctcgctctgctctttttctccctttgatttcttctactggtcatcaacacc

SEQ ID NO: 23855 - DNA, 404 bp, Gossypium hirsutum
  Clone ID: LIB3272-030-P1-K1-G3
cttttaagaagattaaagcccttgtaactactcattcccagctagctactgttttgcggaactcagcaaagcttgtagttagtgaagatggaaaaaaagtaagacgccagcatccccttactgaatcggatatggaagagttgcaattgcatgcatttgtggaatatgaaactgttgagttggctgaaaaagctgttgcggagcttaacgaagagggaaattggaggagtggccttagggtccgtctaatgcttaaacatgtgtcaaaacctgctcatgcaagagtgaaaaaggggcatgatggagaaggtcaatgtgaggaagatgatgtttgtatttctgaactgccttcaaatgagaaacaacaagaagatccttctcagttgtctgatatttattcacat

SEQ ID NO: 23856 - DNA, 414 bp, Gossypium hirsutum
  unsure (1)..(414): unsure at all n locations
  Clone ID: LIB3272-030-P1-K1-G4
agaagccgcttccgggctcgaaagtgttgagaaactcatcagattactttctgaaactcaacagcagcagcaaactaacagtaataatcaagagaaataccaagcttcctctatctcaacaacatctaattccctggatttggaaatggactgcaaagctgaggctgatgccgccgtttcaaggttcaagagagttatctctcttctgggtcgaaccaggaccggacatgctcgtttcagacgagcccctgttcaacccgatcaagagcaagaaaccaaggtttattacgcaacaccgatccagcagattccgccaccagtgactactgcttatcctnttcctnctnctcctccttctcctnctaattatcatcatcgtgattttatgacggtgaaaacagggggttaagaacg

SEQ ID NO: 23857 - DNA, 378 bp, Gossypium hirsutum
  Clone ID: LIB3272-030-P1-K1-G6
ttttcctctcagatttttaaaaaaaaaaaaaagcaaaaaaagaaaaaagagctctcttgttaatcaaggtcacgtaaaaaagacttgagaaccagctgatcatggccaatgagcgctacatcgaagaggccgaagttcgaagctatttattagaaagcaaaaattccatggagaagtgggtgaattcgccggaaacagtcacgggttcggacgataatccctcagccggttttgactgcaacatttgcctcgatactgtgcaagatccggtggtgacgctatgcggtcacctatattgttggccttgtatttacaaatggcttcactgtcaatccatctccactgaaagccatgaccaaaaacagccgcaatgccccg

SEQ ID NO: 23858 - DNA, 399 bp, Gossypium hirsutum
  Clone ID: LIB3272-030-P1-K1-G7
gtgagagagactgtaagcctttactttaccaaacaccatggatgctgctgagagctggtcgagaaccaaatgggtcttccattttatgcttatattcgctcatttctctcttctatcactagctgaagatggtctggtggccaatggtgatttcgagacgccaccgtccggcggcttcccaagcgaggcaatatccgatggacccaatgagatccccagctggagcacgaaggatacggtgaagcttgtgtccgccggtgaaaaagtgagcggcgggatgctactcatcgtaccccgaggcaagcacgccgtcagattgggcaacgacgcggagatcagtcaggaagtgacgggtgagaaaggatcggcgtacgcggttactttcagtgcggcacgcac

SEQ ID NO: 23859 - DNA, 374 bp, Gossypium hirsutum
  Clone ID: LIB3272-030-P1-K1-G8
atagatgatggctatcaagagccaccattgctgcttcagctttatctttctgttattaccattactcctacagcttcattctgtcaaaggtgatctccagttgaactactatgctcaaagttgccccaatgctgaagagatcatcaaacaacaagtcatcaagctctacaacaaacatggaaacacagctgtttcttgggttcgaaatctcttccatgactgcatggttaagtcatgcgatgcatcgttattgttagagacggtgaatggaattgaatcggaacaaaaatcggataggagttttgggatgagaaatttcaagtacgttaagacaattaaagatgctctggagcaagaatgtccagggacagttt

SEQ ID NO: 23860 - DNA, 342 bp, Gossypium hirsutum
  Clone ID: LIB3272-030-P1-K1-G9
ctaaattacaggattttattgttggaactgaagttttaaggtgatggcgaggttcaaaccacatgcttggctacaacagagcaaatggaagaaaggcccagctcgaataagtcttacaacaattataatgttgactttgattggcgttttgattctgttttttgagtttgccacctacagacactggactcaaaggtcaagaattcatattgaaaacaggtaatcagctattgagggtgacatctcttttatggattcaaagtaatccgatcttccaggatatgctattttagatactgcgtaatgctctatttcagtggagctctttaaggacattttttc

SEQ ID NO: 23861 - DNA, 346 bp, Gossypium hirsutum
  Clone ID: LIB3272-030-P1-K1-H1
gcaaacgatggctatcttttctacatcaatggctgctatgctccttctggtagggctcttcgctgcaaacttggatcctactgctgcacagattggtgtttgctatgggatgctcggcaataatctcccaaattcatgggaagtcattcaactttacaaatcaaacaacatccggcgattgaggctctacgatccaaatcaacaagcattacaagctcttagaggctccaacattgaagtaatgttaggtgttccaaatgatcaactgcaaaacctcgctgacccttccaaagcacgatcatgggttcaaacaaatgttgtagcttactggccgagtgttcggttc

SEQ ID NO: 23862 - DNA, 262 bp, Gossypium hirsutum
  Clone ID: LIB3272-030-P1-K1-H10
agtgaataagattgtgagtactttgaatgctggagaggtgccttctccggatgttgttgaggttgtggttagccctccatttttgttccttcctttggtaaaaacttcactgagacctgagttccaagtcgctgcaaaaattggtgggccaaaaaaggaggtgctttcactggtgaaagtagtgcggagatgcttgtcaatttgagcattccttgggttattattggtcattccgagaggagacttatttttgtggggtaaa

SEQ ID NO: 23863 - DNA, 270 bp, Gossypium hirsutum
  Clone ID: LIB3272-030-P1-K1-H12
gtgaggaaaaaaaaagcttcaatctttggttgttaagtgggtgaaacaaaaaaaaaaatggagggcaaagaggaggatgttaaactaggagccaacaagttctctgagagacaacctattgggacatcagctcaaacagacaaggacttcaaggagccaccaccagcaccattgtttgagcctggtgagctcaagtcatggtctttctacagagccggcattgctgagtttgttgctaccttcttgttcctttacatcactgtcttgact

SEQ ID NO: 23864 - DNA, 374 bp, Gossypium hirsutum
  Clone ID: LIB3272-030-P1-K1-H2
catttccaatctccagctcccaaggtaaatatgccgatcagaaacatagcggttggccggcccgaagaggctactcaccccgatgctctcaaggctgctttggctgagttcatctcaaccttgatcttcgttttcgctggatcgggctcaggaatggcctttaacaagttgactgacaacggagcaaccaccccggctggtctcgtagccgccgctctagctcatggcttcggtcttttcgtcgctgtctccgttggcgccaacatcttaagtggccacgtcaaccctgccgtcaccttcggtgcttttgttggcgggaacatcactctcttgcgcggcattctttactggatcgcccaactcctaggctcaac

SEQ ID NO: 23865 - DNA, 400 bp, Gossypium hirsutum
  Clone ID: LIB3272-030-P1-K1-H3
cgttgttcttcctaatcttcctgcaccgttatgcatgcatctaaaccactcaatctcttttgtattttaacggtcatgatccgtgtctgctgcgacgatctgccttatttttgggaggcaccggcatttcgaatcgggagagaatgtccacaaacaacatgggccttcctcgacaaagagatccacaatgcctccattatccatattgctatgacattagacactgcttacccacggggctccgaagctggagtcttctccgttctccaccacgccacttgtgcgagaaaacatctagtaccattttgtcaccacgcaccgacactgagctaaactcacgcgcgccattaccttcactgtccctgacctcaactttgatctctactacttcaacactaac

SEQ ID NO: 23866 - DNA, 172 bp, Gossypium hirsutum
  Clone ID: LIB3272-030-P1-K1-H5
agagcctaaagctgaagaaaggaggtaaatgggaagaggttcatagcccaaatgttcattaaccaccttttttccgttcaccctttcaaaccccttccgttaaaaattcattgttttcttttagaaaatttaggggtccctttttgcccccttattttccggctcaaggaaa

SEQ ID NO: 23867 - DNA, 286 bp, Gossypium hirsutum
  Clone ID: LIB3272-030-P1-K1-H9
caacaatgtcttttcactcttctctcaccatgtcattgctgtctttctccttcttgttgctggttacttttagtgccaaaactggtgttcctccatctgaaacttttaagtttggcaacgacggagaatttgggcccgttggtgttgaatatgatgcaaattaccgtgtcataagcatagctaatgccccctttcagcttgcgttttataacaccacccctaatgcctttacccttgcgttacgcatggcttcaacgccgttcgagtcgctctttcgatgggtttg

SEQ ID NO: 23868 - DNA, 349 bp, Gossypium hirsutum
  Clone ID: LIB3272-031-P1-K1-A1
taaaaagttgggaggtatctttccccttaattttttagggaaacaaacaaagggatggatgattacacgtgatgcagggcggattgaaaaacccagtgtgctctaacacatacgtatgaacgggattctatcttggatgcgggctgaacctagaccctgtgtataggaggaacatcaatgtgcctgatggcgctgctatagataggattggggacctaaccaattgctattaagatgccaggggcaggcgtcattgccaaacccgtgattgtgggggacatcgttaactgcactggtgtgggggtccttcaaacacgctcaatgaatatgcactttaacaatgtgccaa

SEQ ID NO: 23869 - DNA, 407 bp, Gossypium hirsutum
  Clone ID: LIB3272-031-P1-K1-A10
tcccaattcatggagaattggtgttaccacagggatacattgatgagcattgcaaagcattatgaaacaggagagagtctccctgaagaggtatatttgaagcttcttgctgcaaggactttccgtgctggttctctaagtcttcgtcagcttcgatttgctagtgtggatttggaactgcatacaaaatacatcccagatgggtcagaatctgtttttgatgttgatcagagagtttccaaaaaaacacatgtgatccctccattgccagaagataggtttctctgcggattcaatcatatatttgcaggtggatatgctgctggatactacagttacaagtgggcagaagtattgtctgcagatgctttctcagcatttgaggatgtaggactggacaacaccta

SEQ ID NO: 23870 - DNA, 411 bp, Gossypium hirsutum
  Clone ID: LIB3272-031-P1-K1-A11
aaaaaaggtgggagggttttttccccttaattttctagggaaacaaacaaaaccatggatgattacacgagagagatgatggatttgaaaaccctggttactcgaaccctagagaagaaaggggttctagctaagatccgggctgaactaaaggcaagtgtctttgaggcaatagaagaggaagatcgagttattgaaaaagaggagagtttacctcctgcattattgggaagttgcaatgatcgcgctaaacgacttcatgcttctccttctggaagattgttaactgcactagtgtgtgagtacttagactgggcgcaactaaaccacactctataagtgtaccagccagaatgcaatttgcaaaaagactcctggaaagctgagttgaaagactttagcgtcaaaaat

SEQ ID NO: 23871 - DNA, 382 bp, Gossypium hirsutum
  Clone ID: LIB3272-031-P1-K1-A12
aaagcttgagccttcgatcttgaagaagtattattagcatgtgcaattgcgtgcctttgatcccctttccctcctccatcgtcaaaattagaaacccattgctcaaaaatccacaagtttcagatacccatttcccaattatcacgaataatggccgattacatttccttggatgctgtatgagagctaccccatcttcaagttcaagcgtagagggagatggatatgggcagttggagtttgacgatgatgaattggagctcaaacgacgtcgtaccgatgctaccttggagaaaattagtgacaaggagttgaaggggaagatgggcaacaagaatggggataaattggttagcaggaagcaactgatgaagagatcaaa

SEQ ID NO: 23872 - DNA, 317 bp, Gossypium hirsutum
  Clone ID: LIB3272-031-P1-K1-A2
tgcacttgcacatgggttagtcgatcctaagagacgggggaagcccgtacgtgagcgcgtacagcgcgtgcttcgaaaggcatatgggattaaaattgctgaaccgctacacggcggctgacggcaactttagggagtccggagacatctgaagccgcctcgggaagagtcatcttttctgtctaacggcctccccacccttgaaacgggtcatccagacgtatgggtccatcggtcggaagagcaccgcacattgcgtgatgtccgattcgcccgcagcaggccttgaaaatgcgggggaccgagctccgtacgcg

SEQ ID NO: 23873 - DNA, 397 bp, Gossypium hirsutum
  Clone ID: LIB3272-031-P1-K1-A3
gtaacaatggcggtctcacttcaagctgcagctaccctgatgcaaccaatcagggttgctgcaccatcaaggaccaatgtgccgctcaggtcctcccagagcgtttctaaggccttcggtttggagcctgttggtgctaggcttacctgctctttgcaaactgacctcaaggacttggctctgaagtgtgttgatgctaccaagctcgctggtttcgctcttgctacatctgctcttgttgtctcgggagcaagcgctgtaggagtttcaaagcggctaacctacgctgaaatccaaagcaagacatacatggaagtcaaaggaacaggaactgcttaccagtgcccaaccatcgatggtggtgtcgactcttttgccttcaagcctggcaaatact

SEQ ID NO: 23874 - DNA, 414 bp, Gossypium hirsutum
  Clone ID: LIB3272-031-P1-K1-A4
ctttttcctctaccaggtgattttagctttgtgttagttcctttaagcaatccgccaagatgcagaacgaagagggtcaaaacatggatctttacatccccaggaagtgttccgccactaacaggctcatcacctctaaggatcatgcttccgtccaaatcaacgtgggacacttggatgagcttggcagatacactggcacattctccacttttgctctttgtggatttgtccgtgcccagggtgatgctgacagtgctcttgacaggctttggcagaagaagaaagctgaagtccgacagcagtagttggatacctttttaccctagtctatctccgagcttgggaaagaaaaatctcatggcagcgactattatgttctagtttttttcaggttaaactatgtcaaattta

SEQ ID NO: 23875 - DNA, 403 bp, Gossypium hirsutum
  Clone ID: LIB3272-031-P1-K1-A5
cattagttgaaactggagatcttcttgaccaaattcccaccttcctccttcacccactccccaaatctttatacctccaatacccatttctctatatccctttcaaaagtctctattttttctgtaatctgattgaaattgggtttcatgacttgatacacaccaaacatcgtgcgcccatatgagtaccatcgccttctgatccaaccaacggttttaaagccttgaagagatgttaattaggagaccccaagatggacaatgcgttttcaggctctttcacttgctttcgaagcgaataaaggtccccctaccaccacgcaatccaaattacagaatggttttcatccctccgcggtgtcaaccctgacaaggtcttcgacgatgtggtgttcatcaaaga

SEQ ID NO: 23876 - DNA, 416 bp, Gossypium hirsutum
  Clone ID: LIB3272-031-P1-K1-A6
gtcaatttcagcttctcgcaacccccatccagagaggtgcttttggagttggcaagaaataggaacaaagttccattgccaaaggcaataccagggcctgggattccccttcctcctgagcaggatacattgataagtacaaactaccaactggctatccctaagaagcaaccggcacaggcgatggaagagacggaagaggatgaagaaagtgttgaacctaattcctcgcaagagcataagaccgatgcaccgcacccaacgtctcaaagagtatcgttccctctcactaagcgctctaagtgaggtttctgcttttgtaagatgtttcaataatccatttaggtagggtaatatatatgcttgaagattctatcatattcatcagaatgaagggttgatttttcttatgattg

SEQ ID NO: 23877 - DNA, 412 bp, Gossypium hirsutum
  Clone ID: LIB3272-031-P1-K1-A7
atgagctacttaaccatttcccaaatctcctccctgctcttctttagcgtgcgtttcatttccgctcatgcagcgcgctttgaaatccgcaatgagtgctcctacaccgtctgggcagcagcctctcctggtggcggccgccgcctagaccctctgcaaaggtggaccatcgatgtgcctgctggcactgctatggctcgtattgggggtcgaaccaattgcaatttcgatgccagtggtaggggtcattgccaaaccggtgattgtggtggactccttcaatgcaaaggttggggtgtacctccaaacaccctggctgaatatgcacttaaccaatttggaaacatggatttctacgacatttccttagctgatgggtttaacatccccatggtgtttggtccaactaatg

SEQ ID NO: 23878 - DNA, 86 bp, Gossypium hirsutum
  Clone ID: LIB3272-031-P1-K1-A8
cgtcagcctcttatcattttgcttatgctaccttgtctcaacccataggggtgttttcaaggtcaatgaccaagcttgcgctaaca

SEQ ID NO: 23879 - DNA, 303 bp, Gossypium hirsutum
  Clone ID: LIB3272-031-P1-K1-A9
gtatttcggttgcacctactgcaccatctttttgaccccctgcaaaggagtggttgcatggtccattgactttgtccccagtccataagcacccatctgcatggaaacatttcaaaaactttgatccttggacctgctattcaattcatcaacctgtttacaggcaacaagttactgccggttgtccttctcaatattccactcccagctgggtttccccttcaccatcgcctactgccacgtcaaaccactttcataatatggccattcttcaacctgcaatttcttcgattggttcttccc

SEQ ID NO: 23880 - DNA, 393 bp, Gossypium hirsutum
  Clone ID: LIB3272-031-P1-K1-B11
gaaaaaatggatccacagctaactgaagtgtcgcagatgttcgagcgattcaaagctgcattcattagaaaagattttgattcatgcgccaatctcctttctcaactcaaggttttgctgacaaagtttaggagccttcctccgctatttgaaaacacccctaattcggttaacgaagtgctcttagcaagggaaatttacgaacatgctgttgtcctcagtgttaagattgaggatcaagatgcctttgagagggactttttccagttgaagccctattatacggatgctggtagccgtcttccaccatcccagcaagagtaccctgattctaggtcttaatctcttgagacttcttgtccagaacagaattgctgagttccatacccgact

SEQ ID NO: 23881 - DNA, 407 bp, Gossypium hirsutum
  Clone ID: LIB3272-031-P1-K1-B12
cccatctctacttccatttcatctgccatcaatttgctttgaagatcatgttggctatttttcacaaggcatttgctaatccaccagaggagctgaatagtccagcttctcataaatctactaagaagcctaaacagcctgaagaaaccctaaatgatttcctatctcatcaccctcacaacactttctccatgagctttggcaacgctgctgttttggcttatgtccgccatgaacgtgctgcttcagttcatcagaggttgttttgtgggtttgatgacatatactgccttttcttagggagcttgaacaatctatttatgctgaatagacagtatggtctttccaaagggagcaatgaggcgatgtttgtgattgaagcatataggacactaagggataggggt

SEQ ID NO: 23882 - DNA, 415 bp, Gossypium hirsutum
  unsure (1)..(415): unsure at all n locations
  Clone ID: LIB3272-031-P1-K1-B2
gaccgganattcccgggtacgacgccatcgcgtcccgattcttcacatgcgttaataacatcaatagtgacttaagggatatatgtagaccgacggcgtgagcataggtcggcaggatctggttgttctcatgcgaagagacttatccaggatcccatccatccggcacccgttgtattgacttaggatagaacctcactcaaattggtgcgctcttatatggtgcgtgcgatcagctagatgttcaatttgaccaccctgtctttgtcttagtatagctcacggttgtgtgacctgtagatcggtggtataatagtccataactcgacaccggtataagaatacctgttgacgccggattagtggtcggccgttggtataccttggtcattgcttcgggccttttagggtggca

SEQ ID NO: 23883 - DNA, 419 bp, Gossypium hirsutum
  Clone ID: LIB3272-031-P1-K1-B3
ccgaagttaagtcagttgagatgcaccatgaagctgttacagaggcactttctggtgattatgttgggttcaatgttaaaaacgtcgctgttaatgatctcatgcgtggttttgttgcgtacaactacaacgatgaccctgcttatgtggctgccaacttcacttctttagtcatcattatgaaccaccctggacaaatttgtaatggatatgctccattccttgactgccacacatcacacatagatgctaatgttgcttagcttccgaccaagattgacaggcgatctgatgaggagcttgagaaggaacccaacttcttgaagtatggcgctgctggtatgattaatatgattactaccaagcccatcgtagtggagaccttgtcttagctcccacccgtgggtcgcttttctgtg

SEQ ID NO: 23884 - DNA, 411 bp, Gossypium hirsutum
  Clone ID: LIB3272-031-P1-K1-B4
gacttcccttttagctcacagctcctctcttgagtactataatgggtaaggagaaggttcacatcaacattgtggtcattggccatgtcgactccgggaagtctacaaccactggtcatttgatctacaagcttggtggtattgacaagcgtgtgattgagaggtttgagaaggaggctgctgagatgaacaaaaggtcatttaagtatgcatgggtgcttgacaagcttaaggccgaacgtgaacgtggtattactatcgatattgccctctggaagtttgagactaccaaatactactgcactgtcattgatgcccctggacaccgtgacttcatcaagaacatgattactggtacctcacaggctgactgcgctgttctcattattgactcaaccactggtggtttcg

SEQ ID NO: 23885 - DNA, 411 bp, Gossypium hirsutum
  Clone ID: LIB3272-031-P1-K1-B5
ctttttcattggaagcttctcttccaaagatggactatgtgtacggaccaggaaagaaccatctctttgttccagggccggttaacatcccggaaccagttcttcgagccatgaacaggaacaatgaggattaccgttcccctgccattcctgccatgacaaaaactcttcttcaagatgtcaagaaaattttcaagactactactggaactccctttttgattccaactacaggaactggtgcatgggagagtgcactcactaataccctgtcccctggagatcgaactgtatcttttctaattggacaattcagtctgctgtggattgatcaacaacaacgccttaaacttcaacgtcgacgttgttgaaagtgaatgggggcaaggtgctaaccttgacattctggca

SEQ ID NO: 23886 - DNA, 412 bp, Gossypium hirsutum
  Clone ID: LIB3272-031-P1-K1-B6
gtgagttggtgtgaggatgagtcgtggtgcagcagctggagctaagggaaagaaggagggagcctccttcaccatcgactgtgcgaagccggttgaggataagatcatggacatcgcttctttggagaagttccttcaggaaaggatcaaggttggtggcaaagctggtgctctaggtgactccgtcactgtcacccgcgacaagacccgtatcacggttacctctgactccaacttctctaagcggtaccttaaatacttgactaagaagtacttgaagaagcacaatgtccgggattggcttcgggtgattgcttccaacaaggaccgtaatgtttatgaactccgcttccttaatattgctgagaatgaaggggaagaggaagaatgagcaatcagttcagttactttt

SEQ ID NO: 23887 - DNA, 406 bp, Gossypium hirsutum
  Clone ID: LIB3272-031-P1-K1-B7
agagcaggaaaacaagaaaagcagagccgcatcactttttgctagctaagctgctgtgggagttattgttcttcaaaacagcttctgcagtagctaataataacgtcatatattatataaattatatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgattgggaaagtggaacgaaaatatgcgatgaaagagtcgtcgtcgtcggagacaagggcttatttttcaacttgggcgcctgaccctttttccggg

SEQ ID NO: 23888 - DNA, 428 bp, Gossypium hirsutum
  Clone ID: LIB3272-031-P1-K1-B8
cgacgccatcgcgtctcgtgaagaagcgagaaaacaacagaataatgcactaatcggttataaggtgacgcggcttctcttaggaataggtgtcaagattcaagaaatcatcagctaaaaagactaaccaatcactctcactcactcgttcactcgtgatattcgcacttgtagagaatcttaccaatatgtgtcgctttacatgggtcgttgttcgtgtgaaatcatatatctcccattctatcgcttctgatgtctcaggtgtatgactgggatgcgggtataaaaatccaaaccggcccagggaaagaatactgccgacccttattgtggttgcagcggtatacttggtatcggttggcctttttgtggcatgatctctatccctggttactgcactgttggtatttttagaggacacatcatcc

SEQ ID NO: 23889 - DNA, 410 bp, Gossypium hirsutum
  Clone ID: LIB3272-031-P1-K1-C10
ctgaatctagccccaacgacctaacccattagcactaatttgtctattagcaagtattgctatctcatatacgtgtttcctcttgatccacactttgttttcactgttccaactctatctctctaagctcccaatatggccaattcccaccaaccgtttgttgcactcatcgtcggcgtcaccggcatggcggggttgagcctagctgaagccttgaagagccccaatgccctaggcggtccttggaaagtttatggctctgcttcacgtcccataccaacttggttcccttcctcgctcctcgataaatacatcgcttttgatgccaccgacgccggaaacaccgctgatacgctcactccaatctccggcgaagtcacccatgttttctgggtggcaatccaagttcg

SEQ ID NO: 23890 - DNA, 411 bp, Gossypium hirsutum
  Clone ID: LIB3272-031-P1-K1-C11
ctttctgctatcagtttcattacataatatatctcttcgattaaagaatcgctgggttcgattttgtcagacaagatcggccaaattaagatttcaggagattagagaagatggaccctcatgatgagacgggccgccaagcttcagaaggccccatcctgtgtgttaataactgtggtttctttggaagtgcggcgaccatgaatatgtgctccaaatgtcacaaggcaatgatcctgaagcaggaacaggcacaactcagcatcatccatcgatagcattgttaatggcagcactagcgggaatggtaaggaaccatctgttgctgctgctttggctgtgcaatgggggaaattttgggtaaaaaattgaatcatccatcgatccatcccatatgaccttcggtgggat

SEQ ID NO: 23891 - DNA, 405 bp, Gossypium hirsutum
  Clone ID: LIB3272-031-P1-K1-C12
ctccctctcttcttaggtctgctgtatcttagttcttgattaattagccaatcacagcagccatgtctctcctcaatgatctcatcaacctcaacctcagcgacaccactgaaaagatcatagccgaatacatatggatcggtggatctggtatggatctgagaagcaaagcaaggactttgcctggaccagtgacggacccttcaaaactcccgaagtggaactacgatggttccagtaccaatcaagcacctggagatgacagtgaggtcattctttatcctcaagctatattcaaggatccatttagaaaaggaaacaacatcttggtgatgtgcgatgcttacacaccagccggcgaacccattcctaccaacaagagatttaatgcggccaagatcttta

SEQ ID NO: 23892 - DNA, 426 bp, Gossypium hirsutum
  Clone ID: LIB3272-031-P1-K1-C2
ctaatttccagccgctaacaaatatggagaagcctcctctgagagattataccgccgcgaacgccgtcagtgcacctccgctacttaacacacttacgccttcccgccgtacaagcttaaaccgtgcctttgccgcagtttacacgtgtgccatcgtagccttgttctaccgccatacacaaacactcttcagctccaaaaccctagtttctttctacgtaacccttacgttgttcgtctccgacctcatccttgccttcatctgggctaacgggcaagctttccgtatgcgtgcggtttaccgtaaagaattccccgaaaacctcgaaaaggtggtgaaaacaagtgatttaccggggctggacgtgttcatatgtacggcagacccgtacaaggagcctccaataagtgtggtgaacacggcgt

SEQ ID NO: 23893 - DNA, 412 bp, Gossypium hirsutum
  Clone ID: LIB3272-031-P1-K1-C4
cacacatgtcggtatgaggggtgtggatttgaccccaggacagaaacaaagaattgcgcatcgctcgagttgtgttgaagaatgctcccatcttattattggatgaagctagctcttccattgaatctgagtctagccgagtggtccaggaggcacttgatacgctgataatggggaacaaaactaccattttgatagcccatagagctgcaatgatgaggcatgttgacaacattgtagtacttaatggtggtcgaattgtagaggaaggaacacatgattctttggtagccaaaaatggcttgtatgttcgtttaatgcaacctcattttgggaagggcttgcgtcagcatcggctggtttagtttggcttgcaagtataacataccttggttctgctgtatattgctca

SEQ ID NO: 23894 - DNA, 414 bp, Gossypium hirsutum
  Clone ID: LIB3272-031-P1-K1-C5
atcaaatcctggcttgcatttgctgcgcagaaagttgttgaagttaatgcccttgcgaaggcattggctggtcagaaagatgaggccttcttctcttctaatgctgctgctcaagcctcaaggaagtcctccccaagagtcaccaatgcggctgttcaaaaggctgctgacgctttgaagggctctgaccaccgtcgtgcaacaaacgttagtgctagacttgatgcgcagcagaaaaagcttaacctaccaatcctaccaaccacgaccattggatccttccctcaaacggttgaactcaggagagttcgtcgtgaattcaaggctaacaagatctcagaggacgattacgttaaagccattaaggaggaaattaagaaggttgtcaaccttcaggaagaactcgacattgat

SEQ ID NO: 23895 - DNA, 389 bp, Gossypium hirsutum
  Clone ID: LIB3272-031-P1-K1-C6
ctacaccatggatgaagtgaagctctttgggttgtgggcaagtcctttgagtaggagggtgatttgggcattaaagctaaaatgtgcggaatatgaatacatggaagaagatttgccttataataagagtgatctgttgttgcagtacaacccatttcataaaaagatcccagtgctcggtcatggaggaaagccaattgcagagtcattggttattgtggaatatatagatgaagtgtggccacataactcctttgttgccaaaagatgcttacgagagatccgtagctagattgtgctccaaattcattgaggaaatgactcaaccactgtgggtattctgtgctaaccatggcgaagatcagcggggggctttcgagggccaccta

SEQ ID NO: 23896 - DNA, 82 bp, Gossypium hirsutum
  Clone ID: LIB3272-031-P1-K1-C7
tcgtttccatactattccaattattctaaatccttcacccagtttttttacggcggccaccctccttggttatactgcgaac

SEQ ID NO: 23897 - DNA, 395 bp, Gossypium hirsutum
  Clone ID: LIB3272-031-P1-K1-C8
attaaatctcaaagctgtcacgtggatgtataggaaaaggaaccacgacatcggctcgccaacacttgctgcatccgctgctcttcttcttaccttgaacttggtgatcttaactttggtaagctctacctacgtgccttgcccaccaccaccaaagagccacaagcctacccacaaaagcccaccctcgtgacctgaacagccaggcacttgccccatagatgcactgaaactaggcgtttgtgctgatttgttgggctcattgcgcgttagtgttggaccgtcgaggaccaaatgctgctctctcattttgggtttggctgatctcgatgctgctgcttgcctttgcactgctattaaagctcatgtgtggggggttaacctaatcgatcctg

SEQ ID NO: 23898 - DNA, 358 bp, Gossypium hirsutum
  Clone ID: LIB3272-031-P1-K1-C9
cttgggataaggcctgagtaccttaatatggaacagggtgcaaacataaatggtgggaagaatccctagaagcatcttagtcaggaacaagcgtcacagattgctcgaaaggttatatcacggttactaactggtgttgggtttgaaggtgccacataagctccagtggaagtcttctctcagtttcttagctgtcatatgtctaaacttggtcagaatctaaaagttcttactgataattacagaaaacaattgacagcatttgtactaatcatgtatgtgcttcaaacatctgcatatatcatctttggggctctatcttaacttttgaaggatttttccaggatcttattgctta

SEQ ID NO: 23899 - DNA, 422 bp, Gossypium hirsutum
  Clone ID: LIB3272-031-P1-K1-D1
caaatttcaaagattttgattttcttctgcaatttctcatccaccaattgaatcaggttgtgaagtattgagggtgtttattatttgttgtttttttataattactgatgtctccgccgctgcttggcgtggaggaggaaggggttcagagcaatgttactttactcggttcttcaggctcaatggaaagtgtgtgccagaatagtgctgaattgaaggaacggaactacatgggcttgtctgattgttcttcagtggatagctctgttttttcccctccctccgaggaaagaaaggctagtttgaatctaaaggcgactgatcttaggctcggacttcctggattgcagtcgcctgaaagaaatccagagctttgcttgttaagttcttctcagcttgatgagaagccgcttttccctttt

SEQ ID NO: 23900 - DNA, 397 bp, Gossypium hirsutum
  Clone ID: LIB3272-031-P1-K1-D10
tctcaaggttgtttttcttttatcaactgttccaatccaaactcatagattcaatggccgaggatgacgttgtagctaaggatcgcaaaatcctggtggccgtcgatgaaggtgaggagagcacgaacgctctctcatggtgcctcaagaacgtgatttctcacacttcgaaagatacccttgtcctcctttacgctaaacctccacgagccgtatacacttccctagatggcacggggtatttgttttcttctgatattttggccaccatggacaagtacagcaacgatgtggcggattgtgtcatcgagaaggccaaaagggtgtgcagagagcaaggtgatcctgaggttaaagtagaggtgataatagagagcggtgatccaagggacgtgat

SEQ ID NO: 23901 - DNA, 369 bp, Gossypium hirsutum
  unsure (1)..(369): unsure at all n locations
  Clone ID: LIB3272-031-P1-K1-D12
cacaaacccaaatctccaattgatctgtttcatttttcagcaaagctagaaaaacaatgactaaggatatcgagactgcagagcaacatggaggggagttctcggccaaggactaccatgatccaccacctgctccattgattgatgctgaagagttaaccaaatggtcgttttacagggcagtgattgccgagttcattgctacacttctcttcctgtatgtcactgtgttgaccgtgattggttacaaggtccaaaccgaccctgctaagaacactgttgaccccgattgcggaggcgttggtattcttggtattgcttgggctttcggtggcatgatctntattcttgtttactgcaccgctggta

SEQ ID NO: 23902 - DNA, 413 bp, Gossypium hirsutum
  Clone ID: LIB3272-031-P1-K1-D2
agcaattcttaatccgcatgatcgaataatgggtttggacttaccacatggcggacatttgtcacatggatttatgactcctaaaagacgtgtatctggtacatcaatctatttcgagtcaatgccttatcggcttgatgaatccacaggcctagttgattatgacatgcttgagaaaacagctaccctctttcgaccaaaactcataatctgtggtgccagtgcatatcctcgagattttgattatcctcgcatgaggaagattgcagatgctgttggtgcatttctcatgatggatatggctcatataagtggccttgttgctgcttctgtagttgctgacccctttgaatattgtgatatcgtgacaacaaccacacacaagtctttgagaggtccaagaggtggcatga

SEQ ID NO: 23903 - DNA, 421 bp, Gossypium hirsutum
  Clone ID: LIB3272-031-P1-K1-D3
caccgttatcccttgttaaatgctctttgcccttttctcctcttctcttattttttctctctgaaaatggaaggagtgaaattggatagatggggttatgaagttaaaacctcttccgattcttgcatatctgtaatcaacgcttactatcaccaggtgctttcctatggaagaaataggaaagtgatcttagaagctcctgttcttgacaaagactgcgttttagccaacattttggccgcccattttctctcttcctctgacccttcaaaggctccttcactcatagaagctgccaacgctggaattgagcaagcctcgtcttatgagaaagccgtttttgaagctgtcaattatttgatttctcagaacagagatgatgatgttgccgtggagttacactctaagctctagagagatt

SEQ ID NO: 23904 - DNA, 404 bp, Gossypium hirsutum
  Clone ID: LIB3272-031-P1-K1-D4
ctccgacagaacatacaaagcgagctttggagggcattcgcatggaaaccacggacgagctactcgctgtgcaaggtcgcaactagctatgccttgccacagaattaccagccgaaatactgtgtataccacattgtatattggcctgacatcctgtacaaccgcctcaggacgtacaacggccgcatcggccgttacatcctcgctcagatggaggactaaagcacccagtgccacggccacattacctctgtggacgtgctgcggactcaccgcaagcttgctcactccactatgctgatgaacgcgggacaagcctccatggagcagatcattggagcagagtatgtgttgctgaatgtgtggaagacgcacaggacaagcgttgaatctggatacccaga

SEQ ID NO: 23905 - DNA, 399 bp, Gossypium hirsutum
  Clone ID: LIB3272-031-P1-K1-D5
gccatattgaactggctaagttgcattcctcctcgtataggtggtccacttgcgattttaaatccatcagatcctccagaaaggcttgtggagtacttacctgaaaattcgtgtgatcctcgggccgctatttctggtgctttagatagtagtggcaactggaagggaggtatttttgacagggatagctttgtggagacgcttgaaggttgggctagaacagttgtgacaggaagggcaaagcttggaggaatccctgtaggaatagttgcagttgagacacagacggtgatgcaggttatccctgctgatccaggacaacttgattcccatgagagagttgtccctcaagctggacaggtatggtttccagattctgctacaaagacagctcaggca

SEQ ID NO: 23906 - DNA, 349 bp, Gossypium hirsutum
  Clone ID: LIB3272-031-P1-K1-D6
cccgagccaggtttgaagaacttaacatggatctattcagaaagtgtatggaaccagttgagaaatgtttgagggatgctaagatggacaagagcactgcccatgatgttgttcttgttggtggctccactagaattccaaaggtccaacaacttttacaagatttcttcaatgggaaggagctttgcaagagcatcaaccctgatgaggccgttgcatgtggtgctgcactccaagctgctatattgagtggtgaaggtaatgagaaagtgcaagatctcttgctcttggatgtcactccattgtctttcggtttggaaaccgctggtggtgttataaccgtttttat

SEQ ID NO: 23907 - DNA, 318 bp, Gossypium hirsutum
  Clone ID: LIB3272-031-P1-K1-D7
atactcatttagcccctttcattagcatcgaaatacactccaaatttcttgatgactgaaaaatgtcttgctgtggaggaaacggtggctgcggatcatgcctcaagtgtggcactgtctgtggaggatgcaagatgtacccacacctgaacgttgccttgatgaccacatccagagaccatggttctgggtgtgccaccccagaaagcacactttgggggggctctacatggactcggggcttagaacggctgcgagtggggagacaactgcccctgccaccctggcaagtgtgaatgatttgagaccaaaggcaaa

SEQ ID NO: 23908 - DNA, 332 bp, Gossypium hirsutum
  Clone ID: LIB3272-031-P1-K1-E1
gtaacggatagtaagcattcggcggtggagtccgtgatggagaagatcagcgaggggatccacggccatgattcatcgccttcttcgcattccgattcagatcatgagaaaccagcttcccctagctccgtgagggctaagattgatcggctgtttggtagggagagacctcttcatcacgttctcggtggcggaaagcctgctgatgtgctcttgtggaggaacatgaagacatcgagctgctgttcttggtggagcaactgcagtctgcgtcctttgtgagttgatcgaataccacctacttactctgctctgtcacatttcgatactct

SEQ ID NO: 23909 - DNA, 363 bp, Gossypium hirsutum
  Clone ID: LIB3272-031-P1-K1-E10
gagatgaggaaaatcatgggtgccaaagttcttttcttctttgctttgctttgcttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggga

SEQ ID NO: 23910 - DNA, 412 bp, Gossypium hirsutum
  Clone ID: LIB3272-031-P1-K1-E11
cttaggaagcatggacttcatagctactatcctgtttctagctcttgtcgtgtcctccaccaaagctttggaccctcgcggccctcagccagatgactcggaccttttggccatcccaatctatggcaaatgttcaccattcaacccacccaaacctgactcatcgttcaacacagtcatgaacatggcatcaaaagacccagcatgggtcaagtacttgtcgagccttgtagcccaaaagaccactgcggttcccattgcttcatgccaacaagtgctaaacattggcaactatatcgtccgggtaaagattggcactccgggtcagctcatgttcatggtattggacactagcaatgatgtggcttgtgtcccatgctccggctgcaacgggtgctcagccaccactttt

SEQ ID NO: 23911 - DNA, 407 bp, Gossypium hirsutum
  Clone ID: LIB3272-031-P1-K1-E12
gcatttcgtctcttgacttcgccggattgtgaatctcctctttgttctcggatcaaataattgaagtcttgaccttaaacttgaaggttagtggttgaaacagctatctacatgtgaaatttgttagtttcgaatcgattaatgcattacatggatctgttagattggcaagaagatatatgagttctgtttgataatgctgcttattcgtcttctcacgcgattaatcttagtatcatccagtgttggttcagtaatagcttctagaaataattctcaggaggtcgcttgtacatcagaggatcctttgtatccatgctagcagagagcatgcgtggaatctgtgtttcgggtaatgcccctgacgagatattctgccgaagcattcggtgtgttgacaatttgtc

SEQ ID NO: 23912 - DNA, 419 bp, Gossypium hirsutum
  Clone ID: LIB3272-031-P1-K1-E3
gtcaactttgctgtagattttaagcaaagacccatttttcttcttcatctctctgttttcgccgttcttgtttcagtattgggactaatggcggttggtcgtagggacaaaacggcatcgtttcgtggatcccgaatcgtcgtagccattgtgatcggcgttctcctcggctgtgtcatcgctttccttttcccttacggcctcttcaatcccgctgcctcagttcaaaatcgtcgaatcgggaaaacgaatttccagattggttcttcgtcgtgtgaatcctcggagcggagtaagatgctgaagtctgaaatcgtatccctatcagagaagaactccgaattaaagaagcaagtcagggatttgacggaaaggctacaactggctgaacaaggaaaagatcaagctcataagcagtt

SEQ ID NO: 23913 - DNA, 406 bp, Gossypium hirsutum
  Clone ID: LIB3272-031-P1-K1-E4
agaaaaatgaagaaagtagagctgatattccttccaacaccaggagccggccacttggccccaactgttgtattcgtaaagcgtctcatccatcacgatgatcgaattctggttactattctttccattgagtggcattcttcgggtttcgccgatgcctacaccgaatcgcttgctactttgcaatctgatcgaatccaggttattcaggtttctcgggtagatcctcccccgttacatctttggaccttggcacccgaagctttcgtctatgcattaattcagagctacatccctgatgctagaaatgctgacacaaatattttgtctatgaaatccacttcggattcaacccgagttgcaggcttagttcttgatctgttttgctcgcccatggttgatgtcg

SEQ ID NO: 23914 - DNA, 442 bp, Gossypium hirsutum
  unsure (1)..(442): unsure at all n locations
  Clone ID: LIB3272-031-P1-K1-E5
aatnccgggcgggacccacgcgtccgtcctctcctctcctctcctctctctatcactagggtttttcgtctgctcatttgtgaagcagatatcctagttttcacaaaaagagaaaaaaactcaaaagagttattgtttcttggcttcttgctacaatgggagatgcagaaaatgcccttccaccttcaaagaagagggctgctggaagagaaatttctcgggataaccctggactcgatgatgaggaagattcttctgaacaagagactggaacttttaagagggctagtgaagaagtgttggcaaatagaagaattgtcaaagttcggagaaatcaaaccacttcaactgcctcagcgaatcccttctctgggattcgcttggtcccccttactgaaccaactgctactcctgctgcacctagttcagcccctgaatctgg

SEQ ID NO: 23915 - DNA, 388 bp, Gossypium hirsutum
  Clone ID: LIB3272-031-P1-K1-E6
gttaatatatgggtattttggagccccaaaaggactgtccagtgtcggatccaggaaaacccgaaaattgcctcttctaaatatcctcccccatttcccccattatatagtttaacccaaatatattgcaccttcacttcaatctcataaccgtcgatcccctcctgtcttaatcccacacatctctccattgatatacattaccccaggcagcttgctatctagcaaaccattctttacatatctgcgaactatacatagtattagcagggttttttgggaaaaaaaaaacgggggatcgaaggcatggaaaacgtccgcttccattcgaaacatcggaggagaaaagcaaaggacgcgatgaatttgcagcagccgcaactttatg

SEQ ID NO: 23916 - DNA, 309 bp, Gossypium hirsutum
  Clone ID: LIB3272-031-P1-K1-E7
tttcggtttctcgcctccgagaagaagccgacgccgccatggttcacggcaggttctaccgcaattatgggaagacatttaagaagccaaggcgtccataccagaaagaacgtttggatactgagttgaggcttgtaagagaatatgggctccgatataagagagagttgtggagggttcaatatgctgtgagacgaatcaaaaatgctgctagggatctccttactctctgtgagaagaaccctcgtggtatttttgaagaagaagatcttctttggaggatgaacaaggatggactttttgatgaga

SEQ ID NO: 23917 - DNA, 413 bp, Gossypium hirsutum
  Clone ID: LIB3272-031-P1-K1-E8
cgcatagataatcattcagaggattcaaggagaaaggattcagagaattggagagttttggagagtatggatggagggagatccaggaagatttctagaccggaaaaaattcttcttgagattgtgtctgagtcgattcctgccatggctcaaataatgcaggagctgcctgaagaaaccctcgaatcgaccaaagaatacttgaggaatcttattggaaacccagagtggaaggaagaattagttggacttcaaaatcgacttgacaggagatctgatcttagcaaggagactctctcaaagtgccataaggatcagctagcaatcttagttgcagtgaaaatgggcctgaaaagcttcttgtccgggaaagtaggactttccatgaccgagctgctggagattttcttgtt

SEQ ID NO: 23918 - DNA, 364 bp, Gossypium hirsutum
  Clone ID: LIB3272-031-P1-K1-E9
aacaactcaatctgaaatttttatgttcaaaataccaaagctttcgatggcgtttctggtcatcaatctcaacatccatctattaaagtatcagtggacgtaacccccaacttcaattaacagtggtggactccgtcgacggaaaaaaaaatgttggtcaacaatggaagagcgggtgaactagaatgaactggtgaagctgccatggaaggaagggttcaatggtgccgtattgggaaaaagcaaaagagctggtgaagccgccaagggttttaatatcattatgcatttaaaaaattcggaataataaaaataattactggttttgtacttggctaacttgagagttcattggtattattta

SEQ ID NO: 23919 - DNA, 408 bp, Gossypium hirsutum
  Clone ID: LIB3272-031-P1-K1-F1
gctttcttccctctgaaaccctaaaccgccgccgtcgcccgtcaaacgccgacgaaaatggctttcgagggagtagttctccgcggcaccatgcgagcccacactgacatggtaacagccatcgccactcccatcgacaactccgatatgatcgtcacttcctctcgcgacaagtccatcatcctttggcacttgaccaaagacgaaaatgacctacggtgtcgctcgccgccgtctcaccggccactcacactttgttcaagacgttgttctctcttctgactcccagttcgctctctccggttcctgggacggcgagcttcgtctttgggatttgaacgccggaacctccgctcgtcgttttgtcggccacaccaaagacgtgctctccgttgctttttcaattga

SEQ ID NO: 23920 - DNA, 380 bp, Gossypium hirsutum
  Clone ID: LIB3272-031-P1-K1-F10
gttctctccaaaatatctgctttttcttagttttcctttttgtcccttgtttatttgatatttccccctcatggccgccgctgatgtcgagttccggtgcttcgtcggagggctcgcatgggccaccgacgaccgggccctcgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacatcaccgtcaacgaagcccaatcgcgcagaagtggatgcggtggcggaggatttggaggaggaaacggtggttaca

SEQ ID NO: 23921 - DNA, 384 bp, Gossypium hirsutum
  Clone ID: LIB3272-031-P1-K1-F11
tttattttctctgagaagctgaaaaatggcggaatcggtggagttgccaggtcgtttagcaattcttccattcagaaacaaagttttattgcctggcgcctttattcgaattcgctgcacttcacagagcagtgtaaaattggtggagcaagagttatggcagcgagaggagaaaggattaataggaattcttccggttcaagatgctgctgagacgacctccatggattccatgttatctcaaggtgttggaagtgaatcaggtgagcgaagctcgaacgttcaggttagcacatctgatgctcacaaggttgatgggaaaaacccttcagaagtcattcactggcataacaggggagtggcagcacgagctttgcatctatc

SEQ ID NO: 23922 - DNA, 413 bp, Gossypium hirsutum
  Clone ID: LIB3272-031-P1-K1-F2
gttctctccaaaatatctgctttttcttagttttcctttttgtcccttgtttatttgatatttccccctcatggccgccgctgatgtcgagttccggtgcttcgtcggagggctcgcatgggccacccacgaccgggccctcgaaaaaaccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacatcaccgtcaacgaagcccaatcgcgcataagtggaggcggtggcggaggatttggaggaggaaacggtggttacagccgcggtggaggcggcggcggatatggtggtc

SEQ ID NO: 23923 - DNA, 418 bp, Gossypium hirsutum
  Clone ID: LIB3272-031-P1-K1-F3
ggccatctctatgcgctagatcttacactgtcttattaattgccaatcaaactgtcgatctctcttctgcacatcgaaccttattattattgtaacaacataaaataaccttatacccccagagtgccgaataaaatcggcatcaagcgcgttcagaaagaatacagagacactccagtagggaaccaagtaatcatgttgttgctcgcacataacacaagtgacattctcagaacggcattaactagcgtggaagggagtgaaggaacaccgttggcaggtggatattactatgaaaagatcaagttacctcctgagtatccatacaaacctactggaatcaccatgatcacccccaatggacggtttatgacgcaaatgaaaagatgcttgtccatgagtgattctcatccagaaa

SEQ ID NO: 23924 - DNA, 415 bp, Gossypium hirsutum
  Clone ID: LIB3272-031-P1-K1-F4
gacacacctcaaaaaggatctagaaaagagaatatctccttttattttcatttcgtgcttcatttcatctcaaatccatcatcgaaattacttgtagttatcagaatggggacaataggcaaaactactacggccactatttttctttgtcttcttctgtttcctattgtcttttccacgcctaatgacagatttgttagaattggactcaaaaagagaaagattgaccgaaacaatcggatggctgcacaccttgaatccaaggaggaaaaggcatctgaagcttttcttagaaagtatcgtcttcatgggaacttgggggaatcagaggacattgatattgtggcactaaagaactacatgctcagtactttggtgagattggtattggcactcctacacagaacttcactgt

SEQ ID NO: 23925 - DNA, 405 bp, Gossypium hirsutum
  Clone ID: LIB3272-031-P1-K1-F5
gataatccagagttcaatcatctaaaagaagccctaaaatctttgaatcaggtctgagcttgtggtttgttaggcctctttgatcaaactaagtttcatgtctgatcttgacgttcaaattcctactgccttcgatccctttgctgatgcaaatgctgaggactcaggtgcgggtgcaaaggagtatgtgcatattcgtattcagcagaggaatggtcgcaaaagcctgacaactgtccaggggttgaagaaagaattcagctataacaagatacttaaagacctgaagaaggagttttgctgcaatgggaccgtggtccaggaccctgaattaggacaggtgattcaacttcaaggtgaccagcgtaagaatgtatcaaccttcctttcaggctggcatagtga

SEQ ID NO: 23926 - DNA, 301 bp, Gossypium hirsutum
  Clone ID: LIB3272-031-P1-K1-F6
tcaaaaccgaaactcgggaatttcaactcatcatccactttgactcagcggttcacctgactgagtcaactaaaagttatggcgttaccgactcatcagttacagagattccttgcaatcgagttcaatttcatctccaatcccaaaatcgcttacaggaaccaactaaccgcaacaacggcgataagatctagtccaagaagcccctgccgttgctccgcgattgcaataaacgctccttcttcgctaacggttgtttccgggatccgttgggggtcgacatgtgtgcagggcaggcccg

SEQ ID NO: 23927 - DNA, 322 bp, Gossypium hirsutum
  Clone ID: LIB3272-031-P1-K1-F7
cttcacttcagttgttagcagaagaaaaagaatggcgacaaccgtggatggcggaaaccagtacgatagagccgaagaagtaaaaagattcgatgactcaaaaattggagtaaaagggctagtcgattctggtctcaccactatccctcgcatcttccttcacccacccgaaactttatccgacctcaaacccaaacccaaacccaagtcgggtgccatacccaccatcgacctctcggggccccattcgacggtcgtggagcaagtatcttctggatcttaatcctttgggttcttttaaaatggcaaccatggaattccc

SEQ ID NO: 23928 - DNA, 318 bp, Gossypium hirsutum
  Clone ID: LIB3272-031-P1-K1-F8
ttttagttcaaccactcctaataaccgctcggatttttctcacacgtgttgtatattccacttcttttgacccaaacaattaaacagatacgatgcctcaaaaattaggcgtcaaatggctcgtcgactttggtcccaccactaaaaccaccatcttgcttgacgtaaacgtagcattatccaacatcaatacccatccgaaacccatatcccccggcattctcaacatcaatctctctgacccctattcgacggtggacgagcaagtagctactaactctcaatcctttgagttctttcacattatattccacggaa

SEQ ID NO: 23929 - DNA, 373 bp, Gossypium hirsutum
  Clone ID: LIB3272-031-P1-K1-F9
cttgtttagaaaaaaaaaacccccaagaacgaggaatcaatcaaaaagagaagagaggtgtcacggtcgtaacgaatgcacatgtgcttagttttcttgaggcttttattcgctctttgcttctcccctttgaatctgcttctacttttagaaaatttcctgaattctcatcttctagccccgtcacagactaatacaaagaaaagacacccaagagcagaaaaggagggacaatacacctatgcggtcttgctttagtttcttgctactatgaggctggctttgtgaagattggctttgtttcctcggtgggttctttttattgcatctttttttcccttttttgttttccgtcttgggggtgctctgagtc

SEQ ID NO: 23930 - DNA, 416 bp, Gossypium hirsutum
  Clone ID: LIB3272-031-P1-K1-G1
cggacgcgtggggtctttatacaagctttcttcaatttcaacattcaagaatcaagtgtttgcaaagatgagttctacaagcagagcatggattgttgcagctagtattggagctgtagaggctctgaaagatcaaggtatttgcagatggaactacacagtaaggtcagttgcgcagcatgccaagaaccatgtgaggtcagcttcacaggccaagaacctctcctctcaatcctcagctgcaatttcaaagggactgaacaagtctaaacaatcagaagagtctttgaggactgtcatgtacttgagctgttggggtcccaactgagccataaatctgtcaaaatcgattacaattacaaggaacattcttaatttgggtgaatcattgactcccgagtgcaagctttggtcat

SEQ ID NO: 23931 - DNA, 404 bp, Gossypium hirsutum
  unsure (1)..(404): unsure at all n locations
  Clone ID: LIB3272-031-P1-K1-G12
gccaaaaatgtctctttacccttctctcaccatgtcattgctgtctttttccttcttgttgctgtttgcttttagtgccaaagctgttgttcctccatctgaaactttaaggttggcaaccaaagggaatttgggccctttattggttaatatggggcaaattaccgggtcataagcatagctaatgcccccttccagcttgcgttttataacaccacgcctaatgccttcacccttgcgttacgcatggctacaacacgttccgagtcgctcttccgatgggtttgggaggccaacagggggaaccctgttcgcgagaacgccacgttctctctcgngactgacgggaaccttgtcttggctgatgccgatggtcggattgtttgcaaaagtacactggcaac

SEQ ID NO: 23932 - DNA, 351 bp, Gossypium hirsutum
  Clone ID: LIB3272-031-P1-K1-G2
gaaaaaagggctccgaccttcgaagctccaacttattggccgtcctgcctggtcttaggtccggcgttcttggcctccacacgctctacgagccgccaccagagccaccgcattcggggggttgggtttcaaaaaccctcccttttttttgccgattctcaggtacttgcaaaaaatctggcaatagcaaaggcttgacgatggtccactggtggcgttgatctcagcgtgagttggggcctagaatcatggccttgatggggtagcaggagttgaagagtcatgaggcttggcttctggaaccttctgtttgcggcgcgaagagaaagatggcagaaaccctagggtttc

SEQ ID NO: 23933 - DNA, 346 bp, Gossypium hirsutum
  Clone ID: LIB3272-031-P1-K1-G3
gaaagcttgtatcagggaagaatctgtgggcaagcttaagggcattttggggtgcgttgaggaagattttttgtccactgacttcgttagggacagcaagtcgagcatatttgatgccaaggctggtattgctctaaacaagaacctttttaaacttggtttcgggtacgacaacaaataggggtacaagttttgtgtgattgatttgatcgttcacatggcattcaccaaaacatgttgaagttttttttttaaggccagcgaataaatgaggtttttgggtgaaaagaatattatgtgtttagaaaaacttccctttctttggaaaaaaaaacacaaagatttt

SEQ ID NO: 23934 - DNA, 101 bp, Gossypium hirsutum
  Clone ID: LIB3272-031-P1-K1-G4
acgaaaccaaatatggcggagaaagcaaccgggccggtcaatgcttccgccgggaggaagaccgctgttgccgtaacacacttcaagagaggccgcggttt

SEQ ID NO: 23935 - DNA, 381 bp, Gossypium hirsutum
  Clone ID: LIB3272-031-P1-K1-G5
ttgttctctctctctcttattagaaattagacactactagacttgtagaaatgcaagggctcgtcttgttgccggtactcctttgcgccacctaccatatcgctctttccgcgaccaacgttacggtggcggacgggctgttagataatggtaactttgagcaagccccgattgcctaaaccttgaaggccccggtggtggggggcgttattccataccaggatgggtaaaccaagggtttgtggaatacataaagtccgggcaaaagcaaggggacatgttgctggtggtgcctgagggagcctatgcagtcaggttggggaacgaggcttcaatcaagcaggagataaagggggcgaaagggatgtatcactccatcac

SEQ ID NO: 23936 - DNA, 390 bp, Gossypium hirsutum
  Clone ID: LIB3272-031-P1-K1-G6
catgatttgaacttggagcacagtgcaaacttggaacaaaatgcgaacttggagcacattgcaaacttggagcacatggcaaacttggagcacaatgcaaacttggagcatattgcaaacttacagcagattgcaaacttggagcacaatgcaaacttagagcacattgctaacttggagcacaatgctaacttagagcacagtgtggactcggagcagaacttaaacttggagaagaactggaagagaacttggaggagcagaaattgcagcaggaatcacaacatcaaccaaaacaagaccatgtaaacgaggcagtggttggaggtggtgaaaagaagtggcctggatggactggagagagtgtgttccggatgttatgtcctgcac

SEQ ID NO: 23937 - DNA, 412 bp, Gossypium hirsutum
  Clone ID: LIB3272-031-P1-K1-G7
cttagccggatggcggagtggcgtgatgtgacgcctcttcctcaagacgacggtcctaaccccgtcgtccccatcgcctacaaggaaaaattccgtgaaaccatggattacttccgggccatctacaaagccgatgaacgctcccctcgtgcccttcggctgacccgacgagcaatccatctcaatcctggcaattacactgtttggcattttaagcgactcgtgctcgaaacacttaatgccgatttggacgaggaattggattttcttcaacggattgctaattctaactctaagaattatcagttatggcaccatccgcggggggttgtcaaaagatttggagctaatgctagagccaaggagcttaatctcattaagaagatactatcaattgatgccaaaaactatc

SEQ ID NO: 23938 - DNA, 356 bp, Gossypium hirsutum
  Clone ID: LIB3272-031-P1-K1-G8
aatagcctggatccacagctatctgatctgacgcacattcccgaacgagtcaggagtctaacttattttaaactacacccgacccaaccagacaatctccttatccaacttatactgtgggtaacaatataaaaacgcttacttctcttatttgaaactcaccctcaatgcaaaaagacttacatctcaaaactcgggactactacgaacatgctgctatgctcatcagtgcacgttgaacgattatgatgattttcacaaggactttgcacaagttgaacagtattatacgcttgcttctaaaaccttttgattatggcaccaagagaaccaggtcataaaccgtattgtctcta

SEQ ID NO: 23939 - DNA, 244 bp, Gossypium hirsutum
  Clone ID: LIB3272-031-P1-K1-G9
gaaaataaatataaggaaagcagagaggggtaaattggagggagaggtggaatcacatgcgcattagttcactgtcgctctcctgggtcctcgtttagcttagctagttctatttcttgttaatcatcatcatcatatacctttttttttcgccatggctgacgataaggaaatctcagcccctgttgttgatactggtcacatcatctccaccacgattggaggcaaaaatggagagcctaaa

SEQ ID NO: 23940 - DNA, 246 bp, Gossypium hirsutum
  Clone ID: LIB3272-031-P1-K1-H1
gattttcctgaaaaccctaaccggcaagaccataactctcaaggtcgatagcaggtttaccattaacaacctcaatgccaagatccaagacacagaaggaattccaccggactatcaacgtgtcatggtgaccagaaaacagcttgaagatggccatacctaggcttactacaacatccagaagagaatcaacactctatcttgtgaaagaagcgagagggggaaccatcgatccttctttgatgg

SEQ ID NO: 23941 - DNA, 163 bp, Gossypium hirsutum
  Clone ID: LIB3272-031-P1-K1-H11
aattaacaagaatggctctttcagctgccactcttctcactgcccttgcggtactctgctctttctttttcattctattttacatctcatcaagcaaaaatggaaaaggaaaaggaaaagggaaagccattccgggtccccgacccttgccaattattggaaa

SEQ ID NO: 23942 - DNA, 391 bp, Gossypium hirsutum
  Clone ID: LIB3272-031-P1-K1-H12
gcgacgcgtccatcagtgcgtcgtcagagccttcgtgaagcggctcggttcatgcgccgagccacaagccgaagaacgatgcgcgagccatctatgcttgttcgagagaccgccgccgagcagctggaggaacgccagagcgattgggcttattcgaaacccgtggtgattctcgatgtcatctggaattttgctttcgttgcggtggcagctggggtcttgttcttgagccgtgatgaaaaccccgagatgccgttgaggctttggataattgggtatgcttttcagagtttgttgcatatggtttgggtttgtgtggagtacaagcggcgtaagaggcggcagagcatggagtatagtcgatttaatgcaggggaggattgtgttttga

SEQ ID NO: 23943 - DNA, 416 bp, Gossypium hirsutum
  Clone ID: LIB3272-031-P1-K1-H2
cttaagcaatggcggccgaggaggacagcggggagttttacctccgctactacgtgggccacaaagggaaattcgggcacgagtttttggagttcgagttcaggccagatgggaagctccggtacgctaacaactccaactacaaaaacgacactatgatccgcaaagaggtcttcctcactcctgccgttcttaaggaatgccgccgcatcatcgccgagagcgagataatgaaggaagatgataacaattggccagaaccagaccgtgttgggcggcaagagcttgagatagtgatggggaatgagcacatctctttcacaacttcaaagattgggtcccttgttgatgttcagagcagtaaggatcctgaaggtcttcgcatattttattatctggttcatgatttgaagtgc

SEQ ID NO: 23944 - DNA, 415 bp, Gossypium hirsutum
  Clone ID: LIB3272-031-P1-K1-H3
ggcggcttctgcttctatttactattttctcactctcctactcctttgtgccatccgttttaccttctccgagctcgttaaagagcagcctctggtgttgaagtaccacaatgggccaatcttgaaggggaagatcaccgttaatctcatctggtacgggaagttctccccaacccagcgctccataatcgtcgatttcatcaactctttgagctctgccgtcaaacccaagattccgtcggcgtcgttttggtggaaaacgacggagaaatacaagtccggttcctccactttggtcgtgggcaaacaaatccttctcgaaaattacccgctcggtaaaacccttaagaacccacacttgccagcgttggccgggatattcaacggcgtatgtacggttagcgttatcctcacg

SEQ ID NO: 23945 - DNA, 316 bp, Gossypium hirsutum
  Clone ID: LIB3272-031-P1-K1-H4
ggaagcggctttcagactctcttttccctatcccccgtttcgattgccaaaaaattgtaattagcttcttctcttttaaatgtatagcttctttattttgttcttcttgatttgattcataaacggtgacttgggagaaagggtggacgccggttagggtttttgggattgttgagaaggagattagcagcgtggtttccaggcgatgggcgatgtgaaatcgatcatcgtgatggcgagtagggattgtgagagtaaacatcgggagcttctgatcccggtcgctgacgcctgccacgatgataacaccaaacct

SEQ ID NO: 23946 - DNA, 449 bp, Gossypium hirsutum
  Clone ID: LIB3272-031-P1-K1-H5
cgggacggcccgggcggaccgacgcgtgcgttgcagcccatttttttgagaaacaaaaaacagatagcttttgctctctctccctgtcctcttttccttgcggctagggttttgaaaccctcgtcgccgccattgtcacggcgccaccacaggcggtagttgggacgttgcgagcttggctttctagcccctgtttaaagcgtccccaaaggccaagccttctcagcccaaaaggtgcgaaagagaggatctctcccctccctattcggtccgatcccgatgacgaaggagagccctccgacgacgaaaaccaccggcgactacggtgtcagagaggtgccaggcgatggcagttggctcgcgaggaggcaaggcggcacgcgtggtggccaatggttggccaaaagttcggcagtagcattcttggggggctggctgctgcttgtttc

SEQ ID NO: 23947 - DNA, 327 bp, Gossypium hirsutum
  Clone ID: LIB3272-031-P1-K1-H6
acgacgcgtgcataagggcactcttaatattgtagatttggatgattatgcggtagatgatgaacattacgaggagaagatgaaaaaagagagtttggctttcttcttcttggccacttatggagacggtgagccaacagataatgcactctgtttctataaatggttcactgagggaaaagagaggggagtatggcttcagaacatgaagtatgggatctttggccttggtatcaaacaggatgaacatttcaacagggtggcataggtcgtcgatgaactccttacactacagtgagcaaaaggcataattcctttgagttcaag

SEQ ID NO: 23948 - DNA, 400 bp, Gossypium hirsutum
  Clone ID: LIB3272-031-P1-K1-H7
gtcaatgaaaaagatccacaaagataaggatgttgaaccaacagaatttgaggaatcagttgcccaggcattcttcgatttggagaataccaacaaggatctgaaaagtgacctcaaggatctctacattaattcagcagtccaaattgatgtgtctgggagccggaaagctgttgttatccatgtcccgtaccgattgaggaaagcttttcgcaaggttcatgttaagcttgtgagggagcttgaaaagaagttcagtggaaaggatgtgattcttattgctacccggaggatattgaggcccccaaagaaaggttctgctgttcagaagcctcgcagccgcacattgactgctgtacatgaagcaatgctggaagatattgtcttacccgctgagatt

SEQ ID NO: 23949 - DNA, 272 bp, Gossypium hirsutum
  Clone ID: LIB3272-031-P1-K1-H8
gccaaagcaacatacccactctgttcaacagcaaaaaccgcaacagtgcgaggtacctcctgttgtatcgtgcaaccttctatccaaaaccaactcacgactgcaatggtaactgcccgacacttcacatgtatctattaagaacattctctataccttcggagctagaaatgctcctaccaatcacaaaacattaaagacgaggtcatatcattaagcattggctgaacctaatagtgaggatgagccctttttaagcacgatccacgacc

SEQ ID NO: 23950 - DNA, 312 bp, Gossypium hirsutum
  Clone ID: LIB3272-031-P1-K1-H9
gcagaaacgaccggcagagaaataaaaatgggaggctgggcaatcgcagtgggtggtggtgctggtgtagacccaaatctccctaatgaaaggcaagaggaagctaaaagactcctcaatcgttgccttgatattggaatctctgctcttcgttctaacctctccgccattgacgtcgttgaacttgtcgggagggaattggaaacggatcctttgtttaattccgggcgtggatcggcacttacggagaaagggacggtggaaatgggagctagtattatggatggacccgaaagacgatgcggtgctgtt

SEQ ID NO: 23951 - DNA, 385 bp, Gossypium hirsutum
  Clone ID: LIB3272-032-P1-K1-A1
caaaacaacagccaattactcttcagtctcagccgatcttaaaccatgggtcgcgttcgcacaaagacggtgaagaaatcgtcccgtcaggtaatcgagcggtactattctcgaatgaccctcgattttcacaccaacaaaaagattatcgaagaagtagctataatcccatccaagaggctccgtaacaagattgccggtttctcgacccatcttatgaaacgtatccagaaaggaccagttcgcgggatttctcttaagcttcaagaagaagagcgcgagcgtcgcatggattttgtccccgatgaatcggccatcaaggtcgaccaaatcgaagttgataaggaaacacttgatatgctttcggttattggaatgggtgata

SEQ ID NO: 23952 - DNA, 242 bp, Gossypium hirsutum
  Clone ID: LIB3272-032-P1-K1-A10
gaacatctttcctttttttctctctatattttctcatctccttcaacagcgcggggggtctaaactcttataggcaatttcaaaaaagctccaaaacgatggccaatgctgcatcgggaatggctgtgcatgatgattgcaagttgaagttcttggaacttagttatcttttatcattaacggtctgtccacccaagaaacggctcaaccggaagtaggctacagcggtcaaaatagcaccg

SEQ ID NO: 23953 - DNA, 365 bp, Gossypium hirsutum
  Clone ID: LIB3272-032-P1-K1-A11
aacgcgattttctattttgatttctctccctccaattaagatgcagatcttcgttaagaccctgaccggcaagaccatcaccctcgaagtcgagagttccgacacgatcgacaacgttaaggcgaaaatccaagacaaggaagggatcccaccagaccaacaacgtctcatcttcgccggaaaacagctcgaagatggccggaccttggccgattacaacatccagaaggagtacaccctgcatctcgtgctccgtctacgtggtggcatgcagatcttagtcaaaaccctgaccggcaagaccataactttggaagtcgaaagctctgacaccattgacaacgtcaaggcaaagatccaagaca

SEQ ID NO: 23954 - DNA, 337 bp, Gossypium hirsutum
  Clone ID: LIB3272-032-P1-K1-A12
ccttacttggcagccatgattattccagagaagaaccgcagagaaatctgcaaatacctatttcaagagggagtttgctatgcaaagaaggattacaatcttgcgaagcaccccgagatcgatgtacccaatttgcaggtcattaaactgatgcagagcttcaagtccaaggaatatgtccgcgagacttttgcttggatgcactactactggtaccttactaatgatggaattgagtttctcagaacttaccttaatcttccatccgaaattgttcctgctactttaaagaaatctgcaaggcccccgggtaggctaggcggcccacctggtgatc

SEQ ID NO: 23955 - DNA, 231 bp, Gossypium hirsutum
  Clone ID: LIB3272-032-P1-K1-A2
aagataccgaaaaacatttgggggagagacagagagagaggaaggaaagacgtgcaccgacagccttaaatcagctagaatatccacattatcaaagatgcagtcaatgttaaccaactctacttttttcaactcataacaacataaacaacagggggctgttcttatggtcgacaacaacaacaactttttcatggcctcccaaaccagtggatgggttccatccaatac

SEQ ID NO: 23956 - DNA, 393 bp, Gossypium hirsutum
  Clone ID: LIB3272-032-P1-K1-A3
gaagagctttcctttttttctctctatattttctcatctccttttccaccgccgtcgatctcgatccttatccccgttttcaaaaaagctccaaaaagatggccaatgctgcatcgggaatggctgtgcatgatgattgcaagttgaagttcttggaacttaaggcaaaaagaacccaccgctttattgttttcaaaatcgaggagaagcagaagcaagttattgtggagaagcttggtgagccaaccgagagctatgaggattttactaaatgtcttcccgctgatgaatgtcgttatgctgtgtacgattttgattttctaacggccgagaacgtcccaaagagcagaatctttttcattgcatggtctcccgatacatcaaggatcagga

SEQ ID NO: 23957 - DNA, 329 bp, Gossypium hirsutum
  Clone ID: LIB3272-032-P1-K1-A4
tcgacggcacttgcacatgggttagtcgatcctaagagacgggggaagcccgtccgacagcgcgtccagcgcgagcttcgaaagggaatcggattaaaattcctgaaccgggacgcggcggctgacggcaacgttagggagtccggagacctcagcggaggcctcgggaagagttatcttttatgattaacggcctgcccaccctggaaacggctcaaccggaggtagggtccagcggtcggaagagcaccgcacgtagcgtggtgtacggtgcgcccccggcggaccttgaaaatgccgaggaccgagtgccgtacgcgcccggtcgt

SEQ ID NO: 23958 - DNA, 405 bp, Gossypium hirsutum
  Clone ID: LIB3272-032-P1-K1-A5
gaaaaaagcatttgtaattgtaattgtaaattgtttcgagatctctgtgtatagacagtctcaaatggcagcagctgcagcaccagatcacttgttccatttgaggaacaatttctacttgggttcctttcaggctgccatcaacaacagcgatcttcccaacctctcgcccgacgacgccgttgagcgcgactgcctcgtctaccgctcttacatcgctctcggcagctaccaactggtgatcaatgagatcgactccgccgctaccactcctctccaagccgttaaactgctggccctctatctctccaaccctcatgataaggaatcaacaattgcgagcttgaaagaatggttagcagatccagcgattggaagcaatgccatattaaggttgattgctgg

SEQ ID NO: 23959 - DNA, 289 bp, Gossypium hirsutum
  Clone ID: LIB3272-032-P1-K1-A6
ttccgtcctaattttcaggaaaaaatcgccgccgtgattcaaaactcagcccactgtctccgatcgtgtcaactcgtaacccaatctctcaaatatggatcgacccagattcgtaatcgacgccgtcgaagccgagcaaatggccaaacaatcaggcaagacggtgctccaactccttccttctttggtcaaatcagcccagtccgttgcccgcccgccgatctcgaagtaccaagttggggcagtcgggatcgggtcatccggtcggatctttttcggagccaattta

SEQ ID NO: 23960 - DNA, 402 bp, Gossypium hirsutum
  unsure (1)..(402): unsure at all n locations
  Clone ID: LIB3272-032-P1-K1-A7
gttttgacaacactcacctgtctcattaaaacagaaaaaaaaaaaaaaancccctcacctgcctcatttcagtatctaccaattaccagaaactagaggcagcaaaaatgagatctacctaacactctatccgtccttcaaaacatacaaacaaaggggttgttttcttgattgcaagagaaaagcaatctttttggacacccaagtgtggttgaaggcttaaacatcagctgaagaactgatactttttctgttccaagctttgcttttgtgccgtatttcctcaaaatttctagcgatgattccaattgggtttctgggtttactgtttttgctgctcgctctatactgtgggacagacccttttaagcacagtgcaatctctgaatttcctgactttga

SEQ ID NO: 23961 - DNA, 373 bp, Gossypium hirsutum
  unsure (1)..(373): unsure at all n locations
  Clone ID: LIB3272-032-P1-K1-A8
tggaggncggccaaagcaaacacactatcagcaggcgcctgcaagccgtaaagcaaaaatctggcaaatcctataatcaaatagccgaagaaaccggcttaaccaacgtttacgtggctcagctcctcaaacgccaggctcagctcaagcctgaaaccgctcctaagctaagggcagccttgcccgaattgcctgaggagcttctccatgagatgatgaaaccaccgttacggtcctatgatccgaaccttatccaagaacccactgtttacaggttgaatgaggcagtgatgcattttggtgagagcataaaggagattatcaatgaagagtttggtgatgggatcatgtcagctatagacttctactgctc

SEQ ID NO: 23962 - DNA, 399 bp, Gossypium hirsutum
  Clone ID: LIB3272-032-P1-K1-B1
tttcagaaaatcaactaaccaaatcatgtgcccccaagatagtgcgcattctatcaaaccataattcaaaatatctacgctgcgcccaccgtttggttttctgatttcgcagagaaaatacttgtttggcttggaggaaactaagaaggaacagagaacgcaagcctattcacgatttcagctcagaagacatgttttttgaagtggcattgccaagggatgtgaagatacatgctaccaacttggataaaccagtttctcggaggttcatactggcatgcgtactcgacaacctatttaaggagaaagccagcgaggatcatggttactttgtagccgtaactctggtgaaaagcatatgtcaaggcaatgtaatggatgagtcggggaatacggttt

SEQ ID NO: 23963 - DNA, 398 bp, Gossypium hirsutum
  Clone ID: LIB3272-032-P1-K1-B11
atctgccatcaatttgctttgaagatcatgttggctatttttcacaaggcatttgctaatccaccagaggagctgaatagtccagcttctcataaatctactaagaagcctaaacagcctgaagaaaccctaaatgatttcctatctcatcaccctcacaacactttctccatgagctttggcaacgctgctgttttggcttatgtccgccatgaacgtgctgcttcagttcatcagaggttgttttgtgggtttgatgacatatactgccttttcttagggagcttgaacaatctatttatgctgaatagacagtatggtctttccaaagggagcaatgaggcgatgtttgtgattgaagcatataggacactaagggataggggtccataccctgc

SEQ ID NO: 23964 - DNA, 398 bp, Gossypium hirsutum
  Clone ID: LIB3272-032-P1-K1-B12
gaaaaacttaatcatggctcggttgacgttggtgtcctccatcatccttctgctatgctccgtcgccgccggatcaactttcgaggactccaaccccatccagatggtatccgatggcctcagcggcttcgaatcctccgttcttcgtgtcatcggtcacactcgtcatgctctctccttcgcccgttttgcatacaagcatgggaagaggtatgaaaacgtggaggagatgaagctacggtttcagattttcaaaggcaacttggatttaatcagatccactaacaagaagggactgccttacactcttgctgtcaatcagtttgctgattggagctgggaagagttccaaaaacacagattgggggctgctcaaaactgctctgctaccacaaaag

SEQ ID NO: 23965 - DNA, 368 bp, Gossypium hirsutum
  Clone ID: LIB3272-032-P1-K1-B2
tattttctcactctcctactcctttgtgccatcccttttaccttctccgagctcgttaaagagcagcctctggtgttgaagtaccacaatgggccaatcttgaaggggaagatcaccgttaatctcatctggtacgggaagttctccccaacccagcgctccataatcgtcgatttcatcaactctttgagctctgccgtcaaacccaagattccgtcggcgtcgttttggtggaaaacgacggagaaatacaagtccggttcctccactttggtcgtgggcaaacaaatcctcctcgaaaattacccgctcggtaaaacccttaagaacccacacttgccagcgttggccgggaaattcaacggcgt

SEQ ID NO: 23966 - DNA, 395 bp, Gossypium hirsutum
  Clone ID: LIB3272-032-P1-K1-B3
cgcccgcggtccgcggtccggggttccggccacgcctcacgcgtgccccatctccctcatcctattcacaaactttaaaatgtttggacagctcggttgtttctcttacatacaaaaagcgccattagaagatgggtacaacacaggttcaagttatcagacatgtcgcacacagtctgatcttacaatcttatttacatgaacaaatgcactctccacgataaactacaccgcctcccgtcatcatcaaaacaggaacaaccggattttaatcccagaaaatcctatcattgtactggagagctcgatccaattcatgtctccccagctcaaccactgagatatttcacccagaaaccatatcccagattgaattgtcgggcaccgccgccaaa

SEQ ID NO: 23967 - DNA, 261 bp, Gossypium hirsutum
  Clone ID: LIB3272-032-P1-K1-B4
gttcactcatcaccagaagattgttgtagtggatgctgcaatgcctaatggagatccagagaaaaggataattgtgagctttgttggaggtattgatctttgtgatgggagatatgacacacctttccattccctgttcaggaccttggacaccgctcaccatgattatttccataagccaaactccactgatgctttaatcaccaaaggtggaccaagggaaccttttctcgttatccactcccgactggaaggtgccaa

SEQ ID NO: 23968 - DNA, 306 bp, Gossypium hirsutum
  Clone ID: LIB3272-032-P1-K1-B5
tcgatctaacataaatattctttaaaaatcatgttggctattttatcacaaggggtttggtaattcaccagaggagctgttatatccatcttttcataaatctactaagaagcccaaacagtcttaagaaaccctaaatgttttcctatctcatcaccctcacaacactttctacatgaactttagcaacaccaataattattcttatattcgtcatgaacatccacctttatttcatcagaaaaaaggatggacttgatatacaacatatattctcattttttttctggctcttccaacaaattt

SEQ ID NO: 23969 - DNA, 395 bp, Gossypium hirsutum
  Clone ID: LIB3272-032-P1-K1-B6
gcgatctggcagagactactcttctaatcacaatcttcgacggagtaaatgagcgaattttagagagagaaagttaataatcttctcctttgctgcttaaaagttcacagctttcccttcttgaggctcaagttaaggtctttgcaatgcaaactttgctgttggctatggcagaatgcatgtgctgatattgcagtagctgtgataatcatggcatattgccttggttttttttcctggaaaattttatctaaatggagagaaatctaggaaaaggcttaatggatcaacagaagaaccatgaacaaattcgatacaataatatggaagctggaaatgagactcttgagtctgcaaaccaaagatttttccatgatccatctagtaatattaat

SEQ ID NO: 23970 - DNA, 362 bp, Gossypium hirsutum
  Clone ID: LIB3272-032-P1-K1-B7
gtctaagatatcactgcaaggtaaaaacaaaaagaaccagacatggcttcaaacactgctgcattggctgctctcattattacctcgaacttggtgcgcttcactgcgggttgctctacctacgtgccgtgcgcaccacctccgaagggccacaagcctacccacgagagcccaccctgggcgcctaatcagacagccacttggcccaatgatacactgtacctaggggattgtgctggttcccagcgctcggtgctcgttgttgctggaccggcgaggaccaaatgctgctcactcatttcacgtatgactgatctcgagggtgctgactgccttagcactgctatgatagctaatgcgtt

SEQ ID NO: 23971 - DNA, 259 bp, Gossypium hirsutum
  Clone ID: LIB3272-032-P1-K1-B8
accgttccttattttttcgtcgccccctctttatttattttctattttttattaattttttatatcattttaccttatggtgtggggttattacaacctttcttattttacaaccaatctatcattttcttaatgctaagatcaccatttattttcttaattttgggttatttatttctattttttgctttgtgtaatcgtcgatttcatcaactcttttagctcttccgtcaaacccaatatttccgttggcgttttt

SEQ ID NO: 23972 - DNA, 233 bp, Gossypium hirsutum
  Clone ID: LIB3272-032-P1-K1-B9
gaggctgctggcgcacctaaaggcttgctgcggcgctccttaaggctagggttcttcctttttctttgggccagggttgttttggggtttggtttaatgatttggggtttaggttagctctgggcctgtatttgttggactgttttttaattttgtttggacctgggtcaattgggccctattacagctttatttaatcttgttcttaaatcacaataaataatattgatttt

SEQ ID NO: 23973 - DNA, 393 bp, Gossypium hirsutum
  Clone ID: LIB3272-032-P1-K1-C10
gaaagcaagccactagggttttaagagaagatcaaaatggcttcaaaaaaattagcttccatggccttctttttggcactcaacattctcttcttttccctagtcagtgcttgtggctcttgctcttcacccacccctaaaccaaggccaaacccaaaacccaacacccccacccctactgcatccgcacgaggcaggtgccctagagatgccctcaaattaggtgtatgtgccaatgtgcttaacttagtcaatgtcaccgttggttcacctccagtgatgccatgctgttcccttctcaatggccttgtcgacctcgaagctgctgcttgcctttgtactgctatcagagctaacatcttaagcatcaaccttaacatcccagtttctctt

SEQ ID NO: 23974 - DNA, 395 bp, Gossypium hirsutum
  unsure (1)..(395): unsure at all n locations
  Clone ID: LIB3272-032-P1-K1-C11
gacactaaatgttgaggaaacaaatgatggctttgcttataacgttttgttagactacacagtggctaactcgtccatcgggaccggaaatctcatcttgacaaggccgaaatacaacagcacattgtcgattcttcgactcgggatcgatggaaacctgagggtttttacctactatgacaaggttgattcacaggcatgggaagagactttcactctcttctctagggactcaatatggggcactgaatgcgaactgccggagaggtgtgggaactttggactctgtgaggagaaccaatgcgttgcttgcccgtcaacaaacggattactcggttggagccagaattgtcagccgaagaaggtgaattgtangccgaatggtttcagctact

SEQ ID NO: 23975 - DNA, 388 bp, Gossypium hirsutum
  Clone ID: LIB3272-032-P1-K1-C12
gattgttcatggagaatgtttagctgatgatacttttggcacgagccaacagcaattcaagcggctacttttgttctctggaaatgattatttgggcttgagttcacatccagcagttcgaagagctgcagcagaggcagctcgagattacggaatgggccctaggggctctccgttaatctgcggatacacttaccaccatagattactggagtcaagcttggcaagcttaaagaagaaggaggactgtcttctttgtcctacagggttttcagccaatatggcattgatggtagcacttggaaaccttgcatccctccttgcagcaggcaacgtgcctgtgaaggatgaaaagattgccattttctctgatgaactaaaccatgca

SEQ ID NO: 23976 - DNA, 385 bp, Gossypium hirsutum
  Clone ID: LIB3272-032-P1-K1-C2
cggacgcgtgggtcactctcccaccccgaccgcttgattttgatcagacggtaatccatgccgatcagaaacatagccgttggccggcctgaagaagctactcacccagatgctcttaaagcagctttagctgagttcatatcaacgttaatcttcgcttttgctggatctggttcaggcatggcttgtaataagctgaccgacggcggtgcaacaactccggctggtctcgttgccgcctctctagctcacggatttgcgcttttcgtcgctgtatccgacggcgctaacatctgcggtggccatgtcaatgccgccgttacattcggtgctttcgttggcgggaacattactcttttacgtggtatcctgtattggattgctc

SEQ ID NO: 23977 - DNA, 410 bp, Gossypium hirsutum
  unsure (1)..(410): unsure at all n locations
  Clone ID: LIB3272-032-P1-K1-C3
ccacgcgtgccgaattgttattcactcgattcttctctttagtccaaaaaagatgcacatctctcgtcaatgactctaagccggcaaagacgatacactctcgagcgtcgagaggctccagacatcgatgcgacatacgtgatagaccaacaatccaagataagagaaggcatnccctccagaccagcagcgtctgatcttcgccggaaaacagcttgaggacggccggaccttggccgattacaacatccaaaaggagtcaactctccacctcgtcctccgtttgcgcggtgggatgcaaatcttcgtgaaaaccttgaccggcaagacaatcactctcgaggtcgagagctccgacacgatcgacaacgttaaggcgaagatccaagacaaggaaggcatccccccag

SEQ ID NO: 23978 - DNA, 268 bp, Gossypium hirsutum
  Clone ID: LIB3272-032-P1-K1-C4
gtttaggtggcttgtttatgtgtacaagcaatgttttaatagtcccaatgctgattagtggggttagttgactatttggtgattatttgactataaatgtatgttttttctagttgaatgaatgagctgaatgagctatcagccattagctcccttgctgcacatttgtgagcaagtaacaatgctttttgcaccttgctttatgttctgtgctcttggtctctcttttgttgctgccacttttaccaacaatttggtatcatgagcc

SEQ ID NO: 23979 - DNA, 401 bp, Gossypium hirsutum
  Clone ID: LIB3272-032-P1-K1-C5
ctgacctcagaaagagcacccaaaagaaaaaacactgatcaacgaaggatttctagggttttttttcggtatcagcaagcgatggcaatggctgctctcagacgcgaagggaggcgtttcgcccctctgatctctccccgtccaattactgctgtccgatcctctcctatcgttcccactcacgaagatgagggtccgattggtgttcgttatatttcaacccaagtcgttagaaaccggatgaagagtgttaagaatattcagaaaattacaaaggctatgaagatggttgctgcctcaaagttgagagcagttcaaactaaagctgagaattcccgaggcctcttgcagccatttactgcacttctttgtgatcttcccagtgttgatgtcaagaagaa

SEQ ID NO: 23980 - DNA, 379 bp, Gossypium hirsutum
  Clone ID: LIB3272-032-P1-K1-C6
cacacttcaaagttaaataagctattgtacaaagaaattgcccataccccgcctcccaatcatatatacctttatttgctttctctttctttttcaacacttcttctttgttttcaactgttccaatctgtatttcagcttccacagaataaaaaatttccctttctgtttccactgcctatatccacactgttttcatgtttgctgagaaaatttggaatgtataaggtaaattttcccagcttgtgaactgcagtaaaagtcaaagctctctgggtctttttggttctttttttttcctagctacttcaatattccattgttgtttcctttagaatatgtttgtgtagctcacatggaagttgtagcatgatgggaa

SEQ ID NO: 23981 - DNA, 359 bp, Gossypium hirsutum
  Clone ID: LIB3272-032-P1-K1-C7
cgcgtagattggtggtgagggtcgaggggtgcactaccatgatcctccacaggtcccaaggctgctcggcgcggaatttgacaaagtggtcattttataggggggaagcccgcccgacagtgccgcagcgtagcttaaaaggactgtgttacagtgatcggatacaagagtcaggttgaccctgataagggcagtgaccaatgcggtggtgttggcattcttggcattgcttgggcttttggtgggatgatctttatccttgtttactgcactgctggtatctttggaggacacatcaacccaacagggacctttgggcttttcttggctaggaaggtgtccttagttcgagccatatt

SEQ ID NO: 23982 - DNA, 190 bp, Gossypium hirsutum
  Clone ID: LIB3272-032-P1-K1-C8
ccaagattgaagttatagactcactcttctccaaactttttattctcatactagggtgaggtctaagtctaccatgatcctccaccacctctattatttaactacttagtactgttactcattaaatcatatttatatcttcatgtaatatcacacgtttattttccactctttctatttttatacataa

SEQ ID NO: 23983 - DNA, 387 bp, Gossypium hirsutum
  Clone ID: LIB3272-032-P1-K1-C9
ctcgtctcctgcagccattgttacccatcttcttcaagcttggcataccgtcaaactatcctatatgtggtctagtctcacaacggtagcattcgaattttacgttgttgcgttacgcgtcatccaactgtcccctctcaactttccaggttccctgctttacatctcctggagaacacagtcctcaataacactatgtcctcctctttttcttctttcgctcattcaaatagaagtggaggcagaggtcaagatatgaaacatgatcgagaaagatccagaggctgtggcggcggcggcagcaaagacaaaattgatgctcttggtcgactcttgacacgaattctgcgacatatggctactgaactgaatttgaatatgcgaagt

SEQ ID NO: 23984 - DNA, 395 bp, Gossypium hirsutum
  Clone ID: LIB3272-032-P1-K1-D10
gccgactgtcgtgtatccggtatacccgagaagaaaagcccatgtttattttgcgtctgggcgctcccccttcaaccttctcttgctttgtttaccaccatcaagatatagagatttgttggagcttttaacattgagatctgtaccattcttttttcggtttctttgcaaggttagttgatccttggagtgattgaggggcagctggatgctgttttcttacatatgttaatatggaaaagaaaaaggcaatctctcaatacagagagaggctggacaacacactgtcctctgctgaactgactgatcccgagacacttaaaacccttgtcaagaatcagattctacgatgtgcacaacatgagaaagaagaatctagtgtacatttattggac

SEQ ID NO: 23985 - DNA, 398 bp, Gossypium hirsutum
  Clone ID: LIB3272-032-P1-K1-D11
accaaatcccaccatcaaaatccccgtaggggacccattcaacgatccgacgggtagctttccctccgttaactttaactacaacaatgcagtcagtagtccttgccccgtcgattacctcgggtctctccaccgttacctaccgtcaaacgactacgagtccgattcgtttagtgatgattcggacttgcctgttgatgcattctcatgcgaccatttccggatgtacgagttcaaggtgaggaggtgtgctcgtggaaggtcacatgactggactgagtgtccgtacgctcaccctggtgagaaggcccgaagaagggacccgcaaaagtttcattactctggaactgcttgccccgattttcgcatgggaagctgtaagaaaggcgattcatgtg

SEQ ID NO: 23986 - DNA, 399 bp, Gossypium hirsutum
  Clone ID: LIB3272-032-P1-K1-D12
caggcagctcttcttccttttctgcgtctcatcatcaaaccccaaactcttaactggcctcttcctcctcctctttactttaatttcatttgctttcacaaatctaagaccagagctccaaaagattgaatttttaacccctcaaattaaaatcttcctttttcgccttttgggttgaaaatttatataagcaagagggtgatttagaaacaatggatgctgattcatggagtgctcgtctttcttcagcttctaagagatatcaatcggctcttcaattacgatctgatatgtttatggggtttgaagaaattgatggagaagatgaaataagagaggagtttcgatgccctttttgttcagagtatttcgacatcgttggcttgtgttgtcacattg

SEQ ID NO: 23987 - DNA, 344 bp, Gossypium hirsutum
  Clone ID: LIB3272-032-P1-K1-D3
ccaaacacggtttctctattacttactggtcttacttatggccgccgtttaggctctcattgcttcacttctcatctctcttcttcttctccaacttgtcgctgctgatcaactggtgacaagtgccagcaagcgcaagggaactgcccccccttgcaaaatcgactgcggcggcgcttgtgcggcgaggagccgattatcatcccggccacacctatgcaagtgggcatgctgtacatgttgcgcacgctgcaactgtgttccaccgtagacagcctgctaccaagaaatgtgtccttgctatgctagcttgaccacccacggtggccgacgcaagtgccctt

SEQ ID NO: 23988 - DNA, 384 bp, Gossypium hirsutum
  Clone ID: LIB3272-032-P1-K1-D4
atcatttcagagaactgaacgctcccccctctttcccgatccttccgaactgcggaaagccactgatcttcaccacttggttttcctcagattggcggcagagttacttctaagatgtctaaagctcaagatccattctacatcgtcaaagaagagattcaagaatctattgataagttgcaatcaagttttcatcaatgggaaagaattctccccgacactggagaacaagtacatctcacgaaagagctacttgctaattgtgagagcatcgaatggcaggtagatgagttgaacaaaacaatagatgtggcagcaagagatccttcttggtatggcattgataatagagaacttgaaaagccgagaagatggaccatcact

SEQ ID NO: 23989 - DNA, 398 bp, Gossypium hirsutum
  Clone ID: LIB3272-032-P1-K1-D5
tccgcaccaagacggtaaagaaatcctctcgccaagtgattgagaggtactactctcgcatgacccttgatttccacaccaacaagaagatcatcgaagaagtggctatcatcccttccaagcgtctccgcaacaagatcgccggcttttccacccatctcatgaagcggatccagaagggtcccgttcgtggcatctctttgaagctccaagaagaagagcgtgagcgtcgcatggatttcgttcccgacgaatccgccatcaaggttgatcaaatcgaagtcgataaggaaactctcgatatgctttcggttctcgggatggctgatattcccggccttgttaaggtcgatccggttgctgttgcggttccacaaatcgggttcggtcgcggtggt

SEQ ID NO: 23990 - DNA, 406 bp, Gossypium hirsutum
  Clone ID: LIB3272-032-P1-K1-D6
cggacgcgtggggcacctctgagatttatagctttcaatgttcttttccccattgaaaaaatattttcgctagattctttaatccattaagatatcatgggcaaaggtccaggtctctacactgaaatcggcaagaaagccagagaccttctttacaaggattatcagactgaccacaagttcactctcaccaccagctctccaactggagttgctattacctctgccggaacaaagaaaggcgaactctttttggctgatgttaacacccagctgaagaataagaatgtcacaactgatattaaagtggatacctactccaatctgtataccaccataaccgttgatcaacctgcacccgggctgaaagcaatctttagcttcagagtccctgatcagaggtctg

SEQ ID NO: 23991 - DNA, 401 bp, Gossypium hirsutum
  Clone ID: LIB3272-032-P1-K1-D7
ggaaaagagaacaaaaaaaaaaaaccggagagatctttaatctatctcatgagatttcattgaagaaataaaagtatccagaaaaaggaaaaaaacgatatgtatagcaatttcaaagaacaagcgatagagtatgtgaagcaagcggtacaagaagataatgcagggaactacagcaaagcctttcctttatacatgaacgcactcgagtatttcaagacccatttgaaatacgagaagaaccccaaaattagggaggctattacccagaaattcaccgagtatttacgccgtgccgaggagatccgtgccgttctcgatgaaggagggcctgggccggcttctaatggggatgctgctgttgccacccgccccaaaagtaagcccaagagtggtggtgg

SEQ ID NO: 23992 - DNA, 391 bp, Gossypium hirsutum
  Clone ID: LIB3272-032-P1-K1-D9
cggacgaggaacaccattttgaatccaaggccgacgccggtgcctccaaaacctacccacaacaggccggaaccattcgtaagaatggttacatcgtcatcaaaaaccgtccctgcaaggttgttgaagtttcgacctccaagactgggaagcatggtcatgctaagtgtcactttgttggaattgacatcttcactgccaagaagctggaagatattgttccctcttcccacaactgtgatgttccacatgttaatcgtactgactaccagttgatcgacatttctgaggatggatttgtgagtttgctgactgacagtggagacactaaggatgatctgaggctcccaactgatgagaacctgttgaaacagatcaaggatggttttgc

SEQ ID NO: 23993 - DNA, 396 bp, Gossypium hirsutum
  Clone ID: LIB3272-032-P1-K1-E1
ctcaattatccatttattcttttctttcaactcaaagtcccaagtagtattagaatcatgggtgttgtcacttataactatgactctacctcccctgtcgctcccgccaggcttttcaaggccttcgttcttgaagctgacaaggtctggcccatagctgcccctcatgcaatcaagagtattgaggttgaagctaatcctggccctggaagtatcgtaaagatcaactttgttgaaggccttccattccaatatatgaagcaccagattggaggacatgatgaaaacaaattttcatacagttacagtttgattgaaggtgggcctttgggggacaagcttgagaaaatcaactacgagaataagtttgaggcaactgtaggtggaggaagtgtg

SEQ ID NO: 23994 - DNA, 387 bp, Gossypium hirsutum
  Clone ID: LIB3272-032-P1-K1-E10
gcgttctgtctttcatactcatttagcccctttcattagcatcgaaatcactccagttttctttatcactgaaaaatgtcttgctgtggtggaaactgtggctgcggttctggctgcaagtgtggcagtggctgtggaggatgcaagatgtacccagacctgaacgttgccgagatgaccacaactgagactctggttcttggtgtagcaccccagaaagcacactttgagggagctgagatggaattcggggctgagaacggctgcaagtgtggagacaactgcacctgcaacccttgcaattgtaaatgattagagaccaaagccaaagctccctggaagcagagacgcctttgtctttaagaaataatatgttttggtggttat

SEQ ID NO: 23995 - DNA, 401 bp, Gossypium hirsutum
  Clone ID: LIB3272-032-P1-K1-E11
aagggcagttatctcatgcgttgctgtcctactgagtcaaacgaaaaataatcgtgataggaaaatgcctcctaaagccaaatagacgccagcctagatgacacctgcggtggagaagaaagccgtatctgataaagcccgggctgagaagaagcctactgctgtgaaaaagcttcccagggaaggcggggcgtctgtcgaagacaagaagttgatgagagccttgacgagcgtccagacctacaagatctacatattcatggtcctggagcaagttcaccctgacatcgcgatctctagcaaagctatgggtgtcatgaacagatcaatcaatgatatcttcgagaagcttgctcaagaagcctctaggctggcgaggtacatcaagaaacccaccatca

SEQ ID NO: 23996 - DNA, 399 bp, Gossypium hirsutum
  Clone ID: LIB3272-032-P1-K1-E12
cgcaaaattacaaaattacagaaaattttagggataaaaccgagtgaaagaacgaagcaagaaaagtggtatcgggtgggagcaggatggggaggcgacagcaaccagaaactgtgggtgtcttagataggatcaataatttgcctgactctattctttctcacattttgtccttccttcccaataaagaagcagttcgaacttctgttctttcaaccaggtggaagtatctctttgcttcctctatatctatccttgattttgaacattgcttaaaaaatttgtgtgaggaagatgttaacaacttcatgaattttgatgatacattactttttaatcccagagagcgggtccatttagaatccttctgggtgaatgactattttgtggatgatgagg

SEQ ID NO: 23997 - DNA, 355 bp, Gossypium hirsutum
  Clone ID: LIB3272-032-P1-K1-E2
ctcaaagaaaaaatcgagtgtcagattgaaagtgttcttcagatatggctatgaaacaagtggctaattctgctatcaaagcaattgccaattctgggtcatcctctcttacttaccacacaactccatgcttatccagggagcaaaaagattgatggggtgtaccacaaggccaacgagtactttacaaagaatcccacctttgttggttgggcggagggagccttggggctgcgcccatggctggaatcacaggagcattagtgtattgataccgacaacacagcaggaccggactgtggacttgaaaagcatatgcctgatctccatgtgctcatatcaaccccatctcacc

SEQ ID NO: 23998 - DNA, 392 bp, Gossypium hirsutum
  Clone ID: LIB3272-032-P1-K1-E3
cttccattgtttttcagtagtgaagagctaaaaaagaagggaaatcaatggaggggaaagaagaagatgttagattgggagccaacaagttcccagagaggcaacctattgggacagcagctcagtcccaagatgataaggattacactgagccaccaccagcacccttgtttgagcctagtgagttgacctcatggtctttttaccgagccggaatcgctgagttcgttgctactttccttttcttgtatatctcggtattgactgtgatgggagttgttaaggacaaaaccaagtgtacaactgttgggattcaagggattgcttgggcttttggtggtatgatctttgcacttgtttactgcactgctggtatctcaggtggtcatatc

SEQ ID NO: 23999 - DNA, 402 bp, Gossypium hirsutum
  Clone ID: LIB3272-032-P1-K1-E4
gacagacagagggggggagccagattagataaactcatggaaaatggtgttctggttcaaagaccacagactctaatccacatgcggttcggatccggattctctaagatgcggttgacattcatgtgctttaattttgattgtgatctgatcccaaacgaatctattcggacgtgaaacatgactcgtcggtgatcacattgcatccacaacggccacaactctcgtacatgtccgaaccgaggggtcaaactcttcagagtccgcttgactgacgggtcgattcggaagagcgcctgtatgggcatcctaagccaatattccgggtcgaattctggcgcgcataacgggaacgggtcggcttcgcccggtgagggtccggatcacaccgatggctatgct

SEQ ID NO: 24000 - DNA, 401 bp, Gossypium hirsutum
  Clone ID: LIB3272-032-P1-K1-E6
gtcggatgcaaccccaacatcagcatcagcaccagcaacaaccccctgctaaggatgactgccaaggatcgggccagtaaagctttaaactttgagagcaagatgaaaatgagtaggattcctgagacaggatggctttgttttttcttgtaatggttcagtattgtataatggggaaaaccaaaaaaaaaataacaagtgtgagagaaatggatacttttcctctcagaaatctatggggactagattgagtggcttctttctttctgcactgcttcacccaagtttccattacagaggttgtttttcttgattcatgccttctgttgaacttgcatcctccgaattcttcagagaagtactaattcttttgtgctaagctattttactgtggagtgtgc

SEQ ID NO: 24001 - DNA, 382 bp, Gossypium hirsutum
  Clone ID: LIB3272-032-P1-K1-E7
ctttctcccttccatttctctccctctatttagtggtgttgggttctttttttcttcagaaaggaagtgtctcttcttgttcagaacaaaaaaaaaaaagccaaagaaaagagggagagtatagagactccagtacaaaagagcaaaaaaaaaaagaaaaagaaaaatccggaaccaaacaataatactcttactttttagtgttttttttctttctttcttcttgttatgaggctttctttgggaagataagtttcatttcctttcttgggggttttctttaaaaccttttgtttttgctttccttctgttcggccatggccggtagcaatgaagtcaacctcaatgaatccaagagggttgttccattgaatacatgggt

SEQ ID NO: 24002 - DNA, 350 bp, Gossypium hirsutum
  Clone ID: LIB3272-032-P1-K1-E8
ccatacttctcctaggagatccaactttgatatcgagctttcagacacggattctttgtccccatccccccctaattacaccgaaggttcctccacttctcaccaccatgttaatatggaggatcaagttcaagtagactacatcgataatgacataaatgaactaaactttaatgaacgacgtgaactcacacaacatgaaattaacatcgagttgaaagatttttcattcgatagaaggacaactagtatatgaatatatatatatatttgagttttaaatttacagtgataagatgggtaatgacaacaattgtaattggccaaaggcaaaaataagccatttgatt

SEQ ID NO: 24003 - DNA, 391 bp, Gossypium hirsutum
  Clone ID: LIB3272-032-P1-K1-E9
atcccctctccctgctttgctctgaaaagtccaagtttttctccaatggcgaccgtctctccaactcctctgttgaaagatgagctcgacatcgtgattcccacgattaggaacttggactttttggagatgtggagaccctttttccagccttaccatctcatcattgttcaagatggtgatcctaccaagactatcaaggtccctgaaggcttcgattatgagctttacaataggaacgacatcaacaggattttgggtcctaaggcttcttgtatctctttcaaggattctgcttgtaggtgctttgggtacatggtttccaagaagaaatacatctataccattgatgatgactgctttgttgctaaagatccatctggaaaagaca

SEQ ID NO: 24004 - DNA, 99 bp, Gossypium hirsutum
  Clone ID: LIB3272-032-P1-K1-F1
atgcgacatatacaattcatccgactgttgtgtctttcatacacggggaatcccttcaaaagcttgtccaccctttgtttcctatggttaaccctttta

SEQ ID NO: 24005 - DNA, 74 bp, Gossypium hirsutum
  Clone ID: LIB3272-032-P1-K1-F10
taccgtccgaatcccgggtcgacttagcgtccgtttgggcaatcaattttgtaagcaagtatggctaaggacgt

SEQ ID NO: 24006 - DNA, 399 bp, Gossypium hirsutum
  Clone ID: LIB3272-032-P1-K1-F11
tattttctcactctcctactcctttgtgccatcccttttaccttctccgagctcgttaaagagcagcctctggtgttgaagtaccacaatgggccaatcttgaaggggaagatcaccgttaatctcatctggtacgggaagttctccccaacccagcgctccataatcgtcgatttcatcaactctttgagctctgccgtcaaacccaagattccgtcggcgtcgttttggtggaaaacgacggagaaatacaagtccggttcctccactttggtcgtgggcaaacaaatcctcctcgaaaattacccgctcggtaaaacccttaagaacccacacttgccagcgttggccgggaaattcaacggcgtaggtacggttagcgttatcctcacggccaaa

SEQ ID NO: 24007 - DNA, 397 bp, Gossypium hirsutum
  Clone ID: LIB3272-032-P1-K1-F12
ctcaaagatatcactgcaagaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaaaagcccaccctcggcacctgaacagccaggcacttgccccagagatgcactgaaactaggcgtttgtgctgatttgttgggctcagtgcgcgttgttgttggaccgtcgaggaccaaatgctgctctctcatttcgggtttggctgatctcgatgctgctgtttgcctttgcactgctattaaagctaatgtgttgggggttaacctaaacgttcctgtttcattgtctttgct

SEQ ID NO: 24008 - DNA, 317 bp, Gossypium hirsutum
  Clone ID: LIB3272-032-P1-K1-F2
gagctacttaaccatttcccaaatctcctccctcctcttctttagcgtccttttgatttccgctcatgcagcgcgctttgaaatccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccggtgattgtggtggactccttcaatgcaaaggttggggtgtaccttccaacaccctggctg

SEQ ID NO: 24009 - DNA, 341 bp, Gossypium hirsutum
  Clone ID: LIB3272-032-P1-K1-F3
aagctaggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactttatcaagaacatgattaccggtacctcacaggctgactgtgctgttctcattattgactcaaccactggtggttttgaagcttgtttttctaaagaatgtcatgactcgtgagcattctttgcttgcttttaccc

SEQ ID NO: 24010 - DNA, 405 bp, Gossypium hirsutum
  Clone ID: LIB3272-032-P1-K1-F5
gctttcgccaaacaaacgcaagatttgtagattcatttctcttgtctatctgcctccgtatgaatggctttgccaaaccagcaaactgtagattatccgagcttcaagctcgttatcgtcggcgatggaggaactggaaaaactaccttcgtgaagaggcatctaactggagagtttgaaaagaaatacgagccaaccattggtgtggaggttcatcccttggacttcttcactaactgtggcaaaatccgtttctactgctgggatactgctggacaggagaagttcggtggtctcagagatggttactacatccatgggcaatgcgccgtaattatgtttgatgtaactgcccggttgacatacaagaatgttccaacatggcatcgggatctttgcagagtg

SEQ ID NO: 24011 - DNA, 402 bp, Gossypium hirsutum
  Clone ID: LIB3272-032-P1-K1-F6
ctacactttcactttctctctctagaaaccttctctctaaacagtttattatattttttttgcaaatcctttataaaatcaccagtaactctctgatttgaaaactgaggggttttttttttctgcaatttttttgaactgaaggtttactaatggttatggaggataacgaaggaaataagaagagagcccgggaagagtcagaggctaactcggtgcccaatacaaaactcgctcgagttgactcggacaataataagggtcccgactccgactctcccgaggctactcgtgtagaacctgatcctgatgatggagaagataatttgccggaaacaaggcatataccggaggaattgctgaacatcctcgacgattcagatccggttagtggaccagatc

SEQ ID NO: 24012 - DNA, 323 bp, Gossypium hirsutum
  Clone ID: LIB3272-032-P1-K1-F7
gtctgccctctctgagctggatacggcttttcattccctctccaaagatgaaaaattccaggaagaattagctgggattttgaaagactatgttggtagggaaagtccactttattttgcagagcggctgtctgaacattacaagcgtcccaatggtgaagggccagatatataccttaagagggaggatcttaaccatactggtgctcataagatcaataatgctgttgctcaggcattgcttgctaaacgtttgggcaagaaacggattattgctgaaactggagctggtcagcatggagtggcaacagctaccgtgtgtg

SEQ ID NO: 24013 - DNA, 389 bp, Gossypium hirsutum
  Clone ID: LIB3272-032-P1-K1-F8
gaaacttaagctttgatttcccaagttttttttttttttttaagaaatggctcaggcaagaggcggtgcaatggcggtggcagcggcgacggtggtgctctgcttgttgctgagccactttgagttggctcaagcagcaacgtatactgttggtggaaccggtggttgggcctttaacgtggctggttggaccaaaaataagcgttttaaggctggtgatacacttgtattcaaatacaacccatcaatccacaatgtggtagctgtaaacagggccggttacagttcatgcacaaccccaaaaggtgctaaagtttaccagtccggcaaggatcaaatcaagcttgtcaaaggccaaaattatttcatctgcaactattctggacatt

SEQ ID NO: 24014 - DNA, 291 bp, Gossypium hirsutum
  Clone ID: LIB3272-032-P1-K1-F9
accaagctaggtggtattgacaagcgtgtgattgagaggttcgagaaagaggctgctgaaatgaacaaaaggtcattcaagtatgcttgggtgcttgacaagcttaatgcttatcaagaacatggtatcaccattgatattgccctgtggaagtttgagaccaccaaatactattgcaccgttattgatgcaccttgacaccgtgactttatcaagaacatgattacctgttcctcacaggctgactgagctgttctcattattgactcaaccactggtggtttagaagct

SEQ ID NO: 24015 - DNA, 88 bp, Gossypium hirsutum
  Clone ID: LIB3272-032-P1-K1-G1
attcccaccgagcggcgggtagaatcctttgcagacgaatcgaagcgacaaagggctgaatctcagtggatcgtggcagcaagatcgc

SEQ ID NO: 24016 - DNA, 399 bp, Gossypium hirsutum
  Clone ID: LIB3272-032-P1-K1-G10
tttttaacgactctctctctctctctctcttcctctattacttctaatataattttatgttcataatttaggaaccataattatccatccaaaatttcattcatttcccacttcaaataaccttccttttctatgtttggctgatcccaacgcctctttggaagcttcattcatttcatctttctccagagcaccttgctgtggtatattttctgggtttcttgttagatttcatgtatttatgagttgggattttctctctgattatagcttttaaagtttcattttttatttcttagttgaaaattgcttttttttttcagaaaataacctttagaaaggattcattgcagttaaaccagaaacatatatttttcttttcagtggttagaaatgaac

SEQ ID NO: 24017 - DNA, 406 bp, Gossypium hirsutum
  Clone ID: LIB3272-032-P1-K1-G11
tcgttcatttcctcctagccaaaaaaaaaaaaaaaaaaaagcctttttcctgtctctcgttctttttcctgttcaatcatgtcttgcttcattagcaaatatgctgatgagttggctaaaaacgctgcttacattggaacccctggaaagggtatccttgctgctgatgaatccactggcaccatcggcaagcgtctttcaagtattaatgtagagaatgttgaagacaacaggcgtgctctccgtgagctcctattcacaactcctggagctcttcagcacctcagtggtgttattctctttgaggaaaccctttatcaaaaaaccgcttcgggcaagcccttcgttgatgttttgaaggaaggtggtgtcctccctggcatcaaggttgacaagggtacggttg

SEQ ID NO: 24018 - DNA, 353 bp, Gossypium hirsutum
  Clone ID: LIB3272-032-P1-K1-G12
gattactgattgcaagggagagagtgtatcaccgtttctccccctctgttacttgattgctctccgccatggctctctccgtcgagaaaaccgccgccggccgtgagtacaaggtcaaagacatgtctcaggctgacttcggtcgtctcgagatcgagttagctgaggttgaaatgcctggtttaatggcttgtagaaccgagttcggccctgcccaacctttcaaaggagccaaaattactggttctcttcacatgaccatccaaaccgccgttcttattgaaacccttaccgccctcggagctgaagtccgttggtgctcttgcaacattttctctacccaagaccacgct

SEQ ID NO: 24019 - DNA, 410 bp, Gossypium hirsutum
  Clone ID: LIB3272-032-P1-K1-G2
cactcgtcccactcaaggattgtgatcagtgttcgtcctccaaaacccacaaaaaagaaggtttcgaatcgacttcaaattctgacaagtaattgttaaaattttgattgagggtccttcggatttcctctggtaaatcctttcagcgctctcaagttggttcccaaagagagggtaaaaagcctgggaatgctggaagatgtgcctcatcgttcaaaattccatttttgaagttgatgagcttacggcttttcgatcctttttcatctttgatgattctggatttggagttattggcgaaccatcactaactctccatgcacagaagcagaattggcatataagtgatacgagagcaccttttctggtattgcgtgaactttgcggagacggttgagctcattataata

SEQ ID NO: 24020 - DNA, 255 bp, Gossypium hirsutum
  Clone ID: LIB3272-032-P1-K1-G3
tcggatcgttcccgcgtccgctcaaggattgggatcagcgttcgtcctccaaaacccagaaaaaagaaggtttcggggtcgcggtcaaatcttgacaagtactcattcaaattcatattaagggagcttgggatgctctgtggtgaatacggtcagcgctttgaagtaggagccaaaagagaggacaaaaagcccagtcatgcaggcagaggtgccttataggatgaatgtgcagttgtccaacccatgaaggtt

SEQ ID NO: 24021 - DNA, 379 bp, Gossypium hirsutum
  Clone ID: LIB3272-032-P1-K1-G4
cacactctctctctccctctttttctggtccaaagttgggttaacagttgccctgattcagggattaaaaagaaaaaaaagctaagttctatattcgggtgtggcaatggctactaataacaataatagcaagttagagaagttggcttctattgatgcacagctacgtgctttggttcctgctaaagtgagtgaagatgataaactggtggagtatgatgctttgcttttggaccggttcctcgatattcttcaagacttacacggcgaggatcttagggaaacggttcaagaatgttatgaactttctgctgagtatgaagggaagagtacccccaagaaacttgaggagctggggaatgttttgactagtttggat

SEQ ID NO: 24022 - DNA, 390 bp, Gossypium hirsutum
  Clone ID: LIB3272-032-P1-K1-G5
ccctttttacacttcctctttggctatcttcattttcatcttcttcctctttctttctgttctttgttttcttcaaatactgccctttcattttccttagttcttgttaaaaagaaaatgtgtgggattttagctgttttgggctgttctgatgattctcaggcaaaaagggttcgggtgctggaactttcccgtaggctcaagcaccgtggtcctgactggagtggcctctaccaacatggagactgttatttggcccatcaacgccttgccatcattgatcctgcttccggtgaccaacctctctttaatgaagacaagtctattgttgtcactgtcaatggagagatttacaaccatgaagaactaaggaagaagttggcccaccac

SEQ ID NO: 24023 - DNA, 396 bp, Gossypium hirsutum
  Clone ID: LIB3272-032-P1-K1-G6
ttgtttaatggaagtgagcttttgctagaaatcctcggtcctggtattgtcggaggattgttcttgcctattcttggagcacttcccgatgcaatgcttattcttgtatctggactttctggaacagcagaaacagctcaagatcaggtctccgtaggaatggggttgctagcagggtcaactgtcatgcttctcactgtgatatggggttcctgtgttgttgttggccggtgtgatattcgcgactcagttgcggttgatggaactattactaaaggatttcacctaacagagactggtgtgagtaccgatatttggacttgctatgctgcaagtataatggctatatcaattatcccctttgttattgttcaactaccccaagttctcaattca

SEQ ID NO: 24024 - DNA, 367 bp, Gossypium hirsutum
  Clone ID: LIB3272-032-P1-K1-G7
gttgtgcaattcacactcaacaccaggtcaacgtgtcatttggaagcaaaaaccctcttcagaacgtgaaaaacctaataaaatcatttgggattccttcaaaatcatgttctcctcatgtatctctgcaacagggaaattgggtcaagctcatatgtggtgctagcttcgaggatgtagttgatatcaggaatctctcccttgtttacactctagctggagttgattgcattgattgtgctgctgatccatctgtaatcaacgctgtaaatgagggaattgaaacagctagggagattgtatctattagaagaccttgggtgatgataagtgttaatgatgatgaggatcttcattttcgtaaagc

SEQ ID NO: 24025 - DNA, 271 bp, Gossypium hirsutum
  Clone ID: LIB3272-032-P1-K1-G9
gaggttgaggactgcttgtgagagagcaaagaggacactaggatctaatggtcaaactaccagcttatattgtaacatattaccatacaatggaatttaaaacgggattctctgggacgaggatggaaaagctgaacatcaatgtgctattgatgttgacattggcgccaatgcttcagccgaagattcctatgatggttaagaggatggtgaccaatctgtgaagggtgggggcattgattacacttccaagagtgaagaggaaccccct

SEQ ID NO: 24026 - DNA, 333 bp, Gossypium hirsutum
  Clone ID: LIB3272-032-P1-K1-H1
tttatttttagcgcctactaagcaaaatgtatgattaacaccaggaacatggagtgatcatttcatctaacttttatctctcaaaatttacattcaattagatctggtttaggcgatggcttaaaagcggatcttgaaggcagctgaaggatctacagaaagatcctgctacctgttgcagtgcaagccctgttgatgaagacatgtttcattggcaagcgactcttatgggtccacctgacagtgcatatgccagtggagtgtttctagtcaccattcattttgctacggactatccatttaagccacccaaggttgcattcaggacaaagg

SEQ ID NO: 24027 - DNA, 280 bp, Gossypium hirsutum
  Clone ID: LIB3272-032-P1-K1-H10
atccactcacgccccaagctaatcctcgcaacaggtggcgaatgatcgctggttgcacgaattaagatgctcacaattggccggcttgggcaaaacctttactgaatgatcagtccactgaacctaaaaccatcaccgtgaccttgacaggaaagattgcttcatctaccgcctggattggagctatggctctctccaaagtttgggcgcagacgatgaccatgttcatctcgatgttcagttatatagatccccgtaccctcatgtgattggtggatgt

SEQ ID NO: 24028 - DNA, 364 bp, Gossypium hirsutum
  Clone ID: LIB3272-032-P1-K1-H11
cagaggcgaattcgaagagctaaaaaacccgcagttcagcaaccggggagcactcattcgacaagtccgccatgggtaaggttcatggatctttagctcgtgccggtaaggtgagaggtcaaacacctaaagtggctaagcaagacaagaagaagaagccccgtggccgcgcttacaagaggatgcaatacaaccgtcgtttcgtcaccgcagtggtcggattcggcaaaaagaggggacctaactcatctgagaagtaagaactatgcaatttaaaaaagttattgtttgaagcttttatggatttaatctgtatttttccctgtttttttgtaatgttttatgatacttatttttatccact

SEQ ID NO: 24029 - DNA, 405 bp, Gossypium hirsutum
  Clone ID: LIB3272-032-P1-K1-H12
ggcgcatgctttccctaaatgctgcacataacatacctgataaagattctcgcgctgaaacgtatataccagcagtcagccaaaggcatcagcatcaaggttgcggtggatttatatttccagtggctgatggttgcaacggtataactgataattcagggtcctcaaatagattgtcaaagaataccattcaaaatgctgagagggttcagcttggaaatggtagcgatcctgatgggacgactttagttcgttgtactgcaccaatgaaaccttagaagcagatctcttcaactcaagagctatttcaagaaccagcctcaaagctagcagacaaatgtctcggatgataaaacacaatgaatcaagttgtagagatgcgaaggggtttggccggttacacga

SEQ ID NO: 24030 - DNA, 351 bp, Gossypium hirsutum
  Clone ID: LIB3272-032-P1-K1-H2
cttcctattatcttccttccttttcattccttttgctatggcaggaactggggtggtcgctgtttatgggaacggcgcaatagctgaaacccacaaatcccctttctccgtcaaggttggcctagcccaaatgctccgtggcggggtgattatggatgtcgtcacccctgaccaagctcgcatcgctgaagaagctggagcctgcgccgtcatggctcttgaacgagtccccgccgacatccgagcccaaggtggcgtggcgcggatgagtgacccacaactcatcaaagaaattaagcaagctgtcaccattcccgtcatggccaaggctcgtattggccatttcgttga

SEQ ID NO: 24031 - DNA, 331 bp, Gossypium hirsutum
  unsure (1)..(331): unsure at all n locations
  Clone ID: LIB3272-032-P1-K1-H3
caattccgaattccccgtcgacccactcttncnaataaaaaaataaatcatctattaccttttttaaatataatcacataccaagtttggtgttaaatatttaatttttctccccccatcctttaaacccaaattataataaatcaaagccttctttaatcaaaagactcattaacttcttttgtaacccctaatcaccacttatcttcaatcatttataaacaagcattgattcaaagtcctaaaatgcaattacatgttttcgctgtcttacaagacatactgtctgcttatactctgatatctaactcaatgctttcttttcaccact

SEQ ID NO: 24032 - DNA, 386 bp, Gossypium hirsutum
  unsure (1)..(386): unsure at all n locations
  Clone ID: LIB3272-032-P1-K1-H4
agtcggtttccgtaactcacacaatctctgcaacgaatcaaaagaatccttttagaattacaccaataattcattcaagaagattgtttcacttgcaagctgctgctcgttttcgctttgggttcatctcttcctacaagaaatctgattttcaagattttcagggttttgcaaaaccttcacggctttttccgtccacggaaccgaaaacctttaccggagccttgaacgaaaatatctttccatcaaccggcttggatggagctcggactttgttcaaagttaggttgcaaacgagtaacatgtacggctcgagtttgagtaatataaatgccggaatactctngtgtttgattgatgagaaaggagactcaatattaaagaga

SEQ ID NO: 24033 - DNA, 409 bp, Gossypium hirsutum
  Clone ID: LIB3272-032-P1-K1-H5
aaaaaacaaaaacagagcatccactctttttttcttgagtttcctttgtaaattagttcaagctggcgatcgaaaataaagaaaccactgttcgttaaatcaagcccaagaacagaaggataatgggagctggtgggcctgatgaagaagataacaggtggccgccatggttgaaacctttgctgaaagaacagttctttgttcagtgtaaacatcatgttgattttcacaagagtgaatgcaatatgttctgcttggattgcgttaatggcgctctctgttctttctgcttagcttatcacaaggatcatcgttatatccagataaggaggtcttcataccatgatgtgataagagtatctgagatacaaaaatacctagacatatctggagtccaaacttatataat

SEQ ID NO: 24034 - DNA, 405 bp, Gossypium hirsutum
  Clone ID: LIB3272-032-P1-K1-H6
ccgttagagatattcctagggtttgcatttgcggtttggggtatagggttttagacaacgccaaatcttggatttgaggaatggcgactgcgacgggacaggtgaacgcgaagagaaagccggtgttcgtgaaagtggaggatttgaagcccggtactagtgggcacactttgatcgtcaaagtggtggagatgaccccagtcaagacttccgccaggcccaacaggtcccgtgctctcctttctcgacctgtccctccggtccggatcgctgagtgcgtcgttggggacgagactggcaccatcatcttcaccgcacgcaacgaacaagttgatcttatgacaaaaggtgcaaccgtgattttacgtaatgctaagattgttatgttcaagcgaacaacaatga

SEQ ID NO: 24035 - DNA, 423 bp, Gossypium hirsutum
  Clone ID: LIB3272-032-P1-K1-H7
acggtccggtaattcctggctgcgccgacccatcgttttatttatttcactaccctacaacccaaaagataaatggaatcgtttacttgtgcgtagcaatttatcgtcatttcaagctcaattctctgaaaatttttgtgctgaacttcttttttctctttgcaccaccatgtgtggaggtgctattatctgctatttcataccgtcgccacggtcgcgacgattgacagccgatttcttgtggcccgatctgtaaaaatccgggttgaagaaggggtcggctaagagatactcgaagcccgtgatcgacttgggcgatgatttcgagactgactttcaggagttcaaagatgaagaatccgatattgatgattatcatgttgatgatgtcctggctgatgtaaagccctttgttttttacgc

SEQ ID NO: 24036 - DNA, 369 bp, Gossypium hirsutum
  Clone ID: LIB3272-032-P1-K1-H8
gctccttctcgctgcgatttcgtcttcaagatctcagttctcaaatcgtagcgctcttttctatcaagccatggctctggtcttgcatgcaggaaaaacaaacaaaaatgcctttaaggcactcattgctgcagaatatagtggtgtgcaggtcaaaatggttgagaattttgagatgggtgtgtcaaataagactcctgagttcatcaagatgaaccctttggggaaggttcctgtgttggaaacacctgagggtcctgtatttgagagcaatgccattgctcgttatgttgctcgctcaaaggttaacaaccctatatgtggttctacattgattgattatggtcatatcgagcaatggattgattt

SEQ ID NO: 24037 - DNA, 396 bp, Gossypium hirsutum
  Clone ID: LIB3272-032-P1-K1-H9
aaaaaaaaggaaagaacctagggcgctctctcaattctccgccgaccaacagcctttcaaaggtctgttcctctgcccatccttttgactcatgtgagagtcaatcaaggcctccttgagtcgaagggctcatgagcttcgtttgtagccccgaatcgccacttagcttcaatcatggtgaaacaagcgtggattcaagggcctcaaatgcaggtacaggtgtgcgctggcgtacggggcgtgctggctgctgagacgctggtatcgtacggagggcgggcgtggcacgacgtggttgctgttcgtgaaggctgcggtgcgaggaccccttttgccctagggtttgccgaagcttagcttgggtttcgggctgttttggtctgttccagttattgg

SEQ ID NO: 24038 - DNA, 393 bp, Gossypium hirsutum
  Clone ID: LIB3272-033-P1-K1-A1
tccggtttctctccatctagccgtctcgcgtgcgccctgtggctctcttcaaccctcgcatatctcttcaagatctgatctgatctgacaaaaaaatgttcgggagagcaccaaagaaaagcgataatactaaatactatgagatattgggagtgcccaaaaccgcttcccaagatgatttgaagaaggcttatagaaaagctgcaattaagaatcatcctgataaaggcggtgatcctgaaaagtttaaagagttggctcaagcttatgaggtgctgagtgacccagagaagcgtgagatatatgatcagtatggcgaggacgcccttaaagaaggaatgggtggaggcggtggtgcccatgatccatttgatatcttccaatccttctttg

SEQ ID NO: 24039 - DNA, 372 bp, Gossypium hirsutum
  Clone ID: LIB3272-033-P1-K1-A10
cttgcaccatcactgccacataataccctctaaaactgaaaaaaccttgtcttccctctaacttgattggaaaatccacaatggccgccgtcactcgcgaagaaaatgtctacatggtgaaactcgccgagcaagccgaacgctacgaggaaatggtctactttatggagaaagtctcggcttgcgccgcccactacgagggactcaccattgaagaacgcaaccttctatacggcgtttacaagaacaggatcggcgcacgctgagcttagcggcgcatcatctccttcatcgagcacaaagtggagagccgtggtaacgaggatcacgtcggcggtatacgtgattaccgggctaagatcgagtccgagc

SEQ ID NO: 24040 - DNA, 366 bp, Gossypium hirsutum
  Clone ID: LIB3272-033-P1-K1-A11
gcattatactcgtactaagaagaaactagttgtaggcagctattatatcgtttctcctttctcccttctcttaagagtagaatgattattggaaggttacgccaatggttaagtctactggtctgtgtgcttgctgttatactactcaaatctgaaggcgctagtgtagggattacttatctgcaggatgccgtagcgaaaggagctgtttgtttggatgggagtccaccagcttaccattttgacaagggctctggcgctggacttgataattggattgttcacatggagggtggaggatggtgtgaagatgtgccgacttgcctctctcgtaagaacaccgatttaaggtcatcaaagcaaatg

SEQ ID NO: 24041 - DNA, 370 bp, Gossypium hirsutum
  Clone ID: LIB3272-033-P1-K1-A12
aagaaaccctaacattttgagagatctgaaagccttattgttgtcaggtgaggcaggggaatcttgctcaagttcaaagccactagttttccatctcaagttaaggattttaattcagctgctagatgtggtttttttgggatattttaagtgcttgagttgaatgggcactgttgattatggtttaggaatttatagggtttatgtcgtagctactggctactctgttataattggggctttccttacctaattctgaactgtaataaagaaatgggtgaaatgttttgggcaaatgaggaagataaggctaaggtggaatctgttttgggcactgaagcctgcgactacttgatattgttggcttcta

SEQ ID NO: 24042 - DNA, 390 bp, Gossypium hirsutum
  Clone ID: LIB3272-033-P1-K1-A2
cgattgcatctgccatcaatttgctttgaagatcatgttggctatttttcacatggcatttgctaatccaccagaggagctgaatagtccagcttctcataaatctactaagaagcctaaacagcctgaagaaaccctaaatgatttcctatctcatcaccctcacaacactttctccatgagctttggcaacgctgctgttttggcttatgtccgccatgaacgtgctgcttcagttcatcagaggttgttttgtgggtttgatgacatatactgccttttcttagggagcttgaacaatctatttatgctgaatagacagtatggtctttccaaagggagcaatgaggcgatgtttgtgattgaagcatataggacactaagggatag

SEQ ID NO: 24043 - DNA, 394 bp, Gossypium hirsutum
  Clone ID: LIB3272-033-P1-K1-A3
cggtccgaaaagagcttttaaaaaccagacccaaacaaaccaaaccaaagaaggatactgctatgggctgtttttctgatccatgttcatcttctccttctcggtttctcagcttttcttgtaaggatcacctcaacactttccggctgcttgcgtcagcttcccggcaaaccatttactcctgaggtttttttacatcatctatgcaaaacttagagctacataaaggaaacagtatctatttttgtgatagtgggtattgaattgtagagagaatgagtcaattttcctccatgttcaatggattagcaaggtcattttctataagaagagggaaaaatccagggaatggtgatggaagagaagctgcagaggtcatggcaaaggatgccaa

SEQ ID NO: 24044 - DNA, 389 bp, Gossypium hirsutum
  Clone ID: LIB3272-033-P1-K1-A4
cgcgtccgctttccttcccctcatccaaaccacaaaaacacacaactcagagaagagaaggggaagggaaacaacaatgatggggcaaaggcaacacgttgtccttctcattttctcagcttttcttctcttccaaacctcaaacgcccataatattacacgtctacttgcaaagcacccctctttgtccacattcaatcattacctcaccctcactcacttagctcccgagatcaaccgccgcaccaccatcactgtccttgccttagacaacgccgccatgtcttccctcttggataaaaacccttccatttacaccatcaagaacatcctttcccttcatgtcctccttgactactttggtgccaagaagcttcaccaaataagga

SEQ ID NO: 24045 - DNA, 366 bp, Gossypium hirsutum
  Clone ID: LIB3272-033-P1-K1-A6
cgcgtccgagaaaaccaaagcgtcgtggtttttttcttgttaagtacactgtaaaagatggccgatactgaggagattcaaccccttgtctgtgataatggaactggaatggtgaaggctggttttgctggtgatgatgctcccagggcagtttttcccagtattgttggccgaccccgacacactggtgttatggttgggatgggtcagaaggatgcatatgtaggagatgaggcacaatctaaaagaggtatccttactttgaaatatcccattgagcacggtattgtcagcaactgggatgatatggaaaagatctggcatcatacattctacaatgagctccgtgttgctcctgaggagcac

SEQ ID NO: 24046 - DNA, 371 bp, Gossypium hirsutum
  Clone ID: LIB3272-033-P1-K1-A7
aaactcttcatttagcaaaaatgagtaccagttcttcggctgtttcaacccaaaaaaggcttgaagggaaggttgcattgataactggaggtgccggtggcataggtgaggctacagcaaggttatttgttcaacatggtgctaaggttgtcattgcagacattcaagatgatttaggacaagctatttctcaagaacttggagaagaaaacatctcatatgttcattgcgatgttacattagactctgatgtcggaaacgccgttgatttcgccgtttcgaagcatgggaagcttgatataatgttcaacaacgccggtatatccagtcccgataagaacatagttacttcaaacgatgagagattcaaa

SEQ ID NO: 24047 - DNA, 357 bp, Gossypium hirsutum
  Clone ID: LIB3272-033-P1-K1-A8
gatttttcttggttggcatatgtctcaaaggcctaacgttccccactattcttcaatagcttttggtctccattctcatctcctggtttccagtgagatgaaccctaattccaactggtcttaatagtttcatctctttctttttcttctattgattttttgttttaattccttttattgcctttctgaaaaaaagtaattgccttgttgatttgcaagcaaattttggtaaagttcttaaatatttgagtttagatcttctttgagagtgccgctatgggagtgaagggttttgttgaaagaggcatagcctcaatcggggcccggtgttcgacccacccgcttgatttgatcaaa

SEQ ID NO: 24048 - DNA, 381 bp, Gossypium hirsutum
  Clone ID: LIB3272-033-P1-K1-A9
tttgtttctcgtcctcttaacgatatcctctgtttgcagttaagaaaagcaaatcatggctgctaccacggtcccagccgccgcaaggcagctatctcctaaagaagccgatatccagatgatgttggctgccgaggtccatctcggtaccaagaactgtgatttccaaatggagcgttacgtcttcaagcgtcgcaatgacggaatttacatcttcaaccttggcaagacctgggagaagcttcagcttgctgctcgtgtaattgtcgctatagagaaccctcaagatatcattgtccaatctgcaagaccctatggtcagagggctgtcttgaaatttgctcagtacactggttgtcatgccattgctggaaggcacac

SEQ ID NO: 24049 - DNA, 343 bp, Gossypium hirsutum
  Clone ID: LIB3272-033-P1-K1-B1
tccgctttcctctctcaaaatctcaaacccagatttgttctctctctctctctctctctatttccaatcaattaattcctccattggaggagcttagggtttgttggtgttctggtctttgctttgtctgaaaaataaacagaattataaacgaacaccaacgccatgggaagatttgaagagagaggattcgattcaatggtttggcctaagcctatccgaacctttaaatgggctaccaactggtattaaactgggaatgcttgattcaaaacctggtgcaaagctttttgttttaatcctccccgggggagggtttggggccgagattccaaccacccaa

SEQ ID NO: 24050 - DNA, 374 bp, Gossypium hirsutum
  Clone ID: LIB3272-033-P1-K1-B12
gtttgcacaaagatatttctgagcttaacctacccaaatcttgtgctataacatttccaaatggaaaggataacctgatgaattttgaggtttcaattcgccccgatgaaggatattatttcggtggcacatttttattctcctttcaagtttctcccgtctatccacatgaggcacccaaagttaagtgcaagaccaaggtctaccatccaaatattgatttggaaggaaatgtttgccttaacatcttacgtgaagattggaaaccggtgctcaatataaacactataatctatggtttatatcatcttttcacggaaccgaattatgaggatcccctcaatcatgaagctgctgcagtgttgagggataat

SEQ ID NO: 24051 - DNA, 389 bp, Gossypium hirsutum
  Clone ID: LIB3272-033-P1-K1-B2
tccgaaaaaaaatggcttcgtttcatatgattacaacccttctttttctgctaacaataatgctgggtgcatcaaatgctcaactcagtgccaccttttatgccaaaacctgccctaatgtgtccaccattgttagtaatgtgctgcaacaagctcaaggaaatgatatttggatattccctaagatcgttcgccttcattttcatgattgttttgttcatggttgtgatgcttcgttactgttgaacggtacggatggtgagaaaacggcaaccccaaacctttcgacggagggatatgaagttatcgacgatatcaaaacggcgttggagaaagcttgccctcgtgtcgtctcatgtgccgatgttttggcacttgctgctcaaatt

SEQ ID NO: 24052 - DNA, 390 bp, Gossypium hirsutum
  Clone ID: LIB3272-033-P1-K1-B3
tccgattttccattctcttctaagcagcagtggttctcccttcctcaaagcttccggctctcctcctcatctctgcctcaccatttctgtctctcagcttcgtcttccttctccatctttctgctccatagatctgtcgaggtctagagacaatattgagacaaggtcatagaggaggatagaaaatatgtaccctggtcgcgatgcaggttaataactcatggagtgttgtgaagagactacctgtgagggcggactcttcctacagttgggggctggcatttaaagcatgcggaaacaatttactagtaataggagctggaggtcatggagggcatgatgatggagtaaatgttctgcattcttagaatccagaggagagaaacaggg

SEQ ID NO: 24053 - DNA, 351 bp, Gossypium hirsutum
  Clone ID: LIB3272-033-P1-K1-B5
acgcgtccggaaagatcctctccactaggaactagttatagtcttctctcttccaccagattctttttggatcatggcgatatcggatgtggtggttgggaatttgctgatcatatacgtggcggttatagcggggataaaggcgtacggtttagtgtgtgggaggaacttcggtggttggtttgtgttgatggcgtcgactacggtggtgggtctgatcttggtcggggctttgacgtgggacgtcagtcgtaaagccacgcaagcaatttccggtgaggatcaagatgctggttcccttcaagttcacgagatgtgtaaaggtggtatttgctggcacggcgtggctgt

SEQ ID NO: 24054 - DNA, 240 bp, Gossypium hirsutum
  Clone ID: LIB3272-033-P1-K1-B6
gtccgcggtttaggagttgcaaattatcctgggcctacacgcaggcatcctacagttcatatgaccatgcttcgattcgtcgcggtcaccaggtttaccagcaagtgtgtgcatcctgccactctatgtccctaatatcataccgtgatttggttggtgttgcatatacggaagaggagacgaaggctatggcagctgagattgaggtggttgacggtcctaatgatgagggtgagatgt

SEQ ID NO: 24055 - DNA, 378 bp, Gossypium hirsutum
  Clone ID: LIB3272-033-P1-K1-B8
ctttttgtttttattttcaatgtgtttctttgtagatgatccagggctaattttaagccatttcctttacaaaacagctgtttttttagcagttttaagatgggttttgtcttggcttcttaatcttagattcaaagacataaactctttcttcttcactcctaaattttcatcaaattctcatcaaatttcttcagacatgatcagagacaacttggttttaacaacctatggggatgctaaacaaaggatgccttgggtttctgacacgtgtgctgtttgcttgtgtgagctcaaagaaggtgatgatgtaagggaattgaggaactgttgccacgtattccatcaagattgcattgatagatgggcaagctatga

SEQ ID NO: 24056 - DNA, 380 bp, Gossypium hirsutum
  Clone ID: LIB3272-033-P1-K1-B9
caagcagcagccgctaccgtgtcgttggcctcgtacttagccaaatttaaggatggattcacaaattaagtttgccgtggtggtgaaaattatgggaaggacgggatcgagaggtcaagtgactcaagtgagagtcaagtttttggatgatcagaaccgttttattatgaggaacgtgaagggaccggtcagggagggagatattctcaccttgctcgagtctgagagggaagctaggaggcttcgttgatcacttcctcttatctccgttttgttactttattaatgtttatgttgcgcaagtagctagctgtttattatttctgaaaggtatccaaattttcaaatctagacttggattttgggagactgatttaaat

SEQ ID NO: 24057 - DNA, 371 bp, Gossypium hirsutum
  Clone ID: LIB3272-033-P1-K1-C10
tgcgtcgattttcttcgataaagagatccaagaaaatgtcgaataaaccgcgagagtcggttgtgatccgatccgtttggtcggaaaatttggattccgaattcgagataatcagatccataatcgacgttttcccgatcatttcaatggacacagagtttccaggagttgtcgtccgatcggagggcgccggcggcggccatcgctcccgtcgaattgacgccactgagaattaccaaagcctcaaagcgaatgttgacatactaaagcttatccaaatcggcctaacgttatcagacgctgacgggaatttaccaaatctcggcaccgagaaccggtacatttgggagttcaatttcaaagatttcgat

SEQ ID NO: 24058 - DNA, 368 bp, Gossypium hirsutum
  unsure (1)..(368): unsure at all n locations
  Clone ID: LIB3272-033-P1-K1-C11
aaagcagcgtaatgggtgaagaagtgaaggtttttggatactgggcaagcccttacagctacagggcagagcttgctttgaagttgaaaggtgtttcttatgagtacataaatgaggatatctttggcaacaagagcgatttgcttttgaaatacaatccggttcataagaaagtcccggttcttcttcacaacgggaaaccaattgtagagtctcttgttatacttgaatacattgaggaaacttggaagcataatccctatttgccacaagatccttatgacaaagctaccgctcgattctggatcaagttcatcgacgaaaagtgctntcctaccctntggctagctgcatggagcgccgagaat

SEQ ID NO: 24059 - DNA, 355 bp, Gossypium hirsutum
  Clone ID: LIB3272-033-P1-K1-C12
gtggttttggtttttcaattgaagttgagaaatccttgcctgatcttgttttcggtgatgaaaggagagtttttcaagtgatacttcatatggtcgggagcctattggatggcaatagtggaggtggaactgttgtactccgggtgttctccgagaatggtagtcaggaatggaatgatcaaagacgggcagcctggaagcacagctccttggatggagatgtacatatcaggttcgaaattaggatcgagaatagcaattctcagccagagagcagtggctcaatgtcggagttacaggtcagtggcagaaaatataacagcaatagcgccgaggaacgcttgagcttcaacat

SEQ ID NO: 24060 - DNA, 387 bp, Gossypium hirsutum
  Clone ID: LIB3272-033-P1-K1-C3
tccgaatcaagtcatttcaagattttttttctgaacaagaaaaagaaaaatagtaggacaatgccgtccttggaggatgagctgtttccgtcgacgccagggaagttcaaggtcgacagagcacacaatatgaaccgtcaattccatcgttgcttcgcttcaaccagcaccatgtttttatgggctcttttcttgatcgcattgacggcgtcgtatttgcgcttccagagtttcgttgattctggtagccgatatttcagtgcttcatggggtggtatccaatgggaaaaacaagtccgtaactccgctcagatccatcgttccggaggcatgtccgttctggtgactggagcggctggtttcgtcggtacacacgtttcccttgcc

SEQ ID NO: 24061 - DNA, 384 bp, Gossypium hirsutum
  Clone ID: LIB3272-033-P1-K1-C4
cgcgtccgtttttcacttcacatctgcaacgaaaaagaaagcgcccctttatctggtaggatcaggtattagagtggtatagtaaaaatgtcttcaactgggtcaacacgagaggaaaatgtttacatggccaagttggctgagcaagctgaacggtatgaagaaatggtggagttcatggagaaagttgtaaaagctgtcaatgtagaggagctaactgttgaggaacgaaatcttctctccgtggcttacaaaaacgtgattggggccaggagggcatcctggaggataatctcttcaattgagcagaaggaagagagcaaaggaaatggggatcatgttgctatcatcaaggagtataggggcaagatcgaagctgagctt

SEQ ID NO: 24062 - DNA, 388 bp, Gossypium hirsutum
  Clone ID: LIB3272-033-P1-K1-C7
cccacgcgtccgttttttttttttttgttcttcactttctctctgaaatattcattttccttcaactttctcgctttccaaacaagggggaaaaatgcgaagagacgatttgtgcattacgattccgaatttttttcgatgtccgatatcgttggacgtcatgaaatcaccagtaagcttgtgcactggcgtaacatatgacagaaccagcatccagcggtggctagatagcggcaacaacacttgtccggccacgatgcaggttcttcaaagcaaagaattcgttcccaaccgcaatttacaacgactcattcagatctggtccgactcagtcgctcgccgtcaacacgacgccgaattggcggcaaactcagttgtccttccttct

SEQ ID NO: 24063 - DNA, 367 bp, Gossypium hirsutum
  Clone ID: LIB3272-033-P1-K1-C8
aattaaaattccagaattacttaaacaacaatggctacctatgaaggtaatgttttcactgaagaacaagacgctttggtggtcaagtcatggactgttatgaataagaatgcaggtgaattgggtcttaaattcttcttgaagatatttgagattgcaccatcagccaagaaactattctcattcttgagagactcaaatgttccattggagcaaaacacaaagctgaagccccatgccatgtttcgttttgtcatgacatgtgaatctgcagttcaactgcgtaaagcacgcaaagttacagtgagggaatgaaatttgaagaaattaggagctacccattttaagtatggcgtagacgatgaac

SEQ ID NO: 24064 - DNA, 373 bp, Gossypium hirsutum
  Clone ID: LIB3272-033-P1-K1-C9
tgacagtattgcctctcaatttggaggttggacccataagcatgatgaagtggcaactattcatgcagattgaccaatcattccaaattcatcgtagttatggcagcatggttgaaggcgaggctgatgaacttaagagggtcttcctggaaggaaatccgtacttgctagtgatcacaatggtcgtttctttgcttcattctgtgtttgacttcttggcttttaagaatgatatccagttttggaacaaaaataagtctatggaaggattgtctgcaaagtctgttgtggtgagctttttgtgtcagcttatagttttcctctatctactcgataatgagacctcatggatgatactggcaagttctggaat

SEQ ID NO: 24065 - DNA, 390 bp, Gossypium hirsutum
  Clone ID: LIB3272-033-P1-K1-D1
tccgctggcctctttgtaggactgaacaagggccatgttgtaacaaagaaggagttggcaccacgcccctctaatcgtaaaggaaaaacgagcaaaagagtccatttcgtgaggaacttgatcagggaagttgctggttttgcaccgtatgagaagaggatcactgagcttttgaaagtcggtaaggacaagcgagctcttaaggtagctaaaagaaagttgggaactcacaaaagggcaaagaagaagcgtgaagagatgtccagcgttctccgcaagatgagagcccacggtggaggtgcagaaaagaagaaataaagctttattttcttggtttctcacccttgtcgtgctcgagtttcttgtttaggagcagctagaggtttgttt

SEQ ID NO: 24066 - DNA, 368 bp, Gossypium hirsutum
  Clone ID: LIB3272-033-P1-K1-D10
ctctccgtattcagcatatgctgaattcacaggggatcaaaggacctccttacagattcatccatggcaacaacaaggaagttaccaaaatgaaacaaaaagctttaagtaaatctgtgggcttgacagatgatttatttcccaaagtacagccacatatttacacctggaccaacagatatgggaagaattttgtttattggaacggtgctcgagctgaattggtgatttcagagcctgaattagtcaaagaggttctgagaaatagtgaacaaatttttcagaaaaagaaacttacagatattggtaggaagttcttggggaatgggcttatatttattgagggggaaaaatgggcaaagcaccga

SEQ ID NO: 24067 - DNA, 374 bp, Gossypium hirsutum
  Clone ID: LIB3272-033-P1-K1-D11
ctcaactaaacttataacgttcgatcgtttaacgcaaacccatttttaagtgagggaaaggtttcagttcagagtcataagcaacatcaatggctccttcaactctgacggctcttgcggaagagaaaaccttgcaggcaagcttcgttcgtgatgaagatgagcgtcctaaggttgcttacaaccaattcagtaatgatatccctgtcatctctcttgctggtatcgatgatgttgatggcaagaggggtgagatatgcaagaagattgttgaggcttgtgaggattggggtgtcttccaggttgtggatcatggtgttgatactaaactcgtgtccgaaatgacccgtcttgcgagagagttttttgctttg

SEQ ID NO: 24068 - DNA, 365 bp, Gossypium hirsutum
  Clone ID: LIB3272-033-P1-K1-D12
gacctcccctaccccaaaaaaaagtctacctattttattgctctgactaattccaggcaatttttttgcatcctttccttaattgattcttgggtatattatttgtaccccttttttttaaaaaaaagcgggaataaagaaaaaaaaaggctacttatttatttgctgacgtttgtttccggtttaattaaaaaacatatcttaccttccaagctccatgattgcaaagaacagtgccgagatacaacaacattcacagaaaaataagtgattgtcggattaaaggtaaatcgtaaacgtcatcggtttggtgtttgttgttatgcctggcgcatcacggcagggcgtggaacatgtaggcttgc

SEQ ID NO: 24069 - DNA, 385 bp, Gossypium hirsutum
  Clone ID: LIB3272-033-P1-K1-D2
gtccgccgccgcctgcgtctctctcttcatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctattgatgttgacattggtgccaatccttcagccgaagatgctgatgaggatgaaggtgttgatgaccaatctgtgaaggttgttgacattgttgacactttcaggcttcaggagcaaccccctttcgacaagaagcagtttgtcgtgttcatgaagaagttcatcaagaacttgacaccgaaactggatg

SEQ ID NO: 24070 - DNA, 384 bp, Gossypium hirsutum
  Clone ID: LIB3272-033-P1-K1-D4
cgcgtccgcgcagctgagatccgacactccacagcgcagcaatgggtgaggaagtaaaggctttggttcctgagtcactgttgaagaagaacaagaggaatgaagaatgggagcttgccaaaaagcaggagctcgaagccgcgaagaataagaaagtcgagaaccggaagttgattttcaacagggctaagcaatatgcaaaggagtacgaggctcaggaaaaagagttgattcaattgaagcgggaggcgaagttgaaaggaggattctatgttgatccagaagctaagcttttgttcattgttagaatccgcggtatcaatgccatgcacccaaggaccagaaagatcttgcagctcctacgtttgagacagattttcaatg

SEQ ID NO: 24071 - DNA, 384 bp, Gossypium hirsutum
  Clone ID: LIB3272-033-P1-K1-D6
acgcgtccgatcaatggctaaggatgttgaggttggtggtgagttccaagccaaggactaccatgatcctccaccagctccattggttgatgcccaagagttaactcagtggtccttttacagggctataatagctgagttcattgccacccttttgtttttatacatcactgcgtgaacagtgatcggatacaagagccaagttgatccagataagggtggtcaagattgtgatggtgttggcattcttggtattgcttgggcctttggtggcatgattctcatccttgtttactgcactgctggtatctcagggggacatatcaacccaacagtgacctttgggcttttcttggctcgtaaggtatcattggttcgagccat

SEQ ID NO: 24072 - DNA, 374 bp, Gossypium hirsutum
  Clone ID: LIB3272-033-P1-K1-D7
aaaaaaaattagtgaattttgagtggattgttcttggatccaattttttggagattacagagaaaaaaagattgatttgcaaatacacaatacgaataatcgcgatgggtttcaagatatttgtggtggcgatgatggtgggttccatcgcagcggctcagatttcattagcatccaccgtgcctgcttttctatgggctcctggtttctctagcgttgaatcgaaggaatctgtaaattatcagatcaagtctccaaaggatctagctaactctgttctctctcaagggggatggtctgacttactgtgctccgagaggaaaaatgagcgccctgttgatctcgccgttgtttttgttggtagagagttgcac

SEQ ID NO: 24073 - DNA, 366 bp, Gossypium hirsutum
  Clone ID: LIB3272-033-P1-K1-D8
tggcaatcaattttgtaagcaagtatggctaaggacgttgaggttggtggtgagttccaagccaaggactaccatgatcctccaccagctccattggtggacggggaggagttgacaaagtggtcattttatagggctgtaatagccgagtttattgccacgctcttatttttatacatcactgtgttgacagtgatcggatacaagagtcaagttgaccctgataagggcagggacgaatgtggtggtgttggcattcttggcattgcttgggcttttggtgggatgatctttatccttggttactgcactgctggtatctctggaagacacatcaacccagcagtgacctttgggcttttcttg

SEQ ID NO: 24074 - DNA, 319 bp, Gossypium hirsutum
  Clone ID: LIB3272-033-P1-K1-D9
gcatgccattgattgatattctgtccattttgctcttcttgttcctctctctctctctctctctctctctctctatttgtctttcccgcgtcgttcaacagtgtactgaaaaaggtgaaagagctaacaaaaagaaaattccattctcgatttaaagcattttgctttttttcttcttttcagtcaacacacttaattgcctccccacctctccttttttgtttgcttttaattggcgtgtgttaaaaaagttgattgaagaaattctcttgtagactcatagctttgctgtcgttgtcattgggaataattggcaaat

SEQ ID NO: 24075 - DNA, 383 bp, Gossypium hirsutum
  Clone ID: LIB3272-033-P1-K1-E1
gtccgccccgaccgcttgattttgatcagacggtaatcatgccgatcagaaacatagccgttggccggcctgaagaagctactcacccagatgctcttaaagcagctttagctgagttcatatcaacgttaatcttcgtttttgctggatctggttcaggcatggcttttaataagctgaccgacggcggtgcaacaactccggctggtctcgttgccgcctctctagctcacggatttgcgcttttcgtcgctgtatccgtcggcgctaacatctgcggtggccatgtcaatcccgccgttacattcggtgctttcgttggcgggaacattactcttttacgtggtatcctttattggattgctcaactccttggctcaacc

SEQ ID NO: 24076 - DNA, 372 bp, Gossypium hirsutum
  Clone ID: LIB3272-033-P1-K1-E10
cacactccaattttaactactagtgattgtgagggagctggtgagatgtttcaagtcacaactttgattagtgaatctgaaaagctggagaaggaactgattaaaaaccctcctccatcggaggttgacatagaagcagctaggcaagttgtgagcgagagaggagaggctgttaaacagcttaaagctgccaaagcaagcaaatcggaaatcactgcttctgtggctgaacttaacaaagcaaaggagaatctctctaagctggaggagagatctaaattgaaacctgggattcccaagaaggatgggaagatcgactacactcaagacttctttgcccgccaagctttttgacagtttctgggcaactgc

SEQ ID NO: 24077 - DNA, 373 bp, Gossypium hirsutum
  Clone ID: LIB3272-033-P1-K1-E11
aagaaagaaaaccccaagggttgggaaccgtgggtgatcttacagtgaatatggagttagaacaaaaacatgggtgtcccagtcacctactgcgagcttttttttgcaagactgtttgtccacacgctttctcttcttgctgaccttcacgaattgatttccactctcttactgtatttgggtctgcccggttatctcgaacctgacatggcttgcagcgaatgcgcccgtgaaacccaccacgcttacgcctgctccgtatctggtctggtcatccgggaactactacccggcgtcaagtgcttcgacctcgctgacccgaccgagagctgcgccgtgtgcttgtacgacttaaaagggcctgatgagatca

SEQ ID NO: 24078 - DNA, 368 bp, Gossypium hirsutum
  Clone ID: LIB3272-033-P1-K1-E12
ctttgtttgcaaaagccagcgccctctatttccagctccgtttctccaacagttccgttcccaccgccgcaccgtcgatttccacctcagtttctccgtccatggctgcaacggactctcctctaacgaccaaggtttgtatcattgggagtggccccgccgctcacacggccgctatctacgctgctcgtgctgagctcaagcctattctttttgagggatggatggctaacgatattgcgcctggtggtcagcttaccaccacttccgacgtcgagaacttccctggattcccggatggtatcatgggttcggagcttatggggcggtgccggaaccagtcgcttcggtttggtactactatcttt

SEQ ID NO: 24079 - DNA, 387 bp, Gossypium hirsutum
  Clone ID: LIB3272-033-P1-K1-E3
cgtccgctttttatagagagacactcgaaacaaaattatacgtatttatatacggaggtgatagcggcggcgctggtggcggttgtacaatcggaattcagatcggcaatctaatggctgaagacaagtataacctcaagaatccggcggtgaagaggatcttacaagaggttaaggaattgcaatccaatccttccgatgattcatgagcctaccactcgaggagaatatatttgaatggcaattcgcaattaggggtccaagggattctgaatttgaaggagggatttatcatggaaggattcaattgcctgctgagtatccatttaagcccccttcatttatgttgctcaccccaaatggacgtttcgaaacgcagactaagat

SEQ ID NO: 24080 - DNA, 383 bp, Gossypium hirsutum
  Clone ID: LIB3272-033-P1-K1-E5
cgcgtccgaagaaaccctaactttttgagagatctgaaagccttattgttgtcaggtgaggcaggggaatcttgctcaagttcaaagccactagttttccatctcaagttaaggattttaattcagctgctagatgtggtttttttgggatattttaagtgcttgagttgaatgggcactgttgattatggtttaggaatttatagggtttatgtcgtagctactggctactctgttataattggggctttccttacctaattctgaactgtaataaagaaatgggtgaaatgttttgggcaaatgaggaagataaggctaaggtggaatctgttttgggcactgaagcctgcgactacttgatattgttggcttctaagaac

SEQ ID NO: 24081 - DNA, 373 bp, Gossypium hirsutum
  Clone ID: LIB3272-033-P1-K1-E8
cttaaaaaaacataagggtcatccccaaatttcttagagagggacttagggctttgctaagttccgtcggccacccttcgtactagcgaaggtaaccaccattggtggtggccggaatgttgcccgaagcccgatataaccctcatttctttcatataaaatagatttagggccttcaaaatccctaaaccaattgacttccgacctttgacttcttccgttgcaaccttaaccgaacacctaaggatccgttggcttttagaccagagaagcgatagccgaagaatatcaacaccaaaaaaaggtctgctaggagttaacgggggcaggtttccgttttggtccaaggagcgagtggtgcgctcgaagcacg

SEQ ID NO: 24082 - DNA, 342 bp, Gossypium hirsutum
  Clone ID: LIB3272-033-P1-K1-E9
cccacgcgtccgcctcgctaaaagacttttcagatgtctaacccaaggttggaaggtaaggtggctcttatcactggtggagccagcggtatcggtgaggagacggcgaggttctttgtacaacatggggctttggttgttattgttgatgtccaggatgatctggggaatcaagtcgctgcatcgatcggccttgacaaggttagttaccggcactgcgatgtacgagaggagaagcaggttgaggaagcagtaagtttcacagtggagaaatatgggaagctggatatcttattcagcaatgcgggtaccctaggctcgttaaccggaatcttagaaatt

SEQ ID NO: 24083 - DNA, 333 bp, Gossypium hirsutum
  Clone ID: LIB3272-033-P1-K1-F1
cgtccgatcggcagcaaactatttgttggaaaatggtggagattttgaggactgaaggtggaatcttaaactcgggttgcttcataatggagatcgaaccacatggatctgattgaatataatttggcatgtatgaatgggcactatcagggattaagcattgataaactaatgtgttagatcaaaattgaaactacatatataggcttatcaaatattcattttatttcgtcaaaacatgttctgcagagtaacctattgttgaacctgatgatgatcatacagggttcttggagggatcaacataattatctgaatgaacgtcagggagcg

SEQ ID NO: 24084 - DNA, 286 bp, Gossypium hirsutum
  Clone ID: LIB3272-033-P1-K1-F10
ccagccacaagtttaaacaaaaaaaaaaaaacgggggggggggtgggttgccatggaggattggattaagttttatcaatgtggtcaagaggctttttcagaccactcaatttgtaaattataatggaggatgtcatgcttttatgtatgtggcacttattttcaatgtgccccatcattatccctgcttttctttccttttttatggtctttctttgtttggcttggtgtttctaagttatctttgaaaattttataaaaatcaagtactttgtgttgctttatt

SEQ ID NO: 24085 - DNA, 374 bp, Gossypium hirsutum
  Clone ID: LIB3272-033-P1-K1-F11
aaatggggtctctttttactcctctgctccttccactcttttgtctttgccttactctaatctcacccacacattccactgattgttcatcgctcaaactctccggtggcaaaaaacaatactccaattgcacccacctccccaccttgaacgcaaccctccatttcacctacaatgccaccaactcttccctttccatagccttctcagcacctccggctaaagccggcggttggattgcttgggccgtcaaccccacggggacaggcatggcaggttcacaagccctcctggctttcaaaaacaatggatctatggttgttaaaacctacaacataagctcctacagttccattgtggaagggaagctttct

SEQ ID NO: 24086 - DNA, 387 bp, Gossypium hirsutum
  Clone ID: LIB3272-033-P1-K1-F2
gcgtccggttttgggtcaccgagagaaaggcctcagctcatattgctttcatcgattttcctctgcattttccatcactttctcgggaaaaaaaaacagaaagtttcagaagaatgtactcgggtattcggtcgttatcgttagatggatgtgtgggggattatcaagggtcgcttgatggaaccaacttgcctggtgatgcttgtttggtcccaacaaccgaccccaagcctcgactccgatggacggccgagctccatgaacgttttgtcgatgctgttactcaactcggcggccctgacaaagcaacccctaagactattatgagaacaatgggagtaaaaggccttaccctctatcacttgaaatcacatcttcagaaatacc

SEQ ID NO: 24087 - DNA, 372 bp, Gossypium hirsutum
  Clone ID: LIB3272-033-P1-K1-F5
cgcgtccgaaaccaaaaatggaacacgaaattcctttttttcgccagacatgggcacgtcgccggccttagcaacctccgtgccaatcatttccactattcatttcatttcattaaacgtgtgacacgacccactggatcgaagatgccggtggccggttctgccatatacttcatgaatcttcgcggcgatgtcctcatcaatcgcctctaccgagacgatgtcggaagaaacatggtggatgccttacggatgcacattatgcaaacaaaaaaactcggaacttgtcccgtcagacagattggaggacgctctgtgttttacatgagaatcagcaacgtatacatcgtaattgcggtcagcagtaatgct

SEQ ID NO: 24088 - DNA, 367 bp, Gossypium hirsutum
  Clone ID: LIB3272-033-P1-K1-F7
ttcataacaggtgggtcaagcgggatcgggctagccttagcccaacaagccggttcccagggagctcgagtctcactcttagctcgatctcttaacaaactccaagaagccaaagaatcgattcgccgttcctccggcctcgacgttgcgatattttctgctgatgttcgtgaccacgacgctgtccagaaggcggctaacgatgccggaccgatcgatgtcctggtagttaaccagggggtttttgtgcctcaggagcttgagaagcagggattggatgagatcaagtttatgatagatgtgaatctcatggggagttttaatgtcatcaaagctgctttgccgttgatgaaagagaggaaggacc

SEQ ID NO: 24089 - DNA, 375 bp, Gossypium hirsutum
  Clone ID: LIB3272-033-P1-K1-F9
caaaaagcttcaaatctcctctgcctattggagattacagcaaaaggctttttttttttttcattataattttacaagtgtaaaaatccccttggggaatgcagagagatgagacgttcatcgttggcaaggcctgagctttgttaccaccgtaagcgctccatcggcggccgaaattgtcaccgaaaacacgtcgaagacgggtgattcagtttgaaggctttcagttttaaatatacatatatttctcacttatattgtaaatatacagtacttcagatcaaagggtatccgtttcttttcttatttttctttttaatttctcgagcttttattgttcaaaaatggcggacaaagctaaaaccgaaaacccat

SEQ ID NO: 24090 - DNA, 389 bp, Gossypium hirsutum
  Clone ID: LIB3272-033-P1-K1-G1
cgcgtccgcgaaaagaaaaaaaacacccagagtctcagatcaccctgttctttaaatcaagatgcagtcaaccaacggttctgatctgagctcaaagcaccaaaaacagcagcccccaccgccgccgcagccacagcagcctcaatggatgccgaaccagtggatgggagctatgcaatacccggctgctgctatggcaatgatgcaacaacaacagatgatgatgatgtatcctcctcatcattacatggcttataataaccctcattttcattatcaacaacagtatcaacaacaacagttgcataaacaacaacaaggatctaattcagatgaggttaaaacgatctgggttggtgaccttcttcattggatggatgaaacttatc

SEQ ID NO: 24091 - DNA, 373 bp, Gossypium hirsutum
  Clone ID: LIB3272-033-P1-K1-G10
atttcaccccttaggtttctctttcacacagagacagagagagaatcagaggagcttaatcgagatttgatattcctcaccacagatggatcagatattgaacaaggtgggctcctattggctcggccagaaggccaacaaggagatcgattccgtcggcgacgacctcaactcattatccaccagtattgaagggggagccaaatggttggttaataaaatcaaaggaaaaatgcaaaagccgttgccagagctgttaagagagtataacctgccaataggaatcttccctcgtgatgccacaaattatgaattcaatgaagagactgggaagctcactgtttttattccagcaatatgtgaagtgggatac

SEQ ID NO: 24092 - DNA, 370 bp, Gossypium hirsutum
  Clone ID: LIB3272-033-P1-K1-G11
gggaaatctattttggagttaggagctggcattggtcgatttaccggtgaattagctcagaaggctgatagtgttatagctttagacttcattgaggatgttatcaagaagaatgaaagcatcaatggacattataagaacatcaaattcctttgtgccgatgcgactgccccagatttggatatttcagaaggatcaatggacttgatattctcaaatttgctgctgatgtatctctcagatgaagaggtagagaatttggcccaagggatgatgaaatggttgaaagtcggaggacatattttcttcagggaggcttgttttgatcaatctggcgactgcaagcaaaagcatgacccttctctctacc

SEQ ID NO: 24093 - DNA, 371 bp, Gossypium hirsutum
  Clone ID: LIB3272-033-P1-K1-G12
ctcgtatcttcactctcccaccccgaccgcttgattttgatcagacggtaatcatgccgatcagaaacatagccgttggccggcctgaagaagctactcacccagatgctcttaaagcagctttagctgagttcatatcaacgttaatcttcgtttttgctggatctggttcaggcatggcttttaataagctgaccgacggcggtgcaacaactccggctggtctcgttgccgcctctctagctcacggatttgcgcttttcgtcgctgtatccgtcggcgctaacatctccggtggccatgtcaatcccgccgttacattcggtgctttcgttggcgggaacattactcttttacgtggtatcctttat

SEQ ID NO: 24094 - DNA, 376 bp, Gossypium hirsutum
  Clone ID: LIB3272-033-P1-K1-G2
gcgtccggttaccttaactacgaatccgctgtggaatctgccgaccagcaaatgagttgggtacttttcgccacaccagtcgtgttaatactcttggcacgatggctctcctctatggaagtctctggtatgctgtttggttcatcaccctgggaacgtatccgccggactcatcatcacccttctgaaggtacctcaccctgggtggtggctgctttcattgtgttgctgttagtcctgttgcagtaccagtccatttttcgtgagagctggatggtatgatctttatatatgtgtgtgtgtagtactatagtttgaaaaaactgtgttggaatttctcatctttaacaaggttttgccttgttagatccaacac

SEQ ID NO: 24095 - DNA, 385 bp, Gossypium hirsutum
  Clone ID: LIB3272-033-P1-K1-G3
cgcgtccgcccatttccaatctccagctcccaaggtaaatatgccgatcagaaacatagcagttggccggcccgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaggtggccacgtgaaccccgccgtcaccttcggtgctttcgttggcgggaacatcactctcttgcgcggcattctttactggatcgcccaactactaggctcaacc

SEQ ID NO: 24096 - DNA, 384 bp, Gossypium hirsutum
  Clone ID: LIB3272-033-P1-K1-G4
cgtccgctcaaaactattcaccagagttaccactgaaaacatggccgccacaaagcttgggaggatcaagctgggttctcagggcctggaagtgtcggcacaaggccttggatgcatggggatgtcagctttctatggtcctccaaagcctgaacccgacatgatagctctcatccaccatgctattaactctggagttacctttcttgacacctctgatgtttacggtccacataccaatgaaatccttcttggtaaggccctaaaagatggtgtaagaaacaaggttgagttggctactaagttcggtatcgattatactgatgggaaaagggaaatccggggtgaccctgtttatgtaagggctgcttgtgaaggtagctt

SEQ ID NO: 24097 - DNA, 384 bp, Gossypium hirsutum
  Clone ID: LIB3272-033-P1-K1-G5
ccgtccgcgccttctctctctcttattcaacaagccggcgagggaaggaaaaccggagagggagaaaaatgccagctggtcacggtctccgatctcggaccagggatctgttttccagacccttcagaaagaagggttacatcccattgtccacttatctcaggacctacaagattggtgactatgtggacgtcaaggtaaatggcgccgttcacaagggcatgccccacaaattctaccatggccgcactggtcgtgtctggaacatcaccaagcgcgccatcggcgttgaggtcaacaagcaggtgggtaaccggattatcaggaagaggattcatgtcagagtggagcatgttcagccttcaaggtgcactgaggaattca

SEQ ID NO: 24098 - DNA, 375 bp, Gossypium hirsutum
  Clone ID: LIB3272-033-P1-K1-G6
gtccgatttttcctgctttttctccctcgccaaacagaaatcttagatcatttctagacgcagcgaacgatggagaaagcgatcaaccgacagcaagttttgcttcaacaccttaatccttcagcttcttctttttcgtcgcaccaaaacaactctgccctctctgcatcggcttgtttagctggagatagcgctgcttatctaagaactaatgtatttggagatgatgtggtgatagtagcagcatataggaccgcgctttgcaaatccaagcgagggggtttcaaggatacttatcctgatgatttacttgcacctgttttaacggcagtgatagagaaaacaaatttgaatcctagtgaagttggggatatt

SEQ ID NO: 24099 - DNA, 371 bp, Gossypium hirsutum
  Clone ID: LIB3272-033-P1-K1-G7
ctctgtttttcttattctcggattctctcttcatctcccaattctcaaaaccctaattatatttttttatttccctttttgattcagcaatcggggcttgccaatggccaacagtaatctccctcgaagaatcatcaaggaaactcaacgtctcctcagtgaacctgctccgggaattagtgcttcaccatcagaggataatatgcgatatttcaatgtgatgatccttggtcccacacagtctccatatgaaggaggggttttcaagttggaactatttttgcctgaagaatatcccatggctgctcccaaggttcgatttcttacaaagatatatcatcctaacattgataagcttgggagaatatgcc

SEQ ID NO: 24100 - DNA, 372 bp, Gossypium hirsutum
  Clone ID: LIB3272-033-P1-K1-G8
ctatttttggttttacgtgatcttgttaatggtataaagaagaacaagtttacagcctctgaaagcagtgagatcatttccttcctacaacaggcttttgttcggctagaagcatggttccagtggttcaatactacccagttagggaaggatgttggtagctattactggcatgggagagacaatttgacaattcgtgaactaaacccaaagacactttcctctggactggatgattatcctcgtgcatcacacccaactgaagatgagcgtcacttggatcttagatgttggatgcttcttgcagcagattgcatgaattccgttgcagaattgatttggaaggaaaacaaacctggaaaggactatgct

SEQ ID NO: 24101 - DNA, 373 bp, Gossypium hirsutum
  Clone ID: LIB3272-033-P1-K1-G9
gctaacccaaaacttgaagtctcttttgttcagttgacggccataactgatcagcctacaatggaatccctccacgaaaacgccatccgaaaacctctgtttcaatcacaaatttcggatacgaaatccgaatctacaagttcggagcttgaggatgttttgtcggacggtaactcttccttgttggagcgttggggaaaagcgacatgtatcgaatcgaaactccttttccacttggcagcgccggctgtcattgtttatatgatcaactatctcatgtctatgtccacccaaatcttctccggtcatctcggtaatcttgaactcgccgccgccttcctcggaaacactggcatccaagtctttgcttatg

SEQ ID NO: 24102 - DNA, 231 bp, Gossypium hirsutum
  Clone ID: LIB3272-033-P1-K1-H10
gccagttgctgttaatactgcatgaatgaaatttatgctacataatcgtgcgactttgtgcaatgttatagaagggtagggagatgtgtgttataagtggtgttggatggccgacaggttttccttctgtggctattagccattagtcgtagttggaaagaaattatatgattggtgagtgggtcgagtgacccattttcctatgattttgtatgtgggtatggaagatgc

SEQ ID NO: 24103 - DNA, 370 bp, Gossypium hirsutum
  Clone ID: LIB3272-033-P1-K1-H11
tggcaatcaattttgtaagcaagtatggctaaggacgttgaggttggtggtgagttccaagccaaggactaccatgatcctccaccagctccattggtggacggggaggagttgacaaagtggtcattttatagggctgtaatagccgagtttattgccacgctcttatttttatacatcactgtgttgacagtgatcggatacaagagtcaggttgaccctgataagggcagtgacgaatgtggtggtgttggcattcttggcattgcttgggcttttggtgggatgatctttatccttgtttactgcactggtggtatctttgggggacaccataacccaacaatgacctttgggcttttcttggcta

SEQ ID NO: 24104 - DNA, 366 bp, Gossypium hirsutum
  Clone ID: LIB3272-033-P1-K1-H12
aaatgagttagcaatgctgatggccagactgtactctggtaatcttggtatgatttccttgagaaatgcttatcatggtggaagttctagtactattggactcactgcactgaacacatggaagtacccaataccagagggtgaaatccatcatgttattaatccagatccttttcgtggagtgtttggctctgatgctactcgttatgccaaagatgtacaagatcacattgagtatggtacttcaagaaaagttgctgggttaatagcagaaaccattcaaggagttggaggagcagttgaactagccccaggatatctgaaacaggtttatgacattgtacgcaaggctggcggtgtctgcat

SEQ ID NO: 24105 - DNA, 325 bp, Gossypium hirsutum
  Clone ID: LIB3272-033-P1-K1-H2
aaaacaaaagggtggccaactaacatatcatggataccagcagcgagcacaagttataaattgacaaatgtcatcacttcattaagaagttcgctttatttaaccaccattaggtggagccagggacatctttgccatacagaggaagcatatatatattgatggtgctaagccggtgcgctggatgtatctagcgtatagatcgcatatacattatgttgatacaactgcgacgatcttcaaacgaagcaacacttcaccactaaaccgttttgatcgagccttgcttatgtattgcctacaggaggctgagccagcctactat

SEQ ID NO: 24106 - DNA, 387 bp, Gossypium hirsutum
  Clone ID: LIB3272-033-P1-K1-H3
acgcgtccgctttgcgactgggtgtttgaagacattccacagctgagcttaattgatctgggtatcctgtaatgaaacggcgagattataatggcaaccaacttttgcgcaatggtgattggttctagattgccagcaaattgttcaaggttgctttatcctaagtatcataagctatctgttcaacttaacaggtaccaaagaactagatttgattgttatgatcctaatcaacaattttatggaaagctttgtacaggaagttctcttaagaagcctgatacgagcaggcatgtcgtgtctgtaggaagtaaccgggatcaattgaggttcgatgatgaattacccgaggaacctttctggcttagtctgggtagagaaaccata

SEQ ID NO: 24107 - DNA, 380 bp, Gossypium hirsutum
  Clone ID: LIB3272-033-P1-K1-H4
cacacatcttggccgcggacagcacagctttataagcctgccttgatcgtgtatcgaagtacaagtctttaaatttattacagggaaaagcaggaaagcagaactagaacaagatggtaggattttcttcccaaacagaatcttgggttgccaccagaaactcaatctacgaatcccagaaagaggcagatagcttcgaattggatctaaaacgtctagatctgataaagatagatcaagaagacgaggataataatattaacagccaagataagattagcaccaccaagaagaacaagaagaaaaatcaggtgttgctggagggatacgtggaggcggttgatgaggaggatgaactgaagaggacaaagagcttgacc

SEQ ID NO: 24108 - DNA, 372 bp, Gossypium hirsutum
  Clone ID: LIB3272-033-P1-K1-H7
tttctttctctttcctttttctctcctctctctctctctcattttctttctttctctgtgtttgatgctaccacaaaaaggttctttgtttttcttcaaacatttttgggtcgttgatcttctttgttccctcttcaacacagattaattagttcccttttgttgttgttggtctttctctctacaatcgattcccagttttaaaattgcatctaattctcttgttatctcaagaaacccttttaattgaattgttaaaacaaagcgaaaagatcgacccagttctggtttttgatcgtcggtttagtttatttgagttcaatttgcagctatggcgaatccttggtgggttaatcaagtgagtttacaagg

SEQ ID NO: 24109 - DNA, 383 bp, Gossypium hirsutum
  Clone ID: LIB3272-033-P1-K1-H8
gaagatgaaaaataaacgcggtacagacgctgccattatatatagctagagtgctacttggaacggatgggaatggagcgacccaacagactcgggactcctgggaagaatggttcattgaggtcacagaaatcgactgatagaaggagctggcgttgccatgatcaaactcgcaatctgacgaggtatgactcattctgatgcccccgacatgttcagacccaaaactaacgaaattctagtgggaaaggcattgactcattcgacacgagaggaggctcagctgtctacaaactttgacggtgacagcatgtgttcatgcggttcggccataaatcgacctatgaaacagacgttcttcactagaggcttgccgaaaacgg

SEQ ID NO: 24110 - DNA, 376 bp, Gossypium hirsutum
  Clone ID: LIB3272-033-P1-K1-H9
agaaaatgaagggtctgcaggcacttatattggcaatggtaatggttatggcgatcgctacaactgatgctcaaagcatttgcaacatgccagcttcaggtttgatggcatgcaaaccagcagtgaccccccccaaccctccgccgcccacgtcaacttgctgctccgccctctcccacgctgacatgcgttgcctttgctcatataagaactccaagctcttgccttcccttggtattgacccaaaccttgccatgaaattgcctagcttgtgcaagcttcctcatcctgcaaattgttagttcctggttctccatatttgatctcaaatgtgagggaaaatcatgcttattataagcctctacttcacataatt

SEQ ID NO: 24111 - DNA, 272 bp, Gossypium hirsutum
  Clone ID: LIB3272-034-P1-K1-A1
taactctatatccatggctataatttccaccaccgcaaaatttaagtcaacatccttgtttattattcttcttctcttgcagttctccataacgaaaggtcatggtggagacgatcacgacgagaacaacggcgaccatacaaacttgcatgacaaaggcttaatcttggtgaaaacatggtgtttgatcattcttttagtaaccacttttgcaggtggagtctccccttatttctttcgatgggacgaaagtttcctcctcttaggcacac

SEQ ID NO: 24112 - DNA, 391 bp, Gossypium hirsutum
  Clone ID: LIB3272-034-P1-K1-A10
ggaattctgggttttgagtatggaattgttcaaggacctttgggaccggatattgctggtccggagctagttgctgctgttgcaaacgctggtggacttggccttcttagagctcctgattgggaatcaccagattatgtgaaagagttgataaggaagactcggaagttaaccgacaaaccctttggggttggtgttgttctggcatttcctcacaaagaaaatgtaaaggctatactagaggagaaggtagcagtgttgcaactgtattggggagaatgctcaaaggagcttgtaatagaagctcataatgctggggtcaaggttgttccccaagttgggagtttggaggaagcaaaaaatgcaattaatgtgggcgtagatgcaatca

SEQ ID NO: 24113 - DNA, 382 bp, Gossypium hirsutum
  Clone ID: LIB3272-034-P1-K1-A11
gtttgatcatggatatcatttccaccatttccaccaaaaaccctaattttttgtccctttctctcgattttttttttaatttgaaatatttatcaatttaattaaatcacaaaaaaaagaaaaaaatctgcattttctctctttatttacatttctagtccaatgggtatctattattaggcatcaaccatcttaattgttattctctaaagctctcaacttctttttgctctgtagtaagaaggaagatataaagggaataattttacaaaaaaattgccattttcctctgattgttttcttttttatttttccttgtggggttggggttttcattctatggctgcagttgctgacaagtcaggtgaggcagcgctagtag

SEQ ID NO: 24114 - DNA, 210 bp, Gossypium hirsutum
  Clone ID: LIB3272-034-P1-K1-A12
tgaagctgctgctgctacttctgctgtcatagcactcaggtctctgcgtattgcacaaactatagactttgtggcagaccatccattcctcttcttgatcagggaaaatgcgactggagttgtgctcttcattggccacgtcctcaatcctcttgaaaactgatgagtccgttgtggtcatgaggcaagagaatatgtgttgtattttgc

SEQ ID NO: 24115 - DNA, 161 bp, Gossypium hirsutum
  Clone ID: LIB3272-034-P1-K1-A2
gcggtagccgacggctgcgtatatctcttcatctatctgaacgaaggagactttagctcttagctttgagagagaccatgtatgtttaccaggatctgatctccggtgacgagctgcgatttgactcatttccgtacaaggatatcgagaatgggatgctg

SEQ ID NO: 24116 - DNA, 399 bp, Gossypium hirsutum
  Clone ID: LIB3272-034-P1-K1-A3
gatcagccattagctcccttgctgcacatttgtgagcaagtaaaaatgcttcttgcaccttgcttcatgttctgtgctcttgttctctcttttgttgctgcctcttgcaccaacaattggtatcatgagcctatgtcttacgggaccattgattttgcttcccctgcttgttgaaaagaaagaagctgtcaaagcacaagcaagtcattaaggactgcttgtagagaagataatatcggctcaaacttataagatccccaaactagcttgaataagctgaaggaggagtttaaaggaaaggtgtgagctttccaaatgtgaaagcttagcaagatgtcaaagctgcaagcttagcaaagtgcgagcctgatgaagacacctgttgaagacaatatgcaa

SEQ ID NO: 24117 - DNA, 366 bp, Gossypium hirsutum
  Clone ID: LIB3272-034-P1-K1-A4
gtatctcctaaaactaaagcaattctttatctcaaccaaaaccttctcagcaagttgataaatccctggcaattcctcccttgctccgacattcaagatctatactttaaatcccctaagcttttctttcacctttgataactgtctgagtctctatcgaaatcccatcaaaactcaagatgaaggcaaaacagatgaacttgagtggctatcagaaaacctggattgattgctttatttgatgttgatggcactcttacagcttcaagaaaggcggctacacccaagatgtcggagcttatgaaggaactgtaaaaggttggtactgatggagaggtgggcggatctgatctaacttagatatct

SEQ ID NO: 24118 - DNA, 403 bp, Gossypium hirsutum
  Clone ID: LIB3272-034-P1-K1-A5
ttttcaaccaagtccaagagaaaacgaggaaagatttaagtcattattcgtataaacatactacaaaatcaagctttgttcgtgtattattcgtggtcatttttgttatgctgtgcttatagaataatctgggattttgtacttcaacaaaagaagcaggttctcatggctaatagtgcggcagcctgtgccgaaagggcaactcatgatatgctgattggtccagattgggctataaacattgagctatgtgatattataaacacggatccacggcaggctaaggatgctttgaaagtcctcaagaagcaactgggcaataaaaacccaaaagtacagctactagctcttaatgtattggattctctcagtaaaaattgcggggagcatgtttttcagcaga

SEQ ID NO: 24119 - DNA, 404 bp, Gossypium hirsutum
  unsure (1)..(404): unsure at all n locations
  Clone ID: LIB3272-034-P1-K1-A6
tttgcaggcacttatattggcaatggtaatggttatggcgatcgctacaactgatgctcaaagcatttgcaacatgccagcttcaggtttgatggcatgcaaaccagcagtgaccccccccaaccctccgccgcccacgtcaacttgctgctccgccctctcccacgctgacatgcgttgcctttgctcatataagaactccaagctcttgccttcccttggtattgacccaaaccttgccatgaaattgcctagcttgtgcaagcttcctcatcctgcaaattgttagttcctggttctccatatttgatctcaaatgtgagggaaaatcatgcttattataagcctctacttcacataattgtactgaccttcgggntttctttttcctttatttcttttta

SEQ ID NO: 24120 - DNA, 293 bp, Gossypium hirsutum
  Clone ID: LIB3272-034-P1-K1-A7
ttatctctctaaacgcgaaaaatctttagcttttcgcttcgagagagaccatatttggttaccaggaactcatttccgtggcgaactttttttttacttatttccctaccaagaaattcaaaattggattctttgggaaagtgaaggaaaatgggttgtgcaaagagctgtccatgtttacattggtgccaatccttcaacccaaagtgcttattaggattaaagtgtttataaccaaactgtgaaagttgttgacattgttgacactttcaagctttaggagcaaccccctt

SEQ ID NO: 24121 - DNA, 368 bp, Gossypium hirsutum
  Clone ID: LIB3272-034-P1-K1-A9
ggattaggcaacggggacttggagaagatgagagacccgaacaatgctcaagattgggttaaacaaaacgtgcaagcccatttaccggacacgaaaatcacctgtatctttgtcggaaacgaggttctcactttcaacgacactaatctttccgataacctcgtcccggccatgcaaagcgttcatacggcacttgtaaacctcgggctcgacaaacaggtgacagtaaccacagcgcattctttaggcatactacaaacctcttttccgccgtcagccggagctttccgtgaggatttagtcgatattttgagccaaacattgagctttcatcaaaaaacagggtcaccttttttgatcaatgcgta

SEQ ID NO: 24122 - DNA, 333 bp, Gossypium hirsutum
  Clone ID: LIB3272-034-P1-K1-B1
cgcacgcgtccggctaagggtaccaccacgctagctttcatctttaaggaaggggtcatggttgccgctgattctagagctagcatgggaggctatatctcttcacaatcagtgaagaaaattattgaaatcaatccttacatgcttggaacaatggctggaggagctgctgactgccagttttggcacagaaatttaggcatcaagtgccggctgcatgaattagcaaacaagcgtagaatttcagttacaggggcatcaaaactgttggcaaacattctctattcttaccgaggaatgcgtgaggatttagtcaatattttgagccaaaca

SEQ ID NO: 24123 - DNA, 394 bp, Gossypium hirsutum
  Clone ID: LIB3272-034-P1-K1-B10
ctgagtttaagcatatcaataagcggaggaaaagaaacttaccaggattcccctagtaacggcgagcgaaccgggaaaagcccagcttgagaatcggtcgccatcggcgtccgaattgtagtctggagaagcgtcctcagcgacggaccgggcccaagtcccctggaaaggggcgccggagagggtgagagccccgtcgtgcccggaccctgtcgcaccaagaggcgctgtctacgagtcgggttgtttgggaatgcagccctaatcgggcggtaaattccgtccaaggctaaatacgggcgagagaccgatagcgaacaagtaccgcgagggaaagatgaaaaggactttgaaaagagagtcaaagagtgcttgaaattgtcgggagggaagc

SEQ ID NO: 24124 - DNA, 392 bp, Gossypium hirsutum
  Clone ID: LIB3272-034-P1-K1-B12
agagacggcgccaatcagctgtccgccttgaccgaccgtccggcatcgtcttggccctcgatttttcccttttgtaaaccttttttcaccaattcccgaaatggcagtgaaaccctccaaggccgaaaagaaaatcgcgtacgacgcgaaactgtgccagctcttagatgagtacacgcagatcttgatcgccgcagccgacaatgttggctcgaaccagctccagaacattcggaaaggtctccgaggcgactcagttgttttaatgggtaagaacactatgatgaaaaggtctgttaggatgcatgctgagaagactgggaaccaagctttccttaaccttatccctttgcttcagggaaatgtgggtttgatctttactaagggtgatt

SEQ ID NO: 24125 - DNA, 391 bp, Gossypium hirsutum
  Clone ID: LIB3272-034-P1-K1-B2
tttcctatctcaaaatctcaaacccagatttgtgctctctctctctctctctgtatttccaatcaattaattcctccattggaggagcttagggtttgttggtgttctggtctttgctttgtctgaaaaataaacagaattataaacgaacaccaacgccatgggaagatttgaagagagaggattcgattcagtggtttgccctaagcctatccgaacctttagatggtctaccaacagctgttatcagactgagatggctgattcaaaaactggtgcagagcttcttgatataatcctccccgagggagggtatggcgccgagaatcccaccaaccaaatggcttcatcaccaccgtatttctgtggatcaccgccgagcacggcgtct

SEQ ID NO: 24126 - DNA, 397 bp, Gossypium hirsutum
  Clone ID: LIB3272-034-P1-K1-B3
aagaaagatagagagagaaggtcatgcatctctcctgatataggagcctcagccttcaacctttgaacctaccctttctgcttttcttattaatatactcctctatttatgtgaattcacaagggccaaagggttgttgctttaccatggctgttcaagcacctttgtatgctgaaaatatgtgcggtgttcaggattggatggtaaatcctgcacctgctctaattccttcctcgtatttcactcttcaagacccttctcgatatacgcttccttttcatctgcaacaaaacgctcacaatttggctgtttcttcttcttcttcttcctcttccgcatctaatgctttcgtctctgtggctctttcacaatcgttggatgctcaactggagatgca

SEQ ID NO: 24127 - DNA, 202 bp, Gossypium hirsutum
  Clone ID: LIB3272-034-P1-K1-B4
aaagaaagaaaactaaattctcttagagctctggcctgtggccgtcctagctgatcccagagcacgcaccgccttcggccccacatgcctcacgcgccaccgtctgggtcttgaaacccggcggttagggctttcaaaaccctatcctcttcgcgatgaatcgaagggtatcccgacgatctcggcgttaacggaagtatga

SEQ ID NO: 24128 - DNA, 402 bp, Gossypium hirsutum
  Clone ID: LIB3272-034-P1-K1-B5
ctttttccttcttgttgctgtttgcttttagtgccaaagctgttgttcctccatctgaaacttttaggtttgtcaacgaaggggaatttgggccttttattgttgaatatggtgcagattaccgtgtcataagcatagctaatgcccccttccagcttgcgttttataacaccacgcctaatgccttcacccttgcgttacgcatggctacaacacgttccgagtcgctcttccgatgggtttgggaggccaacagggggaaccctgttcgcgagaacgccacgttctctctcgggactgacgggaaccttgtcttggctgatgccgatggtcggattgcttggcaaagtaacactgccaacaaagctgtggtagggttccaattgttgcctaatggtaaca

SEQ ID NO: 24129 - DNA, 297 bp, Gossypium hirsutum
  Clone ID: LIB3272-034-P1-K1-B6
actttaaagccaagaaagcaggccattaaggtttggagaaaagatcaaaatggattcaaaaagatcagcttccatagccctccttttggcactcaacattctcttcttctccctagtcagtgctaattgtggatcttgttcttcttctggctctaacccaaggccaactcccacccctactccatcagcacgaggtaggtgccctagggatgccctcaaattaggtgtatgtgccaatgtgcttaactaagtcaatgtcaccgttggttcacccccggtgatgccatgttgttccct

SEQ ID NO: 24130 - DNA, 389 bp, Gossypium hirsutum
  Clone ID: LIB3272-034-P1-K1-B8
cttttgtagtggaagaaaaaaaagagaaaaaattatggagacaaagtcattggcaatggtggtggtgataactgtttcagtcatgtggggcgttgaaatggccactgcagaactcagtgccgctcagtgcaagcaagaaaggaacctcgccattaccgcttgcaagccggtggtttacggtaagcttccgtccccggaatgctgccagcgagtaagggttacccatctggaatgcgtttgccccatcatcacgcccaagatcgccgcccttattgacgtcaaccgtgccatccgcctcattcaaggctgcggtcgaagtgttcctcgccactacaaatgtggaagtatcacaactccatgaaattggcataccttctgctatactactg

SEQ ID NO: 24131 - DNA, 386 bp, Gossypium hirsutum
  Clone ID: LIB3272-034-P1-K1-B9
ccggaactaggttctctggctgtagctggaaattcgaacaacttaagtgaagggaaaaatcatgaatcaactcaagcggtggaattacctggatttagtgattgtgaggaaggatgtgatgaagagagtcgagaagaaagagatgatgatgaaccaaatccaaaaagaaggaatagcacaggggaagctgcagtagtgttgtcacacaaggctgtcgcggatgcaaaaattatcgtgcaaacaagaagtgaagttgaccttttagatgatggctatcggtggcgcaaatacgggcagaaagttgtcaaagggaaccctcatccaaggagctattacaaatgcacgagtgcaggatgcaatgttcggaagcatgtggaaagagcttc

SEQ ID NO: 24132 - DNA, 399 bp, Gossypium hirsutum
  Clone ID: LIB3272-034-P1-K1-C1
ttttgttctaattcacaaggcaagacaaactgttaagaaagtgggtaggtactaagagcagattttctattgcaactttgtttcatttgggtttcattgcttgggttaactcatcatcaaaagttgaagaaatcattttaatattgagcagcctgttcaacaggttggccagcattagataaagctcccttgcaaataattgaaggagctaacaggaaatattgagatagaaaagaaaaaggaaagggaaactatgacacacttcgttctagttcatggtatgtgtcatggagcttggtgttggtacaagattgtgtcgctgctcaaatcaggcggccaccgtgtcactcccttggatcttggtgccagtggaatcaaccccaagaccatcactgactt

SEQ ID NO: 24133 - DNA, 394 bp, Gossypium hirsutum
  Clone ID: LIB3272-034-P1-K1-C10
atctcattcaaatccttaatataccggcgatcgaaatggatagaataagggcgtttttggtagccgtggcggttgtcgccatatgcggcgtacctcaggtcagatccaccgcttccgatcatcgttacaaagctggtgatgaagttcctctttatgctaataaagtaggtccttatcacaatcccagtgagacctatcgttacttcgattttccgttctgttcctcagctcccgtgaaggagaagaaggaagctttgggtgaagtattgaatggagatcgactagtgagtgcgccttataaacttgagtttttgacggagaaagaggctgaaattgcttgtaaaaggaagcttacgaaggaagaagtggtcaagttcagaaaagctgtctcgaa

SEQ ID NO: 24134 - DNA, 309 bp, Gossypium hirsutum
  Clone ID: LIB3272-034-P1-K1-C11
gggaaaggttccatgtgaacggcacttgcacatgggttagtcgatcctaagagacgggggaagccctttcgacagcgcgttcagtgcgagcttcgaaagggaatcgggttaaaattcctgaaccgggacgcggtggatgacggcaacgttagggagtccggagacgtcggcgggggcctcgggaagagttatcttatctgtataacggcctgcccaccctggaaacggctcacccggaggtagggtacagcggctggaagagcaccgtacgtcgtgtggagtacggagcgcccctggtaggccttgaaa

SEQ ID NO: 24135 - DNA, 388 bp, Gossypium hirsutum
  unsure (1)..(388): unsure at all n locations
  Clone ID: LIB3272-034-P1-K1-C12
ccatgagctacttaaccatttcccaaatctcctccctcctcttctttagcgtccttttcatttccgctcatgcagcgcgctttgaaatccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccggtgattgtggtggactccttcaatgcaaaggttggggtgtacctccaaacaccctggctgaatatgcacttaaccaatttggaaacatggatttctacgacatttncttagttgatgggtttaacat

SEQ ID NO: 24136 - DNA, 228 bp, Gossypium hirsutum
  Clone ID: LIB3272-034-P1-K1-C2
gctggttccaattacagggtcgtgttttgcccccgaggctcacctcatatagagatggtcggaagtaagagccaagaaaaataaagggatcatctcttggtctagttaatctgcgccttggaactaaaaaataaaaaagtcatttggtcttccaaatgatatcaaacacgtggttctacttggtttattttacatatgttttgtttaataatattgtgcagtttcaac

SEQ ID NO: 24137 - DNA, 390 bp, Gossypium hirsutum
  Clone ID: LIB3272-034-P1-K1-C3
agaaaattcatcgatcaatatttctcccccaattcccaaagaatttgattatcgccattcattgctcaccttcggtgggtaaacttccccaaatccttgcgccgccgccggctgccatccaaatctcatcatcaattttcgatcgatcggtagagcaattagggtttccaagaaacgggaatggacgacagctgtgcggtttgtgctgacaatttggaatgggtttcctatggcgcctgtggtcatcgggacgtctgctccacgtgcgtctctcgtctccggttcatctgcaacgatcgacgctgctgcatctgtaaaactgaatccaacgtcatcttcgtcactaaggctttaggggattatacgaggatgataaatgacttctctgta

SEQ ID NO: 24138 - DNA, 359 bp, Gossypium hirsutum
  Clone ID: LIB3272-034-P1-K1-C4
aaaacaaagccatttttagtggtttcgctctctctccctctctctagagaagaggcattccctttgtcggagtgcgcttctgctgagtgtttctttcgttttcttttgttttaagttttggagtaaagagtgtttcaagcttcttagtcctattggctgcttaacgacctaagctagccccgccggatatagttatcaggtgctcatcataaaaaatgactgtcacgccaggaatttccatcaacgatgggaaccttgtggttcatgggaagaccatcctcactggaatgcctgacaacattgttttgaccccaagatccggtgtcgggcttgttgctggtgcttttataggtgctact

SEQ ID NO: 24139 - DNA, 229 bp, Gossypium hirsutum
  Clone ID: LIB3272-034-P1-K1-C6
ggaaaatgtcgaaccgagggcgtggaggttcacctggtaacaagtttaggatgtcactgggtctgccagtggcggcttacagtgaactgtgctgataacactggcgctaagaacttatacatcatttcggtgaagggaatcaagggccgtcttaaccgattgccatcagcttgtgttggagatatggtaatggttcctgtcaagaaagggaagcctgatcttaggaaga

SEQ ID NO: 24140 - DNA, 321 bp, Gossypium hirsutum
  Clone ID: LIB3272-034-P1-K1-C7
tccaattatgcaaacgatggctatcttttctacatcaatggctgctatgctcgttcttctagggctcttcgctgcaaacttggatcctactgctgcacagattggtgtttgctatgggatgcttggcaataatctcccaaattcatgggaagtcattcaactttacaaatcaaacaacatccggcgattgaggctctacgatccaaatcaacaagcattacaagctcttagaggctccaacattgaagtaatgttaggtgttccaaatgatcaacttcaaaactcttcttgacccttccaaagcacgatcatggtttcaat

SEQ ID NO: 24141 - DNA, 162 bp, Gossypium hirsutum
  Clone ID: LIB3272-034-P1-K1-C8
cggacgcgtgggcggacgcgtgggctcttgtgttcaacatgccttgtggtaataaactaaaacatatatgtacgagttacttcttcttttgttatttctgttttccttttgaagatggaaatgcataaattatagagcttgttttcttctaaattgatgatg

SEQ ID NO: 24142 - DNA, 388 bp, Gossypium hirsutum
  Clone ID: LIB3272-034-P1-K1-C9
cggacgcgtgggcttcaccatgaacaaaagcaagctccagctgcaactttgtgcagggatatttactttaagcatcctctccaatggtgcttatggtagtgacaaaatctttgacataactcacaaaatcacttctcagttgccaacttttggatcacagaagggtcttggtcaattcatttggcttctttccagcatcaaaaatgggtccacagtgaatgtgtcggagttcaaattgggaacccacactggcactcacgttgatgctcctagtcacttctttcagaagtactatgaacaaggatttgatgtttcaacccttagccttcaaactcttaatggtcctgttctagtagttgatgttcaaagaaataagaacattactgct

SEQ ID NO: 24143 - DNA, 399 bp, Gossypium hirsutum
  Clone ID: LIB3272-034-P1-K1-D1
aaattctttgctcttcttccactgaaaccgtaaggagaagatcggagagaaaatatggcggccggcgatcgcaccgttttgcagtttaactcaccgtcatcggcgatcctgtcagcgaaagttcaccctctcgtcatatttaacatctgcgattgctacgtcaggcgtcccgaccaagccgagcgcgtcatcggcacgctcctcggctccgtcctccctgatggcaccgtcgatatccgtaactcctatgcagttcctcacacggagtccgctgaacaggttgctttggatattgaataccatcataatatgttagtctcccaccaaaaagtgaatcctaaagaagtgattgttggatggtattctaccgggctaggagtcacagggggcagtgcattg

SEQ ID NO: 24144 - DNA, 383 bp, Gossypium hirsutum
  Clone ID: LIB3272-034-P1-K1-D10
tttctttttacccactacgaaaaaaatagcacacagctaccaccttccctgcgtttctcccaaaatttatattaattttcttttaatttttactttttttctggatatcaattttcccattttctcctgcttcatcttcttgttattgtgaattttctgttcttttttttctctcttttttaattttataaatgaaattcaaaatgggtttttcttcatcatcatcatcatcatcttcctctcttcttctgttcttctgtataacagtcttttgttcaatacgctgtgttttgggttcttctatttgctcccatgaagctgatgtgttcattaaaaatattcactttcaatgctctccttcgatctctccaattccccctctc

SEQ ID NO: 24145 - DNA, 391 bp, Gossypium hirsutum
  Clone ID: LIB3272-034-P1-K1-D12
ctcgattctacttaacgcaaatagttcgagtttcgtaatcaatggctttaccgaaccaacagactgttgattatccgagctttaagctcgttatcgtcggcgatggaggcactggaaagaccacatttgtgaagaggcatctgactggagagtttgaaaagaaatatgagccaacgatcggtgtggaggttcaccctttggacttcttcactaactgtgggaaaatccgattctactgctgggatactgctggacaggaaaagtttggtggtcttcgagatggttactatatccatgggcaatgtgctataattatgtttgacgttactgcccgtttgacatacaagaatgttcctacctggcaccgtgatctttgcagggtgtgcgagaa

SEQ ID NO: 24146 - DNA, 393 bp, Gossypium hirsutum
  Clone ID: LIB3272-034-P1-K1-D2
gaaaggccgaacgcaatggaaagaatagaattagatgaagcaatgctacaagggcaagcagagatatggcgttacttgtacagtttcgcagattccatggctcttaagtgtgccgtggagctccgcatagctgacataatacactctaatggtggccccctcactttgtcgcaaatagcttcatgcattaatggtggccttacttcacctgacatcaccacccttgctcgcataatgagattgctcattcgcagaaagattttcaccgtccaccatccttcagacggtggagatctcttgtacgacctaactcactcatcgagatggcttctacatgattcggagcaaaccctggtgcccatggtattaatggagaaccatccattgcagatg

SEQ ID NO: 24147 - DNA, 375 bp, Gossypium hirsutum
  Clone ID: LIB3272-034-P1-K1-D3
ctctgctcttcgtagtctcccaaatatctttcctttgtcttatcgaatatgatgcaacaaccagcagctggaggcgtggctccgccaccttccatggcggccgatcagtctcagactcatcagtaccagcaacaaccgcagtcgcagccctggatgatgatgtctcaacaacagcagggtggtcaaccggttcctccacctaccggttggacgccgcaacctgttccttcgcccactcaaatgcagcaatactccgccggttctgctgctgctggctccggtgagattcgatctctttggatcggtgatcttcagccgtggatggatgagaattaccttatcaatatctttgctcaaactggagaggtgggttcg

SEQ ID NO: 24148 - DNA, 391 bp, Gossypium hirsutum
  Clone ID: LIB3272-034-P1-K1-D4
cgataaataaaaaatgagctttcttcaggccttgtcagttttccttttgtttttgtcgtatgtaggcgtaggatcagctgagcagtgtggaaggcaagcaggtggtgctctttgccccggtggtctatgttgtagccaatttggctggtgtggcagtactgctgactactgcacagttcctggttgccaaagtcagtgcagcggtagtggccctgcccctgggcctggtgggctaaccaatcttatatcaagagagacgtttaatcggatgcttttgcataggaacgatggggcttgtcctgcccgtggcttctatacatatgatgctttcattgctgctgcccgttcctttcctgcatttgctacaactggtgaccaagctactcgcaag

SEQ ID NO: 24149 - DNA, 357 bp, Gossypium hirsutum
  Clone ID: LIB3272-034-P1-K1-D6
aaatttcctagtgtttacaagtctagggtttttctttttcttcttctccttcggctctctctaaggcttcacccttgatattgatcatggccaactctgatcaaattgcagattcactagggaaattgtctctagattcacaagccgtgactgcaaaagttcccgataccgtaaagaaggatctttatggtgataatggctcatatgtgtaccagcagacttatggttatatgccatatggggtgtattctatgcctagttcacctcttcctgctatgggacatgacggtcaacttcatgctctgcaagaataccattatccaaatccttattaccagccactgcctcaaactagtc

SEQ ID NO: 24150 - DNA, 384 bp, Gossypium hirsutum
  Clone ID: LIB3272-034-P1-K1-D7
cagtttctcattttcaagtctgcaaaacccctagccagccacttccccgccggctctccgaaccatgggccgagtccgtaccaagacggtaaagaaatcctctcgccatgtgatcgagaggtactactctcgcatgacgcttgatttccacaccaacaagaagatcatcgaagaagtggctatcatcccttccaagcgtctccgcaacaagatcgccggcttttccacccatctcatgaagcggatccagaagggtcccgttcgtggcatctctttgaagctccaagaagaagagcgtgaacgtcgcatggatttcgtccccgacgaatccgccatcaaggttgatcaaatcgaagtcgataaggaaactctcgatatgctttc

SEQ ID NO: 24151 - DNA, 389 bp, Gossypium hirsutum
  Clone ID: LIB3272-034-P1-K1-D8
cttgcattgagtctctaagatatcactgcaaggaaaaaaaaaaaaaaccagacgatggcttccaacactgttgcatccgctgctcttcttcttaccttgaacttgttgttcttcactttggttagctctacctacgtgccttgcccaccaccaccaaagagccacaagcctacccacaagagcccaccctcggcacctaaacagccagccacttgccccaaagatacactgaaactaggtgtttgtgctgatttgttgggctcggtgcgcgttgttgttggaccgtcgaggaccaaatgctgctcactcatttcgggtttggctgatctcgatgctgctgtttgcctttgcactgctattaaagctaatgtgttgggggttaacctaaa

SEQ ID NO: 24152 - DNA, 394 bp, Gossypium hirsutum
  Clone ID: LIB3272-034-P1-K1-E1
aaaatccttactttctcagaatagatcacatcgcagtttctcatttccctcgcttcacttattttgttcacatatggacggactgatcaagggtttactggacgtcgctattggccacgagggagataatgagtctcaagatgaacgccccagatccagttcggcgcaggcggtgtcaggggatcaggatcaccaacgagatgaacgctccagatccagttgggcgcaggtggtgtcaggggatcaggatcacgaaaaacaggtgcagagtcaatggcagggttcgggttcaagaccttcggggaggacccacaagaccgagtatgggggatatgaaaaaaatgaaggtgatgagcgacgacatggttataaccaaaataagtggaacagaaag

SEQ ID NO: 24153 - DNA, 391 bp, Gossypium hirsutum
  Clone ID: LIB3272-034-P1-K1-E10
atcaaattcaaaaactaatgtaggttttttttttcttttttgaagttttttagccaagtgaagtgaagagattcttttatcctttgcttcgaagaacttcaaaagagatccccgtttggtctctttcagctgcttttttgtgtttttcacttcagtaacagttggagactcttcgactttgcctcaacccgggggggggggggatcttcaatatggagcagtatgaaattctagagcagattgggaaaggatcttttggctctgccctgcttgtgagacataaacatgaaaagaagaagtatgtcctaaaaaagattcgccttgctcggcagactgatagggctcgtagatctgcccatcaagagatggagcttatttctaaggtgaagaa

SEQ ID NO: 24154 - DNA, 393 bp, Gossypium hirsutum
  Clone ID: LIB3272-034-P1-K1-E12
aaaaaatggcggaaagagcaccgatcgaatccgtacaatgcttcggccgcaagaagacggcggtggcggttacccactgcaagcgaggccgtgggcttatcaagattaacggttgtcctatcgagcttgttgagcccgaaatcctccgtttcaaggccgtcgagccaattcttctcctcggccgccagcgttttgccggcgtggacatgaggatccgtgttaaaggcggaggccacacttctcagatctacgccatccgtcaaagcattgctaaggccctcgtcgctttctaccagaagtacgtcgatgagcaaagcaagaaggagattaaggatatcttagtcgggtacgataggactttgctggtggctgatccgaggaggtgcgagccca

SEQ ID NO: 24155 - DNA, 395 bp, Gossypium hirsutum
  Clone ID: LIB3272-034-P1-K1-E3
attgcactctttgctttgctttccttctctcaaggctaatagcatttgtcatttaaagttgggtttttttttttgggaggaaatctttgttttttgttgtttgttgtgtggtgtgcatggagctccaactgggactctctcttccatccactcctatttttcctttcaaaatgttggacctcaacagctatggttacgagcttagggagggtttgggtccatttggcattaatgttaacaacaattgcggcagttgcagcagcagctgcaattctagcagtagcggcggtgctgatgatggtggtggtggcaccaaaacacgacgactccttgatgaagagaatcgaattgttcctaaaacgttgcctcttttgttttggacaaaccaacgacct

SEQ ID NO: 24156 - DNA, 339 bp, Gossypium hirsutum
  Clone ID: LIB3272-034-P1-K1-E4
attttcaagtctgcaaaacccctagccagccacttacccgccgcctctccgagccatgggccgagtgtcgtaccaagacggtaaagaaatcctctcgccatgtgatcgagaggtactactctcgcatgacgcttgatttccacaccaacaagaagatcatcgaagaagtggctatcatcccttccaagcgtctccgcaacaagatcgccggcttttccacccatctcatgaagcggatccagaagggtcccgttcgtggcatctctttgaagctccaagaagaagagcgtgaacgtcgcatggatttcgtccccgacgaattcgccatcaaggttgatc

SEQ ID NO: 24157 - DNA, 394 bp, Gossypium hirsutum
  Clone ID: LIB3272-034-P1-K1-E5
cttccatccatcaacagtagtctgaattcacttactctctagaaacatgcttcccttcatgagaattccaagtgttaactttcttcaaaatcacctcccagttcttcttcaacaatccggctccttatttcccttaagtgctccgtccacctccgctcctcatccaccacggcctcagcccaggaggaaccctattcatcagataaatagtttctccctttttgagtccttcagtcgctataaagtgagcaactttgttagaatccctgtagataaaacgaaaaacacagtatctgaaacttaaactccgatgctttgagtctttgataagtgctgcgatttcagatctgtcctttttctcttcttgcaatttgcgaatcaccatccaagagtc

SEQ ID NO: 24158 - DNA, 386 bp, Gossypium hirsutum
  Clone ID: LIB3272-034-P1-K1-E6
cggacgcgtgggaaagcgaaaccctagccactctctgctcaactcgccaatgggggcttataagtgcgtgtcggagctatggaggaagaagcagtcggatgtgatgaggtttttacagagggtgaggtgctgggaataccgccagcatacatcaattgttagggtcaaccatcctactcgccctgacaaggcacgccgcttgggttataaggccaaacaaggttatgtggtttaccgtgtccgtgttaggaggggtggtcgcaagaggcctgttcccaagggtatcgtgtatggtaagcccacaaaccagggtgtcacccaattgaagttccagcgcaacaaacggtctgttgctgaggagcgtgctggccgaaagttgggaggtc

SEQ ID NO: 24159 - DNA, 388 bp, Gossypium hirsutum
  Clone ID: LIB3272-034-P1-K1-E7
ctcagaaagagcacccaaaagaaaaaacactgatcaacgaaggatttctagggttttttttcggtatcagcaagcgatggcaatggctgctctcagacgcgaagggaggcgtttcgcccctctgatctctccccgtccaattactgctgtccgatcctctcctatcgttcccactcacgaagatgagggtccgattggtgttcgttatatttcaacccaagtcgttagaaaccggatgaagagtgttaagaatattcagaaaattacaaaggctatgaagatggttgctgcctcaaagttgagagcagttcaaactaaagctgagaattcccgaggcctctggcagccatttactgcactttttggtgatctttccagagttgatgtc

SEQ ID NO: 24160 - DNA, 389 bp, Gossypium hirsutum
  Clone ID: LIB3272-034-P1-K1-E8
aattttctttctcgattttctctttagccaaaaaagatgcagatcttcgtcaagactctaaccggcaagacgatcactctcgaggtcgagagctccgacacgatcgacaacgtgaagaccaaaatccaagataaggaaggcatccctccagaccagcagcgtctgatcttcgccggaaaacagcttgaggacggccggaccttggccgattacaacatccaaaaggagtcaactctccacctcgtcctccgtttgcgcggtgggatgcaaatcttcgtgaaaaccttgaccggcaagacaatcactctcgaggtcgagagctccgacacgatcgacaacgttaaggcgaagatccaagacaaggaaggcatccctccagaccagcaacg

SEQ ID NO: 24161 - DNA, 389 bp, Gossypium hirsutum
  Clone ID: LIB3272-034-P1-K1-E9
ggaaaaaccctggagagaggaaagactggtagacatggacgacggcaacaccaccgaggcggagcgatggctaactatagcggcgaagctactcgcttccggcgactttcacggcaccaggactttcgcgatccgagctcgagaatcggcacctgtcctcgccgaccaaatcttagctgtcaccgacactctcttaaccgctcaatctaaccctcgtgactggtacggtatcctccaactcgttcctttaactcaatccatggaagtcgtggagagtcagtataggaaactcgcgattctcttgaaccctgtgaagaacacgttgtcttttgcggatcaagcgtttcggttcgtttctgaagcttggaatgtgttgtcgaatccttcta

SEQ ID NO: 24162 - DNA, 393 bp, Gossypium hirsutum
  Clone ID: LIB3272-034-P1-K1-F10
cttaccttgaacttgttgttcttcactttggttagctctacctacgtgccttgcccaccaccaccaaagagccacaagcctacccacaagagcccaccctcggcacctaaacagccagccacttgccccaaagatacactgaaactaggtgtttgtgctgatttgttgggctcggtgcgcgttgttgttggaccgtcgaggaccaaatgctgctcactcatttcgggtttggctgatctcgatgctgctgtttgcctttgcactgctattaaagctaatgtgttgggggttaacctaaacgttcctgtttcattgtctttgctcctcaattcctgcgaaaagcaaatgcctgctggttacaaatgtgcttaagcaatgtttgggtttttcttt

SEQ ID NO: 24163 - DNA, 345 bp, Gossypium hirsutum
  Clone ID: LIB3272-034-P1-K1-F11
atacattcgtgccttggatctaagttcgagcttgctcacggaattaccagactctgttggggagttgaaactattacgctacttggaattttttaggcagaaataaaaaggttccaactaatattaagctccggattgcaaacactaactttaggtgcctttgcttttgaatgccaaggccttgtaaaaggtaaccgattatttgactaatgacatgtttggtcagtgtagggctgcaccaagatgggaacttaccaggctacagaattgcatcatttgagtactcacagacaccggacgtggattggaaactgaagacatggcggatcttaaggaaagctgata

SEQ ID NO: 24164 - DNA, 392 bp, Gossypium hirsutum
  Clone ID: LIB3272-034-P1-K1-F12
tttcgttttgttcctttggatctgtgaggcagccgccggttcctttgaccaccaccaccaccaccaccacctctctgtgatcaaccttcactctctttttcaaggaaattagctgaaatggctggaggattaatccaccaggttttaaggaggaaatttcaatcacagtctgctgttcaagctttatcatggttttcatcaaggaaagttaatgacgatgcgggttctgctggtatgaggaccgttgcactccttggagctggtgtttcaggtttactaggttttgcaacagtagcatctgctgatgaggcagaacacggtttaggagttccaaattatccttggcctcacgcaggcatcctcagttcatatgaccatgcttcgattcgtcg

SEQ ID NO: 24165 - DNA, 397 bp, Gossypium hirsutum
  unsure (1)..(397): unsure at all n locations
  Clone ID: LIB3272-034-P1-K1-F2
atttaaactaaatactgaagtcatttgttttgggggagtgccggagaaaatggcctgttttcaatatatagtagctgctctatgctttgcagttgtacttgagggatcgttatcaaaagctcaactgaccccgacattttacgatggaacatgcccaaacgtgacagccattatccgacaagtgctcgtgaatgcttcgttttcagatccaaggattggtgccagtctcatcaggcttcacttccatgattgttttgttcaaggatgtgatgcgtcgattntattggacgatcctgtaaatggtgagaaagaagctattccaaataataattcagctaggggttatgaagttattgatgccatgaaggctgccttagagagtgcttgccccaacact

SEQ ID NO: 24166 - DNA, 384 bp, Gossypium hirsutum
  Clone ID: LIB3272-034-P1-K1-F3
gtgcgcgttgttgttggaccgtcgaggaccaaatgctgctctctcatttcgggtttggctgatctcgatgctgctgtttgcctttgcactgctattaaagctaatgtgttgggggttaacctaaacgttcctgtttcattgtctttgctcctcaattcctgcgaaaagcaaatgcctgctggttacaaatgtgcttaagctcatttccactgtttcctcagcaatgtttgggtttttcttttacgtgttctttttttttctgggcttgtttaatttggtattttgatatgtcaagggttagataaaatggtaaaggtttcttttaccttaaccaatagtcaattctcatctatttatacaatatttgtcatgttagtaagaaag

SEQ ID NO: 24167 - DNA, 389 bp, Gossypium hirsutum
  Clone ID: LIB3272-034-P1-K1-F4
ctgacactctgcttctaagctttactttttctcttttttctctcaatactggtgcactaaaaaatgccaatcaaaaaagatccttcgattccaccgccgatgatcagcaagatcggcccttacaccgtcttcgttacccctccgtcaaccccttctccaactgaccctcctgtttttcactctcccaagaaggccgcgccgccttctccttctccttctgctccgccgcctgtgcagccaccttcccaacagttcgacaagtctttccgtacttcccaatcccttttcgacggttcatttctgggtttcttcaaaaacgctgccttcaaactccaaaacgctcattcaagcttggatgaccatttagctcgttggttcggcttaaatca

SEQ ID NO: 24168 - DNA, 373 bp, Gossypium hirsutum
  Clone ID: LIB3272-034-P1-K1-F5
ggtcgatgaagccaaagcttatctgcttttcgtctctgaatctgatcaatcaacacctgaaaaggaaaacttacaaacaactactactagtctactacccagcactagaagcagctcgtagccagccatggatgaagagtacgatgtcatagttctaggaactggtctcaaggaatgcatcctcagcggtcttctttctgttgacggactcaaggttctgcatatggataggaatgattactatggaggagagtctacatcactcaacctcattcagctctggaagaagtttagaggaaaatgataagcctcctgctcatttgggctctagcagagattataatgtggacatgggccctaagtttatgatggc

SEQ ID NO: 24169 - DNA, 254 bp, Gossypium hirsutum
  Clone ID: LIB3272-034-P1-K1-F6
caaaagcgtgtgatgcttcttgttaataataccacagatgaggaacttttgtgtcaggggttagcactaaatgacagcttgcaacgtgttctttgccggcatgatgacattctgaaaggaaatactggtcccactggagccatagcaaaaacttctggtgggccatttggtaaaattaaccattaaggttattagttcgaaaaataaattgcttaacttttttattaaatcttaaagggttatttttaaaggcc

SEQ ID NO: 24170 - DNA, 386 bp, Gossypium hirsutum
  Clone ID: LIB3272-034-P1-K1-F7
cggagaatcaatccaaccaaatcccaccatcaaaatccccgtaggggacccattcaacgatccgacggctagctttccctccgttaactttaactacaacaatgcagtcagtagtccttgccccgtcgattacctcgggtctctccaccgttacctaccgtcaaacgactacgagtccgattcgtttagtgatgattcggacttgcctgttgatgcattctcatgcgaccatttccggatgtacgagttcaaggtgaggaggtgtgctcgtggaaggtcacatgactggactgagtgtccgtacgctcaccctggtgagaaggcccgaagaagggacccgcaaaagtttcattactctggaactgcttgccccgattttcgcaagg

SEQ ID NO: 24171 - DNA, 384 bp, Gossypium hirsutum
  Clone ID: LIB3272-034-P1-K1-F8
ctttcctgcatccgggttcccactgtggaaattgttgtgtttaatcatttgagagctatgaagtgttttacattccccaattggtataaaaaagatgaaccaaagacccccagatcactttcaaaccggtctctgaactccatgtgcactgatcgcgaaatagcgaggtctggatctgaattgaactctcagaatgtctcaggcgtgagcagtgagtcaatggggcggtcctattttcctagcatgtctcaaagacctagcaatctcagagtgttcacagtttctgagcttaaatctgcaaccaagaactttagccgctctttcatgctcggagagggtggatttggctgtgtttacaagggttctctcaagagtcctgaagat

SEQ ID NO: 24172 - DNA, 390 bp, Gossypium hirsutum
  Clone ID: LIB3272-034-P1-K1-F9
cctgaagctcctctccgctatgttggcatccctcgccaatctgctgcttttcgcctcatgaagcaaatgggatgggaagaaggagaagggcttgggaaagataaacaagggatcaaaagttacgttagaattaaaaacaaacaggacacaattggggttggattggaaaagccgaatccgtgggctttcgatacagctcagtttgatagtattctcaagagattgaaagtgcaagcagcacaaatcaatgatgaagtgaagggcaagttgtcaaggctacccgaccacagggaagatataagaaaagagagagagggaaaattgtgcaggcatattcttcagaggatcttgaaggaattctggccaaaagggttgaggagtcatcaccag

SEQ ID NO: 24173 - DNA, 289 bp, Gossypium hirsutum
  Clone ID: LIB3272-034-P1-K1-G1
gacaaatggagggtccttagctttctctctctctccaaaaaaaaaaaaaaagagaacgaaaaaaagtttcgcttctttgctttctttcgagtaaaaatcaaacgaaaaacaacttaaataatattaaaagattttgattttgatcatcaaattttgtggttctgatccaccagtccagtcagagtggtgaaatattgaagctggctggtggtttggttggtttttgaaatctgatgtctccgccgcttcttggcctggaggaagggggtcaaaacaatgtgactttact

SEQ ID NO: 24174 - DNA, 362 bp, Gossypium hirsutum
  Clone ID: LIB3272-034-P1-K1-G10
attacatgtcccatcgtgcctggtattatgcccattaataactacaagggtttggtgcgaatgactggcttttgcaaaactaatataccggatgaggtcactgctgccttagagcctatcaaggacaatgatgaagcagtcaaatcctatggaatccacctcggaacagaaatgtgccgcaagattttagctcatgggattaagacgttgcacctttatacattaaacatggagaaatctgcattagctatactaatgaaccttggactgattgaagagtccaaaatttctaggtctttaccttggagacgccctgcaaatgtctttcgtgttaaggaagatgttcgcccaatattttgggc

SEQ ID NO: 24175 - DNA, 288 bp, Gossypium hirsutum
  Clone ID: LIB3272-034-P1-K1-G11
cggcgggacacgcgcgattacaccgatgagtttaagcatatcaataagcggaggaaaagaaacttaccaggagttccctagtaacggcgagcgaaccgggaaaagcccagcttgagaatcggtcgccatcggcgtccgaattgtagtctggagaagcgttcttagcgacggaccgggcccaagttccctggaaaggggcgccggagagggtgagagccccgttgtgcccggaccctgtcgcaccaagaggcgctgtctaccagtctgggtgtttgggaatgcacccct

SEQ ID NO: 24176 - DNA, 136 bp, Gossypium hirsutum
  unsure (1)..(136): unsure at all n locations
  Clone ID: LIB3272-034-P1-K1-G12
ctcacgcaatgttatttctgcccactgttctgaatgtcgagttganaaanggtggcacatctggtttaaagataacgcaggtcttctaagatgagctcaacgagaacagaattttcttttggaacaaaaggtcaaa

SEQ ID NO: 24177 - DNA, 351 bp, Gossypium hirsutum
  Clone ID: LIB3272-034-P1-K1-G2
tttttagcttacagcttccattgtttttcagtagtgaagagctaaaaaagaagggaaaccaatggaggggaaagaagaagatgttagattgggagcgaacaagttctcagagaggcaacctattgggacagcagcccagtcccaagatgataaggattacactgagccacccccagcacccttgtttgagcccagtgagttgacttcatggtcgttttaccgagctggaatcgctgagttcgttgctactttcctattcttgtacatctcggtgttgactgtatgggagtccttaaggacaaaaccaagtgtacaactgttgggattcaagggattgcttgggcttttggt

SEQ ID NO: 24178 - DNA, 393 bp, Gossypium hirsutum
  Clone ID: LIB3272-034-P1-K1-G3
gaaaatgattcttgagaatacaatgacagcgttttttttttattttatatatattaatctttcggttcctttcacatgtaatgacacaagggaatctttatagttatcttctcatgctatagttgccccataaaaaaaggcttagcctcgttcatgtcataaaaatccttcacttggatctaaaaaaaggcttagcctcgttcatgtcataaaaatccttcacttggatctatatatatgtttctttaattcttttctcttgaaagtggtcatggaagatgatgcatacgaagaggagcctttgaatctcagcttgacaattatggcggatcccagtggggaaaagattaacagaaagaggaagagaagggttccacttccatcatcatatga

SEQ ID NO: 24179 - DNA, 387 bp, Gossypium hirsutum
  Clone ID: LIB3272-034-P1-K1-G4
gcggcggcataagagttttaaggaaaatgcagatcttcgtgaaaaccctaactgggaagaccataaccctagaggttgaatccagcgacactatcgacaatgttaaggctaagatccaggacaaggaaggtatcccgccggaccagcagaggttgatcttcgccggaaagcagcttgaggatggtcgtacacttgccgactacaatatccagaaagaatcaacattgcatctggttctgaggcttcgtggtggcattatcgagccatctttgatggcattggctaggaaatacaaccaggacaagatgatctgccgcaagtgctatgctcgtctacacccccgtgctgtgaactgcaagaaaaagaagtgtgggcatagcaatcagc

SEQ ID NO: 24180 - DNA, 389 bp, Gossypium hirsutum
  Clone ID: LIB3272-034-P1-K1-G5
ctatacccctatgaccgacccttatattagttcactctctcttttccctttgaggttttgggcttctctcaatttctcaatcccaattgtttttaaaatggcttcttccactgctcaaatcaacgtactcggtggaatcggtttcgcttcttctcgaaaacccaactaccattcacccagaaccgttttcttgggtcaacgacttggtaaaccgtcgccgttaaacgcagccttcttacggttagcgaaaaccaatggaaaacggtacaatgttgggccggttagagttgtgaacgagaaagtggtcggaatcgatctcgggactactaactcggcggttgcggctatggaaggagggaaacccacgattgttacgaacgcggaagggc

SEQ ID NO: 24181 - DNA, 392 bp, Gossypium hirsutum
  Clone ID: LIB3272-034-P1-K1-G6
acgcactgacccacttatcttttttcttgaaaaaaaaaaaaaaaagttttcctagaaaatttctgtttagctctagatgataaatatcgaccaagaagaaacaagtagcgttagagaaatcagaccaaaaagcagaagaatcatgggaggaggaggaccagatgatgaagatgatgaggatgaggatatgaagtggccgccatggctgagacctctgcttcaaacaagcttttttggtcaatgcaagctgcacgcagatgctcataagagtgaatgcaacatgtattgcttggaatgcatgaatggagcgctttgttcactttgccttgcttatcacaaggaccatagaaccattcagataaggagatcatcataccatgatgtgataaggg

SEQ ID NO: 24182 - DNA, 388 bp, Gossypium hirsutum
  Clone ID: LIB3272-034-P1-K1-G7
cctcgaatatcttctcttcgcaggcaaacaaacagagctcaatttcttttcttattccgagtcttggttatcagattgcatgttgcactggagtgattgacatagcaaaagtttgttaggaagaatcaatgaaaccttggttagcatgtctggattaattgaaggtcttcccgatgctgttgcccttaggtgcctagcacgggttcccttctacctatatcctaagttggagattgtttctcattcctggagagctgccattcgtagccccgagctgtttaaagctcgacaggaacttggctcaacagaggaacttctatgcgtgtgcgcctttgatccggagaatttatggcagatgtatgatcctttacgtgatctttggattact

SEQ ID NO: 24183 - DNA, 389 bp, Gossypium hirsutum
  Clone ID: LIB3272-034-P1-K1-G8
ggcgtggcttcgcttctcccctgtttttcacagtcaacgctgcctcccaaaacgaaatcgctgtctcatttcacgatccaaagtttccaaattcctctttgggttttgctcttcaccacttaagtctcaaatggttcgtaggccaaacgacccggaacactcccgtttcgcctctctcgtcctcctcttggtgtctctgttctcctgtcttctggtctatgcggttgtttccacactattgaaccccaccgtaaatcctcaggattccagctttgagtctttggaatcggtggcgggtattgattttggggaaaagaagggcgagtgttgcagaggaattgagaatttggagctgtggggtgcagctgtgaagtgggggtctgacttca

SEQ ID NO: 24184 - DNA, 383 bp, Gossypium hirsutum
  Clone ID: LIB3272-034-P1-K1-G9
gggggtgactgatctaaagccaggtgatcatgttctccccatcttcacgggggaatgcaaggagtgtccccattgcttgtcagaagaaagtaacatgtgtgatctcctccgaatcaacactgataggggtgaaatgattaatgatggaaaatccaggttttccatcaatgggaagcctatctaccacttcctaggcacctctactttcagtgaatacactgttgtccatgtcggccaggttgccaagatcaatccggaggctccgcttgataaagtttgtgttctaagctgcggaatgtccacagggtttggtgccactgtgaatgtagctaaacccaaaaagggtcaatccgttgcaatatttggactaggtgctgtcggtc

SEQ ID NO: 24185 - DNA, 237 bp, Gossypium hirsutum
  Clone ID: LIB3272-034-P1-K1-H1
atttttctaccaaatctccacacttttcttcatccctctcacttcaccccaaattcttcctcttcaaacttctatattttttttaagaaaaaagagaattttatagagaagaagaggatcaagaaaagaattttttttgggggtgataggggtgacggggattggtttgtaattttcattggagtttttgggtgtatttcaaaaaaaaatttataagaaaatctgagatttgggggg

SEQ ID NO: 24186 - DNA, 393 bp, Gossypium hirsutum
  Clone ID: LIB3272-034-P1-K1-H10
gaaggcacttattcttagttggaggggcggtatcgctttcgttcacagaaaagtggtcccctccttccttcactgttgcagaaccactctattaatccccgatcaacttaaaacgcttggtttctgttatccaattccttcaactcagtgactcacctatataataataactgcgtcccttcttgaggctctgttcgttgatgtggtagcgagaaaaatggatcgggcaacagtcggaccggctatggatatgccgatcatgcacgacagtgaccgttacgatttcgttagagatattgggtcgggtaattttggagtagcccggcttatgagagataaggttaccaaggagcttgttgctgtcaagtatatcgagagaggcgataagataga

SEQ ID NO: 24187 - DNA, 273 bp, Gossypium hirsutum
  unsure (1)..(273): unsure at all n locations
  Clone ID: LIB3272-034-P1-K1-H11
cgttaatcttcgtttttgctggatctggttcaggcatggcttttaataagctgaccgacggcggtgcaacaactccggctggtctcgttgccgcctctctagctnacggatttgcgcttttcgtgcatgcatccggcggggctaagataagcggtggccatgtcaatcccgccgttacattcggtgctttcgttggcgggaacattactcttttacgtggtatcctttattggattgctcaactccttggctcaaccgtcgcttgcctgttac

SEQ ID NO: 24188 - DNA, 403 bp, Gossypium hirsutum
  Clone ID: LIB3272-034-P1-K1-H2
gcgactgcgtggtggaatgcagatttttgtgaaaactttgactggaaaaactattacattggaggtggagagctcagacacaattgataacgtgaagaccaagatccaagacaaggagggtatcccacctgaccagcagaggttgatttttgctggaaagcaactcgaggatgggaggactcttgcggattataacatccaaaaggagtcaaccctgcacttggttctgcgccttcgaggagggatgcagatattcgttaagaccctgactggtaaaaccgtaacactggaggtcgagagctcggacaccattgacaatgttaaagcgaagattcaggacaaggagggaattcctccagaccagcagaggttgatttttgccggaaagcagcttgaggatggg

SEQ ID NO: 24189 - DNA, 390 bp, Gossypium hirsutum
  Clone ID: LIB3272-034-P1-K1-H3
gggcagccctttcccatgaaaactctcccctctttcatttttcttgtttgttcttgaaatttctcaaaaactcaatacccaaactttgagattttgctaaaatcacttgagaaactacctcttaagcttatttccactttcgatctctttattttcagcaagggtttggttgtttgttaagagagaaagttgaagctagagagagaaatatccattaagaacatgttgaaaggattcacatcctgttgattcgaattcgtagcgagagaaggtaatgctgctgcgcatgcgatggcatttgaaggtatgaaacactcagaagattctttttgggttgaggatgcttcgcttaaggttttggaactagccaatctggatcgtcgttttcat

SEQ ID NO: 24190 - DNA, 397 bp, Gossypium hirsutum
  Clone ID: LIB3272-034-P1-K1-H5
ctccaaaccatgccacatttctcttctccacctttctgggcgggatcgctatcgatgcacatagactgtcagcgttccgaagccacttgtcgaattcgctaataaacccatgatcctgcatcagattgaggctctcaaggctgttggtgtaactgaagttgtgttggctattaattaccaacctgaggtgatgttgaacttcttgaaggagttcgaaactaaactcgggatcacgatcacgtgttctcaagagactgagccgctcggcactgctggtcctcttgctttggctagggacaaacttgttgacgagtccggcgaaccgttttttgtccttaacagtgacgttatcagtgagtatcccattaaagaaatgattgaattccacaaagctcat

SEQ ID NO: 24191 - DNA, 402 bp, Gossypium hirsutum
  Clone ID: LIB3272-034-P1-K1-H6
tgatctttatccttgtttactgcactgctggtatctctggaggacacatcaaccttttaataagctgaccgacggcggtgcaacaactccggctggtctcgttgccgcctctctagctcacggatttgcgcttttcgtcgctgtatccgtcggcgctaacatctccggtggccatgtcaatcccgccgttacattcggtgctttcgttggcgggaacattactcttttacgtggtatcctttattggattgctcaactccttggctcaaccgtcgcttgcctgttacttaagttcgccactagtggcctgggagtaccagctttcggactatcatccggcgtgggagcattaaacgcgttcgttttcgagatcgtgatgactttcggactggtctacaccgt

SEQ ID NO: 24192 - DNA, 390 bp, Gossypium hirsutum
  Clone ID: LIB3272-034-P1-K1-H8
gtcagcttcggtgagatgctgatcgattttgtccccactgtctccggtgtttctctagccgaagctcccggcttcctcaaagcccctggcggtgctccggctaacgtggccattgctgttgctagactcggaggcaaagcgtcatttgtcggaaaacttggagacgacgagtttggtcacatgctggccgatattctcaagcaaaacggtgtctccggtgacgggatcttgtttgaccaaggcgctagaactgctcttgccttcgttacgttacgcgccgacggagagcgtgagttcatgttctataggaatcctagcgccgatatgctgttgaagccggaggagttgaaccttgatcttatcagatcttccaaggtatttcactatgga

SEQ ID NO: 24193 - DNA, 264 bp, Gossypium hirsutum
  Clone ID: LIB3272-034-P1-K1-H9
ctcaacagcaacaccccacccgacccctaaaaatggtccagacaaaccagtccggttccggcaatgatttcaagctcgtcggattctcgaatttcgtccggtccaatccgaaatccgatcggttcaccgtcaaacgtttccaccacatcgagttttggtgtaccgacgccactaacgtcgctcgccgtttttcatggggtctcggtatgcaatttgtagctaaatcggatttatccaccggaaatttgacccatgcttcttatc

SEQ ID NO: 24194 - DNA, 325 bp, Gossypium hirsutum
  Clone ID: LIB3272-035-P1-K1-A10
acgacatatacaatttagccaactcttgtgtatttcatccacgatgaatcccttcaaggccttgccaaccctttctttcctcttcttaacccttttcagcttagcccatgcagccacatttgatataagaaacaactgcccttacaccgtttgggctgccgcatctccgggtgggggcaggagacttgaccaaggtcaagcatggcaaatcactgcagcctctggaaccacacaagcccgaatttgggctcgaaccaaatgcaatttcgatgcctccgggaaaggctcatgcgagacaggcgactgcggtggagtcctcgaatgc

SEQ ID NO: 24195 - DNA, 431 bp, Gossypium hirsutum
  Clone ID: LIB3272-035-P1-K1-A12
ctcagatttcagaagatggcccgtaccaagcaaacccgccggtagtcttcttgtggggagggttcaagggaggcacttggttccaaaggttgccgtaaatctgccccaaccaccggtggtgtgaagaagccttatcgataccgtcctggaactgttgctcttcgtgaaattcgtaaataccagaagagtactgagcttcttatcaggaaattgcctttccagaggcttgttcgtgaaattgcccaggacttcaagactgatttgcgtttccagagccatgctgttctagctctccaggaagctgcagaggcataccttgtgggtctttttgaagacaccaacctttgcgcgatccatgccaagcgtgtcacaattattcccaaagacatccagttggctcgtaggatcaagggagagcgtgcttaattttc

SEQ ID NO: 24196 - DNA, 345 bp, Gossypium hirsutum
  Clone ID: LIB3272-035-P1-K1-A2
acgaaaccttttatttccgctactcctccgccgccgccccaccctcatcctcctccggtaatcccaatcaagccacctgcaaatccaccggcggtggcggcgggtccggcggtctagccccatcgaaatcaaccctttacgtctccaacctagactactccctcacaaactccgacctccacactctcttttgcaccttgggcaaaatcgcccgcgtaacagtactcaaagaccgagccacatggaattcaaagggggtcgccttcgcccagtttgtttcccgcgatgacgcgctatccgcggcgagtgttatgcacgggaatatactcatcggcagaaccctta

SEQ ID NO: 24197 - DNA, 431 bp, Gossypium hirsutum
  Clone ID: LIB3272-035-P1-K1-A3
cttaaccatttcccaaatctcctccctcctcttctttagcgtccttttcatttccgctcatgcagcgcgctttgaaatccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccggtgattgtggtggactccttcaatgcaaaggttggggtgtacctccaaacaccctggctgaatatgcacttaaccaatttggaaacatggatttctacgacatttccttagttgatgggtttaacatccccatggtgtttgtgccaactaatggcggttgtcacaacattcggtgcactg

SEQ ID NO: 24198 - DNA, 190 bp, Gossypium hirsutum
  Clone ID: LIB3272-035-P1-K1-A4
ggaaatgggcaaaccatacgttttggtaatcccttatccaacacatggccattagcataagggtggagaatcaagcgcaaggaagaatatggctgtgacctttgcatacagatgctacaaggtggtccattcactgatgggtcctcttggcaacatctgctatgatttattacgtttggttgctagaaac

SEQ ID NO: 24199 - DNA, 84 bp, Gossypium hirsutum
  Clone ID: LIB3272-035-P1-K1-A5
gtagcagtctttaatgtttaaacgcgctagtaattggtgataacggatttgctttggcgattgtatcttttcgatttagggaat

SEQ ID NO: 24200 - DNA, 428 bp, Gossypium hirsutum
  Clone ID: LIB3272-035-P1-K1-A6
cacccaccctttcaggggctccttggttgtcaggtgttctcttgctgatggaaacggtagttcagtgaagacgactactttgcatgatctgtatgaaaaagaagggcagagtccatggtttgacaacctttgcaggccagtgaccgttttgctgccactgattgcaagtggggttagaggtgtaactagcaacccagcgattttccagaaagctatattttcatcaaatgcttacaatgatcaattcagggaacttgtgcaatcaggaaaagatatcgaaagtgcttattgggagttagtggtgaaggacatccaagatgcctgcaaactttttgagccattctatgaccaaacagatggaggtgatggttatgtttctgttgaggtttctcccaaacttgctgatgatactaatgggaccattgagg

SEQ ID NO: 24201 - DNA, 318 bp, Gossypium hirsutum
  Clone ID: LIB3272-035-P1-K1-A7
tatgaatcgacgtttctctttcatttgcaacttgtttgtttactaaggggcaaaaaaaaaaaaaaaaacagcctgcaaataccactgccgcctttggtttatagcttctaaatccaactagagaactaggttgtcttcatttcctcagctaattcactacaagtaaaatcacatggattggtatctctgtaatggtatggaggatcttgttgtccccagaaatcaagaattagaagataatatcccttccccagaaagttggtcaaaatgggaattcagccctcctgaaaatgttaacggtgaatgctttggcgtgga

SEQ ID NO: 24202 - DNA, 393 bp, Gossypium hirsutum
  Clone ID: LIB3272-035-P1-K1-A8
cctttgtctcttaacttatctctcccacgtctgccctgcttttcagcagcttttgacagcttccaagttactgaagatgaccaaagcagtggagaagaatacccagaaacagaatctcaagaccttgaagaacaaccacaacaagaggaagctgaagaagataaggtttcagagtctggcggtgaagaaggaaagttgtatgttgggaatttgccttattcaatgacttcttctgagttaactgagatttttagtgaggctggtagtgttgctaaagtggagattgtttatgatcgagttacggataggagcaggggatttggctttgtaacaatggggagcgttgatgaggccaaagaagcaattagactgtttgatggatctcaagtcgga

SEQ ID NO: 24203 - DNA, 433 bp, Gossypium hirsutum
  Clone ID: LIB3272-035-P1-K1-A9
aaaaaagattcgatgggtgcgtctttatccaacttaacggaaggaagcaatgggacggcgatgggaccgggattaggggacataccggagagctgtgtggcctgcgttttcacttacttgacgcctccggagatttgcaacctggcgaggttgaatcgagcgtttagaggggctgcgtcttcggattctgtttgggaaatgaaattacccagtaattatcaagatctgctggatttagtgccacccgaaaggtaccagaatttgtccaaaaaagatatttttgcccttctctctcgcccggtaccttttgatgatggaaataaggaagtatggctggacagagtgaccgggagggtatgcatggcaatatctgccaaagggatggcaataactggaattgatgatcggagatattggaattgtgtttctacag

SEQ ID NO: 24204 - DNA, 436 bp, Gossypium hirsutum
  Clone ID: LIB3272-035-P1-K1-B1
gtcacttgaaggctgaagctatggagggtaaaaatgcgaatctggaagcggcgatcgaccagttgcttaatgttgagaagcagatgcggtttgccggcgatgtgattggcaccaagaaagcggtctctgacattttgcagctctgctttgaagctaaggattggaagtctctcaatgaacagatcgttaatttgtctaagaaacgtggtcaacttaagcaggcagtgactgcaatggttcagcaagcaatgcaatacattgatgaggcaccagatcttgaaactcgtatagagcttatcaagaccctgaacactgtgtctgctggaaagatttatgttgaaattgagagagcaagattgatcagaagacttgcaaagattaaagaagaacagggccttattgctgaagctgcagatttaatgcaggaagttgcagt

SEQ ID NO: 24205 - DNA, 337 bp, Gossypium hirsutum
  Clone ID: LIB3272-035-P1-K1-B10
cagtcgtggaaaccccaccgttgaagttgatgtttctctctctgatggcaccgtcgcaagagcggctgttcctagtggtgcttccactggtatatatgaagctctggaattgagggatggaggatctgactatcttggaaagggcgtgcttaaggctgtggagaatgttaacacaattattggacccgctttggttggcaaggacccaacagagcaggccaaaattgataatttcatggtacaacagcttgatggaaaagttaatgaatggggttggtgcaaacaaaagctggaagcaaatgctatattggctgtttaacttgctgtctgtaaagca

SEQ ID NO: 24206 - DNA, 364 bp, Gossypium hirsutum
  Clone ID: LIB3272-035-P1-K1-B11
aaattattaatgctcattcgttggtaagggacctgaagggtaacctcgggttcttgcctttttcttcttgggttatggtcaaggtggtattttatgccggctacttgaatttgtgggctcctgactttacctttcagcatatgcaataatgcttgaacaggataaacttcccaatggtttggctctcctttaatgtatctctctggggtcattgctatctgggatggcagtttcagaaattccatgggggacaaaactttttgtagaagaagagccttcctgggtttcttataagggagattgcgcaattggattatatcactcccgtgcacacacaacacagtagagtggggacattcgttaa

SEQ ID NO: 24207 - DNA, 433 bp, Gossypium hirsutum
  Clone ID: LIB3272-035-P1-K1-B12
gtgaaggtgtatggcccagcctttgcttctccaaagcgagtgattgcatgtcttattgaaaaggagattgaattcgagactgtccctggtgatttgcttaaaggagagcacaaagaccctgaatttcttaagctccagccttttggaacagttcctgtcactcaagatggagattatgttttatatgaatcccgtgcaatcataaggtactatgcagaaaaatacaaatcacaagggactgatctactgggaaagacagtagaggaaaggggtcaaggggaaaattggcttgaagttggggcacacaatttcaacccatcaatttaccccttggccctacattgtatggttggtttcaaggagggggtcccttccgatgaaaatttgatcaaggaaagcgaggaaaagctaggcaaagtgcttgatatttatg

SEQ ID NO: 24208 - DNA, 324 bp, Gossypium hirsutum
  Clone ID: LIB3272-035-P1-K1-B2
gtcaacgggctagaaaacccgtaaggcgcaaggaagctgattggcgggatccctcgcgggtgcaccttcaaccgaacttgatctttcgagaaggcttcgatttaaatcataccaacaaagacgcctatgacattgtacaacttttgttttaagctaatgattgtaattttctcaatgaacagatcgtttattgttttaataaacgtggacaatttaaacaggtaattatctaattggttcatcaagcaatgtaatacatttatgtgtcactatatttttaaacttttatagatcttatgaagaacctgaacactgtgttctttt

SEQ ID NO: 24209 - DNA, 333 bp, Gossypium hirsutum
  Clone ID: LIB3272-035-P1-K1-B4
attttatcactgccgctttgccagcagccgcgccacactcgagagagagctcgtcaaccatggccgaacagactgagaaagcctttttgaagcaaccaaaagtgtttttaagctcaaagaaatcttcaaaagggaagagacctggaaagggagggaaccgcttctggaagagcattggtttgggcttcaagactcctcgtgaagctattgaaggaacctacattgacaagaaatgcccgtttgccggcactgtttcgatcaggggtcgtatcttagctggtacttgccatagtgctaagatgattaggacaatcattgttcgacggaattacc

SEQ ID NO: 24210 - DNA, 206 bp, Gossypium hirsutum
  unsure (1)..(206): unsure at all n locations
  Clone ID: LIB3272-035-P1-K1-B5
gtcaaaggttatgtcaaaagtcatgagtccacaaatcacggaaatggcgagcaagttccccaatgggcactattgattttgggggcattttccntattaccccacccctttgtatttgctttaaacccaccctggactaactaccttatcaaaacacctgtttaatcaaagggatcatgatccgatttggcctttatattaccccc

SEQ ID NO: 24211 - DNA, 147 bp, Gossypium hirsutum
  Clone ID: LIB3272-035-P1-K1-B6
agaagctacagcacaacgaagaaggcaaatagacttgagaaagaaaaacagtctcaaaatgcagcagaagtcaggcttcctcatcctcttcctctccctcattttccttcctctcatcttctccgacgcccggaagggagctcccct

SEQ ID NO: 24212 - DNA, 158 bp, Gossypium hirsutum
  Clone ID: LIB3272-035-P1-K1-B8
tgtggattttgttttgactttaacgttaatggattatgatatattttagcccctagctgcttaattggagatgcatgtttagaaccacagtggagcttgtgatgtggggggattaacaaggtagcggccttgttttgatgtgaaagctctggggaaac

SEQ ID NO: 24213 - DNA, 427 bp, Gossypium hirsutum
  Clone ID: LIB3272-035-P1-K1-B9
aactaaaaaatttaataaaaatggcaggaaaaaatatatattgagagtttatatatggttttgctaagccagactatcatctcattctcatctgcattttgggtgttcttttttcctctctccttccaagttttaagagaagaaaaccagtaaggagttgctggctttcttgctaaaaggttgtggttttatagataatgcagtgtgagaaaacatacttcataggcaagttcaatggatggtagtgtgatggctgatcctgatccagactcgtctacattgggtttaaggcatattagcagctcactattcaatattcctggtttccttgttgggtttagcactaagggatcttcggattctgatgctgtacgaagccctacatcttcttttgatttgagagggtttgcgaattttagcaacccct

SEQ ID NO: 24214 - DNA, 436 bp, Gossypium hirsutum
  unsure (1)..(436): unsure at all n locations
  Clone ID: LIB3272-035-P1-K1-C1
aaaaaatcagaaaaacactccctttttccccatttataaatctctgttagggtttggaaacccctccccttttgcgccttcagcccgtcgatcgataggaagaaagtctctcctctcctccttttgggtctgatttcagcaatagagagagtctccagcgacacaatcacaaggattccgggttcgtcttgcaggtgtcagacgagtggaggccggcgatggcgtgcggggaaggctctgcgcgaagtgaccagtggttggcctagtgtgcggctgctggaggcttgagggctagggtttgctgctgaaaaattttaagcaagtgggctattaaggtttaggttattgagtttattttgggttttaaattntgggctggtgtgggttttgtaaatggacatttattttggactattttatttttatttgggtttta

SEQ ID NO: 24215 - DNA, 358 bp, Gossypium hirsutum
  Clone ID: LIB3272-035-P1-K1-C10
atttggtttttgtttaatagcttaactgactctctgaaatatcgcggatctttggtgttctacacgcatttttgtttctaactatagcctgattttactcggaagatgatgctggaggaagagttctttcattgcgacaactacgacgaagaggaggaacccaaaacgatgtcgcaatgttccatcggagctttacaacaacaacagcagcaaaagtttgtcgtagtcggttatgcccttacctctaagaaattcaagagctttttacaaccaaagtttgaaggtttatccaggagtaaggggatattattttttccaaatagatcaaaatagaccttttctaataccatggttcctt

SEQ ID NO: 24216 - DNA, 385 bp, Gossypium hirsutum
  Clone ID: LIB3272-035-P1-K1-C11
gtttctccattaaagaagtttagaaaaagatgccaaggccaggtcctaaaccttacgggtgtgttaaaagaactgggcttacctaaccacttcaactcataagaggttccatggttcaacaaattttaaggctagcttttcaaacccatagctcagctactaaaaagaacagggattggcaagataaaatacttattgccattgttaaggccaaggagtcattcaattccacagccatgcttgacaagctcaaggctaaccctgagccttttttcaccattgatattgcctcgtgggaatcggataccaccaaatactactgccctgaaacaggggagcttttgcccccttttttttaaaatacacttaatctggggcgctcccc

SEQ ID NO: 24217 - DNA, 284 bp, Gossypium hirsutum
  Clone ID: LIB3272-035-P1-K1-C12
ctcactttcctttcccatcttaaacatgctccctcctctgtaaatcctattagacgggaatttcccctttcataaatctttgggttttcatggaggaaatcaattgggatacccttctgctcgaggttgacttacccgatttcgggaatatcttagataatgaaaccggtacggaacctcctccttaaccttgttcaacccagaatcccgatgaagaaccggcggtgtcttcgtggatcggggcgatcgagaaggttttgatggaggatgatatttttgttcct

SEQ ID NO: 24218 - DNA, 437 bp, Gossypium hirsutum
  Clone ID: LIB3272-035-P1-K1-C2
tttcaaaattccagaggtttttagtaaccaaatatgattggccttgggagttacggttacactgcaccatcttccaaaaaaatcaacgcctacgatgttcctcaaggcgttgatattcgtggtcgattcgatgaagaattcgctaagattttaacaaaggatgccttacaattcgtcgctgatttgcagagagagttcaggaaccatattaagtatgcgatggaatgtcgcaaagaggcgaaaagacgatacaatgaaggggcgttgcctggtttcgatcctgcaacgaggtatattagagaagggaaatggacttgtgtgccgtttccgcctgcggtggctgatcggagggtcgaaattacagggccggtggagaggaagatgatcatcaacgctcttaactcgggagctaaagtgtttatggctgattttgagga

SEQ ID NO: 24219 - DNA, 439 bp, Gossypium hirsutum
  Clone ID: LIB3272-035-P1-K1-C3
ggttttcttccgccgttcttaatcacagaaagctttgaagaacaagcgtttggaggtgcaaaacatggggccgaagaaaggtggaaaggtggctgtgcccgccaagaagaaacaagagaaggttgtcaatccgttgtttgagaagcgtccaaagcagttcggcattggaggggctttacctcctaagaaggatttgcatcgatttgtgaagtggcctaaggttgttcgtattcaaaggaagaagaggatcctcaagcagaggttgaaggttccaccagcattgaaccagttcaccaagactcttgacaagaacctcgcaacaagtctgttcaagttgctcctcaagtacaggccagaggacaaagtggccaagaaggaacgtctcttgaaaaaagcccaggccgaggctgaaggaaaagcccccgagtctaagaaacca

SEQ ID NO: 24220 - DNA, 417 bp, Gossypium hirsutum
  Clone ID: LIB3272-035-P1-K1-C4
cgtcactagcggcgctgtcacaaaatgtcgtcaacggagtctctcatcctccaactccatgagatctccgccgtttatattcggtaacttcaagctgaaatctgggatcttctcccctatttacataaaccctccttttaatgtcttttacccttcccttcttccgccaaatttccaactccttcttttcctttttccttcccaaaccacccttaaacctaatatgtggtggtcctttacactgccctccttatagccacctccatctctctcgacacctccatccccatgctcatgcgccgcaaagaagtaaaagactacggaactgccaagtccatcgaaggtgtttacgaaaagggtcaagtttgtttggtggtggaagacctcgtaacgtccggtgcatcggttctcgaaacg

SEQ ID NO: 24221 - DNA, 54 bp, Gossypium hirsutum
  Clone ID: LIB3272-035-P1-K1-C5
ctaacttcagcccttctttgggcaggaaccaaccagaagccccccgcgctgggt

SEQ ID NO: 24222 - DNA, 425 bp, Gossypium hirsutum
  unsure (1)..(425): unsure at all n locations
  Clone ID: LIB3272-035-P1-K1-C6
attttcttgttccttccttcgccgtctattgcttttagttgcctcgatttcaagtgaatcagaatggggtaaggaaagactcacattaacattgggggccatcgggcacgtcgattctgggaaatcaaccaccactggccacctgatttaccagcttggtggtattggccaggcgtgtgttggaagggtccgagaaagaacctgctgagatgaccaggaggtcatccaagtatgctggggtgctggacaagctcaaggctgagcgtgagcgtggtatcaccattgatattgccttgtggaaatttgagaccaccaaatactactgcactgtgattgatgcacctggacaccgtgactntatcaagaatatgattactggtacgtcacaggctgactgtgctgttttgattattgattccaccact

SEQ ID NO: 24223 - DNA, 316 bp, Gossypium hirsutum
  Clone ID: LIB3272-035-P1-K1-C7
gagaaaaaagttgcccattcgatccctttctactaccaagttggtggtgagaagctggaggtactactattcttcttccactgcatcggctgcggctggagaagctgagagaactatccgggaagggcctaagaacgtttggactggccaacagatcgactccatctaccattctccccttattgatcttcttttgcatggagctgaagttcacagatatgcttataactttagaggggggcagcagagtactcttctcttaatcaagactggtggatgtagcgaggattggttctattggccttaaatctttaag

SEQ ID NO: 24224 - DNA, 436 bp, Gossypium hirsutum
  Clone ID: LIB3272-035-P1-K1-C8
ttccctcccaaatgtcttcttcgacattaaccgtactcttcgtcctccttggaactctctgttcctttatctacttcttcagctcaccaaaccgcaacaacaatggccggaaacttccacccggtcctgcccctcttcccgtcgtaggtaacatccacatgctaggcaacctcccacaccaaagtcttcactatctcgccaaaaaatatggacccatcatgtcgataatgctaggcaaagtaccaaccatcgtggtatcatcacccgaagccgctgaactgttcctcaaggtccatgacgtcgtttttgcttccaggcctaaagtccaatccgcgaaatacttcgcatatggtggcaaggccatggcttttacccagtacggttcttactggcgaactgtacggaaatggagtattttgcatttcctcagtgcttc

SEQ ID NO: 24225 - DNA, 287 bp, Gossypium hirsutum
  Clone ID: LIB3272-035-P1-K1-C9
caaagattgggttttcagctttggtagatgggtttttgtttttgggtttgattgggggatagctcgctttttgtaagtctacaagctacagctgcagctgaaggggatgcaattgctgacggtactgtttatattgatgggaaagctcccattggcaccatacatgatcatttccctggcactactgttgattgttggccttctaacaaatctaacattggcacatgcttttggagacaagctatacttctcaatttaactcctaacaattatatattctcaaatgc

SEQ ID NO: 24226 - DNA, 260 bp, Gossypium hirsutum
  Clone ID: LIB3272-035-P1-K1-D1
gtactcagaagacctgagatccaatatctaaataccttcatttctttgttgttgtgattatgctgaaagatgatctaccatatgcatcaacatctccctttgatcgtggcgtataatctactttcaaccaaatgataatttggtgtactcttgcaagtaatatattttgctaacactttgtatgtatgcaatagcttttgcatttgatattgacaccgttcgagtttggtaactttagtgaaatctctactgcctatctg

SEQ ID NO: 24227 - DNA, 428 bp, Gossypium hirsutum
  unsure (1)..(428): unsure at all n locations
  Clone ID: LIB3272-035-P1-K1-D10
aaaaaaatggcggaaagagcaccgatcgaatccgtacaatgcttcggccgcaagaagacggcggtggcggttacccactgcaggcaaggccgtggccttatcaagattaacggttgtcctatcgagcttgttgagcccgaaatcctccgtttaagggccgtcgagccattttttctcctcggccgccagcgttttgccggcgtcgacatgaggatccgtgttaaaggcggaggccacacttctcagatctacgccatccgtcaaagcattgctaaggccctcgtcgctttctaccagaagtacgtcgatgagcaaagcaagaaggagattaaggatatcttagtcgggtacgataggactttgctggtggctgatccgaggcggtgcgagcccaanaaattcggtggaagaggtgctagggcaaggtt

SEQ ID NO: 24228 - DNA, 423 bp, Gossypium hirsutum
  Clone ID: LIB3272-035-P1-K1-D11
atttaaactacctgcttctagctctccttccaatcaatctccatttttagggatggcaaagtgaaaggatgttaggcatttccaagaaagaattaatgaatccaccaagggggctgcatagcccaacttcactcacttcatcaaacaagaccaagcttcccaatcaaatcatcaaccatttcctttcttcaaatcccaacaatgctttctcaatggggttcggatcctcagcttgctttgcttatgctcccacagagaatcgtttccccaatcatcaaaggttgttctgtggagtggatgaaatatactgcatattcttgggggatttgaataatttgagcagcctgctaaagcagcatgggctgtcaaagggcaccaatgaagccatgtttatcatcgaagcatatcggaccctccgcgacc

SEQ ID NO: 24229 - DNA, 432 bp, Gossypium hirsutum
  Clone ID: LIB3272-035-P1-K1-D12
agaaaacccttttctaagggcatctctctctctctctctctctcttttactggtaggccactcacatggctctatcactatttcaaaactccatagctgaataataataaaacggcttggaagaaaagccatgggaagacctccttgctgtgataaagttggtatcaagaaaggtccatggacccctgaggaagatatcatacttgtctcttacatccaacaacatggtccagggaattggagatcagtacccactaatactgggttattgagatgcagcaaaagttgcaggcttcgatggactaattatctgagaacaggcatcaagcgagggaacttcactcctcatgaagaaggcatgataattcacttgcaagctttattgggtaacaaatgggcagcaattgcttcatacctaccacaaaggacaga

SEQ ID NO: 24230 - DNA, 336 bp, Gossypium hirsutum
  Clone ID: LIB3272-035-P1-K1-D2
aagctcttctcccatcggccgctcagagaagacagagaggtctctacaaccaccggaatgggtcgtgtcattcgagctcaactaagggtgccggtcggtcttaaggcccataccaaccaccggagggtcccgccgttccgcagcctcacttcgtgacggaacggttacctaaaggtgtcgcaccgacgtattcacgaccctggccgggcgctccttagcccgctcgttttcccacccttcgttcaagaaacaaggaattgttcgtcgccccagggtgtgtcccggtcagtcgtgtattgtggtagaaagctacccttatgttgaaatgtgtttcct

SEQ ID NO: 24231 - DNA, 463 bp, Gossypium hirsutum
  unsure (1)..(463): unsure at all n locations
  Clone ID: LIB3272-035-P1-K1-D3
gcgacgcgcacgcgnntccgcgccgtcacaataatgggtcgtcaaccgganngtctctcanntcctccaactgnnncatgaaatctctgcgcgtgtgagaattcggtgaactttcatagcctcgaaatnnctgggatccttnnctcccnnctatctacccatagaccctnnccgtctcatcnnngtctcttaccccnnttccctcncnntccaccaananntctcccactttcccttcctcttcctcttcttccctttccccaaacacccactttannacctcatatgcccggtgtnncccttacccactgccnnnctccctnagtagccanncctccatctcttcttcgacccacctccanntccccatgccctcatgcccgccgcaannagaagtgaaagggactacccggaaccctgccaagnnntccatcgaaggggtgtttacccgaaaagggggtca

SEQ ID NO: 24232 - DNA, 177 bp, Gossypium hirsutum
  Clone ID: LIB3272-035-P1-K1-D4
gttctccgttgggattgcgtcggctaacttccctattgacaacttttatgaatctcgtcagggtgggtgccgattcaactgcaatggcttgaatgctttaacgtcttctatttaaggtaggtgtgatataactaatagatgatttattattggtactcgtttaagcacctgttcggg

SEQ ID NO: 24233 - DNA, 431 bp, Gossypium hirsutum
  unsure (1)..(431): unsure at all n locations
  Clone ID: LIB3272-035-P1-K1-D5
gtggaggtcgttgtaagggattgtaagagcggaggcttctttgcttgccacctctcggttatgtcttcaaacacttctaaaatcatggatgagaagatgaagttgactgttgctgatgcaggggactccaggggtaaccctgttgccaggtctagaccggggggctgggtaccggctgttctaagctaaggcttggaattaggggaggggttgcaaccatggggaatggcagggaacctggggactaacctggggggaacaatccactttccaggtgctacttctgcaaatgtggggaaggacttcatggggacatcatttctactatgtttactgggcggcttcctagccgattcatacttgggcagatacctaacgatcgcaatattcgccatggttcagatgcttggaactngcctgttagcagtatc

SEQ ID NO: 24234 - DNA, 430 bp, Gossypium hirsutum
  Clone ID: LIB3272-035-P1-K1-D7
cacagctgaaacagacgaacatcaagatgggcacccaaaaacaccacgttcttttgtgatcagtgctttggattatgaattcccttctctatttcggtgccgatgaagatcactattaccaatttattttgcaagaagcatatattacgaagctatgcagcacaaaaaccatattgacagtgaacggtagttgtccagggcctgcgatgcgggttcgaagaggcgatactgagtatgtcaatgtccacaatcaaggaagatctgctgtttcctttgatcggcacgggactgaggatccggtggacgggtcaaactagacgatccagcctggaaactacttcactgacgagagcgaattatacgatgaactctgatcttcacggtggcatgctgggagtgctaccactaaatctaccgtgcatggcgcctt

SEQ ID NO: 24235 - DNA, 401 bp, Gossypium hirsutum
  Clone ID: LIB3272-035-P1-K1-D8
gactgtgttgatcgaagttctattctggttaggagagcttatcagctcaactgtcggttgaactagccttaaatatggatcgcgcttaaccgctcgacctatactccgggttgtcatgcaagggccagcccccgataagcatgagggcgcgaaattcggatgacaacccgattggcgagcacagtctgcgccacagccggtgctcatattaggggaagctggggaacaataaaaccattctcaattggcctcataggggggaggaacattgtgacaggacgtgcccatgatggagcctcaattaacacacctgtttcatttgtaccagacttggttagctggacgtgggataacgacttgatctactgagtcggaccccttatcggtggtggtctcggtga

SEQ ID NO: 24236 - DNA, 421 bp, Gossypium hirsutum
  Clone ID: LIB3272-035-P1-K1-D9
ctgcaactgtcaaagttgctgctaaccttatcaggctactatcctacaataacaagagcatgcttcaaactggtcttattgttggagggtgggataagtatgaaggtggtaaaatatatggaattccacttggtggaacactgattgagcagccttttgctattggaggatctggctccagttacctatatgggttttttgatcaggcgtggaaggaaggaatgacaaaggaggaagctgagcaactagtggtcaaggcagtgtcgctcgccattgctcgtgatggtgctagtggaggtgttgttcgcactgttgttatcaactccgacggagtgacaaggaacttctaccctggtgataaacttcaattgtggcacgacgaattggagccgcatcattcgttattggatatactgaacgc

SEQ ID NO: 24237 - DNA, 430 bp, Gossypium hirsutum
  Clone ID: LIB3272-035-P1-K1-E10
caacaagtcaactattttaccaacttgtccttgccgtcgagctgccactctcctagaaatggacagtaaaaatggcaatgaatgtccgaaaaacattactgaagcttcacaaattagacatgggttgactttattggatgctgatttctttaacgatataaaggttcttgagattgcaaagggtgcaaaagagttcaatattcctataataagaaccaacaggaagttagttgcttctattaatggagggctgcataacccttctcctctggtttttaaccccgagtggagcagggagcaatcacagggcagggccagcaggttaaatcatccttaagcttccggcattcaaaggccaattaatgaagaagatatagcctttatgagtgttctcgaactaggagaactcataaagaaaaaacagattact

SEQ ID NO: 24238 - DNA, 271 bp, Gossypium hirsutum
  Clone ID: LIB3272-035-P1-K1-E11
ctttgagaggcttcactccacagagctgtttgctctatccccttccaacgatggaccggttgtatcttctcttcctcctcctttcctccgacgatgcttcggccgccgactccgacgttaatagcgacggcgatcctctcatccatcaagtagctaccgatggtggcgtcaaggaggactccgatgaccatatccttaacgcggagcaccactaaacgctgttaaaatccaagtttggaaaaacgtacgcatccaaggaggagcacgttta

SEQ ID NO: 24239 - DNA, 343 bp, Gossypium hirsutum
  Clone ID: LIB3272-035-P1-K1-E12
gatctccgtttgcattctctctcagctttccggtcgaagaatcattcaatttaaggggaaaaagaagaaaaaaaaaaaccaaacatgtcgaaatcggtgattgaaacgcctccgaagggtgggtttagcttcgatctttgtaaaagaaacgagatgctttcaaagaaaggtgttaatccgccgtcatttcgtaaaacgggtaccactattgttggcttgatcttccaggatggtgtaattcttggagcagacactagagcaactgaaggacctatagtttgcgataagaattgtgagaaaattcattacatggccccaaacatttacttgtgtggagctggaa

SEQ ID NO: 24240 - DNA, 425 bp, Gossypium hirsutum
  Clone ID: LIB3272-035-P1-K1-E2
ccgatgtcaacgttattcgtcctaaagaatattgggactacgagctcctcactgttcaatggggcgaacaagatgattacgaggtggtgaggaaagtcggacgagggaaatacagtgaggttttcgagggggttcatattacggataacgagaaatgtgttatcaagattctcaaaccggtcaagaagaagaagattaagagggagattaaaatactgcagaatctttgtggagggccgaatattgtgaagttgctggatatagttagggatcagcagtcgaagactccaagtcttatatttgaatatgtgaataatacggattttaaagtgctttatccgacgctgtctgattatgatattcgatattatatctatgaacttcttaaggcactggactattgccacttacaaggtattatgcac

SEQ ID NO: 24241 - DNA, 268 bp, Gossypium hirsutum
  Clone ID: LIB3272-035-P1-K1-E3
cttttaactctaaagccaagaaagcaagccattaaggttttgagaaaagatcaaaatggattcaaaaagatcagcttccatagccctccttttggcactcaacattctcttcttctccctagtcagtgctaattgtggatcttgttcttcttctggctctaacccaaggccaactcccacccctactccatcagcacgaggtaggtgccctagggatgccctcaaattaggtgtatgtgccaatgtgcttaacttagtcaatgtcacc

SEQ ID NO: 24242 - DNA, 437 bp, Gossypium hirsutum
  Clone ID: LIB3272-035-P1-K1-E4
acgctctctctcgctctctgtagccgccgcctgcgtctctctcttcatctctctgaaccaagaaggctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgaaggttgttgacattgttgacactttcaggcttcaggagcaaccccctttcgacaagaagcagtttgtcgtgttcatcaagaagttcatcaagaacttgacaccaaaactggatgcggaaaagcaagagtccttcaagaaaaacattga

SEQ ID NO: 24243 - DNA, 526 bp, Gossypium hirsutum
  unsure (1)..(526): unsure at all n locations
  Clone ID: LIB3272-035-P1-K1-E5
ccgtccgcatacatttcttcttcttttccctaagtcagtggcgttggtggnnctcttgggctcttcacnnccacccgtgaaacggcaaggccataactccaataaccntctaacatcccccacctccttacctggctatccgcaccgagtgcnnaggtgcccnnntagagatgccnnnctcaaattagnnngtgtatggctgccaatggtgctnnntaacttnnagtcaatggtcaccnnngttggttcacncnntccagtgnnntgccatgctgtnntcccttctcaaatgggcctnntgtcgacctcnngaagctgctgggcttgcnnctttgtacctggctnnntcagagctannacatcttnnaggcatcanacnncttaaccatcnnccagtttctttcttaagctttgggctcctcaaaacgtttggttcaaagggaatggggttccaactgggcnnttccaatgggctaattannagtcatcanncttttccctccaattctttcttcaaaacttcctt

SEQ ID NO: 24244 - DNA, 170 bp, Gossypium hirsutum
  Clone ID: LIB3272-035-P1-K1-E6
cctttgtctcttaacttatctctcccacgtctgccctgcttttcagcagcttttgacagcttccaagttactgaagatgaccaaagcagtggagaagaatacccagaaacagaatctcaagaccttgaagaacaaccacaacaagagggagctggagaagataagggttc

SEQ ID NO: 24245 - DNA, 284 bp, Gossypium hirsutum
  Clone ID: LIB3272-035-P1-K1-E7
cggacgcgtgggtttttttttttttttttttttggggtcaacatgaatgagtgtcggcatacgaaattattgtaaaaaaaaacccataaaaagtcgaggaaggggtggccccagataaaaccatcctctctataattttctggaaccaaaaaatacatttgtttatgccttttttcatgcgccacgcgctcaactttgaaatctccagggcttacttcattttggaaaacacacccgggggctctgatttttaaagcgccaggggggaatacactttcgctgac

SEQ ID NO: 24246 - DNA, 433 bp, Gossypium hirsutum
  Clone ID: LIB3272-035-P1-K1-E8
aactttttagtgcaaaacgccttgagtcatacgagtatatccgaagagaagaaatgagagttgtgctaaaagggttggacgaatcattccgtgtcccaatttgtttgaaagatcgtctttcagatttgagtcttaatgtaataagtaggatggtgttcgggaaaaagtatacagaggggactggtgaaaatgagattgtgaccccgaaggagttcaaggagatgcttgatgagttattcctacttaacggagtattggatattggggactcgattccctcgctaagggtcttggatttgcaaggcaatattaagagaatgaaggccttgagcaagaagttcgacaaattcttggagcacgttttggatgaacataacgctaggcgaagagatgttaaagattattgctgccaaggatatggtggatgtacttt

SEQ ID NO: 24247 - DNA, 421 bp, Gossypium hirsutum
  Clone ID: LIB3272-035-P1-K1-E9
gaatatttgccggttactcttcatcacgtctatataagatggtcaagggccccgagggggagaaaattaccttggaaacctgctttattgttcccggtattttattccgcattttttttggacctgatgcccctatttggggaggaccatttttccgtggctgttccgttcggacacaaggttggccctggttggcttatggttcggtatatcagttcccttagtctttgtcggcagtcacttaggttaaaaaacgccacccattgaacaccctgtgaagaccaataaaatcccgaggcagatcttgaaacaggcatggtatatgaagcccgttttctccatactcatgggaggcattcttccattgggagctgtttatattgagctattctacatctaaacatcaatatggctaacccag

SEQ ID NO: 24248 - DNA, 377 bp, Gossypium hirsutum
  Clone ID: LIB3272-035-P1-K1-F1
ctcaacattcccatttccaatctccagctcccaaggtaaatatgccgatcagaaacatagcagttggccggcccgaagaggcgactcaccccgatgctctcaaggcagctttggctgagttcatctcaaccttgatcttcgttttcgctggatcgggctcaggaatggcttttaacaagttgaccggcaacggagcaacaacccccggccggtctcgtagccgccgctctagctcatggcttcggtcttttcgtcgctgtctccgttggcgccaacatctcaggtggccacgtcaaccccgccgtcaccttcggtgctttcgttggcgggaacatcactctcttgcgcggcattctttactggatcgcccaactcct

SEQ ID NO: 24249 - DNA, 331 bp, Gossypium hirsutum
  Clone ID: LIB3272-035-P1-K1-F11
ctgagttacaaaggtttcagctctgaattggttccagagaagagaacaagaaaagaaactaagaaatggcacgcaagaagatcagagagtacgattccaagagattgttgaagcagcacttcaaaaggttttccgcctacgatttgcccatcaaatctgcacaagtgacggagtcaactgatttcaatgagctagtagagaaggagccatggcttttgtcgcagaaactggttgtcaagcctgatatgttgtttggaaagcgtgggaagagtggtttggttggtttgaatcttgatttcgctcaagttactgcatttgtgaaagagcgcct

SEQ ID NO: 24250 - DNA, 306 bp, Gossypium hirsutum
  Clone ID: LIB3272-035-P1-K1-F12
agacattcttcgtcgcctcctattctttctcttttgaaaaccctaacgaccctgcttgctccaccggattcgtcaccgtcttcaccgagatcggtcaattgaacgtcgtaccaccaagacccaagccctccgatgtcttgagctctctccgtgagcgcagtaaggacatccttagcgtggtcgtcgctcttctcttcggcgtcggtagcggcgctctcacggcggctaccctctacttggtctggaccctcttctcggcccggtctgattatcatcgtgcttgtttggagatgatgagagcgacgg

SEQ ID NO: 24251 - DNA, 435 bp, Gossypium hirsutum
  Clone ID: LIB3272-035-P1-K1-F2
ctcaggtcaaggctgaagccactcgtggctcaacttttattacccaagcccaagggaaggtcttctccaacggcttttatctctactgggctcaaaccgccggatctcaacacggagccgcggaacgcgtacaccacatattggctctgtgtaaacccccgaccgcgggtcttttgtgcctctccatacgcacagcgtccgccatatcaccggacacgcctgtcgctgtatatttcttctcgcggtgtcacacgatcacctgctcatgaggagagaccggggttctttacacatgtccgaggtgcacatagcgctcacaatcccggatcactataacgcgttgttaagggaaaagatcggacacgcgtcggtccgcccggatttgttgctgcgagggttgaagatgaagggagacgaggcggataagagaggggt

SEQ ID NO: 24252 - DNA, 432 bp, Gossypium hirsutum
  Clone ID: LIB3272-035-P1-K1-F3
tagatgtttgccccttttcaatctgccgttcactcaccaccaatccaccattgaaatgggtagatggtagctcacaatgaaatcattctatttccctattctaaaccttgccttaataggtcagattttagccttgaaaacctatttcaagcttcgatttcaacgaagaagatacggcttccgatggcttctttgaagggaccaaacgggcccaccggggtgatggcgaccgtggaaccggcaaaggaggcccccgtgggcctgccccgaaggtaccaccggtcctggaggctgttaaaagttgctgcggcccaaaggatgatgctggggtcttttagaaattttacatttggggccaatttgtgttaagcgttatttgggctttggtttagttgttgagttgttataaaatggactgtgaacacttattat

SEQ ID NO: 24253 - DNA, 386 bp, Gossypium hirsutum
  Clone ID: LIB3272-035-P1-K1-F5
ctggtacgtcacaggctgactgtgctgttttgattattgattccaccactggtggttttgaggctggtatctccaaggatggtcagactcgtgagcacgcattgcttgcttttacccttggtgtcaagcaaatgatttgctgttgcaacaagatggatgccactacccctaaatactcgaaggctaggtatgatgaaattgtgaaggaagtctcttcctacttgaagaaggtgggatacaaccctgacaagattccatttgttcccatttctggttttgagggtgacaacatgattgagaggtctaccaacttggactggtacaagggccctcctcttcttgaggctcttgaccagatcaatgagcccaagaggccttcagacaag

SEQ ID NO: 24254 - DNA, 343 bp, Gossypium hirsutum
  Clone ID: LIB3272-035-P1-K1-F6
ctcttgtgacctcgatttcaagtgaaacagaatgggtaaggaaaagactcacattaacattgtggtcattggccatgtcgattcccgaaaatcgacccccattgcccacctgatctacaagctgggtggtattgacaagcgtgtgattgaaaggtttgagaaagaagctgctgagatgaacaagaggtcattcaagtatgcttgggtgcttgacaggctcaaggctgaccgtgagcgtggtatcaccattgatattgccttgtggaaatttgagaccaccaaatactactgcactgtgattgatgcgcctgcacaccgtgactttatcaagaacatgattact

SEQ ID NO: 24255 - DNA, 362 bp, Gossypium hirsutum
  Clone ID: LIB3272-035-P1-K1-F7
attcattcatcaaaaaaagcttttcctctccattttccattccatatttgttctgcgctctctgtttctgtggttgtgttttaggatttgagagatcatggcgtcgcaagaatacttggacaagatgaaggtccgtcaggagtatcggaatctctggcacacggatctcatgagcaccattcaacgcgaccctccttattgctgcttggctttttggtgtggcccatgtgtatcctacatgctccggaaacgagctctttataatgacatgtcaaggtatacatgttgtgctggttatatgccatgcaatggtaggtgtggtgaaaagaaatgtcccgagttttgcctttgcactgaggttt

SEQ ID NO: 24256 - DNA, 345 bp, Gossypium hirsutum
  Clone ID: LIB3272-035-P1-K1-F8
caaagataaggatctctgggtaatgaatgtggcttctgtcaaaatgtctgcaagattgaaaattatttatgaccgaggcttgattggaacagttcatgattggtgcgaagcattttctacatacccacgtacgtatgatcttcttcatgcctgggcggtgttttcggagattaaggagcgcggttgtagttcggaggacctcctgattgaaatggataggatacttcgtcctgacgggtttgtcattataagagataaacactcagtgataaattacatccagaaatttatcactgcattgcggtgggatggctggttatctgaagttgaacccagaactgatgc

SEQ ID NO: 24257 - DNA, 321 bp, Gossypium hirsutum
  Clone ID: LIB3272-035-P1-K1-F9
gaggtttcacatgctttgaaacaatcaattcgaagaggcttgccaagggttgaggcaagacactatctttcagtataccaagatattgagtcccataataagggtttggtggagtttgctaaaaatcgattcaaacatggtccaactttggattagaaaggacttaatgagaattcttgggggggggagggtttaaaccttcaaaggaaggtggccttccccagaaattgagtgggtggaggctttttttggaatctaagaatggtctttgggccccaatttttttttggtaaaaaggttttgacaaaagggatagcaatg

SEQ ID NO: 24258 - DNA, 72 bp, Gossypium hirsutum
  Clone ID: LIB3272-035-P1-K1-G1
gccgaaaatctcgaacttctgtaaccgtggatggcattcaatgccgacgtaaggcgattggcgcatctgcta

SEQ ID NO: 24259 - DNA, 346 bp, Gossypium hirsutum
  Clone ID: LIB3272-035-P1-K1-G10
ggtgaccagtgtcttcctaatggtgtagtaattactgggaatggttacagttatgagagaatgtcgacgtagatttgatcttggggatgccgactatctcaggtatcgtgggatgcaagaatttgatcaggctatgcagcatgttgaagagaaatatggtttcatgacttccgagcacacatatatatcgcggaaggatgaaaaagatagggtgattgtctttgaaaaaggcaacctggttttcgtattcaacttccactggaataacagctattttgactaccgtgtggggtgtgcaaaaccaggaaagtacaagattgttttggattcagatgatccgttattc

SEQ ID NO: 24260 - DNA, 421 bp, Gossypium hirsutum
  Clone ID: LIB3272-035-P1-K1-G11
ggtagctttctctttgttcctccaaactgtgtgcttagatttgaagacctagtccctgtgatcaaatcttgttgttcatttctgggtttaatttctcaagaaaaagaagatgacaaaagataggcaaatcggtgtagcaatggatttctccaagggaagcaaagcagctcttaaatggtcaaccgacaatctggtagacaaaggagataccctttacctcatccacgtcaaacccaatcagagcgacgagtctcgtaaccttctttggttcaccagtggctcacctttgattccattatcggagttcaaagagaaggaagtgatgaaacattatgaggtggaacctgatcctgaggttttagacttggttgatacggcttcaaggcagaaagagatttgaagcttgattggttggccatgg

SEQ ID NO: 24261 - DNA, 334 bp, Gossypium hirsutum
  Clone ID: LIB3272-035-P1-K1-G12
ggaaagatgaaaaggactttgaaaagagagtcaaagagtgcttgaaattgtcgggagggaagcggatgggggccggcgatgcgccccggtcggatgtggaacggcgagagccggtccgccgatcggctcggggcgtggaccgacgcgggtcgtggcggcggcccaagcccgggcctttgatacgcccgtggagacgtcgtcgcctcgatcgtgggattcagcacgcgccgcctcggcgtgcttcggcacctgcgtgctccgggcgtcggcctgcgggctccccattcggcccgttttggaacacggaccaaggagtctgacatgtgtgcgagtc

SEQ ID NO: 24262 - DNA, 438 bp, Gossypium hirsutum
  Clone ID: LIB3272-035-P1-K1-G3
gaaagtttcaatggcaaccctcaaagttccagttcacgttccttctccttctgatgatgctgagcaacttcggaaagcttttgaaggctggggtacgaacgagcaattgattatcgacatattggctcacaagaatgcagcacagcgcaattcaattcggaaaagttatggtgaagcttatggggaagatcttctcaagtgtttggagaaggaacttacaagtgatttcgagcgggctgtgctgctttttacgttggaccctgcagagcgagatgctcatctggctaatgaagctacaaagaagttcacatcaagcaattggattctcatggagatagcttgcagtaggtcttcgcatgaactactcaatgtgaaaaaggcgtatcatgctcgttataagaaatcccttgaagaagatgtcgctcaccacactaccgg

SEQ ID NO: 24263 - DNA, 241 bp, Gossypium hirsutum
  Clone ID: LIB3272-035-P1-K1-G5
attcatacacgaaaaccaacccctttttcaaaataaaagggggaaatgtgcaaatccaaccctagtgcctgcttgaaaactttgtttgcaaaagccagcgccctctatttccagctccgtttctccaacagttccgttcccaccgccgcaccgtcgatttccacctcagtttctccgtccatggctgcaacggactctcctttaacgaccaaggtttgtatcattgggagtggccccgccg

SEQ ID NO: 24264 - DNA, 119 bp, Gossypium hirsutum
  Clone ID: LIB3272-035-P1-K1-G6
tatatcttccacaacacagaggcagctaagtgagttgtgccaaaaataattcgtggggcagaaccggaccccaagggaagaaaaaaagggccctcttttacaatcaactgtcttaagcc

SEQ ID NO: 24265 - DNA, 436 bp, Gossypium hirsutum
  Clone ID: LIB3272-035-P1-K1-G7
cttttgtagtggaagaaaaaaaagagaaaaaattatggagacaaagtcattggcaatggtggtggtgataactgtttcagtcatgtggggcgttgaaatggccactgcagaactcagtgccgctcagtgcaagcaagaaaggaacctcgccattaccgcttgcaagccggtggtttacggtaagcttccgtccccggaatgctgccagcgagtaagggttacccatctggaatgcgtttgccccatcatcacgcccaagatcgccgcccttattgacgtcaaccgtgccatccgcctcattcaaggctgcggtcgaagtgttcctcgccactacaaatgtggaagtatcacaactccatgaaattggcataccttctgctatactactgtttacttatgcttggaggtggaatcagcttctgaaattaaaataatt

SEQ ID NO: 24266 - DNA, 290 bp, Gossypium hirsutum
  Clone ID: LIB3272-035-P1-K1-G8
cacagctgaaacagatgaacatcaagatgggttcccaaaaacaccacgttcttttgttatcagtgcttttgattctcaattcccttctcttttccggtgccgatgaagatcactattacgaatttattttgcaagaaacagagattacgaagctatgcagcacaaaaaccatattgacagtgaacggcagttttccagggcctgagattcgggttcgaagaggcgatactgtttatgtcaatgtccacaatcaaagaagatctgctggttcctttgattggcaagggttt

SEQ ID NO: 24267 - DNA, 395 bp, Gossypium hirsutum
  Clone ID: LIB3272-035-P1-K1-G9
gcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctattgatgtatgtattgatgacaatactttattcgcagataacgatgaggtttacagggccttgtgattcttgttggtagaggctattactgcttatgttaatgttcacatatttatgaatatctagttctttttttttgattgtcattgcttttcggattcgtgtgagggtctaaacaattttatttattcttgtaatatagttactttctagaattgatttttacttgttaaattattacattatttttttt

SEQ ID NO: 24268 - DNA, 175 bp, Gossypium hirsutum
  Clone ID: LIB3272-035-P1-K1-H1
gtgagtaccaagttttcttcctttctttccccctgcaaaataaacaaaatgatcttagtaattaaaaaaccacgctctaagatatcaaggcataattatggtattgcatgccggtcaaacacacaaagtgcctttcatgcacttattgttgccgaatataaaacggagcatgtct

SEQ ID NO: 24269 - DNA, 163 bp, Gossypium hirsutum
  Clone ID: LIB3272-035-P1-K1-H10
atagcctggaagacctggctggcaacaaatatagcggcaataatcatagcaacaaagatgtcaataataacagcagtaccagcaataacaacagcaatgagaacagtgcaaacaatgctgttgacaaacggttcaagacattgcctgcagctgaggcactccc

SEQ ID NO: 24270 - DNA, 338 bp, Gossypium hirsutum
  Clone ID: LIB3272-035-P1-K1-H11
cgacgccacgcgtccgatagactggaagacctgtctggcaacaaatatagcggcaataatcatagcaacaaagatgtcaaattataacagcagtaccagcaaataacaacaggggtgggaactgtggagacaatgctgttgacacacggttcaagacattgactgctgctgatgcactccccagaaatgaagtgcttggaggatacatttatgtttgtaacactgatacaacgcaggaagatctaaagcgactgctatttggtttaccaccattatatagggactgtgttatggcaataacacctggcttacctgtatttctctataactatactact

SEQ ID NO: 24271 - DNA, 414 bp, Gossypium hirsutum
  Clone ID: LIB3272-035-P1-K1-H2
tcgagcagtacgagagcgaagaagggaagaagagtatagatgctcagcttgaaaagatgaagaaatatgccactgttatcagggtcttggcccacacccagattaggaaaatgaagggattgaagcagaagaaggcacacctaatggagatccaagtcaatggtggaacgattgctgacaaggttgattttgcatacaagttctttgagaaacaagtccccattgatgctgttttccagaaggatgaaatgattgatatcatcggtgttacaaagggtaaaggttacgaaggtgttgtcactcgttggggtgtcacacgtctgccccgtaagacccacagaggtctgcgtaaggttgcttgtatcggtgcctggcatcctgctagagtctcgtttaccgttgccagggcaggtc

SEQ ID NO: 24272 - DNA, 432 bp, Gossypium hirsutum
  unsure (1)..(432): unsure at all n locations
  Clone ID: LIB3272-035-P1-K1-H3
tttcatttgactatggattccccacaatcagttgtgtcgccattgaagaacacggttatagctgaatctggtgagaaacaaaaatccaacacaaaagaagctgttttgtccaagaaagacgacaacatcctaggtgttcttgaagtttatgttcatcaagcaagggacattaataatatctgcatttatcacaaacaagatgtgtatgctaagctttgtctcaccactgatcctcaaaccactgtttccaccaagatcatcaatggtggtggaaggaatccggtgttcaacgacaacctccgtctcgatgttgggaacatcgattcgtgtcttaaaatcgagatattcatgatgagtagagtgaagaattatcttgaagatcagttattggggtttgcattggtaccatntgtctgagttatagtcaagaat

SEQ ID NO: 24273 - DNA, 418 bp, Gossypium hirsutum
  Clone ID: LIB3272-035-P1-K1-H4
agacattcttcgtcgcctcctattctttctcttttgaaaaccctaacgacccttcttcctccaccggattcgtcaccgtcttcaccgagatcggtcaattgaacgtcgtaccaccaagacccaagccctccgatgtcttgagctctctccgtgagcgcagtaaggacatccttagcgtggtcgtcgctcttctcttcggcgtcggtagcggcgctctcacggcggctaccctctacttggtctggaccctcttctcggcccggtctgattatcatcgtgcttgtttggaggatgatgagagcgacggagaacttagccctaagaagattgggtatgtaaccattcccaccgttaacgttaaggaagtcaattgatcaaattatgtgtcttaagtctttaatatgaaataagaatcatg

SEQ ID NO: 24274 - DNA, 415 bp, Gossypium hirsutum
  Clone ID: LIB3272-035-P1-K1-H6
cgaaaggagagaaaactaattggattatgcatgagtatcgattagccgacgtggaccggtcggttcgcaagaagaacagcctaaggttggacgattgggtgctgtgccggatttacaataagaaaggttgcatcgaaaaacaacctccgcgaggaagcgttacgaaaaaagctagcgtgacggagattgaggagagtaagccggataatgggacactaggcgtggaggcgtgtgaatttccgccggcagcgacggcggtgggtaacgattacgtatatttcgactcgtcggagtcggtcccgagggttcacacggactcgagctgttcggaacatgcggtgtctcgggaattcatgactgaagttcaaagcgttcccaaatggaaggaagaattgggaatggccaacaataatgc

SEQ ID NO: 24275 - DNA, 433 bp, Gossypium hirsutum
  Clone ID: LIB3272-035-P1-K1-H7
gggagttcagtgtgatggttgtggggttcttcccattactggacctcggttcaagtctaaagtaaaagacaactatgatctctgcagcatctgcttttctaaaatgggaaatgaagctgattatataagaatggacaagcctatgcattaccggcatccatggtgtttcagggcatcaaatgatcatgttccaagagttggcccagcactccctcatgtcttgaggaatcgtgtactaaagttgtctcggcctaaactagaaagtcactttatcttggatgtcaatgtattggatgggactgtaatggctccatctacaccatttacaaagatctggcgaatgcgcaacaatggtactctgccctggtatcgtgggatgcaacttgtctggattgggggagacaagttaacaaatgcaatctcggttgatata

SEQ ID NO: 24276 - DNA, 436 bp, Gossypium hirsutum
  Clone ID: LIB3272-035-P1-K1-H8
ccaagctttaggttgtcatcgttttctcgaggttttaaactatgggtatctcttgaatttgtgaagcaaagggagaaatattggttaaaaactagtagcagtgtattgaatcaagttttacaaaaaaagaagttaaaaagaaagatgaaaatccagtgtgatgtttgtgagagagctccagcaacagtgatatgttgtgcagatgaggctgcactttgtgctaaatgtgatatcgaagttcatgcagctaacaagcttgctagcaaacaccaaaggcttctccttcaatgcctttctaacaagcttcctccttgtgatatatgtcaggaaaaagcagctttcatcttttgtgttgaagacagagctcttttttgccgggattgcgacgaaccgatccatccagccggcagccttgctgcaaaccatcaaaggttct

SEQ ID NO: 24277 - DNA, 331 bp, Gossypium hirsutum
  Clone ID: LIB3272-035-P1-K1-H9
aacgggtcttaagggtcctaactaattaactcggttcccttttccctttagcatagggtggggaattaaaccccagggaaaattttggtgtaacctttgcattcagatgctccaaggtgggccggtcattgattggtggtcttggaaacaacctcttttatttaccaaacgcacatagtgtgagatcacatgtcgcatttttttgtctcaaccacaaaggtcttttattcatgagaactgttcttaaagtagtggacaactccggggcgaaaaaagtgatgtgcatacacactctaaaggggaagaaaggggcacgattttgagacaccat

SEQ ID NO: 24278 - DNA, 380 bp, Gossypium hirsutum
  Clone ID: LIB3272-036-P1-K1-A1
gtctgcctcgtggtagggggctgttgctacttgctgaaatgagctctgctggtaaccttgccacgggggactacacagctgctgccgtaaaaattgccgaacaacactccgattttgtcatcggtttcatctcagtcaaccccgcatcttggcccggtgcacctgtaaatccagcattcattcaggcaacccctggagttcaaatggtaaagggtggcgacgccctcggccagcaatacaacaccccgtattcagtcatctttgataggggtagcgacataataatcgttggtcggggaatcattaaggcagcgaacccagcggaggcagctcgtgagtaccgtcttcaaggatgggaagcatacatggctaaatgcact

SEQ ID NO: 24279 - DNA, 303 bp, Gossypium hirsutum
  Clone ID: LIB3272-036-P1-K1-A10
accgatttaacctcgatccgggtttcatgactaccgtgcacgctatcactgcaccacaaaagaccgtcggtggaccatcactgaaggactggggagatggtagagccaattccttcaacattattcctagcctcacctgccctatcaactctgccggaaagtgtattgctgtcctgaacgccaaacttactggaacgtcattgcaagttcctacccccgatgtatcagacgtcgctctcaccgtcagacttgcgaaatctccatctcatgatgagatcacagctgctctcatggaagagtctg

SEQ ID NO: 24280 - DNA, 379 bp, Gossypium hirsutum
  Clone ID: LIB3272-036-P1-K1-A11
aaggcagtgaagttctccccttccacccctgaaatccggggaactggccgtgtttccatgaggaaaaccaccaagcctgttccttctggtagcccatggtacggtcctgaccgagttttgtacttgggtccactttccggtgagccaccatcttacttgaccggtgagttccctggtgactatggttgggacactgctggactctcagctgatcccgagacctttgctaggaaccgtgagctcgaagtcattcactgcagatgggccatgttgggagctcttgggtgtgttttccctgagctgttggctaggaacggtgtcaagttcggtgaagctgtatggttcaaggccgggtctcaaatcttcagtgagggtggac

SEQ ID NO: 24281 - DNA, 384 bp, Gossypium hirsutum
  Clone ID: LIB3272-036-P1-K1-A12
cgtttaacctacacccttgacgaaatcgagggccctttcgaggtatccaccgatggcaccgtcaaattcgaggagaaagatgggattgattatgctgccgtcacagttcagcttcctggtggtgagcgtgtgcctttcctgttcaccatcaagcaattggttgcatcaggcaaacctgatagctttggaggagacttccttgtaccatcctaccgtggctcatctttcttggacccaaaggggaggggtggctcaaccgggtacgataatgcagtggccttgcctgctggaggaagaggggatgaggaagagctagccaaggagaacaacaagagtgctgcatcttcatcagggaaaatcaccttgagcgtcacaaagagcaag

SEQ ID NO: 24282 - DNA, 332 bp, Gossypium hirsutum
  Clone ID: LIB3272-036-P1-K1-A2
attggactggtagtaagcctgttaagctgttgtctctccatcatcgcgttgataaagtcgggaactttgaaaccactcccaccatgcgcaactgggacgagactgtcgtctccctgggtcaggaaagacgtttccttttaactcagttacagaccgatcaaaaacattcttggtcttggttattttaccacaatcggttacaaaagggctgtaaaaaagatgcctttcactctaaatgttgttaactctgtggaggtgcacgaaagtgccatgtcaattttggacctacctgatgtgttctgggaatgcagtcttgaatggcttccacctgc

SEQ ID NO: 24283 - DNA, 390 bp, Gossypium hirsutum
  Clone ID: LIB3272-036-P1-K1-A3
gagctacttaaccatttcccaaatctcctccctcctcttctttagcgtccttttcatttccgctcatgcagcgcgctttgaaatccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccggtgattgtggtggactccttcaatgcaaaggttggggtgtacctccaaacaccctggctgaatatgcacttaaccaatttggaaacatggatttctacgacatttccttagttgatgggttaacatccccatg

SEQ ID NO: 24284 - DNA, 407 bp, Gossypium hirsutum
  Clone ID: LIB3272-036-P1-K1-A4
ctcacttctttcactttcaaaaccaaaactagaagatcggggagagaagatggcggccggcgatcacaccgttttgcagctcagtacgccttcaacggcgaacctatcggccaaggttcatcctctcgtcatctttaacatctgcgattgctacgttagacgccccgaccaagccgagcgcgtaattggcacgctcctcggctccgtccttcctgatggcaccgttgatatccgtaactcctatgccgttcctcacactgaatccgccgaacaggttgctttggatattgaataccatcataatatgttagtctcccaccaaaaagtgaatcccaagggaagtaattgttggatggtattctactggcctgggagtcacaggtggtagtgcattgatccacgatttt

SEQ ID NO: 24285 - DNA, 357 bp, Gossypium hirsutum
  Clone ID: LIB3272-036-P1-K1-A6
gctctctgtagccgccgcctgcgtctctctcttcatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgaaggttgttgacattgttgacactttcaggcttcaggagcaaccccctttcgacaagaagcagtttgtcgtgttcatcaag

SEQ ID NO: 24286 - DNA, 417 bp, Gossypium hirsutum
  Clone ID: LIB3272-036-P1-K1-A7
ccaaaatttgatccaagccaagtcgtcgacgtcttcgtccgcgtcaccggcggtgaagtcggagcagctagttcactcgctccgaagatcggtcctctcggtctctctcccaagaagatcggagaagatatcgctaaagagaccgccaaggaatggaagggtctccgcgtaaccgtcaagctcactgtccagaaccgccaggcgaaggtcatggtggtaccgtcggcggcagcgctggtaatcaaggcattgaaggaaccggagagggataggaagaagaccaagaacatcaagcataacgggaacatcggactcgatgacgtcatagagatcgctaaagtaatgaggccgaggtccatggctaaggatttgagagggacggtgaaggagattctgggcacctgtgtttccgttggg

SEQ ID NO: 24287 - DNA, 414 bp, Gossypium hirsutum
  Clone ID: LIB3272-036-P1-K1-A8
ctgagtttgaagcttcaagtgctaaaatctagggatttgcgggtggagaagacgagagcccatctctctgcttcaaagctcctgtccaggtagaattctcttcttcccttgcgttgtgttctttgctgttcaatcgccatggcttcaaagcggattttgaaagaactcaaggatttgcagaaagatccacccacttcttgcagtgctggtccagtagctgaagacatgtttcattggcaagcaacaatcatgggaccctcagatagcccttatgctggaggtctgtttttagttactatccatttccctccagattatcctttcaagcctcctaaggtcgcgtttaggaccaaggtcttccatcccaacatcaacagcaatggaagcatttgtcttgatatcctcaaagaacaa

SEQ ID NO: 24288 - DNA, 244 bp, Gossypium hirsutum
  unsure (1)..(244): unsure at all n locations
  Clone ID: LIB3272-036-P1-K1-A9
caacgcccnaaccagcaccgagctccgccgccagcagcgactagccgcaccagggagggggggacaaccagcgcggccgggcatccacgaagactacgaaacaaatggaaggccacagaacttcctaaaggctgtgaggacgtggaggggcggagcgcacggacatagggatttcattgcgcgagccggggatatgctgtatacggggaggctgatggtgaccactgtctgccgggggaaacag

SEQ ID NO: 24289 - DNA, 399 bp, Gossypium hirsutum
  Clone ID: LIB3272-036-P1-K1-B1
ccaagccctcccaagcgccgttctcctccgtcagttgtgactagccgattcaggtcccgaaggacaacaatctcggcttctcaacttcgatttcaacgaagcagatggaatcccacagtacttccgaaaggttgtgaggacgtggaggggcggagcgcacggacgtggggcgaacaatgcgcgagtcggggtcatgcgtggtacgtggaggctgctggtgaccactgctgcggcgtgaaacagatggaaaccctagggtttccgaatttgggcctattgttgttgggccattattttgggctgttttatgtaattgggcatttgggccagatttttctttttggatttactatttgtaaatggatatttaatatttttgttttattttttggtttttgt

SEQ ID NO: 24290 - DNA, 191 bp, Gossypium hirsutum
  Clone ID: LIB3272-036-P1-K1-B10
gtcgtgtaaagctgccgaagcaaggctaaccctgactttcaaccaaaatagtgaaggccccctctttctgcgacgaacgattctttcatccgtgtataccaggaaactgaacttttccttttatatataaactgctttaaaacttctatttttttactatcaaatatcaaatcctttaaccttaaaagtta

SEQ ID NO: 24291 - DNA, 408 bp, Gossypium hirsutum
  Clone ID: LIB3272-036-P1-K1-B11
aaaaaaagagaaaaaattatggagacaaagtcattggcaatggtggtggtgataactgtttcagtcatgtggggcgttgaaatggccactgcagaactcagtgccgctcagtgcaagcaagaaaggaacctcgccattaccgcttgcaagccggtggtttacggtaagcttccgtccccggaatgctgccagcgagtaagggttacccatctggaatgcgtttgccccatcatcacgcccaagatcgccgcccttattgacgtcaaccgtgccatccgcctcattcaaggctgcggtcgaagtgttcctcgccactacaaatgtgggagtatcacatcctccatgaaattggcataccttctgctatactactggttacttaatgctgggggtgggatcagcttctga

SEQ ID NO: 24292 - DNA, 411 bp, Gossypium hirsutum
  Clone ID: LIB3272-036-P1-K1-B12
ctcgaaagttcctctccgttctctcccataaaacgaaaccctaactcgaattcagagccaccaaactcaccttaacaatggctcatcatggcggctccgacccagaatccgaaccaaacacccgactttacaatccataccaagaccttaacctccaggttcctatcaacaacctttacaggctccctacctccccggagttcctcttcgctgaggaatccctccaccagcgccgttcctggggcgaaaacctaacgttttataccggttccgcttatttaggcggctctgtatcgggcgcagccgtcgggctcttctccgctctcaggaatttcgagcaaggcgatactttgaaactcaaaatcaatcggatcttgaatagttcgggtcacacgggtcgatcatggggga

SEQ ID NO: 24293 - DNA, 319 bp, Gossypium hirsutum
  Clone ID: LIB3272-036-P1-K1-B2
aagatgtgctgatgtatttcttagtaggtagtgttccgagttcctagggaggagttgtgcttccaagttttctattatgtttttaatttgatttaatcgccacttacatttgtggtgctgctttttctttcaatgttattttgatgatacaataaagtgtccaaaaataggcattctataaaatcccgtgtttaacattaaatttcatatgtaaatgccttaagggctcattactgtaagtgcccgaaaggcttctttcaattacacacgtcccaacttatgatggtaaaatttcaatttttatctttttactatgttc

SEQ ID NO: 24294 - DNA, 55 bp, Gossypium hirsutum
  Clone ID: LIB3272-036-P1-K1-B3
tgcacagagtatatcacattttgccgaagggtatagagaccacagccggacatgg

SEQ ID NO: 24295 - DNA, 392 bp, Gossypium hirsutum
  Clone ID: LIB3272-036-P1-K1-B4
gccatttccagtgatagatcttgctgagctccatggtgacaaaaggagcaaaacaatgacttctcttcatgaagcttgtgagaaatggggcttctttcaggttgatagccatggagttgataagaagttaatggagaaagtgaaggagatggtgaatggttactatgatgagaatttgaaggaaaagttttatgaatcagagatgactaaaagtttgaacaagaatgagaaaatctccgacatggattgggaaagtactttcttcatttggcaccgtccaaattctaacatcaatcaaatcccaaacataactaagcaactatgtgaaacaatggaggaatacatagcacaattgattaaactagctgaaaccctatcggagctgatatgcg

SEQ ID NO: 24296 - DNA, 366 bp, Gossypium hirsutum
  Clone ID: LIB3272-036-P1-K1-B5
cccacgcgtccgcggacgcgtgggaaaaaaaaacactttcatccactacagcaaggatttctagggtttcgtctgaatcggtaagcgatggctatggctgctctcagacgcgaagggaggcgtttcgcccctctgatctctcctcgtccgataaccgctgtcagatcctctcctctctatcctactcttgaggatgagggtcctcttggacttcgtcatatttcgactcaagttgttagaaaccggatgaagagtgtcaagaatattcagaaaatcacaaaagcaatgaagatggttgcagcctcgaagttgagagcatttcaaacaaaaactgataattctcgtggcctctggcagccatttact

SEQ ID NO: 24297 - DNA, 327 bp, Gossypium hirsutum
  Clone ID: LIB3272-036-P1-K1-B6
ctttccttacagaatgatttacgacgtcaattctccactcttccgctcattcctcagccagaagggcggctcctccgacaaaaggaaaatggaggagcagaagccaaaggaacagagacccaaagcaagtgagaacaaacctgttatgacagagtaactgatgcttttttttagtctgctttaagatgggacaggttggttgttgttttagaatggaaattactgtggatgtttctaatttctatattataacagtttttcttgtttgatttggaatgaacatgttcttatctggcattcaagcttctattttcctgatgttatttt

SEQ ID NO: 24298 - DNA, 412 bp, Gossypium hirsutum
  Clone ID: LIB3272-036-P1-K1-B7
tctgtctcctccatcgctctttttcatcgatcagatctcttcaaacccatctgtcaaaacaaccctccactcattccatccatgacgcttggctcaggaggatccagtgttgtggtgcctcggaacttcagattgctggaggagcttgagcgtggagaaaaaggtattggagatggtactgtcagctatggaatggatgacggagatgacatttacatgcgctcttggactggcaccattattggtcctcataatactgtacatgaaggtcgaatctatcagctgaagctgttctgtgataaagattatccagagaagccaccaagcgtccgttttcattcaagaatcaacatgacttgtgttaaccacgaaactggagtggtggaaccaaagaagtttggacttcttgcaa

SEQ ID NO: 24299 - DNA, 407 bp, Gossypium hirsutum
  Clone ID: LIB3272-036-P1-K1-B8
ctcgctactctccactcaaatggcgctatccttaaccatcagcagtggcaccagtagcagtagcaatgcaaatgggggcccaatccttcccaacaaccagctacccttcggcctccctcatcgccgcaacgtcctcttcccaatctcccccagaaccttccacttgacctccgctgccaaaaagttctcttcccgaaccggacgcttcgatagcaagaaccggaggagcaatctcacgacaaaagaacaagacgaggaacaggagctcaaacggacgggggagattgaagaatcaaacattgctgttggagttggattagaggacgttggtgggagttcgtctgagatttcggctgatggtaagccgttcccggatcttccgggccttcagccggatttatgggaag

SEQ ID NO: 24300 - DNA, 404 bp, Gossypium hirsutum
  Clone ID: LIB3272-036-P1-K1-B9
ctcaaagatatcactgcaagaaaaaaaaaaaaccagacatggcttccaacactgttgcatccgctgctcttcttcttaccttgaacttgttgatcttcactttggttagctctacctacgtgccttgcccaccaccaccaaagagccacatgcctacccacaaaagcccaccctcggcacctgaacagccaggcacttgccccagagatgcactgaaactaggcgtttgtgctgatttgttgggctcagtgcgcgttgttgttggaccgtcgaggaccaaatgctgctctctcatttcgggtttggctgatctcgatgctgctgtttgcctttgcactgctattaaagctaatgtgtggggggttaacctaaacgttcctgtttcattgtctttgctcctcaat

SEQ ID NO: 24301 - DNA, 388 bp, Gossypium hirsutum
  Clone ID: LIB3272-036-P1-K1-C1
agctaaacaagggccgctctctttgcctcacttatcaataccctgtcagtgcctgcgtcagctcaaagcagagatgggagaaggaaagggctcaaccctagtgcaccttctggtggtagtccttagcctggtcgcatttgggtttgccattgcagccgagagaagaagaagcgttggcactgttgttaaagatgacataacaaattctacatattgtgtctacaactcggatgttgccactggctatggagtaggtgctttcttgtttcttctttctggcgaatcgctgttgatgggagttacaaagtgcatgtgttttgggaggccattagcaccgggtagtgatcgagcttggtctatcatatattttgtctcatcatggttgact

SEQ ID NO: 24302 - DNA, 407 bp, Gossypium hirsutum
  Clone ID: LIB3272-036-P1-K1-C10
atgccgccgaagttcgacccaacccaagtcgtcgacgtattcgtgcgagtcaccggcggtgaagtcggagcagccagttcactcgcacccaaaatcggtcctttgggtctatcccccaagaaaattggtgaagacatcgctaaggaaaccgccaaggaatggaagggcttacgcgtcaccgtcaagcttactgtccagaaccggcaagctaaagtcactgtagtcccatccgccgccgctctggtcatcaaggctttgaaagagcctgaaagggatcgtaagaagacgaagaatattaagcataatgggaatattagccttgatgatgtgatcgagatcgcgaaagtcatgaagccttgatccatggctaaggacctgagaggaaccgtgaaggagattttgggaac

SEQ ID NO: 24303 - DNA, 247 bp, Gossypium hirsutum
  Clone ID: LIB3272-036-P1-K1-C12
agagaactcaccagctgtaacacactaacactcctaaaagcttttttaatgggaggctggtttactaccaggaccattattacacgcttctggtgttattctggatcctttccaggtctggtgttgtttacagtgatggtgatgcgcaaaatctttgatatatctcacaaaatcactttccagatgcccacttttaactcccagaagggactcgggcactttatttgggttgtgtccagaatttaaa

SEQ ID NO: 24304 - DNA, 244 bp, Gossypium hirsutum
  Clone ID: LIB3272-036-P1-K1-C2
cttaatcattctactttcaacaccaaatctatattatcggatggagccaaaacgggccggccataacacagttctaccagtcacttcttcctctacagaaaacctataggtcactgcttatcctgtagaaatatatagcatttccacttgcgacgaaggagaggcagaccccaaacccgcgcgtaattcattcgctcataagatcccaccatcctgatagccccgaacctatacgcctcgccta

SEQ ID NO: 24305 - DNA, 190 bp, Gossypium hirsutum
  Clone ID: LIB3272-036-P1-K1-C3
gtgatactcatccatatcagatttttattccgtgatttgctttatggttctttttatgaccaccttatgcggcgcgcttacaactccttatgtgtgctcctacactgcgtgggcagaacactcttttggtggttgtccggtgctagatcctattgcaaggtagaacataactgcgtatgatgaccgtgct

SEQ ID NO: 24306 - DNA, 342 bp, Gossypium hirsutum
  Clone ID: LIB3272-036-P1-K1-C5
ataaaaaatgagctttcttcaggccttgtcaattttccttttgcttttgttgtatgtagtcgtaggatcagctgagcagtgtggaaggcaagcaggcggtgctctttgccccggtggtctatgttgtagccaatttggctggtgtggcagtactgctgactactgcacagttcctggttgccaaagtcagtgcagcggtagtggccctgcccctgggcctggtgggctaaccaatcttatatcaagagagacctttaatcagatgcttttgcataggaacgatggggcttgtcctgcccgtggcttctatacatatgatgctttcattgctgctgcccgttc

SEQ ID NO: 24307 - DNA, 351 bp, Gossypium hirsutum
  Clone ID: LIB3272-036-P1-K1-C6
tacaattgataatgtcaaggccaagatccaagacaaggaagggatcccaccagaccaacagaggcttatctttgccggtaaacagcttgaagatggccgaactcttgcggattacaacatccagaaagagtctaccctccaccttgtccttcgtcttaggggtgggatgcagatttttgtaaaaaccctcactggaaaaactattacgttggaggtggagagttctgatacgattgataatgttaaggccaagattcaggataaggaagggatcccaccggaccagcagaggttgatttttgctggaaagcagcttgaagatggccgaactcttgcggactataacattca

SEQ ID NO: 24308 - DNA, 407 bp, Gossypium hirsutum
  Clone ID: LIB3272-036-P1-K1-C7
cggacgcgtgggtccaactctaatggctctcaaattttagggcaaatttcatctcggtatctctcagccatcctccatcccaatcccaaccccatcatctcttctttctttcccatgcctcgattcttcaatcctttcctcttatccttatttttctgtgttttagggttagggtttggcgttgatttcggtcaagctttcaaagtcccctttagggtcaatgatgttctcccggtgcttccgcgccaggtatcttggccggtcttgaacactcttcattccgccgttgacttgttgccggcttttgtcggatccgtgaccccgaacaatggctcaattgattggaaaggagcttgctttcatggaaacgaggctcgtctcgagttcaccagtagcgatcgcgacga

SEQ ID NO: 24309 - DNA, 409 bp, Gossypium hirsutum
  Clone ID: LIB3272-036-P1-K1-C8
gacggatcgacggtgagagccttcgtgactgacgaccaacagttcacgaagagcgtggatgagcgtttcgcagctcttgacctcaacaacgacggtgtcctctccaggtccgagcttcgcaaggccttcgagtctctgcgtctcctggagtcccacttcggtgtcgacgtcgccactccccccgacgagctcactcagctttacaactccattttcgagaggtttgattgcgatggcagcggcaccgttgacctccaggagttcagatctgagatgaagaagattctgcttgctattgctgatggattgggatcttgccctatccagatggttcttgaggatgatgaccaaagttttctgaagaaagctgctgatcttgaggctgctaagctcgatccaaaccatgctc

SEQ ID NO: 24310 - DNA, 411 bp, Gossypium hirsutum
  unsure (1)..(411): unsure at all n locations
  Clone ID: LIB3272-036-P1-K1-D1
ctcaaattaggtgtatgtgccaatgtgcttaacctagtcaatgtcaccgttggttcacccccagtgatgccatgctgttcccttctcaatggccttgtcgacctcgaagctgctgcatgcctttgcaccgctatcagagcaaacattttaggcatcaacctcaacatcccaatttcccttagcttgctcctcaacgtttgttcaaggaacgttcctactggcttccaatgctaaatcatcactgttccctacattttttatcgtctttcttatggtgtttgtgtttgattttagaaagttatgatttctattatttactgtgtgttttcatttgtaactttgttggttaaatttccttgtggngatggatatagaataagtctaatacttttcttcagatgtttttcttag

SEQ ID NO: 24311 - DNA, 400 bp, Gossypium hirsutum
  Clone ID: LIB3272-036-P1-K1-D10
ctcagccccgaagccaagagaagagtggtttttgaagaagagagaaggaaaattatatgtgaaagtatggcggggaaagaagagaaccgaatatttgtgggaggattgtcatgggatgtcactgaacgacagcttgagcatgcgtttagtccatttggcaaaatccttgaatctcagatcatgttggaaagagatactgggcgtccacgtggatttggatttatcacgtttgctgatcgccggtccatggatgaagctatcagggagatgcatggacgggagctgggggaacgcaccatttcagtgaataaggctcaacccaagatgggtgaagatcttgatcatggttatagaggaggttactcatcaagtggcaggggtcgctatgcaagtggagaca

SEQ ID NO: 24312 - DNA, 412 bp, Gossypium hirsutum
  Clone ID: LIB3272-036-P1-K1-D11
ctgcaagcctttactttaccaaacaccatggatgctgctgagagctggtcgagaaccaaatgggtcttccattttatgcttatattcgcacatttctctcttctatcactagctgaagatggtctggtggccaatggggatttcgagacgccaccgtccggcggcttcccaagcgaggcaatatccgatggagcccccgagatccccagctggagcacgaacggtacggtgaagcttgtgtccgccggtgaaaaagtgagcggcgggatgctactcatcgtaccccgaggcaggcacgccgtcagattgggcaacgacgcggagatcagtcaggaagtgacggttgagaaaggatcggcgtacgcggttacgttcagtgcggcacgcacttgcgcgcagatggagtcactgt

SEQ ID NO: 24313 - DNA, 342 bp, Gossypium hirsutum
  Clone ID: LIB3272-036-P1-K1-D12
gaagagagtaaaggggaaaaaaagcgtcgtcgtttttgcttcttcttctacttcgctctctctccttctccgaagttcctctttcgttctttcatttattcagattagttgaagggcacataatacgcgttgacaagtgttttttgctgcactcactacctcgattcttgtttccagtattggaaaagatggccgacggggaggatattcaacccctcgtctgggataatggaaccggaatggggaaggctggttttgctggtgatgatgctccaagggcaggttttcccaatattggtggtcgtccccggcacaccggtgttatgggtgggatgggtcaaa

SEQ ID NO: 24314 - DNA, 367 bp, Gossypium hirsutum
  unsure (1)..(367): unsure at all n locations
  Clone ID: LIB3272-036-P1-K1-D2
ggcggcttctgcttctatttactattttctcactctcctactcctttgtgccatcccttttaccttctccgagctcgttaaagagcagcctctggtgttgaagtaccacaatgggccactcttgaaggggaagatcaccgttaatctcatctggtacgggaagttctccccaacccagcgctccataatcgtcgatttcatcaactctttgagctctgccgtcaaacccaagattccgtcggcgtcgttttggtggaaaacgacggagaaatacaagtccggttcctccactttggtcgtgggcaaacaaatcctnctcgaaaattacccgctcggtaaaatccttaagaacccacacttgccagcg

SEQ ID NO: 24315 - DNA, 406 bp, Gossypium hirsutum
  Clone ID: LIB3272-036-P1-K1-D4
attctaccgttttattcattcactcttttctgcattattctcccgatgaccatgttcaggccagaggctgagcttgctgcatgggttgtctgttacatccctgctacaatgtcgttccttaacatccttccggcaccaaaatccttcccgttcattgttccttaccttcttttcgagaataccatgtcggtgaccaagttcaatgctatgatatctggtcttttccaactcggcagtgcatacgagtgggtcgttacgaaaaagtccggacgatcttctgagggtgatcttgtttcattggttgagaaaaagccaaaacaccatcgggttggatcagaacccaatcttgaggaaatgaaagctgatctccagcaagaacaggaacaaaaggcttgtaaaaagaagc

SEQ ID NO: 24316 - DNA, 390 bp, Gossypium hirsutum
  unsure (1)..(390): unsure at all n locations
  Clone ID: LIB3272-036-P1-K1-D5
aggaaactgaggaaaaaagaccaaactagttaaaagcaatggaagatgttgcaagggcaaccgaggctcctttagcaccagtcacttgtggaaggagagtccgaaatgacttggaagataaacttgctaaaccttatatggcgagagctntggtggctccggatgtcgatcacccgaacggaacgccggtccattaccataacggaatgagtgttcttcaacaacatgcggcatatttcgaccaggacgacaatggaatcatttatccttgggagacttacgccggttgtcgagccatgggatntaatccgattgcctctcttttttttcaccattcttattaatggatctatgagctatcctacacttncaggatggttaccttcaccg

SEQ ID NO: 24317 - DNA, 366 bp, Gossypium hirsutum
  Clone ID: LIB3272-036-P1-K1-D6
gcgctccgctttcttcgcataacccggtgctcaagcccccgctccgcgaccttgggggcagatctcgctggtagtcgcctatacccaactcactactagcaaggccgaataggggaatggtcacactcatacggcacttgcacatgtcttgctccatcctaacctacaacaggtggacctacaacagcgcctccactgcgagctttctaagggactcttctataaattactgatccggacctctgcgggttacatccaccttagctaacatctacacctgtcacgtgaactcggccagagctatctgttctttcaacggcctgacatcatgtataccgctcaatcctatgttggttcatcaactac

SEQ ID NO: 24318 - DNA, 400 bp, Gossypium hirsutum
  unsure (1)..(400): unsure at all n locations
  Clone ID: LIB3272-036-P1-K1-D7
gtgaacggaggcgttgatatggggagtgtttcacaagcttatttggaaagcgaaccagtgaaggaggcgagatctttgatatctgagctttgtcgccagttctatagccttggatgggtctcaggaacaggtggcagcatcaccatgaaggtccatgatagctctatccccaagcctcaacaacttatcctcatgtccccttctggtgtccaaaaggagagaatggaaccagaggacatgtatgtattatcaggagatggggctatcatatcttcaccttctccaaagccataccctcataagcctnctaaatgctctgattgtgctccgcttttcatgaaggcatatcatatgcgtaatgctggggctgttatccacagtcatggaatggaatcctgtc

SEQ ID NO: 24319 - DNA, 411 bp, Gossypium hirsutum
  Clone ID: LIB3272-036-P1-K1-D8
gttaagaacttgaaaatgtatgaaaaatacccatctccgattaaatgtgaaccgactactgtgtcaatgcccatcaaggaaggtgagccaattgtcttcacctatgaagttactttcgaggagagcgatatcaagtggccatctcgttgggatgcttatttgaagatggagggagctaaagtccattggttctcaatcttgaattctcttatggtgatcactttcctcgccggtatagtccttgtgatcttcttaaggactgtcaggcgggatctgactcggtatgaggagcttgataaggaggcgcaagcaatggtgaacgaggagctgtctgggtggaagctagttgttggggatgttttccgtgccccatccaatcctgcccttttgtgtattatggttggggatggg

SEQ ID NO: 24320 - DNA, 411 bp, Gossypium hirsutum
  Clone ID: LIB3272-036-P1-K1-D9
attgtttcctcgatgctacccaattttacgcttcaatgcgtacccaaggctgctggcccgacaatttcactttccctttcgttctcaaggcctgttccaggcttttggatttccatttaggaataagaatccatgccctcgttataaaactaggattcgatcgtgatgtctttatcaagacaagtttgctgtatttgtattccaaatgtggatatttggattatgcacgtaaggtgtttgacgatattcctgataaaaatgttatttcttggacagcaatgattagtgggtacatagatgttgaacggtatagagaagcggttgatttgtttcgtaagctaatagatatgggtttgaggcctgatagtttcagtgttgttagagttctggcagcttgtgctcacttaaggg

SEQ ID NO: 24321 - DNA, 393 bp, Gossypium hirsutum
  Clone ID: LIB3272-036-P1-K1-E1
gttgacccctgggcgtgcaaaaccggaatcgaaattaaaggggaagcaaaaaaaccactgccatagcagttttgcaggatttctgggattctaacacaagcacaaaatttgggtctttagagaagaacagaaagattaataatggaggtggaattggaagagatgcttgatgatctgttgtctataaggcaatctgtgtctgatccttctcttcatgcttcaattgacaagctgcaattgcgtgttgatcgtcttactcatcttgctaaggctgtacctgttcgacgatcaaaagtcaaggatatgagtgctgaggtggttgatagcaatccctatagtaggctcatggcacttcaaagaatgggtatcgtggagaactatgaaagggatccg

SEQ ID NO: 24322 - DNA, 409 bp, Gossypium hirsutum
  Clone ID: LIB3272-036-P1-K1-E10
gcaactttgacgcagctgctatttcttttttgtggttttcagcagcagcttgtatttggaagaatggtgagggtgagcgttttgaatgatgcactcaagagcatgtacaatgcagagaagaggggcaaacgacaggtcatgatccgaccgtcctcgaaggtgatcattaagttccttttggtcatgcagaaacatggttatattggggagtttgagtatgttgatgatcatagatctggtaaaattgtggttgaattgaatgggaggctgaacaagtgtggggtgatcagtcctcgttttgatgtcggtgttaaggagattgagggttggactgctcggttgcttccttcaagacagtttggttatattgtgctcacaacatcagctggaattatggaccatgaagaag

SEQ ID NO: 24323 - DNA, 412 bp, Gossypium hirsutum
  Clone ID: LIB3272-036-P1-K1-E2
tttcctctctattgtctctctttagaacaatcctttcatccaaaaacccaatacaactgttaacaaaccctagaaagaggaagataaagtttcttccaacgattaaagagagaaaatagaggggaaatccaggcacatgcacctagtagaggctacttcgatcaactagaaaatacagacgatttgtatttgaagaaacgatcaaggatgcgtcgttggctttgctgttcctgtcaagcagaggagagttaccaagcacacgaaaacgagcacttgaaagcccccaaggatcatacagatggaaatcatagaaactcaagggtggcagctcctgtcaaacctgaagtgcaaaaatcaccaccacctatcgaagttcctgcactatcgttggaagaattgaaagagaaaacgg

SEQ ID NO: 24324 - DNA, 411 bp, Gossypium hirsutum
  Clone ID: LIB3272-036-P1-K1-E3
aaaacaatctgttttattaattaaacaaattgaaataaaggtgaataaaatatactggagtgaagaccagatacagatctggatcgtgccctaagtaaagcccataaaagagtagcacttcaattcttcaaatcttttttttttttgcttcagaagccataatacattgcagtcttatcactgttatataaccatgtcaaggaggcctgtaaatcctgctcggcgctttgctgatggcggaagcatcccttttgttggctcagtacagtctaagacacgttcatcaccattcttatctattgggcttttggttgtgggtgcaattcttctgattggctatttgcattatggttcagggcaatccaccagtgtaaaagaggcactaaagtaagttgaaggtggttcttcatg

SEQ ID NO: 24325 - DNA, 403 bp, Gossypium hirsutum
  Clone ID: LIB3272-036-P1-K1-E4
agttccatggctccaaaagtccaccaaaaaggaaggaggaatcacattactgcaaaagatgagtataggcatggttctcgccataatcaccatggttatatccgccattgttgaagatagaagaagagccttagctttgagtaaccccatcggcatagattcaaagaaaagatccatttcttcactgtcaacaatgtggttaatccctcagctaacattaataggactctccgaagcattcacattaattggtttaatcgaattttactacaaacagttccctgaaaacatgagaagcattgctggatcattcacttttattggccttgcattgtcgagttacctcagcagtttcttgatatcagttgttcataagatctcggaaagatcccaaacaggtgac

SEQ ID NO: 24326 - DNA, 401 bp, Gossypium hirsutum
  Clone ID: LIB3272-036-P1-K1-E6
caaaaattgggtgagacaaaatttggaaaatacacaaagtcaggaagctgagtgggaaggggtctgtttggttgcgctgctggtgagcgcgatgatggagaaaggcaaagagcccgccgcagccaacgaggatggcgaagttggtaagaccgagagcgaggagattcaggaagccttagaaattgtcctctttcaagtctctgaatgttatgtttatttgatacctgcaaggaaaactgcagcatcttacagagctgatgaatggaatgtcaacaaatgggcatgggagggaactttgaaaggcattagcaagggagaagaatgcattatcaggcttgaagacaagaatacaggtgaattgtatgctcgagcatttctgagagatggagagccacattcag

SEQ ID NO: 24327 - DNA, 407 bp, Gossypium hirsutum
  unsure (1)..(407): unsure at all n locations
  Clone ID: LIB3272-036-P1-K1-E7
gtacgattaaccccaaggtcatagagtgcgagtatgctgtccgtggtgagattgtcacccttgcacagaaattgcaagaagagatacagactaagccagatgctcatccctttgaagagatactgtactgcaacattggaaatccacaatctcttggtcagcagccaataacttttttccgagaggttcttgcattatgcgaccatccagccattttggacaaaagtgagacacagggtttattcagtgctgactccattgaacgtgcttggcaaattcttgatcaaattcctggaagggcaactggtgcctacagtcatagccagggtatcaagggattacgagatactattgctgccggaattgaggttcgtgatggttttnctgctgatccaaatgatattttc

SEQ ID NO: 24328 - DNA, 354 bp, Gossypium hirsutum
  Clone ID: LIB3272-036-P1-K1-E8
ctgttgtcaactttcttatttctcgatcaaattgtgtggcttggcagaacaggcatctataagaacaaagaacgtgctgagttgattggacgaatatcccttttctgttggatgggatcatcaatatgtaccacattggttgagcttggggagcttggaaggctatctgcatcaatgaaaaagttggaaaagagacttaaggatagtgacaagtacaagaatgaggagtatcgtgcgaagctccaaaattcaaatgagaggactttggcccttgttaaagcgggaatggatatagtagtagcagttgggcttcttcaattggcaccgaagaaagtcacccctcgagtaacggga

SEQ ID NO: 24329 - DNA, 411 bp, Gossypium hirsutum
  Clone ID: LIB3272-036-P1-K1-F1
cgccaaatctcccactccctcctctcctctctccctccccaaacaccctttaacctcatatgtggtgtcccttacactgccctccctatagccacctccatctctctcgacacctccatccccatgctcatgcgccgcaaagaagtaaaagactacggaactgccaagtccatcgaaggtgtttacgaaaagggtcaagtttgttttgtggtggaagacctcgtaacgtccggtgcatcggttctcgaaacggcggcaccgcttcggtctttgggtatcaacgtaacggatgccatcgtggttatagatagggagcaaggcgggagggaaacgtttgaggagaatgggattaaacttcatgcactttttactttaactgagatggtcaggttttaagagccaaagggaagc

SEQ ID NO: 24330 - DNA, 410 bp, Gossypium hirsutum
  Clone ID: LIB3272-036-P1-K1-F10
cagcgacctaatttcttcctcagacgctcaatggaccttcagcatcggcgattccattttccctccattcgagctcaacagtcggggacgatatttccgcgaaaagaagacgaggaagattctttgaaggtaaaggaatgggaagttggaatgttgcaaaacgaagtcgcagcgagtcaagggattagaatacggcggcgtccaccgtcgggtccgcctttgcattacgtgggtcccttcgaattccgtttacagaatgagggaaacactcctcgtaacattcttgaagaaatagtttggcacaaagatgtggaagtttcccaaatgaaagagaagaagcctttgctttcattgaagaaggttatcgagaattcacctccaactagagatttcgtcgggtctcttaaagc

SEQ ID NO: 24331 - DNA, 278 bp, Gossypium hirsutum
  Clone ID: LIB3272-036-P1-K1-F2
agagaatgctggaagttcatacagctactccagaggtggcgatgagagctcccatatagaaagttaccaggatatttgtggccagaacaccaccatcagcggatgaatcaacctttcgcaggcactttggggagtatggtgagataacaaatttatacatgccgtaggatcaagtctcaaaagctcatcgatgaatcggctttatcactcttgctagtgcagaatctgtggagaatctgatggctgaagctcatgaactgggtggttctacagtagta

SEQ ID NO: 24332 - DNA, 413 bp, Gossypium hirsutum
  Clone ID: LIB3272-036-P1-K1-F3
ctcgctctctgtagccgccgcctgcgtctctctcttcatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgaaggttgttgacattgttgacactttcaggcttcaggagcaaccccctttcgacaagaagcagtttgtcgtgttcatcaagaagttcatcaagaacttgacaccaatactggatgcggaaaagcaagagtcctt

SEQ ID NO: 24333 - DNA, 403 bp, Gossypium hirsutum
  Clone ID: LIB3272-036-P1-K1-F4
ctgaattctcccctttctcacctaactcttgtttgattgctttctttgtttcaatgaaattatctcccaaaatcttgcttttttatttttcttaatttttcctctccttgatcgttgctagctgcaaaaagggtacgtcagaaatggattttttcttcagaggcctaaatgaggatttttcatcttcccaaatggacattcttagatgtccatttttgagaaatattaacgagccaactaacttttccttctcgtctgcattgcctttccccatgccggtacgaggagccaaaggtccaatatttgaagatggacccaatttcgacatggcattcaggctattccatggacgtgacggagtagttccgctatctggacgatcatccttgcgttttgagaaagc

SEQ ID NO: 24334 - DNA, 414 bp, Gossypium hirsutum
  Clone ID: LIB3272-036-P1-K1-F5
gaaggtgtatggcccagcctttgcttctccaaagcgagtgattgcatgtcttattgaaaaggagattgaattcgagactgtccctgttgatttgcttaaaggagagcacaaagaccctgaatttctcaagctccagccttttggaacagttcctgtcactcaagatggagattatgttttatatgaatcccgtgcaatcataaggtactatgcagaaaaatacaaatcacaagggactgatctactgggaaagacagtagaggaaaggggtcaagtggaaaattggctagaagttgaggcacacaatttcaacccatcaatttacgccttgaccctacatgtgatgtttgcttccaagatggggttccctcctgatgaaaatttgatcaaggaaagcgaggaaaagctaggcaa

SEQ ID NO: 24335 - DNA, 416 bp, Gossypium hirsutum
  Clone ID: LIB3272-036-P1-K1-F6
ctggtttcttttagcttacagcttccattgtttttcagtagtgaagagctaaaaaagaagggaaaccaatggaggggaaagaagaagatgttagattgggagcgaacaagttctcagagaggcaacctattgggacagcagcccagtcccaagatgataaggattacactgagccacccccagcacccttgtttgagcccagtgagttgacttcatggtcgttttaccgagctggaatcgctgagttcgttgctactttcctattcttgtacatctcggtgttgactgtgatgggagtccttaaggacaaaaccaagtgtacaactgttgggattcaagggattgcttgggcttttggtggaatgatctttgctcttgtttactgcactgctgggatctcaagtggtcatatcaat

SEQ ID NO: 24336 - DNA, 390 bp, Gossypium hirsutum
  Clone ID: LIB3272-036-P1-K1-F7
caaaaaaaaaatcccaaaagccatggaaaaagagaagctggacttcatactggttccgacgggtctactcgtgcttgctctctatcatgtttggcttctttttaccattctcaagcatcccactagaaccgtgatcggcttaaatgctgaatctcgccaccaatgggttctctccatgatgtctgatcccttgaaaaatggtgttttagcagtacaaacaatacgcaacaacataatggcatctacacttttggcaaccgtggcaatcactcttagttcgttgattagtgttttcgtaaccagcagctcggactctagcaacacaacttcagaaatattttatggcaataagagtcgtctactctcttcaatcaagtatttttccatctt

SEQ ID NO: 24337 - DNA, 397 bp, Gossypium hirsutum
  Clone ID: LIB3272-036-P1-K1-F8
ttttcttgttccttccttcgccgtctattgcttttagttgcctcgatttcaagtgaatcagaatgggtaaggaaaagactcacattaacattgtggtcatcggccacgtcgattctgggaaatcaaccaccactggccacctgatttacaagcttggtggtattgacaagcgtgtgattgaaaggttcgagaaagaagctgctgagatgaacaagaggtcattcaagtatgcttgggtgcttgacaagctcaaggctgagcgtgagcgtggtatcaccattgatattgccttgtggaaatttgagaccaccaaatactactgcactgtgattgatgcacctggacaccgtgactttatcaagaatatgattactggtacgtcacaggctgactgtgc

SEQ ID NO: 24338 - DNA, 403 bp, Gossypium hirsutum
  Clone ID: LIB3272-036-P1-K1-F9
gaaaatgaagggtctgcaggcacttatattggcaatggtaatggttatggcgatcgctacaactgatgctcaaagcatttgcaacatgccagcttcaggtttgatggcatgcaaaccagcagtgaccccccccaaccctccgccgcccacgtcaacttgctgctccgccctctcccacgctgacatgcgttgcctttgctcatataagaactccaagctcttgccttcccttggtattgacccaaaccttgccatgaaattgcctagcttgtgcaagcttcctcatcctgcaaattgttagttcctggttctccatatttgatctcaaatgtgagggaaaatcatgcttattataagcctctacttcacataattgtactgaccttcgggtttctttttcctt

SEQ ID NO: 24339 - DNA, 290 bp, Gossypium hirsutum
  Clone ID: LIB3272-036-P1-K1-G1
gcgagagcttatgttgctgaggcgcggggaattcgtggtgagaaagcgaatgtgaacttggctaacgtgactgcgcttacctctgcaaagcgtgcggtcaagacatattctgagaaaccacttttcaagtcgaatttgagccctgtgcagctaaatctcaaccagaattacaattactctggccacggctagcaggaatacttcgataccatgggtttcagtagaagagaagccactggccaactagtttgcatatgctgaccctgttactacgtctatagatgctggat

SEQ ID NO: 24340 - DNA, 413 bp, Gossypium hirsutum
  Clone ID: LIB3272-036-P1-K1-G10
aatttgtattccaataagaacctggcaagccaatccaacaaaatacacatcgaataaatgccttggtcttcacaaaaaagaagaagaagaagaggctgagcatctggtagctttctctttgttcctccaaactgtgtgcttagatttgaagacctagtccctgtgatcaaatcttgttgttcatttctgggtttaatttctcaagaaaaagaagatgacaaaagataggcaaatcggtgtagcaatggatttctccaagggaagcaaagcagctcttaaatggtcaaccgacaatctggtagacaaaggagataccctttacctcatccacgtcaaacccaatcagagcgacgagtctcgtaaccttctttggttcaccagtggctcacctttgattccattatcggagttca

SEQ ID NO: 24341 - DNA, 410 bp, Gossypium hirsutum
  Clone ID: LIB3272-036-P1-K1-G11
tttgtcttgctggagtgtacttgacattggcacgggaaatggtctgctccttcaggagctttctaagcaggggttcacagatttaactggaactgattatagtgaaggagcaattgaccttgctcaaagcctagctgatcgagatggattttcaaacatcaagtttctggttgatgatattcttgagacaaagttggatagacagtttcaacttgtcatggataaggggactctcgatgccattggcttgcatcctgatgggcctatcaaaaggattatgtattgggattcagtttcaaagttgttggcccccggtggaatattagtgattacatcttgcaaccatacaaaagatgaattggtccaagaggtggaaaatttcaatcaaaggaacattgcaatatcccaag

SEQ ID NO: 24342 - DNA, 404 bp, Gossypium hirsutum
  Clone ID: LIB3272-036-P1-K1-G12
cggacgcgtgggttccgtttagcagagctttcttcgacgagcagccatctgtaatcaatcatgggtcattctaacgtctggaactctcaccccaaaacctacgggcctggctctcgcgcatgccgagtgtgtggaaaccctcatgccatcatcaggaagtacgggctcatgtgttgcagacagtgcttccgtagcaatgccaaggaaattggattcattaagtaccgctgaggaatgtttatatggctagaagttggaaacactttttggctagtatgaacctttgtttcgaaattgtagcaacttttaagataacactgctgttttttggtgaaattagtttaagagcttgaagttttgtttctgcaaaggataatttgttgttttctcaatgaagtaatcat

SEQ ID NO: 24343 - DNA, 385 bp, Gossypium hirsutum
  Clone ID: LIB3272-036-P1-K1-G2
atttatttcactacccaacaacccaaaagataaaaggaatcgtttacttgttcgtagcagtgtatcgtcatttcaagcgcaattctctgaaaatttttgtgctgaacttcttttttctctttgtaccaccatgtgtggaggtgctattatctacgatttcataccgccgtcgcgttctcgactattgacggccgatttcttgtgtcccgatctgaaaaaatcctggttgaagaatgggtcgtgaaagaaatactctaagcccgtgatcgactttgtgcgatgatttctatactgactttcaggagttcaaagattaaaaatctgttttagatgattttatgttaattattttttcccgttttaaacccttttttttttaccctac

SEQ ID NO: 24344 - DNA, 370 bp, Gossypium hirsutum
  Clone ID: LIB3272-036-P1-K1-G3
ctttggtatctctagttggttttgggctttacgagtttggctttcctggggttgccaaatgtgcggagattggactgcctcagctgattcttatagtatttgtctcacagcacgtgcctcatgtgataaagtctggaagaaatgtctctgatcgatttgctggcttgttctcagaggtgattgtctggacttatgctcatttactcactgggggtggagcttataatggtacagcaccaaaaacacaaacaagctgtagaactgatcgttctggtctaatagatgctgctccatggataagagttccttatccctttcaatggggagcgccatcatttgatgctggtgaagcctttgctatgatgatggc

SEQ ID NO: 24345 - DNA, 402 bp, Gossypium hirsutum
  Clone ID: LIB3272-036-P1-K1-G4
ccgacggtgaggatattcaacccctcgtctgtgataatggaactggaatggtgaaggccggttttgctggtgatgatgctccaagggcagtttttcccagtatcgttggtcgtccccggcacactggtgttatggttgggatgggtcagaaggatgcctatgtaggagatgaagcacaatctaaaagaggtatccttactttgaaatatcctattgagcatggtattgtgagcaactgggatgatatggaaaagatctggcatcatacattctacaacgaactccgtgttgctcctgaggagcaccctgtgcttctcacggaagcacctctcaaccccaaggccaatagagaaaagatgactcagatcatgtttgagaccttcaatgtacctgctatgtatg

SEQ ID NO: 24346 - DNA, 412 bp, Gossypium hirsutum
  Clone ID: LIB3272-036-P1-K1-G5
cgggttcaagtccccattgccccggaatacctagcgtttaaccccaacaccggggcagggaccataatagattcgggtacggttgtaacccgattcgtccagcccatttacaaggcaatccgagatgagtttgtgaagcatgtgaaaggtccatttactgccattggagtatttgacacatgctttgatgctacagcagaagctgaggcacctttaataacattacatttcgaagccttgtcgatgccattgccaatggaaaacagcttcttacacaccagtgccgggtctcgggcatgcttggccatagcaccggtccccaacaatgtgaacgccgccatgaatgtgatagccaatttgcagcagcagaatcataggattctctttgatgtcatcaattctcgcttgggaa

SEQ ID NO: 24347 - DNA, 411 bp, Gossypium hirsutum
  Clone ID: LIB3272-036-P1-K1-G6
cccacgcgtccgcggacgcgtgggaaaaaaaaacactttcatccacgacagcaaggatttctagggtttcgtctgaatcggtaagcgatggcgatggctgctctcagacgcgaagggaggcgtttcgcccctctgatctctcctcgtccgataaccgctgtcagatcctctcctctctatcctactcttgaggatgagggtcctcttggacttcgtcatatttcgactcaagttgttagaaaccggatgaagagtgtcaagaatattcagaaaatcacaaaggcaatgaagatggttgcagcctcgaagttgagagcaattcaaacaaaaactgagaattctcgtggcctctggcagccatttactgcacttcttggcgatcttcccagtgctgatgttaagaaagaacgt

SEQ ID NO: 24348 - DNA, 401 bp, Gossypium hirsutum
  Clone ID: LIB3272-036-P1-K1-G8
cgccatacaggcttgtaaatgctgaaggttgtttctgggggataatccactcggccggcgaagttttgtccttaggtctcgtcgtcacactcttttggaaatggaatccaatccaccatagtactattaagtcaaccatttccatagcctactaaaagataaacaccgctcttcatttctccactctcaaacaactagtagcatctatggcttccatggcttctctttcagcttcttaccctaaatatacgtccaattttcccactagatacacgcacctgttgtatgatttatgtcttgttccacgaaatcttcctcttgtgaaaaaattgtctttctcggatttgacaatcgttagaaagtctaatcaaactgaatcaatgatcgattctactgataaa

SEQ ID NO: 24349 - DNA, 311 bp, Gossypium hirsutum
  Clone ID: LIB3272-036-P1-K1-H1
cttccgtttttttttttttttttcccccaactttttgaaattatcccattaagtcttaatctttcaattgggaataatatatcttggaatgattccttcattccaataaaaagcccaattctttgtttttgatgtcaacagaagctgccacaacaaatttccaaagttcaaatttccagccggtggcgcagccgccggatttccggccggaggtgactgtcagtccccataacgggctccgcttttggcagtcatgattgcgggctccatagccggcttgcgtgagcatatggctatgttcccggttgaca

SEQ ID NO: 24350 - DNA, 345 bp, Gossypium hirsutum
  Clone ID: LIB3272-036-P1-K1-H10
ctcttcccatttctctctcttttcttggcagggaaaaaagtgagtgacttgtgggaaagcaaaaataaaggccatatctttgatgtgaaaagagagcaataccagttacaaggaacaaagattttgtagatattttttccttcacagttagtttaacataatggaaggaatcaaaggtggaggaggaggtagagttggtgttggtgttggtgttgaagaagatatgggagatggtatgcaatgcagtaatcatccttatagaaataaccctggtgggatctgtgctttttgccttcaagagaagctaggcaagttgggttcttcttcttttcctttacctattcg

SEQ ID NO: 24351 - DNA, 322 bp, Gossypium hirsutum
  Clone ID: LIB3272-036-P1-K1-H11
tagagggcgtcaggacaaagaaggttgcactcctctccattgggcagctattaggagtaatctagatgcttgcacagtcttagtacaggctggcaagaaggaggacttgatggtcactgataatggtggcctcacacctgaacagcttgcttctgataaaaatcacagagaagttgctatcttccttggtaatgctagaaggttgtatgaaaaaggatgtggtcggaacaacagttttggacaactttctaaattaagacttgcaccaattctttggtgcactagcttgctactatatggtgacatatattcaatctgtgtt

SEQ ID NO: 24352 - DNA, 415 bp, Gossypium hirsutum
  Clone ID: LIB3272-036-P1-K1-H12
atcacccctaaattccccaccactttccctctccacctccacctccgcctttcctcctccgccacctgtctccgtcacagccgatcttccccgttcttaacagcaacaacaacaactcgggtggcggcggtggaaacgatgagaatggaaaacacaggggtggtgatgacgagaatgcgggtgataagaacaggaaagaggcgatgattgtactggcggaggcagggaggtcaacggagagtctgccgaaggacttggcggcggcgatccaggctgggaggatccctgggtcggtcatagagaggttcttggggcttgaaaaatcggggcttatgagatggttgatgcagtttggagggtttaaagaaaggcttttggctgatgatcttttcttagctaaaagtgcgatggagtg

SEQ ID NO: 24353 - DNA, 274 bp, Gossypium hirsutum
  Clone ID: LIB3272-036-P1-K1-H2
tcgtttcttctacataccctccttgtggagaacccatccccctcctttagggtggagcagttaaaaagagaaaatcaaaagtatggcgaccgccactgtccccgccgccgtaaggcagctttctgctaaagaagccgacatccaaatgatgttggccgccgaagtccatctcggtaccaaaaactgtgactttcaaatggagcgttacctcttcaagcgtcgcaatgacgggatctacatcatcaaccctggcaagacctgcgagaaacttaac

SEQ ID NO: 24354 - DNA, 410 bp, Gossypium hirsutum
  Clone ID: LIB3272-036-P1-K1-H3
tcagtgtctcactctctccgtgcttcactccagtttctcctttccctcttcgaagaaaaaatgcgtgagatccttcatattcaaggtggccaatgcggcaaccaaatcggagccaagttctgggaagttgtttgtgctgagcatggcatagatgcaactgggcgttaccaaggagacttggatcttcaacttgagcgaatcaatgtctactacaatgaagccagttgtggtagattcgttcctcgtgctgttctcatggatcttgaacctggaaccatggacagcatcagatctggccctgtcggtcagatttttagaccagataacttcgtttttggtcaatctggtgctggtaacaactgggctaagggccattacacagaaggtgctgaagtaatcgattccgtact

SEQ ID NO: 24355 - DNA, 364 bp, Gossypium hirsutum
  unsure (1)..(364): unsure at all n locations
  Clone ID: LIB3272-036-P1-K1-H4
tggacgcatgggttccgcctggctccgtctgttactctgcggccacctcatggccaaaattcgtctagggcacaagcttggaggctgatcaggctgactgcatctaacccgttgcagacatgtttatcacctctttccctctacggattcgtttagaataagagctgccatggccggcgatgagtcgggggcaaatgcgctggtggaattgtttgctgtagcggcggctcatgcccttgtcttcggcgttatgatatcagccggtcacatatcangcggccatcttaacccagccgtcacgctcgtgtagctatccaggggtcacatcacggtggtccgtgcgatcctctactggatcgatcag

SEQ ID NO: 24356 - DNA, 416 bp, Gossypium hirsutum
  Clone ID: LIB3272-036-P1-K1-H5
cccacgcgtccgcccacgcgtccggccttcaaggaaagtttagccctgaagcacttaactggctatttgttaaggggttgtttggctggtttctgcaagtctcgctgctgaaagtaacattactatcactgggcagtggtgaggcaccattacttgacattcttgcatatgctgggtatgctttcacaggaatgtgtttggctgtcctcggaaagatgatatggagatattcttactactttttgatgccatggacatgcttatgcatgggagtcttcttggtaaagacaatgaagcgggtcctctttgctgaggttagaagttacgattccagcaagcaccattatcttttgctctttgttgcccttgctcaatttccactttttacgtggcttggcaacatcagtgttaattgg

SEQ ID NO: 24357 - DNA, 433 bp, Gossypium hirsutum
  Clone ID: LIB3272-036-P1-K1-H6
aggtgccgtaccggtactcggcagtttccggcccagagccacgcgtactatctaccctctctcccgcaagccccaacttttttttatttcttgtttcatataattgcgttgctgatctaaaatggcgggtcggggcaaaactctcggatccggagcctcgaagaaggcgacatcgaggagtagcaaagctgggcttcaatttccggtgggtcgtatagctcgggtccttaaggctgggaaatatgctgaacgagtcggcgccggagctgcggtttacctagccgctgttcttgaatatcttgccgctgaggttcttgagcttgccggaaatgcagcgagagacaacaagaaaacccgaattgtgccacgccatattcagctagccgtaaggaacgatgaagagctaagcaaattacttggagatgtcacgatt

SEQ ID NO: 24358 - DNA, 83 bp, Gossypium hirsutum
  Clone ID: LIB3272-036-P1-K1-H7
cttccgctttcttctacatattctcctgcatggggtagccgatcctaagagacaggggaagggagtttaaaagaggaaatcaa

SEQ ID NO: 24359 - DNA, 200 bp, Gossypium hirsutum
  Clone ID: LIB3272-037-P1-K1-A1
ctagaaacataattaacaatccgaaactcgttcccggaggtggtgctacacaattaaccgtgtctgccacattgaagcagaagagtgcatctgttgaaggcatacaaaagaggccgtatgaagccgctgctcttgcttttgaagccataccacgtacttgggcacaaaattgtgcgtgtaatgtgattcgagctatgact

SEQ ID NO: 24360 - DNA, 371 bp, Gossypium hirsutum
  Clone ID: LIB3272-037-P1-K1-A12
cttccctaaaattttcccagtctcaaccaaactctctctggtgacccttcaaaagaatcaccgccatggcgatgcaaaccggagtcggcttttcgaagattttgatccttgccggcgcaggttacaccggtacgatccttctcaagaacggtaagctatcggacatgttaggcgaattgcagtctcttgtgaagggactggaaaaaaactggggaccaatcagatgattcagatgcccttctggctcaggtgcgtcgtctctcaacggagattaggcaactggcctcagcacggcagataactgttctgaatggggattccggcgttaagttaacctctctggtaatccctgctgctaccttgggggcatt

SEQ ID NO: 24361 - DNA, 421 bp, Gossypium hirsutum
  Clone ID: LIB3272-037-P1-K1-A2
tcaaagctcatctgtcaacccagagccccttctctccgccgaatctcctttttctcccgtaaaaatgtctctggtggccaacgaagattttcagcacattttgcgtgtcctgaacaccaacgttgatggaaagcagaagattatgtttgctttgacctccatcaagggtatcggaaggcgtttcgccaacattgtttgcaagaaagccgatgtagacatgaacaagagggctggtgaactgactgcacaggaattggacaatctcatgacgattgtggcgaacccgaggcagtttaaaatcccagattggtttttgaacaggcagaaggattacaaggatggaaagtattcccaagttgtgtccaatgctctcgacatgaagttgagagatgacttggagcgcttgaagaagatcaggaac

SEQ ID NO: 24362 - DNA, 416 bp, Gossypium hirsutum
  Clone ID: LIB3272-037-P1-K1-A3
gcgaaaccccaacttttatttctattttccttttcccttctctgtctcatttctttttccgccgccgattcctccatcacagccgacttacgtctcaccgattccagtttcccgtcggttcatgcgaagaagctgattagggagttgaatttgtttcctaaaggggaagtcaatgtcgttgacgaacaccgggtttcgttgccggagggtcccaaactggtggagaagcggttcaagttcccaactttggaagtgcccggtggagtttcctttgaggatttgggtcaccatgctgggtattacaagcttcctaattctcatgatgccagaatgttctacttcttcttcgaatcacgcaatagcaaaaaggaccctgttgtaatctggttgactggagggccaggttgtagcagtga

SEQ ID NO: 24363 - DNA, 394 bp, Gossypium hirsutum
  Clone ID: LIB3272-037-P1-K1-A4
gcaaatcgtaacttaatgcctaaatgacacaaggttgactaataaaataaatcgcgagagaatatgtggtcatatgaggatctcaccacaggcgatgagctgctttagggctctttcccatacaaagaaatcgatattggaatggcacaggggaagtgacagggaaagtgctgctggtcaaggcagctgacaatgtacaatatcgaggctaacccttgtgcagaaggtggtgaacatgaacaacgtgttgtccctcttgccaataagggtccacacatacacggcactctgagacttcaggacctacacgatgcatacacggatctgaccatgcccagactgaataggatcatcacgacctctccacccagatctgatcctgttatgcatgcac

SEQ ID NO: 24364 - DNA, 408 bp, Gossypium hirsutum
  Clone ID: LIB3272-037-P1-K1-A5
ctctcttgcgtgtcgttttcatttcaacctctgccttcttttccattatttttcacccttgtttccatcttctttccgctgacttctcgggtaaatcggtactagatctctgtggtctattgccggaattttcgttcggattccggcgaccccagtcttcgatcctattttctcttcaatccagaatgaatcccgagtatgactatctgttcaaacttttgcttattggagattctggtgttggaaagtcttgtctccttttgagatttgctgatgattcatacatagatagttacataagcaccattggggtagattttaaaatacgcactgtggagcaggatgggaagaccattaaacttcaaatttgggacactgctggacaagaacgatttaggacaatcacta

SEQ ID NO: 24365 - DNA, 409 bp, Gossypium hirsutum
  Clone ID: LIB3272-037-P1-K1-A6
gaaaggccgaacgcaatggaaagaatagaattagatgaagcaatgctacaagggcaagcagagatatggcgttacttgtacagtttcgcagattccatggctcttaagtgtgccgtggagctccgcatagctgacataatacactctaatggtggccccctcactttgtcgcaaatagcttcatgcattaatggtggccttacttcacctgacatcaccacccttgctcgcataatgagattgctcattcgcagaaagattttcaccgtccaccatccttcaaacggtggagatctcttgtacgacctaactcactcatcgagatggcttctacatgattcggagcaaaccctggtgcccatggtattaatggagaaccatccattgcagatggctccttggcactact

SEQ ID NO: 24366 - DNA, 419 bp, Gossypium hirsutum
  Clone ID: LIB3272-037-P1-K1-A7
ctatgtttcatttggaccgtcctatgtacttgctgggatatctttcaagccaaagtcgggtgtatctgatagacaaagagtttaatgttatggggtacacattacttctcagcctaattgagtacaaaactcttgtgatgcgtggagacttggaaagggccaatgaaattttaccttcaattcccaaagagcaccataatagcgtggctcatttcctagaatcacgaggtatgatagaggatgctttagaagtagctacagaccctgattacagatttgagcttgccgtacagcttggtaaattaggtattgctaaggagatagccactgaagttcagagtgagtctaaatggaaagcagtgggagaattagctatgtccactggaaagctacaaatggctgaggaatgcatgaagcat

SEQ ID NO: 24367 - DNA, 416 bp, Gossypium hirsutum
  Clone ID: LIB3272-037-P1-K1-A8
aaaaaagaggtcttccgtctcatattcttcgatcctctggaaagttgtagaccagagcaagaatacattatggctggacatagtgattcaagttcgtctgaaaagaaatcaagtgaagccatgaatgatgtaccgacctttagcacggagaatatgcaaaataacatgaaagttatatattacagccgaacgtttatgtctatcatcggaggagttattgctggaattttagggttcacaggctttatggggtttatcttttattttcttgtcatggcaattacttcaattggactcatagcaaaggcaaagttctcagtccatttatattttgatagctggaaccggattatactcgatggtttcatgggcggtcttatgtcattcgtgctattttggacatttgcctacgacat

SEQ ID NO: 24368 - DNA, 416 bp, Gossypium hirsutum
  Clone ID: LIB3272-037-P1-K1-A9
tgcatggtttctcgcactggaaggcacttgcagcgatacgataacctaggccgccgccaagttgtcggttgcattccctatagatacaaatctagcagtgatggaaccatgactgatgacttggaggtacttgtgatctcctcccagaaatgtcaaaaaatgatgtttcccaagggtggctgggagcttgatgaatctagagaagaagctgcattaagagagtcacttgaagaagctggtgttctaggcaatgttgagtgtgaactggggaagtgggacttcataagcaaaagccatggcacattttatgaaggttatatgttccctttgctagtgaaagaagaacttgatttctggcctgagcaaaatctgagacaaaggacatggatgaatgttaaagaagccagggatgtgtg

SEQ ID NO: 24369 - DNA, 410 bp, Gossypium hirsutum
  Clone ID: LIB3272-037-P1-K1-B1
gaaaatatctcaaatctcctcctcctcctcagaaatcttagtatcatcaccatggcctcaaatcccaaggtcttctttgacatgactatcggtggtcagcccgctggtcggattgtgatggagcttttcgcagattgcactcctcgcactgctgagaacttccgtgccctctgtaccggcgagaaaggcgtcggccgcagcggtaagcccctccactacaaaggctcctctttccatcgtgtgatccctaactttatgtgccaaggaggtgacttcacggccggaaacggtaccggaggtgaatccatctacggatccaagttcgctgacgagaacttcatcaagaagcacactggtcccggtattctctcaatggctaacgctggtcccggaactaacggatctcagtt

SEQ ID NO: 24370 - DNA, 391 bp, Gossypium hirsutum
  Clone ID: LIB3272-037-P1-K1-B10
gggaaagatcgattcatcagtcttcttctctgagtagaggttttggatttgtaagcatttacaatgtcttcgtcctatctcccagcaaccactgactcaattgctctggccttagaagccaaaacaccatctgaagccatctcaatcctttaccgtgtactagaaaatcctgcatctgctcccgatgctctacggattaaagagcaggccataacaaatctatctgatcttcttagacaagagaaccgagcagaggagctcagaagccttctgacccaactgaggcccttttttgcactaattccaaaggcaaaaactgctaaaattgtccgtggtataattgatgatgtagctaagataccaggaacatcagatctccagatttctcttt

SEQ ID NO: 24371 - DNA, 276 bp, Gossypium hirsutum
  Clone ID: LIB3272-037-P1-K1-B11
caaaaaagaaacaaaatacgtttaatttcccaattcccatgctaatttcacactgggaatagcgttaaaaaagagagagagagaaattgcatcaatttcctttttatattggaaaaatagccttaacttggatatggcgacagttggaagacattcctcaatctatagagatctggttgtagttcatatggtatccacatccatgcattggccctgacctatacctgtgttctctagagacaagtgttcccagctcaagttctaaagctccttatc

SEQ ID NO: 24372 - DNA, 409 bp, Gossypium hirsutum
  Clone ID: LIB3272-037-P1-K1-B12
ctcagacttcgatcatcaattttagggttttttctattatttcataatcagattgttgattatccaaaactcaatcttcagatcaggtcttagttttctagttgttgggttctttcgacgagctaagtttcatgtctgatcttgacatccagattcctactgcctttgatccgtttgctgatgcaaatgctgaagactctggtgctggtgccaaggagtatgtgcatattcgtattcagcagcggaatggtaggaaaagcctgaccacggtccaggggttgaaaaaagaattcagctataacaaaattcttaaggacctcaagaaagagttttgttgcaatggcactgtggtccaagaccctgaattaggacaggttattcagcttcaaggcgatcaaagggagaatgt

SEQ ID NO: 24373 - DNA, 416 bp, Gossypium hirsutum
  Clone ID: LIB3272-037-P1-K1-B2
aaagaatcaaatctctgctactgcatagtaaaagagagaaagagcgacaatggaggcagcaagaacagttaaggacgtttcccctcacgatttcgtcaaggcttacgccgcccatctcaagcgctccggcaagatagagcttccttcatggactgatattgacaagccggaaactctaaggactctctccatatgatcctgattggtactatatcagagccgctttcatggcgagggaaatatacccgtggggaggtcttggtgttggtgcctttagaaggatttacggtggggctaagagaaatggaagccgtcctcgccatttctgtaagagcagtggatctgttgctcgccacattcttcaacaattgcagaacgttaacatcattgatattgatcctaaaggtggtaggaga

SEQ ID NO: 24374 - DNA, 421 bp, Gossypium hirsutum
  Clone ID: LIB3272-037-P1-K1-B3
tcgaagccgccccgagaaaggaagcagagggcaagtaaaatgaagaccattctttcttcagagacaatggacatccctgatggggttgctattaaggtgaaggccaagatgatcgaggttgaaggtcccaggggtaagctcatccgtaacttcaagcacctcaacctcgattttcacctcatcaaggacgaggagagcggcaagcgcaagctcaggatcgaggcttggtttggctccagaaagactagcgccgccatccgtactgctctcagccacgttgagaatctcatcaccggcgtcaccaagggttaccgttacaagatgaggtttgtttatgctcattttccgatcaacgcctccatcactaacggcaacaagtccatcgagatccgtaatttccttggcgagaagaaggtgcgaa

SEQ ID NO: 24375 - DNA, 410 bp, Gossypium hirsutum
  Clone ID: LIB3272-037-P1-K1-B4
gctcactctcttattggactgatcgaagtccaagtgcttcttcacttcatcggcgggtattttcagattggtattttacaaattagagataattgtcaaaggatagagccatgagttgttttggctgttgtgaagaagataatatccacaatgccacagacaatggaggccaatacatggttaaaaactcagcaggaaatgttgggggttaccatacatctgaaactgcatcgaagagtgctcaaaccgtgaaggttcagcctattgaagtccctgctattttggcagatgaattgaaggaaatcacagataactatggtaacgatgctttgattggagaaggttcatatggtcgagtttattatggagttcttaaaagtggagaggctgcagcgataaaaaagttagat

SEQ ID NO: 24376 - DNA, 411 bp, Gossypium hirsutum
  Clone ID: LIB3272-037-P1-K1-B5
aattaaacttcaatggtgctcttcgggcttctcctactaccagtcctacttctcctggtcctctacttaatgggtcgggcccggcccattaacatacctattaaaaaccgacacgttttcataacaggcggttcaatgggcattgggctagccatagccaaacaaggctgatcgggaggggggcgtatttcccttttggcttggtccgttgaccagctccaaaaagcaaaggaatcaatctgtcaagcctatgaagtcgaggtctcgatctttagtgctgatgttcgtgactacgatgccgttgagcgtgcgataaacgaggctggcagtatcgatgttctagtagttaaccatggggtgtattacgttgaggagtttgagacccaaggactagatgtgatgaagacgatg

SEQ ID NO: 24377 - DNA, 411 bp, Gossypium hirsutum
  Clone ID: LIB3272-037-P1-K1-B6
ggctggtgtagatggccaactgtgggttttatgtccaatacttttcgttatgcagggttttgaggcatatgttggactgctattgctcaagacagcatttgttggagttgttactgaatggcaggtaatttgttgtgggatacttttggttttgatggctgttggaaactttataaacacaatacagacactcatgacgaaatcaaggtttaaagcaaagatgaaaagatcaaagagcaaggcggagttggattagaatgtccctaattgttaggtaaatcttacatctagttttttagtgtcatttttttttatgtttccagtgtctcatatatgtttgttttagatgaggcaaagtgtttgtttttgaagtattttcattttcacaggcagttttactttatatgaaat

SEQ ID NO: 24378 - DNA, 415 bp, Gossypium hirsutum
  Clone ID: LIB3272-037-P1-K1-B7
gcctcactccgccatcttcaataatttcttccgttgatctttgttagagatgaggggtttaattgttcatgatgggaaagatcaagatcggaatcaatggatttggaaggatcgggcgtttggttgcgagagttgctctccaaagcgatgatattgagctcgttgctgttaacgatcctttcatcaccactgaatacatgacctacatgtttaagtacgacagtgttcacggtcaatggaagcatcatgagcttaaggtggaggactcaaagacccttctctttggtgaaaaggctgtcacatttttcggtatcagataccctgagggaatcccattgtctgaggctggagccgagtgggattctttttatggctaacgctggacccggaacgaacgggtctcagttcatcattt

SEQ ID NO: 24379 - DNA, 287 bp, Gossypium hirsutum
  Clone ID: LIB3272-037-P1-K1-B8
ctcttatactttttttctcttcttgcttatcattttcttcaccaaacattttggtacgaaagtttcaaccattttgatgccataattcattcattttcctggaaaatataaaaaccaagctacattatcaaactgggtcttccttcttttttagaattaaaccagttcctgatctgggttttcacattgagctaacatactttttttttttttttcaaaatggaaaaccaggtttttcttggtgctcaaggaccgccattagactttgggcagtcattatcatcacc

SEQ ID NO: 24380 - DNA, 412 bp, Gossypium hirsutum
  Clone ID: LIB3272-037-P1-K1-B9
caatcatctaaaagaagccctaaaatccttgaatcaggtctgagcttgtgggtgggtaggcctctttgatcaaactaagtttcatgtctgatcttgacgttcaaattcctactgcctttgatccctttgctgatgcaaatgctgaggactcaggtgcgggtgcaaaggagtatgtgcatattcgtattcagcaaaggaatggtcgcaaaagcctgacaactgtccaggggttgaagaaagaattcagctataacaagatacttaaagacctgaagaaggagttttgctgcaatgggaccgtggtccaggaccctgaattaggacaggtgattcaacttcaaggtgaccagcgtaagaatgtatcaaccttccttgttcaggctggcatagtgaagaaggaaaacatcaaaat

SEQ ID NO: 24381 - DNA, 410 bp, Gossypium hirsutum
  Clone ID: LIB3272-037-P1-K1-C1
attttatttttccttttttttttcccacactttttttaaaacccattagctaaaaatgcactgggttctttctgtgttgcttgcagttatcggagttactgcactgctcgttgtaactccggtaagtgggtaccgtccatggccgtacgtaaaacccaacagctccgacttaatgttcggaggctctaagaaatttgagggctcatcggagtttgtacatatgagatatcatatgggtccagtccttactgctcatatcaccatccacccaatctggtacggccggtggcagaaatcacagaagaaaatcatccgtgagttcatcaactcgatctccgccgttgattccaaacacccttcggtggctgggtggtggaagaccgtacagctttacaccgaccaaacgggag

SEQ ID NO: 24382 - DNA, 342 bp, Gossypium hirsutum
  Clone ID: LIB3272-037-P1-K1-C10
ctcatctcttccatttttggcttctctttcagatctcaaagatgtatacatcaaggaagaagatccacaaagataaggatgctgaaccaacagaatttgaggagtctgttgcgcaggcattctttgatttggagaataccaatcaagatctgaaaagtgaccttaaagatctctatattaattcagcagtccaaattgatgtttctgggagccggaaagctgttgttgtccatgtcccatatagattgaggaaagctttccgcaaggttcatgttaagcttgggagggaacttgaaaagaagttcattggcaaagatgtgattcttattgccacccggagga

SEQ ID NO: 24383 - DNA, 305 bp, Gossypium hirsutum
  Clone ID: LIB3272-037-P1-K1-C11
caaaaatacaggcaagatatgtcagtgatccatcgtgaaaacaacttaacccaatcaatcctccatttataggagcctcgatctgaattcattttcaagatcaaaaggaaatgatggatgtgagggtgaagcttttaatccttttggcaacctcactcttgatttactcgctcatagttttactcaaagtcctgtatgactactggtgggtgcctctccgtatacaacacttcttgaattcacaaggacttaaagggcctccttacaagttcatccatggatgcaacaaacaaattaacaaaatg

SEQ ID NO: 24384 - DNA, 381 bp, Gossypium hirsutum
  Clone ID: LIB3272-037-P1-K1-C12
cggttcccaacaattcactgaagcatttcgagcttgaaaatggtaattgctccaaatcatttgaagttaaagatgaaaacggattcacatggccttttcgttgctatgttcgtaacgacggtgcctacaagaagcctgttttatccagcggttggcgtcaatttgtccttaataaaggagttcaccagggggatttgattacactctataaggatgttgaagcagaagcttcgtataagatcgaagttcagagaaaaatcaagttattaggcaaggagtgctggtataatctggaaccagaccaacctacaggcgcatcagcacaagataagagaaaaatcctgttatttggcaaggagtgcggctattttctggaaccag

SEQ ID NO: 24385 - DNA, 371 bp, Gossypium hirsutum
  Clone ID: LIB3272-037-P1-K1-C2
ggaaaacaagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaagatatgcgatgaaagagtcgtcgtcgtcggagacaagggcttattctt

SEQ ID NO: 24386 - DNA, 384 bp, Gossypium hirsutum
  Clone ID: LIB3272-037-P1-K1-C3
attaatggctgcttttatcccattcaagctatcacttcttttgagtctgctctcaaacattggtttcttaccggaaaccagcaagaacaatgttgggatatttccacctacatgtaatcggattaaatgcccaagtttcgatttgattaaagtcggcaatggctatgagattcgtaaatacaactccaccatctgggtgactacttcacctattcaggatatttctcttgttgaggccaccaggactggttttcttcagctatttgactacattcaagggaagaacaaatacaagcaacaaatagagatgacagctccagtcatcactgaagttttaccaagcgatggacccttctgcgagtcatcatttaggattagctttta

SEQ ID NO: 24387 - DNA, 374 bp, Gossypium hirsutum
  unsure (1)..(374): unsure at all n locations
  Clone ID: LIB3272-037-P1-K1-C4
gggtggagggtctatcatccatatcgtggaccacctgaatcttgaggcattgaggggggcagaggtgctgcgggcgctttatgaatcgtctaaaggaattgcacagaaaatgacantnncgggactacgttacatcaggcagattgcccaggagacaagtggtgaggtgggttacagtctcggcaggcagccggctggactcagaacttttagccaaagattaagcagaggcttcaatgatgcaataaatggattcaatgattatggatggtctataatgaattgtgatggaacggaggatgtgataattgcagttaattcaatcaatagctttagtagcacattaaatcctgccaatgctctctcgttccttg

SEQ ID NO: 24388 - DNA, 298 bp, Gossypium hirsutum
  Clone ID: LIB3272-037-P1-K1-C5
attcctgcttctgataagggcagattctttgcttttggtcgtgtcttttctggcaaaggctcaactggattgaaggttaggatcatgggccccaactctatgcccggggagaaaaaaaacacttgtgtgtaaagagtgcgcaaagaactgactttgggatggaaaaagaacagactcttgaagatgtaccttgtggtaacacagttgccatggttggtttggatcagtttatcaccaagaatgctactttgacaaacgagaaggaagttgatgcccacccaattcgtgcaatgaagtt

SEQ ID NO: 24389 - DNA, 409 bp, Gossypium hirsutum
  Clone ID: LIB3272-037-P1-K1-C6
cttttcttctcttgtgacactgctaatattttttattgtcgtctccggcgttcgaagatcataaaaaaccggagtcgtttcaaatggctacgagaacggatctagatgggaggccaataaagccgatgacgatatgcatgatcggtgccggaggcttcatcggctcccacctttgcgagaaattgatgtcggagacgccgcacaaggtgctcgccttggacgtttacaatgacaagatcaagcacctcctcgagcctgactctctcccttgggctggccgtattcagttccaccgacttaacatcaagcacgattctaggctcgaaggcctcatcaagatggcagatctcgtgataaatcttgctgccatctgtactccggcagattataatacgcgtccactagacac

SEQ ID NO: 24390 - DNA, 415 bp, Gossypium hirsutum
  Clone ID: LIB3272-037-P1-K1-C7
ctcgactctgtctcctccatcgctctttttcatcgatcagatctcttcaaacccatgtgtcaaaacaaccctgcactcattccatccatgacgcttggctcaggaggatccagtgttgtggtgcctcggaacttcagattgctggaggagcttgagcgtggagaaaaaggtattggagatggtactgtcagctatggaatggatgacggagatgacatttacatgcgctcttggactggcaccattattggtcctcataatactgtacatgaaggtcgaatctatcagctgaagctgttctgtgataaagattatccagagaagccaccaagcgtccgttttcattcaagaatcaacatgacttgggttaaccacgaaactggagtgggggaaccaaagaagtttggacttcttg

SEQ ID NO: 24391 - DNA, 381 bp, Gossypium hirsutum
  Clone ID: LIB3272-037-P1-K1-C9
aaacaaacaaaggggcagtttaaaaagatatcattgggcggtctaacaatggcagaggcggcatacatcggggtcgagaccatcaaccgtgattgtcacgattttaagtctcttttctattgttcagacagggattttctcgttcgcaacaacggtgatcaggttaaaatctatagcttgaatgggaagaacgtcggattgtctttatcagcatcttgccgcggtccatgccgttgattcaccccacatttaatcgaggtgtacaccgtgctctcaccgtacggcgatctcgaggtcttttttatttctgcagatcaagatgcagagtcattcaatggttacttatacaagattccatgggtggcaatacctttttctgat

SEQ ID NO: 24392 - DNA, 381 bp, Gossypium hirsutum
  Clone ID: LIB3272-037-P1-K1-D1
gtgatttcttcatctatttaatttgtatctataaaatttatatttctttattttctcatagcaataaaaccttgttcaaaaaaaaaaaaaaaggcaataaaacccttcaattttcactcccattaatcctaacatggctgtcacgtcttacataatctcatgatttaccataccattgaaacccactgcttcttcttcaagctcggagaatagtagcaccctatgtttagttaagaaaccactcacttcttccttctctaatggcgaaagtactttcctaaaacttacaaggataaggagtgttcctggaagatctcattgttacagacaaataggaggtgccccttatacgcccatgaacctttttgatcggtttgctag

SEQ ID NO: 24393 - DNA, 407 bp, Gossypium hirsutum
  Clone ID: LIB3272-037-P1-K1-D11
tggcggagcagcagcaactagagccatggaccgacctcagtggcaaagtggtgatggtgacgggggcatcttctggtttaggtcgtgacttttgtcttgacttgagtaaagccggctgtcgtatcgtggctgccgcgcgccgcgtcgatcgccttaaatccctctgtgatgaaatcaatcacctcacctttcctttttccggaccccagcctagtggccctcgagctttcgctgtcgagctcgacgtatgtgctgacggatccaccatacagagctctgtgaaagcggcctgggatgcctttgggaggatcgatgctttaataaataacgctggcgttagaggtaatgtgaaggatcctttggaattgactgaggaggaatggaatcaaaacatcaagaccaatcta

SEQ ID NO: 24394 - DNA, 413 bp, Gossypium hirsutum
  Clone ID: LIB3272-037-P1-K1-D2
gaagatcttgactgagagagggtactctttcacaacaactgcggagcgagaaattggtcgtgatatgaaagaaaaacttgcttacgttgctcttgattttgagcaagaattggagactgccaagagtagctctgccatcgaaaagagttatgaattgcctgatgggcaagtgatcacaataggggcggagaggttccgttgtccagaagtactcttccagccatctctgattggaatggaagctgctggaatccatgaaactacttacaactccatcatgaagtgtgatgttgatattaggaaggatctttacggaaacattgtgcttagtggtggatcgaccatgttccctggcattgctgataggatgagcaaggaaatcactgcacttgcccctagcagcatgaagatca

SEQ ID NO: 24395 - DNA, 413 bp, Gossypium hirsutum
  Clone ID: LIB3272-037-P1-K1-D4
cttcaaccaaatcgaagctggggtttgcaaggaggtttaaaacgaccatgaccacggttgttcccaccttcggagaagatcccgtccttcccgttgtccgattcacgggcgacctctcttgggctgatgccggtcctgaggttgcggaaccgcaagtgacgagtctttgtatggaagcgcaagagtgtatggggatgggaagatgggtggatttggcttctttaatgcttacttctgctgagttggtctttcccaaggcgtctgataaagatctcgaatgtatcttcactgttatctggaatctagcctcaaagctcgaaaatccagatgatgaacttgagatggcaaagctcatatctacaaaaatcagggaacaaccaaatgataagcctgcaatgcgtttaaagatcttg

SEQ ID NO: 24396 - DNA, 415 bp, Gossypium hirsutum
  Clone ID: LIB3272-037-P1-K1-D5
atttatttcactacccaacaacccaaaagataaaaggaatcgtttacttgttcgtagcaatttatcgtcatttcaagctcaattctctgaaaatttttgtgctgaacttcttttttctctttgtaccaccatgtgtggaggtgctattatctccgatttcataccgccgtcgcggtcgcgacgattgacggccgatttcttgtggcccgatctgaaaaaatccgggttgaagaaggggtcgggtaagagatactcgaagcccgtgatcgacttgggcgatgatttcgagactgactttcaggagttcaaagatgaagaatctgatatagatgattatgatgttgatgatgttttggctgatgtaaagccctttgcttttaacgctacaaagaaacctgcttctgctgtatctcat

SEQ ID NO: 24397 - DNA, 408 bp, Gossypium hirsutum
  Clone ID: LIB3272-037-P1-K1-D6
gcgctttgctttctctctctttttatggatgggatcatctcctttccttctccttcgtgaaggctacgatttgaagactgtttttgatttccattagcatgcgaattaggccttttcgttataattcatcgcctgaaatatctgttatcgaatacgcttctacttttttttgtttcctgattttgattttagtgataacaactggaaattttgaatgctcgagctgtaatatgggatatttgaattcggttttgcaatcttcaagtcaggttcatgctgaatatggaccggttagcggcggaggccttagccagaatggaaagtttagctacggctgtgcaagctctcctggaaagaggtcttcaatggaagatttttatgaaacaaggattgacggtgttgatggag

SEQ ID NO: 24398 - DNA, 322 bp, Gossypium hirsutum
  Clone ID: LIB3272-037-P1-K1-D7
ggcctctcactgttttccttcaaaaccctaatagctgttcctcgcctcctgaacgggttcaaaattggccggttctgagggattgactttacggggaacattccttcccacaacggcctggggaccagccattgctactccaatcgataactccgacatgatcgtcacttcctcccgcgacaaatccatcatcctttggcacttaaccaaggacgaaaagacctacggtgtccttcgtcgtcgtctcaccggtcactctaacttcgtccaagacgttgtcctctcttccgattctaagttcgctctctctggttcctgggat

SEQ ID NO: 24399 - DNA, 389 bp, Gossypium hirsutum
  Clone ID: LIB3272-037-P1-K1-D9
catctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctattgatgttgacattggtgccaatccttcagccgaagatgctgatgaggatgaaggtgttgatgaccaatctgtgaaggttgttgacattgttgacactttcaggcttcaggagcaaccccctttcgacaagaagcagtttgtcgtgttcatgaagaagttcatcaagaacttgacaccgaaactggatgcggaaaagcaagagtccttcaagaaaaacat

SEQ ID NO: 24400 - DNA, 415 bp, Gossypium hirsutum
  Clone ID: LIB3272-037-P1-K1-E10
agaagcccttgatctccgaggaaaggctgctgtagcacaagcagctctggcatataggctctaccagaagaaattctccggtccaagatgggaggctttggtgaaaaagggtgccaagaaacagaggttgctctgggcttcaactagtgtcaagaaccctgcctaccctgacaccctatatgttgctcctctcattggacctgacacggtctcaaccatgcctgaccaagcactccaagccttcatagaccatggcacagtttcaaggacgattgacgcaaacgtgtctgaagctgaaggcatctatagtgcacttgagaagttggggattgactggggcaaagtcggttcacagcttgaagacgagggagtggagtctttcaagaagagctttgacagccttctcgacacattg

SEQ ID NO: 24401 - DNA, 393 bp, Gossypium hirsutum
  Clone ID: LIB3272-037-P1-K1-E11
aatttgctttgaagatcatgttggctatttttcacaaggcatttgctaatccaccagaggagctgaatagtccagcttctcataaatctactaagaagcctaaacagcctgaagaaaccctaaatgatttcctatctcatcaccctcacaacactttctccatgagctttggcaacgctgctgttttggcttatgtccgccatgaacgtgctgcttcagttcatcagaggttgttttgtgggtttgatgacatatactgccttttcttagggagcttgaacaatctatttatgctgaatagacagtatggtctttccaaagggagcaatgaggcgatgtttgtgattgaagcatataggacactaagggataggggtccataccctgctgatc

SEQ ID NO: 24402 - DNA, 360 bp, Gossypium hirsutum
  Clone ID: LIB3272-037-P1-K1-E12
gttcttcaggcatcatactttctcatccattacctattcgcaagccaaaccgggcatgtaggagcattatactctgctttccttgctatgcacttggcggccggagtacctggtgtattagcagtgttggctctcggttacaataccaacctttttggttccataacacattatagcagcggtcaggcggccgtctactatggagccggatatatggagctaccagacgtattcaaaatgggttttgtaatggccattgttaatgccattgtatggggaggtgttggaactttatggtggaaatttttaggcatctactgatttcccagttttaaacttccccccccccaccctatcaag

SEQ ID NO: 24403 - DNA, 412 bp, Gossypium hirsutum
  Clone ID: LIB3272-037-P1-K1-E2
gaattccacagatcaaatccttacgtgacaggttggataattgggtaggcaaagtacaaaccgcttggttatcaatcgaagctgaaacacctgatcttgttgcagcatgaattttttctcccctcaagttcctttctgcccattgtaacaatttcgttattggaaaaaaaaaagaaaaaaaagagaagttaatggtgagcaatgaggatagagacaagtgtaagtgatgtggggatattagttgatagttgatcctggaattattctattcttgtggaaggagtgtcccctcctttatactttctttttcacgtttggtcatttgttggatatttacagtggcatatatgccttaggatacttgttaaacttgagaatagctagcttccttctcttttttaactttgtattg

SEQ ID NO: 24404 - DNA, 329 bp, Gossypium hirsutum
  Clone ID: LIB3272-037-P1-K1-E3
caatttgaagccacctgcctgcccctttctcaattcgccggaatgaagctcatcatggggaccctaaaaggcgggcactttgaaattagggttcagcccaatgataccgttatggctgtgaagaaaaacatagaggatatacaagggaaagacaattatccatgtgggcaacagctgttgattcataatgggaaggtttcgaaagatgaaactactttagctgaaaataaagtatctgaggatggttttctggttggcatgcttagcatgatcaagcatttggtgtcaactggagcgtagtttgctcatcctgcttcatcatttgcatc

SEQ ID NO: 24405 - DNA, 412 bp, Gossypium hirsutum
  Clone ID: LIB3272-037-P1-K1-E4
gttttccttactaccaaatgttattcctcagccatttctctctgtaaatttgagtgtatgtaattctgtatatagattatgattgattcctattgatacataattggtttcgggatggctacttataccccgaagaacattctcataactggggctgctgggtctattgcatcggatggtgccaatcggattgtcctcaactacccagactacaagattgttgtacttgacacgcttgattactgctcatatttgaaaaacctcattccctctgagtcatcgcctaactttaagtgtgagaaaggggatattggtagtgctgaccttgttaactacctcctcattactgagtctattgacacaataatgcactttgcatcccaaactcatgttgataactcgtttgggaaca

SEQ ID NO: 24406 - DNA, 418 bp, Gossypium hirsutum
  Clone ID: LIB3272-037-P1-K1-E6
tccacttcttctcttatttgaactcaaagtcccagctaatattagaatcatgggtggtgtcacttatgactatgagaatacctccccagtcgcccctgccaggcttttcaaggcctttactgttgaagctccgaaagtttggcccacggctgcacctaatgcagtaaagagccttgaggttgaagctaatcctagctctggaagtatcgtaaaaatcaactttgttgaaggccttccattccaatatatgaagcaccagatcggaggacatgatgaaagtaatttttcatacagttacgatttaatcgaaggtgggcctttgggggataagcttgaaaaaattagctatgagaacaggtttgaggcagctgcaggtggagggagtatttgcaagagctcaatgaaattctacactata

SEQ ID NO: 24407 - DNA, 343 bp, Gossypium hirsutum
  Clone ID: LIB3272-037-P1-K1-E7
ctcctgagtacggtttcatccaccatcttttttccttcattcaacctgtgtctgcggcccataatataatgctacaacatgttttcgacttgctagaactgcgagttttcacatagtatggcccaaaggtaaaaaataaattggtgggtgacacatcgaggcttggcattggtggtggtcaaatagatgggaaggcggtgcagacattacaaaagagctttgttcaggttcagaatatattggaccaaaagcggctgctcatcaacgaggttaaccagaaccatgagtccacgatccctgacaactcgagaaggaatgttggcctgattaatgagctcaacaa

SEQ ID NO: 24408 - DNA, 409 bp, Gossypium hirsutum
  Clone ID: LIB3272-037-P1-K1-E8
tccctctcttcttaggtctgctgtatcttagttcttgattaattagccaatcacagcagccatgtctctcctcaatgatctcatcaacctcaacctcagcgacaccactgaaaagatcatagccgaatacatatggatcggtggatctggtatggatctgagaagcaaagcaaggactttgcctggaccagtgacggacccttcaaaactcccgaagtggaactacgatggttccagtaccaatcaagcacctggagatgacagtgaggtcattctttatcctcaagctatattcaaggatccatttagaaaaggaaacaacatcttggtgatgtgcgatgcttacacaccagccggcgaacccattcctaccaacaagagatttaatgcggccaagatctttagccac

SEQ ID NO: 24409 - DNA, 357 bp, Gossypium hirsutum
  Clone ID: LIB3272-037-P1-K1-E9
agagaagccatcggtcaatcagttcgcatacgtggaccctgttcctacgtctatagatgctggatttaatcaatcagataatgcccccttgtacttcaattcagaccagggaagtaactcgatcaattgttccgactatggctggggagaacagggtgccaaaactcctgaaatatcatccattcttgaagcttctgtagagggtgatgagtttcttgaggatgctaaccctagcaagaagctgaaaccaagttccgacaatgttatgcctgccgaagacaactccgcgaagaccttgtcggacgagctgttggctttggacaaccagatgaaatacttccaaatgcggcatttatt

SEQ ID NO: 24410 - DNA, 415 bp, Gossypium hirsutum
  Clone ID: LIB3272-037-P1-K1-F10
caggccctcatttttgtcacaaggtctcgcagctggtcctactttgaacgccctggacttctactagtcagtgcctttctagttgctcagttggtggccactttaatagctgtgtatgcagactgggggtttgcaaggattaaaggtatgggttggggatgggctggtgtaatctggctatacagtgtggtgacttttatcccactggattttatcaaatttgcaatccgctatgttcttagtggaaaggcttgggataaccttttggagaacaagactgccttcactacgaagaaagattacgggaaagaggaaagggaagcacaatgggcagctgcgcagaggactctgcatggccttcaaccacctgaaaccacaagcattttcaatgaaaggagcagttacagggaacttt

SEQ ID NO: 24411 - DNA, 401 bp, Gossypium hirsutum
  unsure (1)..(401): unsure at all n locations
  Clone ID: LIB3272-037-P1-K1-F11
gcaactttgacgcagctgctatttcttttttgtggttttcagcagcagcttgtatttggaagaatggtgagggtgagcgttttgaatgatgcactcaagagcatgtacaatgcagagaagaggggcaaacgacaggtcatgatccgaccgtcctcgaaggtgatcattaatttccttttggtcatgcagaaacatggttatattggggagtttgagtatgttgatgatcatagatctggtaaaattgtggttgaattgaatgggaggctgaacaagtgtggggtgatcagtcctcgttttgatgtcngtgttaaggagattgagggttggactgctcggttgcttacttcaagacagttntgttatattgtgctcacaacatcagctggaattatggacca

SEQ ID NO: 24412 - DNA, 409 bp, Gossypium hirsutum
  Clone ID: LIB3272-037-P1-K1-F12
ctcaaacaatggaagtggtgaagaacttggacatccaaagatacatgggaaagtggtacgagatagcttccttcccatctttctttcaacctaagaagggggagaacaccagcgctttttacactctgaaggaagatgggacggtgcatgtgcttaatgagacttttgttaatggcaagaaagattccatagaaggcaccgcctacaaggctgatcccaagagtgacgaagccaagctcaaagtcaaattctacgttcctcctttcttgcctatcattcctgttactggggattactgggttttatacattgatgaggattatcaatatgttcttggtgggggtcctaccaagaagtacctttggatattatgcaggcagaaacatatggatgaaaaaatctacaacat

SEQ ID NO: 24413 - DNA, 371 bp, Gossypium hirsutum
  Clone ID: LIB3272-037-P1-K1-F2
tttatgtttacagcttactctctctttttatctgtttttatttaagagattattacggagattttttttataaaaaaaccagtttactgctcttatacagttatacttatgaagttgagcagcaaaagagaaaaatggaaaaaggagggataattggtgtggagaaaagaatgagaaaaggttaaaagctttgttggacttttttttcttttcatttatttgatttggatttgtgatatgaataatggatttctcggttctttttaaaaaagatctgattttagctgttgggatgcgcttctgagtgtttaaaagacaggggcatggccggaagtaatgaagtcaacctcaatgagtgcatgatggtggct

SEQ ID NO: 24414 - DNA, 384 bp, Gossypium hirsutum
  Clone ID: LIB3272-037-P1-K1-F3
gcggcttctgcttctatttacaatcttctcactctcctgctcctttctggcatcccttttaccttctccgagctcgttaaagagcagcctctggtgttgaaataccacaatgggccactcttgaaggggaagatcactgttaatctcatttggtacgggaagttctccccaacccaacgctccataatcgtcgatttcatcaactctttgagctccgccgtcaaacccaaggttccgtcggcgtcgttttggtggaaaacgacggagaaatacaagtccggttcctccactttggtcgtgggcaaacaaatcctgctcgaaaattacccgctcggtaaaatccttaagaacccacacttgccggcgttggccgggaaattcaac

SEQ ID NO: 24415 - DNA, 418 bp, Gossypium hirsutum
  Clone ID: LIB3272-037-P1-K1-F4
ttttcttgttccttccttcgccgtctattgcttttagttgcctcgatttcaagtgaatcagaatgggtaaggaaaagactcacattaacattgtggtcatcggccacgtcgattctgggaaatcaaccaccactggccacctgatttacaagcttggtggtattgacaagcgtgtgattgaaaggttcgagaaagaagctgctgagatgaacaagaggtcattcaagtatgcttgggtgcttgacaagctcaaggctgagcgtgagcgtggtatcaccattgatattgccttgtggaaatttgagaccaccaaatactactgcactgtgattgatgcacctggacaccgtgactttatcaagaatatgattactggtacgtcacaggctgactgtgctgttttgattattgattccac

SEQ ID NO: 24416 - DNA, 417 bp, Gossypium hirsutum
  Clone ID: LIB3272-037-P1-K1-F5
ttcatactcatttagcccctttcattagcatcgaaatcactccagttttctttatcactgaaaaatgtcttgctgtggtggaaactgtggctgcggttctggctgcaagtgtggcagtggctgtggaggatgcaagatgtacccagacctgaacgttgccgagatgaccacaactgagactctggttcttggtgtagcaccccagaaagcacactttgagggagctgagatggaattcggggctgagaacggctgcaagtgtggagacaactgcacctgcaacccttgcaattgtaaatgattagagaccaaagccaaagctccctggaagcagagacgcctttgtctttaagaaataatatgttttgttgtttatgtgtttttagaataaagtagccatggcttgtcgtaggtttt

SEQ ID NO: 24417 - DNA, 416 bp, Gossypium hirsutum
  Clone ID: LIB3272-037-P1-K1-F6
catagcagccatggcagtccgtatgcttcttgggttaggtgtcctgctactctgccttgcaaaggtttcatctgatctgaaggcagaagaagttataaccaatgtcggtgaggtgggttctttggttaccagaggcggaaacagaagactgatgctagagattgattgtggaggattatgcaagaaaagatgcagtcaacactcgaggccaaacagatgcaacagggcgtgtgggacttgctgcttgaggtgcaagtgcgtgccaccggggacttcagggaacagggaggtctgcgggacctgctatactggcatgaccacccatggaaacgttgccaagtgcccttaacctttacgtcgcccaatatgtgttgcagccatcaaggggaaaaatgaaatgtttgtttgtgtaatat

SEQ ID NO: 24418 - DNA, 398 bp, Gossypium hirsutum
  Clone ID: LIB3272-037-P1-K1-F7
ctttatatctctgcttaaccctttctcccccaccttcgaatcaaccaaacttgccatttggctatcttcaagtgctctctcataataaactaaagaaccaaaaaaaaaatggttaaagttgcaggtgttttggtttgtcttttgattgtgggcatggatgttggagcagggatacttggcatccaagctgaagctgcacaaaacaaggttaagcacctgcggctgtggatatttgagtgcagagacccgagccatgatgctttcaagctagcgttgggtgcagcaacgttgctgacactatcccacgtacttgctaacctgcttggtgggtgcatgtgtgtttgttctcaagaagagtttcagagctcttccactaacaggcaactctctgtcgcatg

SEQ ID NO: 24419 - DNA, 407 bp, Gossypium hirsutum
  Clone ID: LIB3272-037-P1-K1-F8
gataaactgacaatatctgagtcaaacaatggaggactctggagatagcatcagggggaaagggttggaaggcacaggcttggatctgccacccaataagcatggcaatttgaagagtgcttccagcgatgaaaaccttaagcacattcttcttcgtgtcaaaacctctaaaactcctgtgcggtgtttgtagccagattcttcctgcattttgcaagttgagcaaccagttcccaaacttatcattcgtgtatgctgatattgatgaatgtcctgaaacaacgcagcatattcgtgacacttctacgtttcatttttatcgagatggtgaaagagtggacgagatgttcggtgctggggaagagcggcttcatgatcgcttgtggtacattcctgaacaaccccat

SEQ ID NO: 24420 - DNA, 373 bp, Gossypium hirsutum
  Clone ID: LIB3272-037-P1-K1-F9
tcttatttgaactcaaagtcccagctaatattagaatcatgggtgttgtcacttatgactatgagaatacctccccagtcgcccctgccaggcttttcaaggcctttactgttgaagctccgaaagtttggcccacggctgcacctaatgcagtaaagagccttgaggttgaagctaatcctagctctggaagtatcgtaaaaatcaactttgttgaaggccttccattccaatatatgaagcaccagatcggaggacatgatgaaagtaatttttcatacagttacgatttaatcgaaggtgggcctttgggggataagcttgaaaaaattagctatgagaacaggtttgaggcagctgcaagtggagggag

SEQ ID NO: 24421 - DNA, 411 bp, Gossypium hirsutum
  Clone ID: LIB3272-037-P1-K1-G1
aaaagctgtatgttccttccccattgctatttccttttattaactattaaaaccaaaattttttttgtcaaaaacgttttaaccttttattttttttaaaaagccctaaaagctttatgaaattctctcttctccctcattctcccctttgccttccagccgaaaaggccaccaatggctcacccaaccgccgccgtgactccggtgctgtgagatcgtggaggaggagcgaacatgggcgtgcaacacgtgagttggtgcgctgatggaggacaacatggttcgtgggtgcaaacatgggcacggaggccgtgggacttgcgacggctgaaattagcctagggtttcccttgtcttctgattgcttaggttttgggccataagtattgggctgctgtaattgggtcttta

SEQ ID NO: 24422 - DNA, 410 bp, Gossypium hirsutum
  Clone ID: LIB3272-037-P1-K1-G10
gtaggtgccgactgctccgttctttgtagcaaagcaaagtttgtgaagcatggccgtcgggaagaacaagaggatttccaagggaaagaagggaggaaagaagaaggcagcggatccttttgctaagaaggattggtacgatatcaaggctccttcagttttcactaccagaaatgtggggaaaactctcgtctcccgtactcagggtaccaagattgcttctgaaggactcaaacaccgtgtgtttgaggttttccttgctgatcttcaaggtggtgatgaggatcatgcttacagaaagattcgtttgagagctgaagatgttcaaagaaaaaatgttttgaccaacttttggggaatgaattttacaactgacaggctgaggtctttggtccgtaaatggcaaaccc

SEQ ID NO: 24423 - DNA, 418 bp, Gossypium hirsutum
  Clone ID: LIB3272-037-P1-K1-G11
atatcctctgacctcacggagcttggaaggacaccagtagcagtcgtttctgctggtgtaaaatctatattagatattccgaggacactggaatatttggaaactcagggagtttgtgttgctgcttacaagaccaatgagtttccagctttttttactgaaacaagtggctgcaaggtgccttgtcggttaggtagcccaaaagaatgtgcacagttaattgatgcaaacaggaagcttaatctcggaaatggagtactgattgcggttcccatcgcaaaagaatactcagcttctggaagcttaatagagtctgcaatacaacaagctcttacagaagccagggaaaagaacataacagggaatgctgagactccattcttgctcgctagggttaatgaaataactggaggagcat

SEQ ID NO: 24424 - DNA, 414 bp, Gossypium hirsutum
  Clone ID: LIB3272-037-P1-K1-G12
aaagagcaggaaaacaagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaagatatgcgatgaaagagtcgtcgtcgtcggagacaagggcttattcttcagcttgggcgcctgaccctgttacggtgtattac

SEQ ID NO: 24425 - DNA, 402 bp, Gossypium hirsutum
  Clone ID: LIB3272-037-P1-K1-G2
cctgaaatgccggcagtacaggtggtcatattaaccctgctgtgacctttggattgtttctagcaaggaaactgtcacttacaagggcattgttctatatgatcatgcagtgcctgggtgctatctgtggagctggtgtggtgaagggattccaaggagataaccgatatgagatgttgggtggtggagctaatgttgtgaaccatggctacactaagggtgatggtcttggtgctgagataattgggacttttgtgcttgtttacactgttttctctgctactgatgctaagagaaatgccagagactcccatgttcctatcttggctccacttccgattgggtttgcagtgttcttggttcatttggccaccattcccatcactgggaactgtattaacc

SEQ ID NO: 24426 - DNA, 407 bp, Gossypium hirsutum
  Clone ID: LIB3272-037-P1-K1-G3
ctttctctttagtttacgtttattgtccttttggaatttttgatactaaaaaaaggaagcaacgaagaagggaaatggagggcaaagaagaggatgttagattgggagccaacaagttcacagagaggcaaccaattgggaccgcggctcagagtcaagatgacgggaaagactacactgaaccaccaccggctccatttttcgagcctggcgagttaacctcatggtctttttatagggctgggattgccgagtttgtggcgactttccttttcttgtatatcactattttgactgttatgggagttgttaaggaaaaaactaagtgcccaactgttgggattcaaggaattgcttgggcttttggtggtatgatctttgctcttgtttactgcactgctggcatt

SEQ ID NO: 24427 - DNA, 418 bp, Gossypium hirsutum
  Clone ID: LIB3272-037-P1-K1-G4
gcgtaacgaccttgtaaacactcaaaacgctattgccagcaaacaccgcagaatcccacgcgccacctttttccaccgatctcactcgctacccatggcgtcccccgcgaccattccgatgacgacgtctcaatctacggtcggtggtggtacccaatcacagcccccgatagccacgcctgcgtttagggcgttcctctcgcgcttcacgtcctcgatccgtcaaggactctcccaacgccgtccatgttatgaactcattgatcggtccgccatggcccgtcccgataatctaactgatgcctattcccggatccgcaaaaacctctcttacttcaaagtcaattatataactctactagtggttgtgctcgccttttctatcctatcgcatcccctctctctcctcgtcctcctc

SEQ ID NO: 24428 - DNA, 401 bp, Gossypium hirsutum
  Clone ID: LIB3272-037-P1-K1-G7
gattattcatattattattcctttcttcttctttcattctcaacaatctcttcccgctcttcttccataatactctttctcttcatatataatctttattttcaaacaccctaaatttacaaccacatattccagagaggatttttttttaaaaaatggtgatgaagttaccttatctgggttcttgtttgtttttggttttttttagtttggtttctattgttgcttctgggtctggaaaagggctcccaattctttcattcgatgaaggatataatcagttgtttggggatgataatctagttatccatagagatggtaaagctgttcacttgtctttgaacgaaagaacagggtcggggtttgtgtcacaagacctttacttgcatggttacttcagt

SEQ ID NO: 24429 - DNA, 407 bp, Gossypium hirsutum
  Clone ID: LIB3272-037-P1-K1-G8
accagttattccaggatgctttcttcgcgctaaagctataggtctgatgcctatgattgatcagggtgagaaagatgacaagattattgctgtctgtgccgatgatcctgagtatcgtcactacaatgatatcaaggaactcccacctcaccgcctggctgaaatccgtcgcttctttgaagactataagaagaatgagaacaaagaagttgctgttaatgactttctgcctgcctctactgcatacgaggcaatccaacactccttgaatctctacgcggactacatagtggagagcttgaggcggtaattgtcggttcaccgtgccccgtctatatacaaatatatatattaatatgaatatgaatatgttgctactatacaagaaattcatcgtctccttgtgc

SEQ ID NO: 24430 - DNA, 380 bp, Gossypium hirsutum
  Clone ID: LIB3272-037-P1-K1-G9
acagcctatacgaaccccaagagctcctcatctctttgtttttaccttccatttgaactcaagttcgtcgtcgttttctactctttagccatcaaagatgaccaccatggaaagcttaatcggtttagttaacaggatccaacgagcatgtacggtgctcggtgattacggtggcggcgacaacactttctcttccctttgggaagctcttccttccgttgccgtcgtcggtggtcagagttcagggaagtcttcggtgcttgaaagcatagtcggacgtgattttcttcctagaggatcaggaattgtgacgagacggcctttggtgttgcaacttcataagacagacgaaggttcacaagagtatgctgagtttcttc

SEQ ID NO: 24431 - DNA, 348 bp, Gossypium hirsutum
  Clone ID: LIB3272-037-P1-K1-H1
cactcatctaaagtgtgatgcagcctcgccgaccgtgttcattctaaatgcgaaagccagtacaatccatagatgtaagaacaacatttatatgcttgtagcaccgactcatatgtttccattcccggttaaagccatgattgtccctatgagctttacagcccaaaatctggtttgccgggatactacaccgatcatcgacgaactctctctcgatctcacctaagatctgccgatgatcgaaaatttataaatatcccgacaacaacaaagatgaagagagaagacacagtgaaactcatcagcgctgaaggaatggaatgcgtcatcgacatagaagctgatatg

SEQ ID NO: 24432 - DNA, 414 bp, Gossypium hirsutum
  Clone ID: LIB3272-037-P1-K1-H10
caagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaagatatgcgatgaaagagtcgtcgtcgtcggagacaagggcttattcttcagcttgggcgcctgaccctgttacggtgtattaccggccggagaactg

SEQ ID NO: 24433 - DNA, 206 bp, Gossypium hirsutum
  Clone ID: LIB3272-037-P1-K1-H11
ggggcgcatggctaccgttagtagtttcgctggtccagacacaggcactggaaggagaccaaatcccacagcttatattgtgatgacctcgagatactcgaggattcgtgttctcatcaaaagttgcggcacagaggatgacaggttgcggtgccgatgaagtgggctcacaacactacgttgggggagcgggttaaatgtgcggt

SEQ ID NO: 24434 - DNA, 341 bp, Gossypium hirsutum
  Clone ID: LIB3272-037-P1-K1-H12
cctctctcaacctggctagcaattttcttgcttctcatcttccatggaaacctttcttgatttaaccttattgtttcatactttaacatgttataatagcaacaaaagctttctctcgagatgctggtctttcccagagcatgaaaatgacagctccaaggcaccagattgcgagagaactctttgttttgatcgttcaagcaatggagtttcgagtttatcggcgaagaaagaagatggtgtgagaattcataggaaagacgtgcaaaaattgatgggaaatctggggattttttgcgaccaagaaaagtagcaaccgaatgaatcattcggttttaatg

SEQ ID NO: 24435 - DNA, 224 bp, Gossypium hirsutum
  unsure (1)..(224): unsure at all n locations
  Clone ID: LIB3272-037-P1-K1-H2
gagagctctaccggcatgggcagatgacctgcagggtgctatgctaaggtgaaagacatagcttacccaaacagacgttgttgtcgctgagtttctcatcccatgttttggaaatatgatgcgggcatgaaacagtacggcgtcgtttattagcatgtcagagatcaacttggctcgntgctggaaggaactttgagtctacgttgaagctctgtgaatgctga

SEQ ID NO: 24436 - DNA, 409 bp, Gossypium hirsutum
  Clone ID: LIB3272-037-P1-K1-H3
gcgtctctctcttcatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctattgatgttgacattggtgccaatccttcagccgaagatgctgatgaggatgaaggtgttgatgaccaatctgagaaggcagttgacattgttgacactttcaggcttcaggagcaaccccctttcgacaagaagcagtttgtcgtgttcatgaagaagttcatcaagaacttgacaccgaaactggatgcggaaaagcaagagtccttcaagaaaaacattgaggga

SEQ ID NO: 24437 - DNA, 418 bp, Gossypium hirsutum
  Clone ID: LIB3272-037-P1-K1-H4
cgaacatttgagaccatttctggtgttttagggtttgatcacagtgagaaagaccgatgggaggtggccatggagggagcacaacttacaaaggtgtaaatttgcaccacccaaagagatggcacgtcgccaccggcaagggcttgtgcgctgtcatgtggttttgggtcctgtacagggctaagcaggatggtcccgtagtgttgggttggcgacacccttgggagggccatgatgaccattctcatggccatggagacaagcattagcctgaagaagcttatctgcttatgggtgcgtggcacagatgctgttctggaatgtcttctgtttattttcttcggtgtcaataaagtgatggtgaaatgggattgtaagcataatgaaatgaaaactgaaacttcatttatgcattatg

SEQ ID NO: 24438 - DNA, 422 bp, Gossypium hirsutum
  Clone ID: LIB3272-037-P1-K1-H5
aaaacagagcatccactctttttttcttgagtttcctttgtaaattagttcaagctggcgatcgaaaataaagaaaccactgttcgttaaatcaagcccaagaacagaaggataatgggagctggtgggcctgatgaagaagataacaggtggccgccatggttgaaacctttgctgaaagaacagttctttgttcagtgtaaacatcatgttgattttcacaagagtgaatgcaatatgttctgcttggattgcgttaatggcgctctctgttctttctgcttagcttatcacaaggatcatcgttatatccagataaggaggtcttcataccatgatgtgataagagtatctgagatacaaaaatacctagacatatctggagtccaaacttatataatcaacagtgctaagatcgtttt

SEQ ID NO: 24439 - DNA, 346 bp, Gossypium hirsutum
  Clone ID: LIB3272-037-P1-K1-H6
tcgcctctctaaacctggctagcaattatatcgctgatgaggaacattgatgttgagttgggttctgatcatctgcctctccctagtagcagtgcagagccaatactactgggagaccctaccatatcgtcccaggccaggtaaggtcaccaatcttcacttctttatgcacgaatttacgggtattacagcagtccaggtagcccaagttaacatcacaagcagcgacaataattcatcagtgccatttgcctgcctagttgccgttaatgatcccctcaggactggtcctgagcctgactcggagctgattggaaatgttcagggtattgcgctcctggctgga

SEQ ID NO: 24440 - DNA, 391 bp, Gossypium hirsutum
  Clone ID: LIB3272-037-P1-K1-H7
gattaatacctccaccctaccgtgctcgtgcttactacttccattattcctgctatttctgctctggaaatcttctaggccagaagctaagctaagctaaacctgacttctaagacatggatcttcttcactcctttagctcattagctcttcttctgtacctgattgacttaactctgaactctaaaggtgcattaagagcttctttcacattcgtcaaccgatgtggctacacggtgcggcctgggatattagcaaatgcaggcagtcctacactcgacagcactgggttcgagctaccaaaggactcgtctcgttcatttcaagccccaactggctggtccggtcgtttttggggtcgaacgggctgcacatttgacggatcccggtc

SEQ ID NO: 24441 - DNA, 406 bp, Gossypium hirsutum
  Clone ID: LIB3272-037-P1-K1-H8
ttctttttatcttttctacaaaaagacccctatcagacaactgtcaatcaggttcctttcttttctgtcgatccatctccaaagtttattgcttaaggatcctttcaatcagggttacttaatggatcaactgtttctattatattatagtgattctggtgtgttaccaggggcggatgtaaagcctttaggcttggcacttggtgcccatgtgtgttccagagggatgttagcctacaagctaggcagttgatgcccaagtatgttctcggttggtttagcttgtttaagtgttttggtgtgttctggatggttaaccatgtaaacgaatctattatatcggtcatcgggcagatttttaatggttacatgatttggaattcatcttgtaaatggttatatgcct

SEQ ID NO: 24442 - DNA, 398 bp, Gossypium hirsutum
  Clone ID: LIB3272-037-P1-K1-H9
caacaaaggaaaaaaaacattcatggctactaaaaaacatgatgatcatgagaattatccaactgttttggttaccaagacagttaccgtacacccaaaacccttgttgcatcatccacaacagattctccatctttccaatttggacaggcagtgtccgatgttaatgtacgtcgttttcttttacaaaccttgttttgcttaccagaacttgtctctgggctccatcttcaacagcttgaaatctgggttggaagagacactttctatatggtatccagctgcaggtaggttgagcttgaaccaagctgatggtaagcttaatctttggtgcaataatggtggtgcagttctagctgaggcagtcaccactgcgaagatcattcaacttggggatc

SEQ ID NO: 24443 - DNA, 77 bp, Gossypium hirsutum
  Clone ID: LIB3272-038-P1-K1-A1
ggaaaaaacacccagagtctcagatcacccggttctttaaatcaagatgcaatcaaccgacggttgttatttgagct

SEQ ID NO: 24444 - DNA, 376 bp, Gossypium hirsutum
  Clone ID: LIB3272-038-P1-K1-A11
tgaggaaaatcatgggtgccaaagttctcttcttctttgctttgctttccttttcagctgtgtcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgttcctgaagtgtttc

SEQ ID NO: 24445 - DNA, 406 bp, Gossypium hirsutum
  Clone ID: LIB3272-038-P1-K1-A12
ccagaaagtaaaaagaacagagcttggatatcctaagctaatgtcggacgaggagcaccatttcgagtccaaggccgacgccggctcctccaaaacctatcctcagcaggccggtactattcgtaaaaacggctacatcgtcatcaaaggccgtccttgcaaggttgtcgaagtttccactttcacgactgggaagcacggacatgctaagtgtcactttgttgggatcgacatcttcactgctaagaagctggaagatatcgttccttcttcccacaaatgtgatgtgccgtacgtcaaccgtactgattaccaattgatcgacatttctgaggatggattagtgagcttgctgactgtaagccgggacactaaagatgatctgaggctcccaactgatgaaaac

SEQ ID NO: 24446 - DNA, 297 bp, Gossypium hirsutum
  Clone ID: LIB3272-038-P1-K1-A2
ctagcttatgatcgtgacgggggggtagcttgttagcccttgggtcccgacccatggtggcaaatggtcagaaagtttgtggcatgaacaaagaaggtttcaaggcatgccagccgagcgtgactggcgggaaccccagcccttcggcggcattgggcttatgttgcatggctttaaacgaagcccacctcacatgcctttgtttcttcaagaattccaagttgatgaatgattatggaattgattttaattgagctaaggacctgtccctgcaatgcaatttgaccaaatttttaa

SEQ ID NO: 24447 - DNA, 284 bp, Gossypium hirsutum
  unsure (1)..(284): unsure at all n locations
  Clone ID: LIB3272-038-P1-K1-A4
gttccttgtgaacggcacttgcacatgggttagtcgatcctaagagacgggggaagcccgtccgacagcgcgtccagcgcgagcttcgaaagggaatcgggttaaaattcctgaaccggacgcgngagctgacggcacgtaggagtccgagagtccgcggggcctcggaagagtatttttttggttaacgggctggccaacctggaaaccgcttaacccggaggtggggcccaccggtcgaaaaacccccccccttcggggggtgcccggggccccccgggggg

SEQ ID NO: 24448 - DNA, 417 bp, Gossypium hirsutum
  Clone ID: LIB3272-038-P1-K1-A5
tttaaaatttttgggccaataaatttggaaggcaggattggttaaggcctttagggtggtggtgaggttcaaggcaagggcttccattaatcttcaccaacttcaatagtggaccgggaggagttgacaaaaggggcattttataggggtggaataacccagtttattggcacccttttatttttatacaataatgtgttgacagggatcggatacaaaaattaaggtgacccttataagggcagggaccaatgccggggggttggcattcttggcatttgttgggcttttggggggaagaactttattcttggttaccggaccggttggattttttgggggcacaataacccaacaagggccttttggctttttttggcttggaagggggtcttaagtcgaagcataatttatatt

SEQ ID NO: 24449 - DNA, 372 bp, Gossypium hirsutum
  Clone ID: LIB3272-038-P1-K1-A6
gcgtttgtctcagatctcagaagatggcccgtaccaagcaaaccgccctaagtcggctggtgggaaggctcctaggaagcaacttgctaccaaggccgtccgtaaatctgccccaaccactggtggtgtgaagaagcctcatcgataccgtcctggaactgttgctcttcgtgaaattcgaaagtaccagaagagtactgagcttcttatcaggaaattgcctttccagaggcttgttcgtgaaattgcccaggatttcaagactgatttgcgtttccagagccatgccgttcttgctcttcaggaagctgcagaagcataccttgtgggtcttctttgaagacaccaacctgtgtgcgattcacgccaagc

SEQ ID NO: 24450 - DNA, 368 bp, Gossypium hirsutum
  Clone ID: LIB3272-038-P1-K1-A7
gcggtgttgatcaagctgagaaggaaatggctggatacgctaagcttatgatcgagacaatggtggttgctggtttagcccttgggtccctacccatggtggcaaatggtcagaaagtttgtggcatgaacaaagatggtttcatggcatgccagccgagcgtgactgccggtaaccctagccctccgccgccatcggcctcatgtagcatggctttaaacgaagccgacctcacatgcctttgtttcttcaagaattccaagttgatgaatgattatggaatccatttcaatcgagctgaggacctgcccgtgcaatgcaatttgaccaaatctttcaattgctagatgtgggattaaaatgaaaaa

SEQ ID NO: 24451 - DNA, 219 bp, Gossypium hirsutum
  Clone ID: LIB3272-038-P1-K1-A8
atcgtcaataaggggacggtcgcttctgttcaaaccataaacggggccaaatatggcgggcgagaagcaatcgagtcgggtcaatgcttcggccggaagaagacggcggtagccgtaacgcactgcaagaggggccgtggtttgatcaagatcaatggttgtcccattgagcttgttcagcccgagatccttccttttaaggccgttgtggccaatcct

SEQ ID NO: 24452 - DNA, 142 bp, Gossypium hirsutum
  Clone ID: LIB3272-038-P1-K1-A9
ctcactgggttaagtaaaccctattttggtaccctatcttttccagctggaggtggagtccaaggtgggggattatccatttcaatactcctaccgtaaagatgaacaaggaagggttcatgaaaatggctggtgcagtccg

SEQ ID NO: 24453 - DNA, 86 bp, Gossypium hirsutum
  Clone ID: LIB3272-038-P1-K1-B1
aattaaccaactctttaaacgtttagtaactatacttcttaagtaccaaatcctctcatctaattatgacccgcattaatggatta

SEQ ID NO: 24454 - DNA, 411 bp, Gossypium hirsutum
  Clone ID: LIB3272-038-P1-K1-B10
ttaaagagctcgctttgagtaccgcgtcaagctacgtccgactcagtgtccgagtcaacgattcctcatccttagctgaatctgatcctgaacaatgcaagagggcagcagcgagcaggaatttaacagtataagagcttcaattgcgatattgaattcaaatttagatcaacagaatcaaaggaagattagcgttctcaatgaattacaaaatttacaagagaaaattcgaaaggaaggtgctgaatccaaagtgaaaaaattcgtttcccttttggagaatttaaagttactagaaagacaagaatctgaaattcggtgtgattttgatgcaaaacgttcttcactggaagctgaggttagtgatttggaggaaaaaatagcagctggatctgacagcaagatgctttc

SEQ ID NO: 24455 - DNA, 392 bp, Gossypium hirsutum
  Clone ID: LIB3272-038-P1-K1-B11
gctaaccatgagctacttaaccatttcccaaatctcctccctcctcttctttagcgtccttttcatttccgctcatgcagcgcgctttgaaatccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccggtgattgtggtggactccttcaatgcaaaggttggggtgtacctccaaacaccctggctgaatatgcacttaaccaatttggaaacatggatttctacgacatttccttagttgatgggtttaaca

SEQ ID NO: 24456 - DNA, 330 bp, Gossypium hirsutum
  Clone ID: LIB3272-038-P1-K1-B2
gttcttccttggaggtaaaaagaaaaaagggtttcttttgttcgtttttttttctgtagaggatgccagacaaaggagggagctttgttccagttcatcaatggcgtgttggtttggtaacagcataggttctggttggtatggtggtggtttggagcatatatggctgctcctttaattctacattactgtcgtgacagtgatcacatgcttacatcacgttgacccttataagggcagttactaatgttgtggccctcgcattttctgcaattcttggctaatgggggggtgatttttattcttgattactcgcccttgtggtttttt

SEQ ID NO: 24457 - DNA, 427 bp, Gossypium hirsutum
  Clone ID: LIB3272-038-P1-K1-B5
atactgcagaaatctccaaagccagaatggtttcaaaatcacatgatgtggagtcctcttgggatgatgaattcaaaaaactggtgcaaaacttccccaaagagagaagctgggcaggatccaatctttatttctatcaaggtttttggtgcccctctcttgttctaaaagcttttatttctttccagaaacattttcaagcatttaattctgatgtcatcgttgctacttttccaaaatgtggtactacttggctcaaggccttgactttctccactctgtatcgcaatcagttcccatgggatgaaaatccattgctcacctttggccctcaccaacttgttcgtttcttcgagtatgatctttacttgaacaacccttttcctgatcttcaaaatgtttgtgcttatcagccaaggcttttttc

SEQ ID NO: 24458 - DNA, 415 bp, Gossypium hirsutum
  Clone ID: LIB3272-038-P1-K1-B6
gtcggttccttacctttcctacgatgccatctcgccgtagaacccttttgaaggtcatcatcctcggcgatagcggggtagggaagacgtctttgatgaatcaatatgttaataagaagtttagcaatcagtataaggcaacaattggggctgattttttgacaaaggaagtgcagtttgaggataggcttttcaccttacagatctgggatactgctggccaggaaagattccagagcttaggtgttgctttctaccgtggtgctgattgctgtgttcttgtatacgatgtcaactcaatgaaatcattcgacaaccttaacaactggagagaagagtttcttattcaggcaagcccttcagatccagagaatttcccttttgttgttttgggaaacaaagttgaccttggatg

SEQ ID NO: 24459 - DNA, 192 bp, Gossypium hirsutum
  Clone ID: LIB3272-038-P1-K1-B8
tttttggcaatcaattttgtaagcaagtattgctaaagaccttgaggttggtggggggttccaaaccaaggactaccattatccttcaaccacttcaatggttggacgggagggagtggccaaagtggtaatttattagggttgaaatacccgatttaatggccaccctttaattttaatccataattgggt

SEQ ID NO: 24460 - DNA, 399 bp, Gossypium hirsutum
  Clone ID: LIB3272-038-P1-K1-B9
cgaaaacctaaagattctctctcccaaaccaaaccttcaaatttcagcaagagagagagagagagagaacttacatagctcagatttcgatcatcaatttagggtttcttagttcgatccccgattacccaatacccaaatttacagatcaggctgagtgttctagttgttcggctgtttctatcctctaagtttcatgtctgatcttgacatccagattcctactgcctttgatccgtttgctgatgcaaatcctgaaaacgctggtgctggtgccaaggaatacgttcacattcgtattcagcagcggaacggtaggaaaagcctgaccactgttcagggattgaagaaagaatttagctataacaaaattctcaaggacctcaagaaagaattttg

SEQ ID NO: 24461 - DNA, 346 bp, Gossypium hirsutum
  Clone ID: LIB3272-038-P1-K1-C1
gaagattaattaagagtcatcagctcctgcacggtagacgttcttttgcctaggccttggatccaccgtaaatctgggcgccttcctagcatcttaattctttaccaatgcgccgagttcttggcttaactaatatgtaaatctgaggtctatgtggtgatttcttttacggggttattacccatgtcatttggtgcttccgagcacccttttacatatggacaactgttttgaattgggggcttctatatatatgtgagcatgaaactgggtgcttcattctctgtaatattagtaaccaacttacatgtgcctaaatgacggttctttcttacattgtaccaca

SEQ ID NO: 24462 - DNA, 412 bp, Gossypium hirsutum
  Clone ID: LIB3272-038-P1-K1-C10
cttctctctttttctcattcattctttagtttcaatatcaaagcaaaaatgggttcttcttgtaatgttgtttcaatggccttactggcttgtttggtgttgaactccttggtttttgttgcccacggtggtgacttttaccaggatttcgacctaacatggggtgacagaagaggcaagattttcaatggtggcaagctcttgtctttgtctttagacagggtttcagggtctggttttcaatctaagaaagagtatttgtttggaaggatcgatatgcaactcaagcttgttgctggcaactcaactggcactgtcactgcttattatctgtcatctcaagggccaacccatgatgagatagactttgaattcttagggaatctgagcggtgacccttacattttacaca

SEQ ID NO: 24463 - DNA, 415 bp, Gossypium hirsutum
  Clone ID: LIB3272-038-P1-K1-C11
ctaccccaacaacccaaacaaacaaacaaaaaaaggaatcgcctctacttctactttttacataattctcactttcaattccctcactctgatcaagccgccatgtgtggaggtgctataatctctgattttattgctccggtgcggtcgcgtcggctgacggctgactacttgtggcccgatctgagaaaatcgcaatcgaaaaaggcttccagtaataggtactcgaagccggcgatcgatttcaccgataacttcgaggccgactttcaagacttcaaggatgataaatccgatatcgaagactatgatgttgatgatgttttggctgatgccaagccctttgcgttctctgccgcaaagaaagcatcttctactgtttctcatgctcaagctgagaagtctgcaaaaagaa

SEQ ID NO: 24464 - DNA, 410 bp, Gossypium hirsutum
  Clone ID: LIB3272-038-P1-K1-C12
caagattaagttggttcctttgaaccttcaaaatagacctgcttggtacaaggaaaaagtttaccctgaaaacaaggtgccgtccttggaacataatggcaaagtcattggggagagtcttgatttgattaaatatgttgatagcaacttcgaagggccgtctcttctacctgatgatgctgacaaaaaggagtactttgagacgacgttatcacacatggacgaatttctagggctggtgtatgctacatttaaaggagactcaacaaaggatgctgatgctgcttttgatcacttggaaactgctcttgcaaaatatgatggtccattcctcctaggcaacgagtttactctggcggacattgccttcattccttttgtcgaaagggttcagatctacttaatcagag

SEQ ID NO: 24465 - DNA, 359 bp, Gossypium hirsutum
  Clone ID: LIB3272-038-P1-K1-C2
aagcaaccgttgttttactcaaaaagatccctctccaacaatggcttctaatcccaaggtcttcttcgacatgaccgtcggtggccaaccagctggtcggattgtgatggagctctttgccgattgcactccccggactgctgagaacttacgtgctctctgcaccggcaagaaaggggtaggccgtagcggcaaacctctccactacaaaggctcatccttccaccgggtgatccctaatttcatgtgtgaaggaggcgactttaccgcctgaaacggtaccggaggtgaatgcatctattgagacaagttcgcggacgagaactttatctagaagcacacgggacctggcattcttt

SEQ ID NO: 24466 - DNA, 406 bp, Gossypium hirsutum
  Clone ID: LIB3272-038-P1-K1-C3
aatttgtgaaattatcaaattatttccgatttccgatttctgatttgggaatttcttgtttttgatttctgattgtgaatcagagatgggtttaggcttatcagtcttaatagctatgaaggcaacggcatggatgttattatatctcttcttcagtagatttgggttcacagtgttggcaataccattattgtatgcatcattgatttcatggcttgtttcaattgcttctcacccttcaatcgatcttcccatgcttttgggcaaaaacccagatgggactttcccaattttgtccactatcatgttctccccatatctgtattttgctagagctttttcaatggcgagaaggttccttgctggtgaagaaccttactctaaatatgtgagggtttatatgttg

SEQ ID NO: 24467 - DNA, 420 bp, Gossypium hirsutum
  Clone ID: LIB3272-038-P1-K1-C4
ctgaatctgagtttgaggatgggaaattggatattcagaatactggtgtacctcttgtggatcattgccatggagaatttgatataagcacattgcagatcattaaaaatgaagatctggaagagctaagggagttgggttcgggtacgtttgggactgtctaccacggaaaatggagaggaacagatgttgccatcaagcgaataaaaaaaatctgtttcactggtcgttcatctgagcaagagagattgactgtggagttctggcgtgaagctgacatcctttcaaagcttcaccaccccaatgtagtggccttttatggtgtggtgcaagatggacctggaggaacactagccactgtcacagagttcatggtgaatgggttttttagacatgtgttgcttagcaaagacaggcaac

SEQ ID NO: 24468 - DNA, 397 bp, Gossypium hirsutum
  Clone ID: LIB3272-038-P1-K1-C5
tgtctattgaattctttccttcactttctcgagaaaaaaaaaatgtcttcaggttgcaattgcggatctagctgcagctgcggatctggctgcaattgcggtgagaactgctcaatgaaccttaaccttggatactcggagaagacaaccagcactcagaccatcatctccggagttgcgccagtgaagatgacctttgagggaccagagatgggcactactgaatcaggacatggatgcagctgtggatcaagctgcaaatgtaatccatgcacctgttgaaaagcttgatgaaagccatagattatgaaaaaagaaagcagcaaaataacaggcctctgtaatgatttattttcaaggatggatgcctgcaagggctaataatatgtctctctct

SEQ ID NO: 24469 - DNA, 426 bp, Gossypium hirsutum
  Clone ID: LIB3272-038-P1-K1-C6
tttatttgcatgaactcttaatccactcggtctcaaatccccaaaccccaaaaggatagttgaaaaaagaaaaaagaaaacctttgttttgtcttcaaatattgaaactttccttcactttcccactgaaaatctttcattttttcccaggaaaaatgaggtgggaaaaggttcagttatacccaaaagaagaaggaggtgtgggagaagcatgtgcggggccagggaaaagatggggacatacatgtaacgccattaaaggaggcagatttctctatgtttttggtggttatggcaaagataattgccaaaccaatcaagttcatgtctttgacactgctagtctgacatggagcctactagcaacaaaaggcacaccgtcaattccaagggatagtcatagttgtactactggtggtgacaacc

SEQ ID NO: 24470 - DNA, 404 bp, Gossypium hirsutum
  Clone ID: LIB3272-038-P1-K1-C7
ctcagatcagaactagagagtttacatcctggtaagaggttgagtcgccatggcttcagcttcctccaattcactatcaatctcaccctcatccaccctcgtggatgccaaagctcctcgtcaaccaactgctgcatccccacaatgtgtcactcttcctactcttcctcccccacccgttcagtcccagagtcgtccctggaagaccactgcctactgtcgcaagattgctcgaaatgtgatggctatggccactggtgagactttggccacgcgtgaagctccaaccgaagttaccccaactgagctgacagagtttatcaacaaaatacaagaaacctgggataaagttgaggacaagtacgcagtgagttcacttgcttgagcaggtctggttttggtct

SEQ ID NO: 24471 - DNA, 238 bp, Gossypium hirsutum
  Clone ID: LIB3272-038-P1-K1-C8
gctttggaagcatggacttcatagctactatcctgtttctagctcttgtcatggggctccaccaaagctttggacccttgcggccctcagccagatgactcggaccttttggtcatcccaatctatggcaaatgttcaccattcaacccacccaaacctgactcatcgttcaacacagtcatgaacatggcatcaaaagacccagcaagggtcaagttcttgtcgagccttgtagccc

SEQ ID NO: 24472 - DNA, 331 bp, Gossypium hirsutum
  Clone ID: LIB3272-038-P1-K1-C9
agctacttaaccatttcccaaatctcctccctcctcttctttagcgtccttttcatttccgctcatgcagcgcgctttgaaatccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccggtgattgtgggggactccttcaaagcaaagggtgggttgtaccttccaaacacctttgctgtatattccccttaa

SEQ ID NO: 24473 - DNA, 164 bp, Gossypium hirsutum
  Clone ID: LIB3272-038-P1-K1-D1
ctttctttattacttttaagatcatatcttgtttaattttgtttatctgtatggttttggagaatttacggatattttctatcagagattgtttttgaggttaattttagatgattttaacatttgtgggtcatctttatggctatatatgtgatgtttaattc

SEQ ID NO: 24474 - DNA, 420 bp, Gossypium hirsutum
  Clone ID: LIB3272-038-P1-K1-D10
tagcagccgatggagaggctgaatctgaaacacaagctcggcgataaatggatttcaaccctagccagcatatggatccagtgcaccagcggttcactctacaccttctccatctattccccaattctcaaatccacccaacgctatgatcagtcaaccctcgacacggtttccgtcttcaaagacatcggtgccaactgcggcgtcctttccggtttcctctacactttcgccactccatctaaccgccgcaacgcttattttggtggaccctgcttggtcctcgcggctggtgctatccaatgctttatgggctacttcctcatctgggcttccgtggttggattgatcccttgcccttccggtgtagggatgtgcttcttcgtgcttttggcagcgcatgctcagactttcttaata

SEQ ID NO: 24475 - DNA, 390 bp, Gossypium hirsutum
  Clone ID: LIB3272-038-P1-K1-D11
gcggcgaagcgatttgcaatctcaactcaccgtttctcacgattggattctccttaaaatcatggctgctcagattagcaagaagcgcaagtttgttgcggatggagtgttctacgcggagctaaatgaggttttgacaagggagcttgctgaggatggatactccggagttgaagtcagagttactcctatgcgtactgagatcatcatcagagctactcgtactcaaaatgttcttggtgagaagggtagaaggattagagagttgacttctgttgttcagaaacgattcaagtttccggagaacagtgtggagctctatgctgagaaagttaacaacaggggtctttgcgccattgcacaggccgagtccctgcgatacaagcttct

SEQ ID NO: 24476 - DNA, 416 bp, Gossypium hirsutum
  Clone ID: LIB3272-038-P1-K1-D12
gatcgcgggtactactcagtcgagaccgtttcacttctagtggccctcaaagtccgatatagagatagaataacaattcttagaggaaatcatgagagccggcaaataacacaagtgtatggtttttatgatgaatgcttgagaaaatatggaaatgccaacgtgtggaagtattttactgacctgtttgattatttaccactcacagctcttattgagagtcagatcttttgtttgcatggaggactttccccatctttggacacgttagacaatattcgagcattggaccgtatacaggaggttcctcatgaaggaccaatgtgtgatctcttgtggtctgatcctgatgaccgctgtggatgggggatctctcctcgtggagctggctatacatttggacaagatattgcgac

SEQ ID NO: 24477 - DNA, 413 bp, Gossypium hirsutum
  Clone ID: LIB3272-038-P1-K1-D2
aaaaaatctcaaattcccttatttgggttgatatatagtattatatatatatatttacaagaatggtagcttcggctatttcagcttctttcaatctctctctctgtactcaatccagacccacttctatttcatccctttctcccaaactcgacgaagttgatagtctctgcattgccatccccttatggagactcttctacaatggggttatctagtagaactgctgggctacctatgaagatcaacaagaagggcttacttgaatccaatccaagctacgatgcaatacaagctaaaacggggaatccacctgtgatgccagcagtaatgactccaggggggcctttggacctttcaactgtgttattccgaaatcgtatcatcttcattgggcaaccagtcaattcaca

SEQ ID NO: 24478 - DNA, 187 bp, Gossypium hirsutum
  Clone ID: LIB3272-038-P1-K1-D3
gttccatgtgaacggcacttgcacatgggttagtcgatcctaaaagacgggggaagccggtccgaacagcgcgtccagcgcgagcttcaaaagggaatcgggttaaaattcctgaaccgggacgcggcggctgacggcaacgttagggagtccggagacgtcggcgggggccttgtgaagggttatc

SEQ ID NO: 24479 - DNA, 415 bp, Gossypium hirsutum
  Clone ID: LIB3272-038-P1-K1-D4
gtttgagaatcactttttcacccaaaagtgcttttctcttaaaagcagcaaagaacagcctcctttttctcttaaaatttctccatcaaaaaagtgcttctctctagacggagaagctaaaaaattctccttttcttctgctgtaactgcttttggatgaaaattgaccaaatacccgtcttttcccccaaacgtttttcccctctgctggttccctaaatgttctttcccctctgctggtgaaattggagctttatacccgatttttttccctattttcggctttcaaagctctactttctgttctttgttcctcttccgcagcagagaatgagaacaactcgacttttagttgaatatctttattaaaaatttgtctcatctggtggtttctgagaggaaaaaaatgggatcc

SEQ ID NO: 24480 - DNA, 201 bp, Gossypium hirsutum
  Clone ID: LIB3272-038-P1-K1-D5
tagcagccgatggagaggctgaatctgaaacacaagctcggcgataaatggagtggagccctagccagcatatggatccagtgcaccagcggttcactctacaccttctccatctattccccaattctcaaatccacccaacgctatgatcagacaaccttcgacacggtttctcgtcttcaaagacatagttgccaactg

SEQ ID NO: 24481 - DNA, 373 bp, Gossypium hirsutum
  Clone ID: LIB3272-038-P1-K1-D6
gtcactctctttccttcccatcttaaacatgctccctcctttgtaaatcctattagacgtcaatttcccctttcataatctttgggttttcatggaggaaatcaattgggatacccttctgctcgaggttgacttacccgatttcggggatatcttagataatgaaccggaaccggtaacggaacctcctcctcaaccttgttcgacccagaatttcgatgaagaaccggcggtgtcttcgtggatcggggagatcgataagggagtgatctattgtggtttaaaaaccatagaggttgtcactcaacattgtggagctctatgctgagaaagttaacaacagggggttttgctccattgcacaggccgagtt

SEQ ID NO: 24482 - DNA, 421 bp, Gossypium hirsutum
  Clone ID: LIB3272-038-P1-K1-D7
gttttatccttccatgcaaggttcccatggaatcccgcaaatcccacccttctattgtttgtttcagtgaaatcttggtggaaccaaaccacaaggggaaacatcagattctaagaaactccaagtttcaacctctgggcagtggtcttagattccaaattactgacagacatagttacatggtcttctgcaacagtaatgttgaacaaggacctgtaatcccttctagccctgctcctgctcctggatcctggtttgtcttttatatatgtatttgaaaggaaaatatatcttttaattttgctcttcaatgaggtttgtcacagtcatttttaaattttcaggaaaccttggaattctgggatttcttgatgagtataatcctacccttttggaggggaaacttgccggcatttattta

SEQ ID NO: 24483 - DNA, 374 bp, Gossypium hirsutum
  Clone ID: LIB3272-038-P1-K1-D8
gaaaacaaatatcattgcattaggtgcaaatcttatgtaaaagcaagaaagaagtggacggtattagagtcacctaatattcttaccattgttttaaagaggttccagtctggtaattttgggaagttaaataagtcagttcaatttcctgaggtccttgatttggccccatatatgagcggatcaagttcgaaggcggtcatatacaatctctatgctgtggttgttcacttggatgttatggatcctgccctttcaggccattacgtatgttacgtgaagagtttccgaggggaatgtttaaggattgattaacagcacggtaataccaatgtcattggagagggttttgttcgaaagggcgtacatgctct

SEQ ID NO: 24484 - DNA, 264 bp, Gossypium hirsutum
  Clone ID: LIB3272-038-P1-K1-D9
cttgcattgagtctctaagatatcactgcacggaaaaaaaaaaaaaaccagacatggctgccaacactgttgcatccgctgctcttcttcttacctagaacttgctgttcttcactttggttcgctctacctacgtgccttgcccaccaccaccaaagagccacaagcctacctacaagagcccaccctcggcacctaaacagccagccacttgccccaaagatacactgaaactaggtgtttgtgctgatttgaagggctcgg

SEQ ID NO: 24485 - DNA, 417 bp, Gossypium hirsutum
  Clone ID: LIB3272-038-P1-K1-E1
caacaaacaagattcaaaatgtgttacagcgggcaactgttgacagcaactcacaaattgggaccatatttcatattctccagacaaaggaatctcctcctacctatttccacaccaacaaatttacttctgctttccaagaaatcgtggatgcatatgggattgcgaagtatcaagaagcaaatcctggtgtattcacaatcatcacattccctttcctttttgctgttatgtttggtgactggggccatggtatatgcctgtttttggcaacatcatatttcataatcaaagaaaaaaagttttctagtcagaaacttggagacatcactgagatgatttttggtggtcgctatgttattatgatgatggcattattctcaatctacacaggattgatatacaatgaaatttttt

SEQ ID NO: 24486 - DNA, 261 bp, Gossypium hirsutum
  Clone ID: LIB3272-038-P1-K1-E10
gttgtcatggtggacaagtaaacataggatcgctggaatggcttgtcaagctgcgggagggatattctgttttgccgcgataccatattaatgaagccactctgtgctggaaaaaacctgatgttgtaggagaggatggtaaagatctcattctacatattacgggcactaattatgattgtaatagagagatcatcaaccctattgcctttggagatccgatataagaaggtttggagggcgtgcgatgtctaggacccc

SEQ ID NO: 24487 - DNA, 422 bp, Gossypium hirsutum
  Clone ID: LIB3272-038-P1-K1-E11
gaaaaaacaaacgcttccactcggctgaaccaaaatctctcattcgaaccccttttctcttctcgacggatcgtgttatgtaatggccaatcaaggccctattcaaccagaggttcgcgagtttcgctcactagccttagaatcgtcacctaacttcgattgtgacgaatcaagtgaggattcgaatgagccaactctctggtgagtcattttctcttttctgatttttgtttttatatgcagtaacaaagatttgtgaaataggagcagaatcgaaaagaaagaaataatctaaaatcaccttagtttttcctcgctttttccttctattttcatattccccccatacaaattacatttggtctttatttatagccgaataaagagaaaaacagaaaatcaaagaaatttcctagatcttt

SEQ ID NO: 24488 - DNA, 415 bp, Gossypium hirsutum
  Clone ID: LIB3272-038-P1-K1-E12
ctctcagtctccctttctctttagatctcataaaagctctaatctgatggctgctaccatcgtttccattaaagctaggcagattttcgacagccgtggaaatccaacggtcgaggttgatgtggaaacatccaacggtaaaaaggctagagccgcagttccaagcggtgcatccactggaatttacgaggctcttgaactgagagatggaggttccgattaccttggtaaaggtgtatcaaaggctgttgctaatgttaacacgattatcgggcctgcattgattggaaaggatccaactcagcagactgctattgacaatttcatggttcaacaattagacggaactcaaaacgagtggggttggtgcaaacaaaagcttggagcaaatgccattcttgctgtgtcccttgca

SEQ ID NO: 24489 - DNA, 375 bp, Gossypium hirsutum
  Clone ID: LIB3272-038-P1-K1-E2
tattccttcatttctttaaatacttccatttttttgattttttttaagtgaaggaacagtgaaaagcaacaggaaatggcaaatatagatatcgatgggatcttgaaggagcttcccaatgatgggcgtatccctaaaaccaagatcgtttgtactttgggtccggcttcacggtccgtacctatgatagagaagctgttgagggctgggatgaacgttgctcgcttcaatttctctcatggcagtcatgagtatcatcaagagaccttggataatcttaagtctgctatgcacaacaccggcattctttgcgcggtcatgcttgacaccaagggccctgagattcgaactggattcctgaagatgggaaagctg

SEQ ID NO: 24490 - DNA, 117 bp, Gossypium hirsutum
  Clone ID: LIB3272-038-P1-K1-E3
tcggactcgtggtctaactcttcttttttaaaaaccctaacccttctcttttaaagagcgcaacccctcattctttgtcactcactctctttttcttttcaccaaaaaaacattttt

SEQ ID NO: 24491 - DNA, 422 bp, Gossypium hirsutum
  Clone ID: LIB3272-038-P1-K1-E4
gatcagtatcacttgtaagctttacagggaaaaagggggaaaaaaagtgcggatcaagcatagatggaaaacatgggagttttaggcaaggtggtggattaccttctattgttatcattctttagcatcacattaacagctcagttggacatccccgagtccatcctcccccacgcctacaatcccttctatcaagtttataccacgttaacccaggattatttggtgcttgagcagcctggttttttcaaggcacttatgacgttggaacttgtttaccaactccctctcgctttgcttaacatctatggattgttatactccaagccctggttcaacaccacctgcctcctctttggtgcctctatcgttgcctctacgacagctatggtgggagacattctgaattcccagaaggcatc

SEQ ID NO: 24492 - DNA, 414 bp, Gossypium hirsutum
  Clone ID: LIB3272-038-P1-K1-E5
ctctttaaagaaaaattggttttcgattccattttcaatttatatattttggattagattcggttggtcttagggaaaaacaaaggaaagggcaatgtcaaccccagcaaggaagaggctgatgagagacttcaagagactacagcaagatccacctgctggtattagtggggctcctcaagataataatatcatgttttggaacgctgtcatttttgggcctgatgatactccttgggatggcggtacgttcaagctgactttgcagttcatggaggattatccaaataagcctccaaccgttcggtttgtctcacggatgtttcatccaaatatctatgcagatgggagtatttgtctcgatattttacaaaatcagtggagtcctacatatgatgttgccgctatactcac

SEQ ID NO: 24493 - DNA, 311 bp, Gossypium hirsutum
  Clone ID: LIB3272-038-P1-K1-E6
ataatactctgaactttgggtttagaggggatgaggaaactcttgatggcttggctggcatggttcttatttgataggttatccaaggtacggtggatcgtttggaggtggaggatagagatgcagacacgcgagaggggaacacagaactggtagtgttggactaggctgatagtggacagattctgggtcgaccaccgggagtggaccatgggggtgaaagttacgcgacactcatgaacgattcattagatgaaagctggggtccttaaaggggtgggcttttatttgattctgaatgttataatggg

SEQ ID NO: 24494 - DNA, 285 bp, Gossypium hirsutum
  Clone ID: LIB3272-038-P1-K1-E8
aaagcacaccaagctaggcgccatgcaaatgctatatcatctttttttttctgggggacacagcctttctaaaacatccccagctatatcaattacacaccactgttcacggtagagagaacgaataactaggcgtacctctccgtgagttggcactcatgataagctattcagtggcgaacacatattctggtcagctctaaatgtaaaaggacaaggaattttacttggatcaccaactttactgtaagcacttgaagacacagccctgtggcaattgggagg

SEQ ID NO: 24495 - DNA, 375 bp, Gossypium hirsutum
  Clone ID: LIB3272-038-P1-K1-E9
ccgaaccttttgaagaacgaaaagcaatggcttcattcgagcaagcgccgcccggaaatgcgaaagctggggagaagatcttcaaaaccaagtgcgcgcagtgtcacaccgtagataaaggcgctggtcacaagcaaggtcggtcagatctgattttgttcttcattgaattcaggccaaatttgaatgggcttttcgggaggcagtccggcacaactgcgggatactatgattgcggtgcatcagagcactgcttacatgttttcaccggacacagtcggtgactacgagatgtgtccttgctatgctagcttgaccacccacggtggccgacgcaagtgcccttgagtgctaattgacaatcggaacgaatct

SEQ ID NO: 24496 - DNA, 419 bp, Gossypium hirsutum
  Clone ID: LIB3272-038-P1-K1-F1
aagaaccaaacacggtttctctattattttcttgtcttacttatggccgtcgttaaggctttcattgcttcacttctcatctctcttctccttctccaacttgttgctgctgatcaactggtgacaagtgccagcaagcgcaagggaactgccccccctgcgaaaattgactgcggcggggcttgtgcggcgaggtgccgattatcatcgaggccacacctatgcaagagggcatgcgggacatgttgcgcacgctgcaactgtgttccaccggggacagccggtaaccaagaaatgtgtccttgctatgctagcttgaccacccacggtggccgacgcaagtgcccttgagtgttaatcgacaatcggaacgaatctttctcttttgatgtttgtatgaaattaataaacgtatgcat

SEQ ID NO: 24497 - DNA, 346 bp, Gossypium hirsutum
  Clone ID: LIB3272-038-P1-K1-F10
ctcaaagatatcactgcaagaaaaaaaaaaaaaccagacatggcttccaacactgtggcatccgctgctcttcttcttaccttgaacttgttgttcttcactttggttagctctacctacgtgccttgcccaccaccaccaaagagccacaagcctacccacaaaagcccaccctcggcacctgaacagccaggcacttgccccagagatgcactgaaactaggcgtttgtgctgatttgttgggctcactgcgcgttgttgttggaccgtcgaggaccaaacgcagctctctcatttaaggttgggctgatctcgatgctgctgtttgcctttgcactgctatta

SEQ ID NO: 24498 - DNA, 422 bp, Gossypium hirsutum
  Clone ID: LIB3272-038-P1-K1-F11
cgtaaggttagcttcatgtactacatgcatcaacctcttactattgcaattaactctcttttatcttcccctctctctctctctctctctcacacacacgttcaaaaacattcttaagaatattgaacccccaaagaaacatagagaagggataataaaaataaaaataaaaatacataatgttttgtttcagatcaaacccttatgcattgttttttcttttctttttttctttgtttctttttggacatgaaacaggttctcaagctttaaatgtccagactttgaatatttcagggtattgtagaagttttgtgtttggggagagagagcagagtgaagtgttagcatggaggaagacagaaaggaggaaccttgcagagggaagtgaaggagacaacaactcgtctttgattttggct

SEQ ID NO: 24499 - DNA, 425 bp, Gossypium hirsutum
  Clone ID: LIB3272-038-P1-K1-F12
gtaacggtttggtattgggcacctgggcatgcccgttcgagctgagggtgaagatggcactttacctcaaatctgtcacttctagaactcagaggaaaatttggccggaatccaaaagcgaccttatcctcaaatctacccttgttaatgggaaagtcccagtcctcatccatggccataatcccatctgcgagtctctaatcatcgcatgagtacatcgacgaggtttggaccacctctgctttttacatcctccattctgatgcctatgaacgcgcccagacccgattatgggcggcctatgtcgaagataagttttccactgccttaagaagagtgttgtttggtgctacagaggaagataaaagggcagccctggccgaagtatcagaagggatcgtgctgttggaggaagtctttgtgaa

SEQ ID NO: 24500 - DNA, 254 bp, Gossypium hirsutum
  Clone ID: LIB3272-038-P1-K1-F2
gggaagccctttactaacctgactgcataaacacaaccatgtccaaccattcaggttttctagtccccagactttttatctacatttgaaatacctatgttggatccgactcttccgatcaccggtacagggaccgagacgctgtacctttttacgccaaaggcgttggccggtgtggcaacacgaatgtgacctatgggtaagagggtcaaatcctcacccgcttttattgaggacgtgaataaaacataaga

SEQ ID NO: 24501 - DNA, 362 bp, Gossypium hirsutum
  Clone ID: LIB3272-038-P1-K1-F3
ttcagaaagaaataaaggaagaagaagcaatggccactcttacagtgcccacgacagttccttcggtgtctgaagattgtgaacagctaagaaaagccttttcaggatggggaactaatgagggcttaatcatagatatattgggtcacagaaatgccgagcaacgaaacttgattcgaaaaacctacgctgaaacctatggagaggatctcctcaaggcactagacaaggagctctcgaatgactttgagaggctggttttgctttgggctcttgatcctgctgaacgtgatgcccttttggctaatgaagccaccaaaaggtggacttcaagcaatcaggtccttatggaaatagcttgc

SEQ ID NO: 24502 - DNA, 416 bp, Gossypium hirsutum
  unsure (1)..(416): unsure at all n locations
  Clone ID: LIB3272-038-P1-K1-F5
gtttaaaatataagaaaaaaaatcatacgcaatgagcactgctggtcaggttattcgttgcaaagctgcggtggcatgggaggcggggaagccactatcgatagaagaagtggaagtggcaccaccccaaaagcatgaagtccgtattaagattctcttcactgctttatgtcacactgatgtatactactgggagtgtaagggttacactcctctgtttcctcgtatacttggtcatgaagcctcanggatcgtggagagtgtgggtgagggtgtgaatgatttgaaacctggagatcatgtgctccctatcttcaccggagaatgcaaagaatgtcgccactgtctgtcagaagaaagcaataacatgtgcgaactgcttaggatcaactgcgaccgaggtgttatgcttgctg

SEQ ID NO: 24503 - DNA, 426 bp, Gossypium hirsutum
  Clone ID: LIB3272-038-P1-K1-F6
atcaacaatgggtgaaatatggcttctccatgtgcactttaccagattttaataagtacccgattgctttttacactccccttagcttagctttctttgtgatcttttcattttttctcaaaaaacgatgtcgcttttcttcgaaaggaacggtgatggtaattcaatcagacggtcagggtttatccacgatatgcagtgtattcaagattcgccggagctaaaaaacgatgatcagagagagtcggtgctggcggaagatagggaagaagaggatgatttggagtattgtagttcgtcgtcgatcggagggaacagtgatgtttctggcgaatcatcatcggacggtgaagattcaagggagactgaagttcaaggcaagcttaaaggacccttggataccatggatgctctacaagaggtttt

SEQ ID NO: 24504 - DNA, 375 bp, Gossypium hirsutum
  Clone ID: LIB3272-038-P1-K1-F7
gatttcctttccttttctcaccggaaaatgaaaaacatgggcgactttccgacggtgctagtcgtcgggcctttgatcttcagttgtctttcctatgttagatccgacgctttcgatcaccgttacaaggacggtgaccctgtacctctttacgccaataagggtggcccctttcacaaccccagtgaaacctatcgctacttcgatctacccttctgttctccagatcatgtaacggagaaaagagaagctttaggtgaggttttgaatggagatcgactcgtgagtgctccttataaattgaattttaaagaggaaaaagattcttctgttgtttgtaagaagcacgttttaaaagatgagggtggctttttt

SEQ ID NO: 24505 - DNA, 256 bp, Gossypium hirsutum
  unsure (1)..(256): unsure at all n locations
  Clone ID: LIB3272-038-P1-K1-F8
gccagttttcatatgcttgaatcaaagattaaaccatgcatgtcaaagtatgaacaaattcacactgcgaaactgccagtggctcattaaatcacagatggctcggctgatggaatttgctactaggctaaccgtagtcgttttggagctaatacgcgcaccaaaccggnggcttttgaagggtctcatttattagataaagggtcgaagcgtgcttcgcccgtcgtgtagacgattcatgacaactcgacggatc

SEQ ID NO: 24506 - DNA, 342 bp, Gossypium hirsutum
  Clone ID: LIB3272-038-P1-K1-F9
acaagcagttcgagaagccggaaccctagttccggcataaggtcaacaccggaccgatccgcttactctcctagcttttcttcctacactgcatcaactgcctctcgttcagggcggaatccagtaaaggttgcggtccggtccatcgctggagcttttgtcgcgtgttttacacctcccgagacagacgacagcaataatttaaaagtatccaatgagtttggagctccttctgctgcgtcggaaacgtcaagaatgaggggtcagaatcgagggatttattccaattcaacgaaggagagagcgcctgggagcatgaaattcacgattgaggaaattttt

SEQ ID NO: 24507 - DNA, 406 bp, Gossypium hirsutum
  Clone ID: LIB3272-038-P1-K1-G1
gcgctgtccacaacactgaaaatgttgccgttcgacacaatcgaggaggctgctacattattgggacggaacctaacggtggccgagacgatgtggttcaagtactcggctaaaaagtcggattactatctttactgccacaacatgttgtttttgttcctcatattttctgtggttcctttgccgctcgtttttgttgagatgatgagatctttgggtttcgataaatacaagattcaacccaaagttagcctgtcgttgcctgagatgttcaaatgttacaaggatgttatgcggatgtttgttcttgttgtgggtcctttgcagttagtctcttatccttcaattaagattatcgggattcgaacagggctgccattaccatcgttgtgggagattgtggcac

SEQ ID NO: 24508 - DNA, 369 bp, Gossypium hirsutum
  unsure (1)..(369): unsure at all n locations
  Clone ID: LIB3272-038-P1-K1-G10
ggggaggaaaatgccaatgggttgcccctttctttccctccgcttctccctctttgtctccctttctttcgcaacttcatcttctcccttctcatttttcaagctccaatccccatcatcttcaatccccaaagctacgccatccgatttgctctctctcttggccaccccttctcactcttcctcagttaacccttcagtcgccgatgaactcaagtcctgtttcaagttcctcgtcccctttaatccaagcaatacccgaagctcctctgatttcaaatccccttcttctagacggtcccttttgaaaagcccaagagatgaacaaaatgagcttatttggtggcctnctgaaccggttcttgagct

SEQ ID NO: 24509 - DNA, 325 bp, Gossypium hirsutum
  Clone ID: LIB3272-038-P1-K1-G11
atctcgaagcttccctttccgttttagatctcaaaattcaaaaggctctctttttcatctcatggctgctactattgtctccgtcaaagctaggcagatcttcgacagccgtggaaatcctacggttgaggttgatgtggaaacatcgaacggtataaaggctagggccgcagttcctagcggtgcatccactggaatttacgaggctcttgagttgagagatggaggttccgattacctcggtaaaggtgtatcgaaggctgttgctaatgttaacacaatcatcggccctgcattgattgggaaggacccaaccgagcagact

SEQ ID NO: 24510 - DNA, 209 bp, Gossypium hirsutum
  Clone ID: LIB3272-038-P1-K1-G12
gcctgcgttttttttttcatttctctgaaccaaaaagactttagcttttcgctgggagagagaccatgttggtttaccaggatctcatctcccgtgacgagcttttttctgactcattcccctacaaggaaatcgagaatgggatgctgtgggaagttgagggaaagtgggttgtgcaaggagctattgatgttgacattggggccaat

SEQ ID NO: 24511 - DNA, 382 bp, Gossypium hirsutum
  Clone ID: LIB3272-038-P1-K1-G2
gcatttttcacaaaaaatgagagctccagccttatcattttgctctaatgtattcccaggctcaactccgcagtgtgaaaagcaacctggcagtggcactgccatttttccaagagcccaatggggttgccgtggctccaatagttatcagcgcctcaaaaaaaattagtttccgaagcaactgcaacaaaaggcaaccccggtggtggtggcggcggcgaaggcaccggtggaggtgactgagcagcattgtaacaagggaagtgtttgaagagatgcttccgtatagaaacgatccttgttgccctgccgctgggttctacacctatgatgctttaatggaagctgcaaaggcttattctgcttttgctgcaaccggcga

SEQ ID NO: 24512 - DNA, 225 bp, Gossypium hirsutum
  Clone ID: LIB3272-038-P1-K1-G3
caatggtgtgcatacccaaggcgaccatggacgacctactggctatgcaagcttgcaacgttgctttgccttcccgagaattaccagatgaaatactatttctaccacatcctctcttggcctcagcttttttacgtcgccgaggactacaacggccggatcggcgggtacctcctttctaagatggaggaccaaagcaacgagtgccacgggcacattaccttt

SEQ ID NO: 24513 - DNA, 378 bp, Gossypium hirsutum
  Clone ID: LIB3272-038-P1-K1-G4
gccgacaatgtgggttcgaatcaacttcagaacacttcgcaaaggtctttgagggagctcagattgttctcatgggtaaatacacagtgataacacggtcggcccctgtgcgctctgagaaacccggaacccggttttcttttaaccttatccccttgcttcagggaaatgttggtttgatttttaccaagggtgatttgaaggaagttagtgaggaagttgccaagtacaaggttggagctcctgctcgtgttggtctggttgcacccattgatgtggttgtcccacccggcaacactgggcttgaccctacacaaactttttttttccaggtgcttaatattccaaccaagattaacaagggtactgttgaaatta

SEQ ID NO: 24514 - DNA, 274 bp, Gossypium hirsutum
  unsure (1)..(274): unsure at all n locations
  Clone ID: LIB3272-038-P1-K1-G5
gtttcattttattgctatttctatcatttatttgcttctatagaggttcttcaaaggccgtgatgattgatccggttcgtacgaggaaaaattttttgatctcatccagacatcgaacggcggcgaaggcgggcgatcaacatacagataaagcttcgatttcctncaccaaccaccactaccacgacaaccacaaaaagaagagcaggttttcttcttaatcgcccgccattcaagtgagggcttttaacttcttcataaagcaccaaggctt

SEQ ID NO: 24515 - DNA, 431 bp, Gossypium hirsutum
  Clone ID: LIB3272-038-P1-K1-G6
tcggtcagtattgtagatcattaaaatggagaagaaaggttttgtgtgaaatattctcccttgtcgggggtttttttaatcttttctttccctgggctgctgttcccactcctaaagccctaaaataaaacagggacccccttttttttgcccaagattactttgctcaggatgaaatggaattgatggatggaaaggaattgttaccggagggtgacagattcaatggggaagggatgttaatggaaagcactgattatccagggacaggtgcaaacaagaaccatgatcccaaaactccagggagagcttaaaaaacattaagacccataacctatttgttttatgtatagcttaagacatgacaggataaaaggcatgtctttgaatctgggtttccttcaatttttcgctagaatttcctctctttt

SEQ ID NO: 24516 - DNA, 383 bp, Gossypium hirsutum
  Clone ID: LIB3272-038-P1-K1-G7
atccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccggtgattgtggtggactccttcaatgcaaaggttggggtgtacctccaaacaccctggctgaatatgcacttaaccaatttggaaacatggatttctacgacatttccttagttgatgggtttaacatccccatggtgtttggtccaactaatggcggttgtcacaacattcggtgcactgcaaacattaacggacaatgcccgaatga

SEQ ID NO: 24517 - DNA, 325 bp, Gossypium hirsutum
  Clone ID: LIB3272-038-P1-K1-G8
gcattgttcattggtgttctaacaatggaccctaggatttcattctctaatgattgtgcggatgtggggtccaggtttgaaaccactttttccggggagcctccgttttcgccgccggagttcgaatcttcggtaaaaactacgctatgataccggcggacgagatcttcttcaagggggtggtgttgcctttgaaaggggataattaacatggaagggaggtgtctttaccagataccctgcttggggatgaccgggataatggcggcgggttcttcccgccgaaggggttcgggggggggaaaaagagggttgggttcaaaaa

SEQ ID NO: 24518 - DNA, 61 bp, Gossypium hirsutum
  Clone ID: LIB3272-038-P1-K1-H10
atttgttttgaaggcgaccaacaacagttcaccacacagcatcgcatttaaacttggactt

SEQ ID NO: 24519 - DNA, 427 bp, Gossypium hirsutum
  Clone ID: LIB3272-038-P1-K1-H3
tgcttgaaaatggcgaaaccatcgagagaagccatttccatggcttcaacctcgccgtcgtctctctctccttcgaaggtacccatggagctccacgtatccaaccgtcaaaagctcctcaaatctcttcgccaacacctctccaagtcctctcgcccccatcatggcttcgttctcctccagggtggcgaagagcaaacgcgctattgcaccgatcacatcgagctgttcaggcaagagagttacttcgcttacctgtttggtgtgagggagcctggtttctatggtgctattgacattgcaactgggaaatccattctttttgcgcctaggttaccagctaattatgctgtttggttgggggaaataaagccagtttcctactttcaagaaaggtatatggttagcatggtctactacactgatg

SEQ ID NO: 24520 - DNA, 101 bp, Gossypium hirsutum
  Clone ID: LIB3272-038-P1-K1-H4
tacaatctaaacttcctggagctccgcaattccttctttgtctgcttcctgataggaaaaactctgatctttatgggccatggaagcggaagaatcttttg

SEQ ID NO: 24521 - DNA, 168 bp, Gossypium hirsutum
  Clone ID: LIB3272-038-P1-K1-H7
ggctgagcgaatttgcggtttgttagttcgtgtgtgaaagaggtaataaaaggagaaaaacgatgggtgttttaacatttgtgtgcaggaccaaaggcggtgagtgttttgccaagcagttggagggagagatggaaggctttgttgtttccacttacaagctccagc

SEQ ID NO: 24522 - DNA, 425 bp, Gossypium hirsutum
  Clone ID: LIB3272-038-P1-K1-H8
gttgtggagaaaaaaatattacgtttgggaagcgagaaagtgcgagaaaatgagcggagcaggaaagaaagtagtagatgtggctttcaaagcaggaaagagcattgattgggaagggatggcgaagcttttggtctccgatgaggctcgcaaagagttcgccactcttcgtcgcactttcgatgaagttaactccactttacagaccaagttcagccaggaacctgagcctatcgattgggaatattatagaaaaggaatcggctcgcgattggtggatatgtacaaagaggcttatgagagcgtagagatccccaagtttgttgacacagtcactcctcaattcaaaccgaaatttgatgcattgttggttgaattgaaagaagcagaagagaattctttgaaagagtccgagcgtttggaga

SEQ ID NO: 24523 - DNA, 416 bp, Gossypium hirsutum
  Clone ID: LIB3272-038-P1-K1-H9
ggcaagttagatgttcttacaagtcttcaaaaccttgtttcacttacttctcaggtgagttgccgaattcatctttttttccgaaaactcccattatgtgaccttgaatcaaacaaaggcctatatatctccaatggtgttgtatcttcttctgatcttgaacattcgaggcatgttggaccagcagtgaagctagtgatgtcgatcctcataagtgccagtgtgatcctagtactactagctatctacgcgttaatccgtgctcgatttttcaacaatggccttatggaagattatacttgggaagtgactctgtatcagaaactcgacttctcgatcgatgacatagtccacaacttgacatcatccaaccgtgaccgcactgggagcttcagggttgtatacagaggaacgat

SEQ ID NO: 24524 - DNA, 202 bp, Gossypium hirsutum
  Clone ID: LIB3272-039-P1-K1-A1
gccattaaagcttagaagaaccaaatccttaaacaaaagttcaaaattccaatttcttggaagaatataatcttcttttctggcgttgcttgaacttctctttcagttttagcaccttaagtaaacgagcctgggggcccaaaaaagctaaggatctatttaattagatttgtttttgtttctcggaagtgccaaggaaagg

SEQ ID NO: 24525 - DNA, 328 bp, Gossypium hirsutum
  unsure (1)..(328): unsure at all n locations
  Clone ID: LIB3272-039-P1-K1-A10
gaaagaatatatcaaacaaaaagtcacaaaccagagtaaaccctaagaacactgtcggcggcaatggcaacttacgatctaaccccgcgtatcggcccgaacctagacaggcacttagtgtttccattgctggagttcttgcaagagcgacaactatacccagatgaacagatcttgaaagcaaagatcgagcttttgaacaagacaaatatggtcgattacgctatggatatccataagagcctttaccacaccgatgatgttcctcaggacatgttcgagaggagagtcnaggttgtcgctcgtctcaaagctttggaagatgccg

SEQ ID NO: 24526 - DNA, 307 bp, Gossypium hirsutum
  Clone ID: LIB3272-039-P1-K1-A11
aaacaccctttaacctcatatgtggtgtcccttacactgccctacctatagccaccgtgcatctctgtcgacacctacatccccatgctcatgcgccgcaaagaaagaaaagactacggaactgccaagtccatcgaaggtgtttacgaaaagggtcaagtttgtttggtgggggaagacctcgtaacgtgcggtgcatcggttctcgaaacggcggcaccgctttgggctttgggtatcaacgtaacggatgccatcgtgggtatagatagggagcaaggcgggagggaaacggtggaggagaatg

SEQ ID NO: 24527 - DNA, 240 bp, Gossypium hirsutum
  Clone ID: LIB3272-039-P1-K1-A12
atcagataaaaatatcttattctacaatattttccgatcaaatcgagatccccgcgaaaatgaacgacggagatgtttccaggcagattcagcagatggtgagattcatccgccaagaagcagaggagaaggctaacgagatctctgtttcagcggaagaggaattcaacatcgagaagctccagttggtgggggcagaagagaagaagatcaggcaagagtacgagaaaaaggagaagc

SEQ ID NO: 24528 - DNA, 373 bp, Gossypium hirsutum
  Clone ID: LIB3272-039-P1-K1-A2
caaaaatagtgatatgtataacgagtggaagattgaactgaaagctatggcagaccgaattattagcatgcggaaacaactatttgatgcttaaagtgctaaaggacttcaggggactggagtcacattataaaagcaattgggatgtttactttcacaggattggacagtgatcaagttggtttcattgtcaaggggtaccacaattacatgacatctgatgggaggattagtatggcaggtcttagctccaagactgtgcctcatcttgctgatgctatacatgctgcagtgacccgtggctgttagaaagcaaattttaaagttctgtagcaagtactttttgggttttagccccatccatggcatgact

SEQ ID NO: 24529 - DNA, 300 bp, Gossypium hirsutum
  Clone ID: LIB3272-039-P1-K1-A3
ctcgatctccccactttcactatcaatggcgaagccaaggctttcgcgcgttccggcccggaaatcttcatcgtcaaccatgtttctaactctgctcatcatgttcaccttcctggttttgattcttttggcgctcgggatcctttcaattcccagcagtaactcccgcagttcgcacaaacccaacgatttgacctcgattgtgcataacgtcgtcgacaaaaacgattattatgagggggtaggagagcaatgggttgaagtcatcttctgtgagcctagagcttttatctatcacaa

SEQ ID NO: 24530 - DNA, 400 bp, Gossypium hirsutum
  unsure (1)..(400): unsure at all n locations
  Clone ID: LIB3272-039-P1-K1-A4
ctcttatccaactccacccaaagctaaaaagggtcgtctctgaaacatccatggccgacaattgctcattgccacagttcgtaatggagttaagagtcttgccaattaagaaccttaaaaaacaaggttcttgtggtctctttactcgacatttaagacaccatatatctctcactaagttcaatggtgtgaacaatctttgtgaaggtaatgttgagaaatctacatttggtgaaagctttgtggtaccaatagaatccaacttcttcgctaataactcttacatttctcttcaactacacaccaaaaggctccttggtcgtaaggatttactgggttggtgtcagattccggctgctgatattgnggaaccgccagtagggtcagtccggtacttgag

SEQ ID NO: 24531 - DNA, 104 bp, Gossypium hirsutum
  unsure (1)..(104): unsure at all n locations
  Clone ID: LIB3272-039-P1-K1-A5
caacgatgcaaggaggatcttctggcatcggctacggcctcaagtatcaggcaagatgcattttggatgttaaagcagacaccgatcataccanctttattttt

SEQ ID NO: 24532 - DNA, 371 bp, Gossypium hirsutum
  Clone ID: LIB3272-039-P1-K1-A6
gtttcgtgcttcagaaaggaagtgtctcttcttgtttagaaaaaaaaaacccccaagaacgaggaatcaatcaaaaagagaagagaggtgtcacggtcgtaacgaatgcacatgtgcttagttttcttgaggcttttattcgctctttgcttctcccctttgaatctgcttctacttttagaaaatttcctgaattctcatcttctagccccgtcacagactaatacaaagaaaagacacccaagagcagaaaaggagggacaatacacctatgcggtcttgctttagtttcttgctactatgaggctgtctttgtgaagattggttttgttttctcgggggggtctttttcttgcatctttttttccctt

SEQ ID NO: 24533 - DNA, 181 bp, Gossypium hirsutum
  Clone ID: LIB3272-039-P1-K1-A7
atatactcaaggcagtgatgagaggaataaaactaccaacaccgtggcactacaagaaggctttaatgcgtgaaccctggctagtggagaacgggttgaaggggtctagcaaggagattcgccatggcaggactgcacacaacatgtcgtcttcgtcgttgcagaaaaaatcggacctgac

SEQ ID NO: 24534 - DNA, 104 bp, Gossypium hirsutum
  Clone ID: LIB3272-039-P1-K1-A8
tctaaacctttgcccccaagcatgttgccctcccatgtgctaaagagaaacaaggatggttatttctggttcttaaagaacccattccagtacacaaagacaat

SEQ ID NO: 24535 - DNA, 270 bp, Gossypium hirsutum
  unsure (1)..(270): unsure at all n locations
  Clone ID: LIB3272-039-P1-K1-A9
cttggatctaaatgtcaccgaagaggtattgaagcaatttttcttgccattaggagaaaangtgtgtgtcaggattcctgccaccaaaggatgcggttatgtccagttcgcgaacaggaattttgctaagaagccatacggaggatgcaggggcaaatgattggtcaacaagttgtccaaattacttggggtaggatcccaacagcaaatcaggacctacctggtagctggggcgcacaaatagatcctattcagtggaatgcttattac

SEQ ID NO: 24536 - DNA, 139 bp, Gossypium hirsutum
  Clone ID: LIB3272-039-P1-K1-B1
gccgttatttattcttttgccttttgtgttttgtctgagaaaaaaaggaaaggaagaaaatgtctccgtcgtcgccccgccgttgtcgtcggctggttttatttgtataagctttttggcgccgctgattttaccttcg

SEQ ID NO: 24537 - DNA, 277 bp, Gossypium hirsutum
  Clone ID: LIB3272-039-P1-K1-B10
aaagaaaagactcttccttttttcctttctttcctgtccaagttttttgagttgtaggccaagatgaatgctaccatgtttaaggttttgatgatgttgggttttttgggcaccgattggatgggtcaaggaccaacaggaccaggcccaatattccctcccatgtttacaccttcggcaggtggttcttcaaccccgaccccaaacccaagcccaaccccaacctcaatcttaaccccaaccccattcccattcccattctctactccaaacccat

SEQ ID NO: 24538 - DNA, 371 bp, Gossypium hirsutum
  Clone ID: LIB3272-039-P1-K1-B11
cccaaatctactccctcctcttctttagcgtccttttcatttccgctcatgcagcgcgctttgaaatccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccggtgattgtggtggactccttcaatgcaaaggttggggtgtacctccaaacaccctggctgaatatgcacttaaccaatttggaaacatggatttctacgacattttcttagttgatggggttaacaacccc

SEQ ID NO: 24539 - DNA, 343 bp, Gossypium hirsutum
  Clone ID: LIB3272-039-P1-K1-B12
cgacatcccagtcaagacactgttgacggttattgaaggagcggaatctgacggagatgtgttagttttccctgaaatgatcaaatacaagggtttggcggactccgatgtggatggttttgttgaggatgtgcttgtgaatggcaagccgtgggcttctggagttcaggaaacattgactggttcatatatctttgtgtgtgctcacgggaatcgggacaagagatgtggtgtttgtggaccagctctgattcaaaagctgaatgtggagattgagttgcgtggactgaaggatcaggtgtttgtaagtgcttgctctcacattggagggcacaagtatgct

SEQ ID NO: 24540 - DNA, 359 bp, Gossypium hirsutum
  unsure (1)..(359): unsure at all n locations
  Clone ID: LIB3272-039-P1-K1-B2
ataagaagagatttagggggataaccggattctatttgacttacactactaatactaattcatacatggactatatgttcttcttctcctcctgatattgatcctgctcgacctttgacgcaagtcaagaaaaggagtcctttttcatccttctgcccagaatcgcctaatcaaaaatcaatcatggctgtgaccatcaagcgagcggccctcatcgttgccagtcttggcgtcttatcttttatctttggagtcattgccgaaaacaagaagcctgccgctggaactnctaattctggaaaagatgtgggtatttgtaagtattcattcgatccttcgtgggttctggctacctatcg

SEQ ID NO: 24541 - DNA, 331 bp, Gossypium hirsutum
  unsure (1)..(331): unsure at all n locations
  Clone ID: LIB3272-039-P1-K1-B3
ctttttctcattcattctttagtttcaatatcaaagcaaaaatgggttcttcttgtaatgttgtttcaatggccttactggcttgtttggtgttgaactccttggtttttgttgcccacggtggtgacttttaccaggatttcgacctaacatggggtgacagaagaggcaagattttcaatggtggcaagctcttgtctttgtctttagacagggtttcagggtctggttttcaatctaagaaagagtatttgtttggaaggatcgatatgcaactcaagcttgttgctggcaactcagctggcactgncactgcttattatctgtcatc

SEQ ID NO: 24542 - DNA, 374 bp, Gossypium hirsutum
  Clone ID: LIB3272-039-P1-K1-B4
gagaagtcgagttggacgatgtctggtttgcctatccttcccgtccgaaccatatggtactcaagggaataacacttaaactgcaaccaggatcaaaagttgctcttgttggccctagtggtggaggaaaaagcacgatcgcaaacttgatcgaaagattttatgatccaattaagggaaagattctattaaatggggttcctttgctagaaatatcacatgaacatttttatagaaagatcagcattgtaagccaggaacctgtccttttcaactgctcaatagagaaaaacatagcttacggatgcgaaggccgagtcaatattaccaatattgaaaacgcagcaaaaatggccaatgcacatgaattcata

SEQ ID NO: 24543 - DNA, 369 bp, Gossypium hirsutum
  Clone ID: LIB3272-039-P1-K1-B5
ttgttggccaaatcatgaccactctcgtgaccggtgtgtttctcctcctactatccggcggcggcgtcgtatccgccgctagatatatcaccggtgatggtctccgggtaccttcggaagcttcaaggttcttccgatggaggagcgatgatgatgaagttggtggcacaagatgggcgggcctgattgctggatctaatggatattggaattacaggcatcaggctgatgtttgtcatgcttatcaactcctaaggaacggtggtttgagagaggaaaatatcattgtctttatgtacgaggatatcgctttcaatgtagaaaaccctaggcctggtggtatcattaacaatccttatggcgatgatg

SEQ ID NO: 24544 - DNA, 390 bp, Gossypium hirsutum
  Clone ID: LIB3272-039-P1-K1-B6
gtgtagcgattctcagttagtcttttctttaagcttacagcttctctccagagttttataatgggtaaggagaaggttcacatcaaccttgttgtcattggccatgtcgactctggcaagtcgaccactaccggtcatttgatctacaagcttggtggtattgacaagcgtgtgattgagaggttcgagaaggaggctgctgaaatgaacaaaaggtcattcaagtatgcttgggtgcttgacaagcttaaggctgaccgtgaccgtggtatcaccattgatattgccctgtggaagttgagaccaccaaatactattgcaccggtattgaggcgcctggacaccgggactttatcaagaacatgattaccggtacctcacaggctgact

SEQ ID NO: 24545 - DNA, 268 bp, Gossypium hirsutum
  Clone ID: LIB3272-039-P1-K1-B7
gcttttctttatattctctttccaatgaggtgcagatgggttagacgcaggccagaggagatccaaacctcttccttctgtttttttctcttcctctttttctgggttttaagctctaaattactaaagggaaagaatggatcatctcgcccatgtttctaaccaaccaaattctcagccccaatctcaaatttctcatttggctctcgacattgggaggtctttgatcaaattggtgtatttttgtagatatgatgatagatgtaga

SEQ ID NO: 24546 - DNA, 226 bp, Gossypium hirsutum
  Clone ID: LIB3272-039-P1-K1-B8
ctcatgtatgtatacagactcaggtaaatggctgaacttctgcctccgatctgtgatgggaaaagccggagcgagttctgaaggtaaatggtagccttagctgcgggacatttagagagaatgtgcattgtttcgacctgtatttagctaacaggtattgtgtttttaggagctcaagattcgaggtcttcatagcgttgtagctttgcaactgctcgcattggtt

SEQ ID NO: 24547 - DNA, 280 bp, Gossypium hirsutum
  Clone ID: LIB3272-039-P1-K1-B9
ggggattttgctggtttatgatgttactgatgagtcatctttcaacaatattgggaattggattcgcagtattgaacaacatgcttcagacaatgtcaacaagatactggttggaaataaggctgacatggatgagagcaaaagggctgtgccgacctccaagggtcaagccctcgccgatgagtatggtatcaagttcttcgaaactagtgcaaagacgaatttgaatgtggaggaggttttcttttcaatagccaccgacattaagcaaaggcttaca

SEQ ID NO: 24548 - DNA, 340 bp, Gossypium hirsutum
  Clone ID: LIB3272-039-P1-K1-C1
attaaaacagggaaagaaaagcagcgtaatgggtgaagaagtgaaggtttttggatactgggcaagcccttacagctacagggcagagcttgctttgaagttgaaaggtgtttcttatgagtacataaatgaggatatctttggcaacaagagcgatttgcttttgaaatacaatccggttcataagaaagtcccggttcttcttcacaacgggaaaccaattgtagagtctcttgttatacttgaatacattgaggaaacttggaagcataatccctatttgccacaagatccttatgacaaagctaccgctcgattcttgatcaagttcatcgacaaa

SEQ ID NO: 24549 - DNA, 146 bp, Gossypium hirsutum
  Clone ID: LIB3272-039-P1-K1-C10
ataaaataaattataaaaaaaaaaaaaaaaaaaaaaaaaaaaaaaaaataaaagtgggggcctccaaaaatggggttccaaccttacattcacataaataaccatgtaattacattttaactatattacctactttcaatcaacaa

SEQ ID NO: 24550 - DNA, 260 bp, Gossypium hirsutum
  Clone ID: LIB3272-039-P1-K1-C11
gtttttggaggtttaaccggggccgcccctgaccttaagttaattattttgcggcggaaaggaattaggatttaatttttaggccccgtaagaaggtaatgggggggaattaataacctccaatcccgaggtttatattataaatagaaccaggtttgttcataggaggcaaaccattgcagcctctcaaagatccaatcttttaatatttaaacaaacaagagggcttagatttttctccactagctcaaatgggcact

SEQ ID NO: 24551 - DNA, 388 bp, Gossypium hirsutum
  Clone ID: LIB3272-039-P1-K1-C12
gagaaacttgaggggaagaatcttgctatcccttgcttttctctcgcaaaagggtctcaaacttgtttgtaacgttcgctgaatactatcgctcatttcttccctcagaaccctaatcgataactgaagccatttaatcatgtttgggcgtgttccaaaaaaatctgataacactaagttttacgaagtacttggggttcccaaaagtgcaagtcaggatgaattaaagaaggcttataagaaagctgcaattaagaatcatccggataaaggcggagaccccgagaagtttaaggaactggctcatgcttatgaagtacttagtgacccagagaagagagaaatatatgatcaatatggtgaagatgctcttaaagagggaatggga

SEQ ID NO: 24552 - DNA, 236 bp, Gossypium hirsutum
  Clone ID: LIB3272-039-P1-K1-C2
cctttttaaaaaaaaaaaaaaaaaaataataaaaaaaaaaaaaaaaaaaaataaaatagatggaaaaaaaaattagagatacaaaaaaaaaacttaaatttaaaaataaaaggaatttaattaaaaaaacataaatgaaaaatatctttaataaacaagaggggtgcccttttaaaaaaacaaaacttttcatacgagatttcccaggttttattttctttattaagccaattaaa

SEQ ID NO: 24553 - DNA, 298 bp, Gossypium hirsutum
  Clone ID: LIB3272-039-P1-K1-C3
aaagaaattgtcaaaaatcatgatgttgctttctcagatagaccaagtaccactggcgctaacatcttgttttacgggcgcaccgatgtggctatcgcaccgtatggcgagtactggagacaagctaggaaggtgtgtggcactgatcttttgactcttcgaagagttaactcgtttcagttcttgagagatgatgaagttgcagtcaccatatataaactccgccgagcttctatcaagggagaggctgataacctgacggaggtgctgatggatgcttcgaataaccagatttcga

SEQ ID NO: 24554 - DNA, 157 bp, Gossypium hirsutum
  Clone ID: LIB3272-039-P1-K1-C4
ttcaaatcgcagggcttttttaacctctccctctctctctagaaccctcactattgttttcttttgtttgtttatatggcatctcaagccagcctcctccttcaaaaacagctcaaagatctttgtaggaatccggttgatgggttctcggccggat

SEQ ID NO: 24555 - DNA, 361 bp, Gossypium hirsutum
  Clone ID: LIB3272-039-P1-K1-C5
gttttattggccatgataaaatagggactggcagcagtggacagaacgggcaggctggtcggggaggatgggcacttccctctactgagtcttctcaaccaaaagggaggatgatggtagatgcaagagacaggtccgggcctttgcatagcgaacacactaggatgaaaggatcagcagattttaaagataagagttctcactctcgagggaaacgtagggactaagttggagtgagtctaacaccgagatgatcttgtggtgcagaaggcattgccttccctcttatatatatatgtatgtagtattgtatgttgttgccatgttttcctagtttagagcttttatgattcatgcgtct

SEQ ID NO: 24556 - DNA, 319 bp, Gossypium hirsutum
  Clone ID: LIB3272-039-P1-K1-C6
gtcggcagaactcactgtgtgaagctggtgcatcgtttgtacccagaggttgaccctgccctcaaccccgaccatgttccacacatactccataaatgccctgatcagatcccagaccccaaggccgtccagtatgtgagaaacgaccgtgggacacccatggttttggataacaactactacaggaacatactggacaacaagggtttgttgattgtggatcaccaactggcgtacgacaaaaggaccagaccttatgtgaagaaaatggccaagagccaagactatttcttcaaggagttctcaagggccattactc

SEQ ID NO: 24557 - DNA, 309 bp, Gossypium hirsutum
  unsure (1)..(309): unsure at all n locations
  Clone ID: LIB3272-039-P1-K1-C7
cagaaatggatgcaacgatcagtcctggattataccctttgcaccgttgtaaaactctccatctggtgaggcatgctcagggggttcataatgtagcaggggaaatagatcacgctgcttattcatctgaagaatatttcgatgcccatctcactcctctgggctggcaacaggttgatcatctgcgcaaccatgttcatgaaactggactttctaagaaagtggatttggtcattgtttcccctttgctcaggactatgcaaactgcggtgggagtctttggtggtgaggngtataaggatgggatag

SEQ ID NO: 24558 - DNA, 217 bp, Gossypium hirsutum
  Clone ID: LIB3272-039-P1-K1-C8
ccgctgttttattggtaatctttcatgggcaacaacagataggggcctaaaagatgcatttgaaaagtttggaaatcttcttgacgctaaggttgctgttgacaagttttctggccgttctcgtggatttgggttcgtctcttttgatgataaagcagcaatggaggaagctattgaagcaatgaatggaatggatttggatggccggaatataact

SEQ ID NO: 24559 - DNA, 375 bp, Gossypium hirsutum
  unsure (1)..(375): unsure at all n locations
  Clone ID: LIB3272-039-P1-K1-C9
agaggcgctgtctacgagtcgggttgtttgggaatgcagccctaatcgggcgggagattccgtccaaggctaaatacgggcgagagaccgatagcgaacaagtaccgcgagggaaagatgaaaaggactttgaaaagagagtcaaagagtgcttgaaattgtcgggagggaagcggatgggggccggcgatgcgccccggtcggatgtggaacggcgagagccggtccgccgatcggctcggggcgtggaccgacgcgggtcgtggcggcggcccaagcccgggcctttgatacgcccgtggagacgtcgtcgcctcgatcgtgggatcagcacgcgccgncttcgcgtgcttcggcacctgcgtgctccgggcg

SEQ ID NO: 24560 - DNA, 388 bp, Gossypium hirsutum
  Clone ID: LIB3272-039-P1-K1-D1
cgcaaagatcagaaaataggatccagcgatggcggaagatctggttctcgatacggcgatcagagattgggtgttgatacccctttcagtggtgatggttctgatcggcatcctccgctacttcgtctccaagctcatgcgctcctttcaagttcctgatcctaagatcgtcaaagaagggcaagtaatcgttagggctcggaatttacgaggtgctgcaaattttatccctcccaagtcttttcgatctcggagggtttatttcagcaatgaggaaaatggattactgtttgtccgcaagggccaggctcaaaatgcgcaagcacaaatgttctctgaccctaacatggctatggacatgatgaagaaaacctctctatgatatacc

SEQ ID NO: 24561 - DNA, 317 bp, Gossypium hirsutum
  Clone ID: LIB3272-039-P1-K1-D10
cttcaatcatgctccggctagcggggatctgatctggaactactgatgtcatggcggacaccgacggagcatacggaaccattaagcaacctgctgagatgggtgatgcagctaacaacgggatagatattgctaccaggcatttcgggcctagcaaggatcagatacctatactttcatacactggcttttatgagctagctggggttggagctgtagagatcaccagcgggccttgagttgcattgcattctgggagagaagacaagacttaccaaccacctgagggatgtatttccaatgctactgaaggaaca

SEQ ID NO: 24562 - DNA, 351 bp, Gossypium hirsutum
  Clone ID: LIB3272-039-P1-K1-D11
agattttcatgtttatgacttgatacaccaatctttttcacccgtattcatataatgtctttctgatcctgaaatccccaagatgaacaatctgttctcaggctccttctctcgcttccggagcgaagaggcgtcccctgatcaccatgtaatcgagatgactcagtcttcctccacctctggcggtgttaacctcgacaagttcttcgaagacgtcgagtccatcaaagacgagctcaaagaactcgagaggctaaaccacgacctttcatcgtctcacgagcgaagcaagacgttgcacaatgcgaaagccgtgaaagaattgagagcaaagatggatgctgatgtagc

SEQ ID NO: 24563 - DNA, 352 bp, Gossypium hirsutum
  Clone ID: LIB3272-039-P1-K1-D12
tatcgaaggaaagatctgaaagagaatggcaacttttgcagggactacccagaaatgcaaggcttgtgaaaaaactgtttacttggttgaccagcttactgctgacaacaaagtttatcataaagcttgcttcaggtgccaccattgcaagggtacccttaagctaagtaattatagctcctttgagggtgtcttgtattgcaagcctcactttgatcaactatttaagatgactggcagcttggataaaagttttgaaggaactcctaaaaccgttagggtagaccgatcagctgaccaggtcaccaacagcaaattttcgggcttgtttgccggaactcaaaagaaatgt

SEQ ID NO: 24564 - DNA, 357 bp, Gossypium hirsutum
  unsure (1)..(357): unsure at all n locations
  Clone ID: LIB3272-039-P1-K1-D2
cttagctctaagcagttaaaaccttccaacctcaaaacccaaagcctcaattccctggctttgtctcttaacttatctctcccacgtctgccctgcttttcagcagcttttgacagcttccaagttactgaagatgaccaaagcagtggagaagaatacccagaaacagaatctcaagaccttgaagaacaaccacaacaagaggaagctgaagaagataaggtttcagagtctggcggtgaagaaggaaagttgtatgttgggaatttgccttattcaatgacttcttctgagttaactgagatttttagtgaggctggtagtngtgctaaagtggagattgtttatgatcgagtt

SEQ ID NO: 24565 - DNA, 319 bp, Gossypium hirsutum
  Clone ID: LIB3272-039-P1-K1-D3
ctttatcttgggaaaccaggcttaaaatcatcaacggagctgctcgaggtctagctggtgtacacttttctgagaaggtcatttgtagagatttcaaggcctctaatttattgctcgatgggcactacaatgcaaaaatatcagattctggcttggctaaattggggccttctggtggagactcgcatgtaactaccagggttatgggaacatatggttatgctgcacctgaatacattgcaacaggacattcattcctcaactacgcctaggcatagacaacaatctagtagtcagcgtccacagtttcattcaaggc

SEQ ID NO: 24566 - DNA, 419 bp, Gossypium hirsutum
  Clone ID: LIB3272-039-P1-K1-D4
gcttgttcagctaattttgattttcttttggcaactgagacagacgatcaagagttagaaatgctaagggctctggtgaggaaagcagcttcaacttcagcttttgggagtgcaaattcagccccatgtgttattgctaatccaatccaccacctccagaccaaacgcttctccataggaatcctccccgatggggtcaatcgtagctccgacaattttgtccagaattccgatgccatggaacgtctcttgtctgaccttcaatcccatatcaacaaggttcttgctggaggaggagaaactgctgtgaaaaggaacaggagcagatataagcttctccctagggaacgactcgatcgtcttcttgatcctggttcttcttttctcgaattgtctcagcttgcagggcatgaattata

SEQ ID NO: 24567 - DNA, 359 bp, Gossypium hirsutum
  Clone ID: LIB3272-039-P1-K1-D6
cagttatcctcaagatgatccttcgagcacctttacttgccctgctggttccaattgcagggtcgtgttttgcccccgaggctcacctcatatagagatggtcggaagtaagagccaagaaaaataaagggatcatctcttggtctagttaatctgcgccttggaactaaaaaataaaaaagtcatttggtcttccaaatgatatcaaacacgtggttctacttggtttattttacatatgttttgtttaataatattgtgcagtttcaacagcacaagacgtcacaagttgctatcatctttcatcaaaatttccaactcataaatacccatataaaaaagttatatgaacttatatt

SEQ ID NO: 24568 - DNA, 261 bp, Gossypium hirsutum
  Clone ID: LIB3272-039-P1-K1-D7
ttaagatcgggattaacggatttggaagaatcggacgtttggttgccagagtggctcttcagaggaacgatgttcaactcgtcaccgttaacgatcccttcatttccaccggttacatgacatacatgttcaaatacgacagcgttcacggtcaatggaagcaccatgatcttaaggtcaaagactctaaaaccctcctctttggcgaaaaacccgtcactgttttccgaatcaggaaccctgaagagattccatgggctg

SEQ ID NO: 24569 - DNA, 355 bp, Gossypium hirsutum
  Clone ID: LIB3272-039-P1-K1-D8
cccaaatctcctccctcctcttctttagcgtccttttcatttccgctcatgcggcgcgctttgaaatccgcaatgagtgctcctacaccgtctgggcagcagcctctcctggtggtggccgtcgcctagaccctcggcaaagttggaccatcgatgtgcctgctggcactgctatggctcgcatttggggtcgaaccaattgcaatttcgatgccagtggtaggggtcattgccaaaccggtgattgtggtggactccttcaatgcaaaggttggggtgtacctccaaacaccctggctgtatatgcacttaaaccaattgtgaaacatggattttttacgacattttccttagt

SEQ ID NO: 24570 - DNA, 353 bp, Gossypium hirsutum
  Clone ID: LIB3272-039-P1-K1-D9
ctgccatcaatttgctttgaagatcatgttggctatttttcacaaggcatttgcgtgtccaccagaggagctgaatagtccagcttctcataaatctactaagaagcctaaacagcctgaagaaaccctaaatgatttcctatctcatcaccctcacaacactttctccatgagctttggcaacgctgctgttttggcttatgtccgccatgaacgtgctgcttcagttcatcagaggttgttttgtgggtttgatgacatatactgccttttcttagggagcttgaacaatctatgtatgctgaatagacagtatggtctttccaaagggagcaatgaggcgatgtttgtga

SEQ ID NO: 24571 - DNA, 353 bp, Gossypium hirsutum
  Clone ID: LIB3272-039-P1-K1-E1
gctttggaagcatggacttcatagctactatcctgtttctagctcttgtcatctccggcaccaaagctttggacccttgcggccctcagccagatgactcggaccttttggtcatcccaatctatggcaaatgttcaccattcaacccacccaaacctgactcatcgttcaacacagtcatgaacatggcatcaaaagacccagcaagggtcaagtacttgtcgagccttgtagcccaaaagaccactgcggttcccattgcttcaggccaacaagtcctaaacattggcaactatatcgtccgggtaaagattggcactccgggtcagctcatgttcatggtattggacact

SEQ ID NO: 24572 - DNA, 348 bp, Gossypium hirsutum
  Clone ID: LIB3272-039-P1-K1-E10
gttaaacccctccattcattatttacgttaagttcaaagaaatggctaatcctgtgatcactcgcgtccacagtctccgtgagcgtttagatgagacccttcttgcccacaggaacgagattttggccttgctctcaaggatcgagggcaaaggaaaaggaattctgcaacaccatcaaattattctagagtttgaagctatccctgaagagaacagaaagaagctcgctgatggtgcattttttgaagtattgaaggctagtcaggaagcgatcgtgttgcctccatgggttgcacttgctgttcgtccaaggcctggtgtttgggagtacattagagtgaatgttc

SEQ ID NO: 24573 - DNA, 415 bp, Gossypium hirsutum
  Clone ID: LIB3272-039-P1-K1-E11
ctcaaagatatcactgcaagaaaaaaaaaaaaaccagacatggcttccaacactggtgcatccgctgctcttcttcttaccttgaacttgttgttcttcactttggttagctctacctacgtgccttgcccaccaccaccaaagagccacaagcctacccacaaaagcccaccctcggcacctgaacagccaggcacttgccccagagatgcactgaaactaggcgtttgtgctgatttgttgggctcagtgcgcgttgttgttggaccgtcgaggaccaaatgctgctctctcatttcgggtttggctgatctcgatgctgctgtttgcctttgcactgctattaaagctaatgtgttgggggttaacctaaacgttcctgtttcattgactttgctcctcaattcctgcgaaa

SEQ ID NO: 24574 - DNA, 423 bp, Gossypium hirsutum
  Clone ID: LIB3272-039-P1-K1-E12
cggattccccaccatcgtcaatgtcagccagtgtagcagtagttgcattagcacttgtactagtttcaattcttccagtattctaacctctttgagtagatgtgggtcacttttagggatttcctattaccttcgatctatctcctttttctttttatgttatagttcccggtctccttatgctgtaacaagtgttggagcgaaggaattttccaagttcttctctatctgactaccaagcagttgattatgcaagaggtgcttagcttatacttaaagtaagtactatattgatctttcttctttctagcagtctcaatgaagtagtcccttattaggctctcagtgtaaacctagtctcatgctttgagatgaagctttccgacgagtcaggttgaaagaaagccatatgagtcaagggct

SEQ ID NO: 24575 - DNA, 323 bp, Gossypium hirsutum
  Clone ID: LIB3272-039-P1-K1-E2
cccggattctcaggcaaccgtctccgaccacaaattgaagaaaatcaaagaagaagaggaggaacctgaggatacaaaatctgggttgatgaatttagatgaaaatcttttgtacgaagttttcaaacacgtcgatgcaaggactttggctagggcttcttgtgtaagccgtctatggcgccaaaccgccaaagacgagcggctttgggagctgatctgcaccaggcactgggctaacatcggttgtggaacccaacagcttagatctgtcgttttgcctctcggcggcttccgtcagctccactcccggtacctttggacgt

SEQ ID NO: 24576 - DNA, 375 bp, Gossypium hirsutum
  Clone ID: LIB3272-039-P1-K1-E3
aaacaccttctttccgagaaaaaaaaagctcaagagagaagaccatggccgatcaacggacggacgatcagatctctgagttcaaggaggctttcagcctctttgacaaggatggcgatggttgcattactaccaaggagctggggactgtgatgcggtcacttggtcagaaccctactgaggcagaactccaagatatgatcaatgaagttgatgctgatggaaatgggaccattgattttcctgaattccttaacctaatggcaaggaagatgaaggatactgattccgaggaagaacttaaagaggctttcagggtgtttgacaaggaccagaatggtttcatatctgctgctgagcttcgccatgtcatga

SEQ ID NO: 24577 - DNA, 69 bp, Gossypium hirsutum
  Clone ID: LIB3272-039-P1-K1-E4
atgattatcgaagatatgatctaggaagagcatttgaagatatgtgtgctcagatgtattacagaggca

SEQ ID NO: 24578 - DNA, 260 bp, Gossypium hirsutum
  Clone ID: LIB3272-039-P1-K1-E5
atttgatcaatcgaatttacatctctctctttcttctatgctgcaaaccctataggggtggcctcaagtgattttacgagaatgtctcggttctatgttgggaatacggatcctcgggtcactgagagggatctcgaagacgagtttaggattatcggcgttctccgcagtgtatggctagctcgaaggcctactcggtatgcgtatatcgagtttgacgatcgcagggatgctattgatgcagtacgagcaccgggttg

SEQ ID NO: 24579 - DNA, 328 bp, Gossypium hirsutum
  Clone ID: LIB3272-039-P1-K1-E6
aaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaagagcccaccctcggcacctaaacagccagccacttgccccaaagatacactgaaactaggtgtttgtgctgatttgttgggctcggtgcgcgttgttgttggaccgtcgaggaccaaatgctgctcactcatttcgggtttggctgatctcgatgctgctgtttgcctttgcactgctattaaa

SEQ ID NO: 24580 - DNA, 308 bp, Gossypium hirsutum
  Clone ID: LIB3272-039-P1-K1-E7
aaatggcatttgtcaaggctcagaaaaccaaagcttactttaagcggtttcaggttgcatacaaaagaaggagagagggaaagactgactaccgggctaggattcgcctaatcaatcaagacaagaataagtacaacactccgaagtaccgattcgttgtccgatttagcaacaaagatgtcaccgcacaaatagtttctgctaatattgctggtgatatggttcttgcttctgcttactcacatgagcttccacgatatgggcttgaagtgggtcttacaaactatgccgcagcttattgcactggt

SEQ ID NO: 24581 - DNA, 370 bp, Gossypium hirsutum
  Clone ID: LIB3272-039-P1-K1-E9
ggattggtaagcgacacgcctttcttactcaaaccctattctttttcccaatggcgggaatctagggttttacattctccttttcctctccaaatcaaccttatttcattttttttcttctcttagaaataatatcgtcaatgagcaacgaattagttaacttcaacatgtccggtcttggcgatgctcttaatgccgaagcacgagctggtctcgttaacgctctcaagaataaacttcaaagtcttgctggggatcactccgatgtgctggagagcctatcaccgattgtcaggaagcgtgtcgaggttcttagggagatccagagccaacatgatgaattggaggctaggttttttgaggagagggc

SEQ ID NO: 24582 - DNA, 299 bp, Gossypium hirsutum
  Clone ID: LIB3272-039-P1-K1-F1
ccaaatctctcaaaaccttcattccatcccactcaccccgaacaacctctctccaccaacatggggaaaacacgtggtatgggagcggggcgcaagctgaggacccaccgcaggaggcagaggtgggctgataaggcatacaagaagtctaaccttggaaatgaatggaagaagccatttgccggttcttcccatgctaaaggaattgtccttgagaagataggtatcgaggctaagcagccgaactctgccatccgaaagtgtgctagagttcaattgatcaaaaacggcaagaagat

SEQ ID NO: 24583 - DNA, 405 bp, Gossypium hirsutum
  Clone ID: LIB3272-039-P1-K1-F10
cctaaatagcctgtgcagagatagaaacaacatggttttcattgtcagtgctaaaagccgaaagacactcactgaatggttttctccatgtgagaaactaggaattgctgctgagcatggctacttcttgaggctcaagggagacgtggaatgggagacgtgtgtaccagccgtggactgtgcatggaagcagattgcagaacctgtgatgaagcaatacatggagactactgatggatcctacatcgaagataaggaaactgcccttgtctggtgttatgaggatgcagatccggattttggatcatgccaagctaaagaacttcttgatcatctcgaaagtgtgctggccaatgaacctgttacggtaaagagtgggcagaattctgtcgaggttaagccaca

SEQ ID NO: 24584 - DNA, 394 bp, Gossypium hirsutum
  unsure (1)..(394): unsure at all n locations
  Clone ID: LIB3272-039-P1-K1-F11
gctttttgttacctcgatttcaagtgaatcagaatgggtaaggaaaagactcacatgaacattgtggttatcggccacgtcgattctgggaaatcaaccaccactggccacctgatttacaagcttggtggtattgacaagcgtgtgattgaaaggttcgagaaagaagctgctgagatgaacaagaggtcattcaagtatgcttgggtgcttgacaagctcaaggctgagcgtgagcgtggtatcaccattgatattgccttgtggaaatttgagaccacgaaatactactgcactgtgattgatgcacctggacaccgtgactttatcaagaatatgattactgggacgtcacaggctgactgtngctgtttgattattgattccaccactg

SEQ ID NO: 24585 - DNA, 418 bp, Gossypium hirsutum
  Clone ID: LIB3272-039-P1-K1-F12
caggattcgaaaggaataagcttcagcgtccgaatcgggaggaaatggtgaagggacgccaaggagagcgtgtcagactctatgtaagaggaaccatcttgggttacaagaggtcaaagtcgaaccagtacccaaatacttctttgatccagattgagggagttaacaccaaggaggaagtagcttggtatgcaggaaagcgcatggcttatatatacaaagctaaggtgaagaagaatggctcacactatcgctgcatttggggaaaggtcactagacctcatggtaacagtggtgttgtccgtgctaagttcaagtctaaccttcccccaaaatctatgggagatcgagtcagagtcttcatgtaccctagcaatatctaagcttgctcgatgccgaacggcttgtgattgactac

SEQ ID NO: 24586 - DNA, 271 bp, Gossypium hirsutum
  Clone ID: LIB3272-039-P1-K1-F2
ctttctcatcttgtgatttgagcttcgtgtttgtgttgggttaagcaattcgccaagatgcagaacgaagagggtcaaaacatggatctttacatccccagaaaatgttcggccactaataggctgatcacctcgaaggatcatgcttctgttcagattaatgttgggcatttggatgagcttggcagatacactggaactttctccacttttgctctttgtggttttggccgtgcccagggtgatgctgacagtgcccttgacaggcttt

SEQ ID NO: 24587 - DNA, 282 bp, Gossypium hirsutum
  Clone ID: LIB3272-039-P1-K1-F3
gacaaaaggtttttcaatatcggattagatgctgttcttacgagctatgtctctatgcttgatgacttccttgtcgatatgattctgtgcatgagagaccggaccgaaaatgaccagcttgcgttagtgagagaagacatatctgtcaggcattcggtggaaagcaagggagaccctggaaacctgggtgtacgattcttgagagacataattcgcacctccatgatctcgcgcaacgatgcatgatcgggaacactcactcggtttttttacatgcttcac

SEQ ID NO: 24588 - DNA, 444 bp, Gossypium hirsutum
  unsure (1)..(444): unsure at all n locations
  Clone ID: LIB3272-039-P1-K1-F4
ttcgtttttaggggttcaggttctctcaccaacacaccatcatctctgcatcatctatcttaaaaggcttttaaggtttgggttattttagatggtcggtcatggagccaaagttcactgaattctctgattacataaacggctttagtgttgaagatttagatgatacatttcagctcaattctggtcagtactcaaatggcacaatcggattcgagttcaatgacccttctccagatcttaacgttttgaacatgaatgttgctgttgcaccttctgaaccagaccctgttacttttgttcaaccgctcactgtaagtacagatgggagctcgatttctacgtccacagnggtggagtccgggaaggggagtcttttgtcacccgtcggatgacaatgattcaacggatccagttctcaagtacataactcagatgcttatg

SEQ ID NO: 24589 - DNA, 309 bp, Gossypium hirsutum
  Clone ID: LIB3272-039-P1-K1-F7
ctctggaacctgaactggctccacagaaaggattattgattgagaaaacatggggagggacaagcataagcctggccataaggcactgttttcacatctagctcatggtggctatgcacactctcctggaccatattcaccgggtgtagcgtaccctcaagaaggctattcaccagctggctacccttctcaaggaggatgccccactcacggctctccaccatttggcatatccgggggcatccgagtcaggtcacaattacatgggagcgctacttgcatgtggtgcaccagctgccgaactttcta

SEQ ID NO: 24590 - DNA, 291 bp, Gossypium hirsutum
  Clone ID: LIB3272-039-P1-K1-F9
ttaagatcgggattaacggatttggaagaatcggacgtttggttgccagagttggtcttcagaggaacgatgttgaactcgtccccgttaacgatcccttcatttccaccgattacatgacatacatgttcaaatacgacagcgttcacggtcaatggaagcaccatgatcttaaggtcaaagactctaaaaccctcctcttcggcgaaaaacccgtcactgttttcggaatcaggaaccctgaggagattccatgggctgaagccgggctgagttctgtttgagtaactg

SEQ ID NO: 24591 - DNA, 365 bp, Gossypium hirsutum
  Clone ID: LIB3272-039-P1-K1-G1
actttattctggtttttcaagaaagtaaaagcaaaccgttaaaatgggttctttaatggcgggatgggattctcctgtatcagaatcggatcctacatcagtaatacgccaacgaaatcgatcgttgaccaaggaagagatcgaagcttattggaaatcaaagaagcaaacggaggaagaacatcttaaagctacttttagtccatcatatacctgcactcactcttacctggaaacaccattggaggagcatggaagtaagaatctgagatcaaactccagccaggaggatgcagaaacaagcctggagaatatcataaagaaaaatggctggtggacaaggagcaattgggcattcttgaatg

SEQ ID NO: 24592 - DNA, 430 bp, Gossypium hirsutum
  Clone ID: LIB3272-039-P1-K1-G10
gagctttcatattgcaaagcacatccatctcagatgtgcaacaaactgactggataactattattatgagcagtgattcatccacactaatttcaatcaccgctatttctgcaatattgatgtttgcagcctggtctatatcaaaatggaggaaaccccaattgaagacggtgtatgatctagagaaaggacgatatatagtcactcgtataggtagaagttgatctatcattgtccagaggagatttgaacacgtcattatgatgttgcagccaaggaggagagtgcatgtctctagggtatttaccttttttaatgcttccttggtttctgcacccccttaagggcatctcattcatggcagtgggaaatgtaagattgtatatcaatggagttccaacatgacttattgtaaacattttcatgggcg

SEQ ID NO: 24593 - DNA, 438 bp, Gossypium hirsutum
  unsure (1)..(438): unsure at all n locations
  Clone ID: LIB3272-039-P1-K1-G11
cacaattttgcttatttctattttcaccttcttcttcactctttttaatttcttttcatctccaaggtctatcactaattttcaagcatccagtcaaggtaattttctttcatttgcttcattcatgactatacaatgattgttttttattatcagctactgttatagcagctagctttgtaagatagtcaaggtaataagatctgaagcaatggtttcctctagtgattatcaacagttttagatttcaagactggatgatcagcagacataatctactatagttagaaattaattccaaaagagctacccggaagcaatataatgttgaaataccaaaatgttgaacattntacctcttaatattctgttgcacacttgaatgtaaaaaaatcttttcttattttcactcttctaattttaaaaaaaattaccact

SEQ ID NO: 24594 - DNA, 375 bp, Gossypium hirsutum
  Clone ID: LIB3272-039-P1-K1-G2
ctttttcttccttcttatttacagcttcctccctttatctgacaggccatttccctttctgatatccttccctccctcactctctcttcttctgcctttgatctgctctctatccctttctctatagtatttagtggcatatttagaaaaagtgttagtgaagataaagcgtgagagggagattaaattttttgcattgcgtatatttggttttcagtttgtttgtttgtttgatgggttttacttctcttcaagtttgcatggattcatctgattggcttcagggaatgactcaggaggtgccaggaatggattcttcatccccatgtggggatattctcacatgctcaaggccattgatagaaaggagggcta

SEQ ID NO: 24595 - DNA, 383 bp, Gossypium hirsutum
  Clone ID: LIB3272-039-P1-K1-G3
ccgccgcctgcgtctctctcttcatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgaaggttgttgacattgttgacactttcaggcttcaggagcaaccccctttcgacaagaagcagtttgtcgtgttcatcaagaagttcatcaagaacttgcaccaaaactggatgcgga

SEQ ID NO: 24596 - DNA, 300 bp, Gossypium hirsutum
  unsure (1)..(300): unsure at all n locations
  Clone ID: LIB3272-039-P1-K1-G4
ccaatacaaagcttnatattatcttttttagttccgccccacgaaaacgaaacagatggaggaaatacaatcgttgtgttttttaagtcgggttttagtttttggggagaaaaaaatgatgggagtgtttatcagagcgatagtgtcttctcccgacgagctggtggtggccggttgccgaactccatcacctaatataacggcggctgctctggttaaacggatccttgagacgaactcctccggcgtgtccatgcagatcggagaccatgtccaattcgcttattctcaccataaaga

SEQ ID NO: 24597 - DNA, 415 bp, Gossypium hirsutum
  Clone ID: LIB3272-039-P1-K1-G5
gtgagactcttttgtataactgtagcatatagtactagtaagcagtaatagcaatggcctcctccatgatctcatcggcaaccattgccaccgtgaactgctcctccccggcacaggccaacatggtggcccccttcaccggcctcaagtctgcctctgctttcccagtcactaggaaggccaacaacgacatcacttctcttgcaagcaatggtgggagagtgcaatgcatgcaggtgtggcctcctcttgggaagaagaagttcgagacactctcatacctccccgatcttacacccgtacagttggctaaggaagtagattaccttcttcgctctaaatggattccttgcttggaattcgaattagaggagggattcgtgcaccgtaagtactcgagcttacccacgtacta

SEQ ID NO: 24598 - DNA, 403 bp, Gossypium hirsutum
  Clone ID: LIB3272-039-P1-K1-G6
ctcaaatctcctcctcctcctcagaaatcttagtatcatcaccatggcctcaaatcccaaggtcttctttgacatgactatcggtggtcagcccgctggtcggattgtgatggagcttttcgcagattgcactcctcgcactgctgagaacttccgtgccctctgtaccggcgagaaaggcgtcggccgcagcggtaagcccctccactacaaaggctcctctttccatcgtgtgatccctaactttatgtgccaaggaggtgacttcacggccggaaacggtaccggaggtgaatccatctacggatccaagttcgctgacgagaacttcatcaagaagcacactggtcccggtattctctcaatggctaacgctggtcccggaactaacggatctcagttc

SEQ ID NO: 24599 - DNA, 398 bp, Gossypium hirsutum
  Clone ID: LIB3272-039-P1-K1-G7
agagaacatagccaaagtcaagctaagctttgagatttatcaatggcggagaagaggttcaagtacgtcatcctcggtggtggtgtcgctgccgggtatgcggcgagggagtttgccaaacagggagttcagcctggtgagctagccattatttccaaggaagcggttgctccatatgaacgtcctgctctgagtaaggcgtatctcttccctgagggagctgcaagacttcctgggttccatgtctgtgttggaagtggtggagagagattgctttctgagtggtacaatgaaaaaggaattcaggtgatccttatcactgaaatagtgaaagcagatttttctgtcagactctattaagcgcaggtggagaaacgttcaaatatcaaaatttgatc

SEQ ID NO: 24600 - DNA, 383 bp, Gossypium hirsutum
  Clone ID: LIB3272-039-P1-K1-G8
aattactcttataattcgtacccggattccggcgattcttcgccgcgatctcgggggatcgactttgaaaatgctccgccgtgggaggatcaagcgcaacaaccgcagagttataaggctaagtttatgtgcagttacggtggcaagatccatcctcggcctcatgataatcagctatcttacatcggtggagagactaagatactggccattcatcaaaccaaggtgctgatgaggatgaaggtgttgattgcccctctctggggcgggggcgacggtgatttatctttcaagtaccagctccctggtgaggacctcgacgcacttatttcggtaactaacgatgatgatctcgaacacatgatgaaaactggatgcggaaa

SEQ ID NO: 24601 - DNA, 365 bp, Gossypium hirsutum
  Clone ID: LIB3272-039-P1-K1-G9
cccacgcgtccgggtatttccaatcccacgctgctcaaaaacactctctcctgcccctctctcaccctctaatctgatcactgatttcttcgatttcaagttgaagtcaagctgcagctatactgtgatttggttaatatagaattgaaacaatgggggagctgttgggactgctaaaagtggtggttgtgcaaggtaaaaggttggttatccgggattttaagagcagcgatccttatgttatagccaagctcggtgatcaggtagcaaagactaaggttatcaacagttgcctcaatccagtatggaatgaagagctcactttctccctcactgaacctggtggagttctaaatttggaagta

SEQ ID NO: 24602 - DNA, 385 bp, Gossypium hirsutum
  Clone ID: LIB3272-039-P1-K1-H1
ggaaaacaagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaagatatgcgatgaaagagtcgtcgtcgtcggagacaagggcttattcttcagcttgggcgcct

SEQ ID NO: 24603 - DNA, 430 bp, Gossypium hirsutum
  Clone ID: LIB3272-039-P1-K1-H10
gccgaagagtttgcgaggaaacagggtgtggagttggtggacaatgaatatttcattacagaagacaatgtggggatgcttaagttagcaaaagaagcaaactcaatcctgttcgattaccgtatcccaaccctcaccacctgcggtggcagcgcagccatggaaaatcaattacaaatgaacggcttaccaatcagtctctacgccccagaaacagtaggttgcgttgtagttgacaaacaaggtcattgcgctgccgctacttccaccggtggattaatgaacaagatgaccggaaggattggtgactcgccgctgattggttcagggacttatgcttgtgacttagtggctgtttcatgtaccggtgaaggtgaagccattatacgaagcactttggctagggaagtagcggccgtgatggaatata

SEQ ID NO: 24604 - DNA, 342 bp, Gossypium hirsutum
  Clone ID: LIB3272-039-P1-K1-H11
aaaagccaaggtcaaacgaaggcaaaaataaggttttccatggaaggggaagctggtgcatacgaggacgttaagccaaacgtcgtcgctaaacaaagtaatggcgatgttgtcggggataatggtgttggaaatctgggatccgttgaagcccctgattttctttccaagaaaaatttgcagaactgttccgtggcaactcctgcatctggactgaattccactggccctgctccatctcaactaaccatcttctatgatggacacgtttgtgtgtttgatgcaattcctgtggaaaaggtgcgggagattatgcttattgctgcaactggtgctgctaac

SEQ ID NO: 24605 - DNA, 404 bp, Gossypium hirsutum
  Clone ID: LIB3272-039-P1-K1-H2
atcccccgtctctctctgaatctctctcctgaaaagcaaattaggccaaaagaaagccggtctaagaaacgatgtcgtcttcgtcgtcgttcaggaagtcctcgtgcctttcacggagattctcgggatcgagatcattggccaaaacggcagcgctagcaacggtctcgccaacggtgaaccagtcggagatttcttcttcttcgtcgtcgtcgtcgcagcctacgccgctggcggaggcggaggcggaggcggaggaggaagggcaatcgtggtcgacgatgctgccggagttgctaggtgagatcatggagcgcgtggaggcgagtgaagatcggtggcctcagaggcaaaacgtcgtcacatgcgcctgcgtttgtaagaaatgagagaagctatgagag

SEQ ID NO: 24606 - DNA, 395 bp, Gossypium hirsutum
  Clone ID: LIB3272-039-P1-K1-H3
cggacgcgtgggtttcactacccaacaacccaaaagataaaaggaatcgtttacttggtcgtagcaatttatcgtcatttcaagctcaattctctgaaaatttttgtgctgaacttcttttttctctttgtaccaccatgtgtggaggtgctattatctccgatttcataccgccgtcgcggacgcgacgattgacggccgatttcttgtggcccgatctgaaaaaatccgggttgaagaaggggtcgggtaagagatactcgaagcccgtgatcgacttgggcgatgatttcgagactgacttttaagggttcaaagatgaacaatctgatatagatgatcatgatggtgatgatgttttggctgatgtaagccccttgctttaacgctacaag

SEQ ID NO: 24607 - DNA, 420 bp, Gossypium hirsutum
  Clone ID: LIB3272-039-P1-K1-H4
attttccggcggcttatcagcgttacaatcgctactggaagaagtcgacgacgatgcctctgaaatgggttttcttttggcagcccaatgcaggatcaaccgtgaacagccaaatcctaaacgaagtttcgcaatgcgtcgagagcatcaatggcgtcaaagaaggtcgttggaaagccactctcactttttataaacccatgttacgagatcaaacgttatccgccgagttcccgcgtgaattcatcgggatttcgcttccagaacaaccaaacaagtactatttcgtgcttcggttcaataagattgtcctggaatctgattcttctattcagttgataatggagaaattgcagtcttataaatccagggttcgcccttaatttcgaggggtttcaataccaactaggcgacttccaa

SEQ ID NO: 24608 - DNA, 385 bp, Gossypium hirsutum
  Clone ID: LIB3272-039-P1-K1-H7
gatcagtgatcgggatagatgcccacagtgcaaagggaacaaggttactcaggaaaagaaggtgctggaagtacatattgagaaaggaatgagagatggtcagaaaattacatttgagggacaagctgatgaggctccagatacaataactggagacattgtttttgtattggaacaaaagaaacaccccaaatttgataggagatttggggacgaactttatgttgaccacaaactcagtttgacagaggctctatgtgggtttcagtttgccctaactcaccttgatggcaggcagctcttaattaaatcaaaccctggcgaggtcgttaagcctggtcaatacaaggctatcaatgatgagggtatgccccaccatcagaga

SEQ ID NO: 24609 - DNA, 200 bp, Gossypium hirsutum
  Clone ID: LIB3272-039-P1-K1-H9
atggaaataccattactttaaccgtattttaactaattccgggaatcggaggcggggcacggccctttttttggacaccaaaggccggttttgggccggccgatccgggggagagacattgagggggggggggttggtttggcgcgacatatgtgtaaagagatagcacgggtgctcagaggtgcgctaagcgagcacag

SEQ ID NO: 24610 - DNA, 389 bp, Gossypium hirsutum
  Clone ID: LIB3272-040-P1-K1-A10
gcctaactttggagataattttggatctgaaacagagagagagagtatggatcgccaccacgatccaaaccctttcgatgaagaagaagtcaatccattttcgaatggtggttctgtcgcacctgcacgaccactggcatccgaacctttgggttttgggcagaaacatgatgctactgtggatatacctctggattcaatgaatgattctaagaaaagagaaaaggagctcgcagcttgggaagctgatcttaaaagaagggaaaaggatataaagagaagagaagatgctgtttcccaagctggtgtttctgtagatgataaaaattggccaccaattttcccgattatacatcatgatatagctaatgagataccgggtcatgctc

SEQ ID NO: 24611 - DNA, 381 bp, Gossypium hirsutum
  unsure (1)..(381): unsure at all n locations
  Clone ID: LIB3272-040-P1-K1-A3
caaaatatctgctcctcttagtttccctttttgggccttgtttatttgagggtggggcctcatgggtgccggtgatgtcaagttccggtgcttcgtcggagggctcgcatgggccaccgacgaccgggcccttgaagaagccttcagtgcgtgtggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacataactgtcaacgaagcccaatcgcgcaaaantggaggcggtggcggaggatttggaggaggaaacggtggttacagccgcggtgg

SEQ ID NO: 24612 - DNA, 377 bp, Gossypium hirsutum
  unsure (1)..(377): unsure at all n locations
  Clone ID: LIB3272-040-P1-K1-A6
acaccctgtcgccaagaaacgcacccnccaagacaaccactccccgtttgggggtggacgtaagangaggtgggggcgttacgtctccgagatacggtttccgggtcaaaagacacggatatggctggggtcgtttgggtcaccggggatgggagctcgggcatatgactcggcagctttctttttgaaaggcgactctgctatcctcaacttcccggagttaggggggtcacttccccgggcagggtcttgctccaggagggatatacatatcgctgcgggcaaagcggctttggaggaactcgggggcagggtaaaagaagaggagggtccggaaagcattttggtggttggatgatgtggggaatggcggggtt

SEQ ID NO: 24613 - DNA, 86 bp, Gossypium hirsutum
  Clone ID: LIB3272-040-P1-K1-A7
ctttaccataaaaaacccttccctttatgtgtgggtgccttatccggggagaggtaaaagggggggggcgaaaaccaagaacccat

SEQ ID NO: 24614 - DNA, 378 bp, Gossypium hirsutum
  Clone ID: LIB3272-040-P1-K1-A8
cttcgttcaaccactcctaataaccgctcggatttttctcatacgggggggaaatgggggtggctgtcaccaagctattcagccggctatttgccaaaaaggagatgcgcatactgatggttgggcttgatgctgctggtaaaaccaccattctttacaagctgaagttgggagagattgtcactactattcccaccatcggtttcaatgttgagaccgttgaatacaagaacatcagcttcactgtttgggatgttggcggccaggacaagatccgaccattgtggagacactattttcaaaacacgcaaggacttattttcgtgggtgatagcaatgatcgtgaccgtgtggatcaagctagagatgagttgcaca

SEQ ID NO: 24615 - DNA, 385 bp, Gossypium hirsutum
  Clone ID: LIB3272-040-P1-K1-A9
ctgagatggtcaaggttttaagagctaaagggaagctggaggaagagatgggaagtttggttatgaagtttttggaggagaataagaaagtacccgtgcctaaggttgagaaagtgaggattaagtgtctggggtatcaagaaagggctaagatttctaagaatccaactgggaaaaagctgtttgagattatggttaacaaagagagtaatctctgcttggcggctgatgttgccactgctgctgagttgcttgatattgctgagaaggttggacctgaaatttgcctattgaagacccatgttgacatattccctgatttcactccagagatcggatctaagcttcgcgcgattgcagaaaaacataacttcatgttttttgg

SEQ ID NO: 24616 - DNA, 390 bp, Gossypium hirsutum
  Clone ID: LIB3272-040-P1-K1-B1
cctggggatactttgtggcctctcttcccataattgaaggtgctgaatggcttggactcatcgggccagtctttttgacattgctgctgctttttgttagcggcctaacaattctcgagaagtcaggagacaagaagtttggtaatgtggaagcatatagagtttacaagaaaagaactagccctcttattccactgccacgatcaatatatgggaacctgccgtattggttcaaagccgtttttctctttgaatttcctatctacaaccgttatttaaacagaaaccgtacgaagcaaggatagaacagaagtcgagttgtgcttcgttatcttgggattcgcgaggtcatagacgaggttttgaaactttactggcacatttctgatg

SEQ ID NO: 24617 - DNA, 385 bp, Gossypium hirsutum
  Clone ID: LIB3272-040-P1-K1-B10
caaaaaaaaaaaaaaaaaaaaaaacacccccgaaaatgcgaagctctagagggtcgatgttcctcgcgatttgcgcaatcctggccatccacgtggcggttacaacttcttctccgacgtttgatttcgccggcgaccatttcctccagatcaaatcggaatgcagcggatccaccgctgagtgcctgatgcaaggcggggaggactcgtcggacttcgatgccgagttcgccatgggatccgagatcagcaggcgcattttagcggcgagacggtacatcagctacggtgcactgaggagaaacactgtgccgtgctcgcgacgcggcgcatcttattataactgccgacctggagctcaggcgaatccctactcacgcggatg

SEQ ID NO: 24618 - DNA, 351 bp, Gossypium hirsutum
  Clone ID: LIB3272-040-P1-K1-B11
taagcatttaattcttttacatatatttgttacttttctctattgggaacgggggaaggataggcaacaattggggaaattcaagtcttgtacagctgtggtttgtttgttcttagttttttttttcttcttcttgtgaattgggtgttttgggggatcggtaaggaaaattctaacatgcccatttcatgattgtggtttgattttctggttatataggaaaatttaggcctgggggtgtttaaagttgtttttgttgctggggttttttttttttgcgctggttaatggttcttttggattatgcagggttgagaaaattcttggtggggggaaattattttttttttt

SEQ ID NO: 24619 - DNA, 393 bp, Gossypium hirsutum
  Clone ID: LIB3272-040-P1-K1-B12
actccccatcaaaacaacacattgcaaagagaaagggaatattatgaaaaggacccaaccatggcatttgcaggaacaacccagaaatgtatggcttgtgacaaaactgtgtatttggtcgataaattaacagctgataacagggtttatcacaaggcttgttttaggtgccatcactgcaaaggtactttgaagcttggcaactacaattcctttgaaggagtcttgtattgcaggcctcattttgatcaacttttcaaaagaactggtagtcttgagaaaagttttgaaggtacaccaaagattgcaaagccagaaaaaccagttgatggtgagaaaccaatagctactaaagtatcaggcatgtttggtggaacaagagataaatgtttt

SEQ ID NO: 24620 - DNA, 273 bp, Gossypium hirsutum
  unsure (1)..(273): unsure at all n locations
  Clone ID: LIB3272-040-P1-K1-B2
ggagtattggtcatatttttcccatatnccccattcatggattgtatnagggggggggaatgaggggggtggtatctgatttaacctgtgacagtgatgggaagattgataagttcatcggaggtgaaacaagcttgcctttacatgggtaggaggggaatggtggttgtagcattggtggtgctaatggtcggtactatttggggatgttcttgggtggggcttaccaggaatccctctgtggagtttacaacctcttttgctgcccaaatg

SEQ ID NO: 24621 - DNA, 104 bp, Gossypium hirsutum
  unsure (1)..(104): unsure at all n locations
  Clone ID: LIB3272-040-P1-K1-B4
atgacatgtaacctttactggggttgctnccagatcatgactaatanttggaccggggagttagctgagggggagaggtacttttagaccttttttaatcatcc

SEQ ID NO: 24622 - DNA, 361 bp, Gossypium hirsutum
  unsure (1)..(361): unsure at all n locations
  Clone ID: LIB3272-040-P1-K1-B6
gaaatttaaaaaagagagagagaatgaaggttggtgctgcatatttnttgggtgggggggagggcaacacttccccttcagctaatgatcttaaggccattcttggctctgtcggagctaaagctgaatatgaaaggattcaacttcttttatctgcgggcaagggcaaagatataacagagcttattgcatccgggagggaaaagcttgcttccgttccatctggtggtggtggtgttgctgttgcatctactactcctggggctggtgccgctgctgctccagctgcatcctaggctaaaaaagaaaaggaaggtgaggagaaagaagaattcgattattatattggatccagtctctt

SEQ ID NO: 24623 - DNA, 393 bp, Gossypium hirsutum
  Clone ID: LIB3272-040-P1-K1-B7
atatcctcctcttctccatcaccaagtttggcaggtggcttgcagagacggaccctttgctaccctaatttcaaccccatctgtcttttatccatcctcacttctctaatataaaccacgttcccccttgtgttctgaacgtaacaaagttcctggaagaacatccaggaggagaagaggtgttgttggaatcagcagggaaggatgcgacgaaagaattcaacgatatcggacatagcaaggcggctcagaatttgctcctcaagtatcagattggtgttctccagggtcacactttaaagaataatgaacaggttggttcaaccgaggagcccaaaaagaaagagatgagtgcatttcttatcaaggatgacctgactcctaaatatgctg

SEQ ID NO: 24624 - DNA, 389 bp, Gossypium hirsutum
  Clone ID: LIB3272-040-P1-K1-B8
tcgaaaaaagagcttttaaaaaccagacccaaacaaaccaaaccaaagggggggctgctatgggctggttttctgatccatgttcatcttctccttctcggtttctcagcttttcttgtaaggatcacctcaacactttccggctgcttgcgtcagcttcccggcaaaccatttactcctgaggttttttttacatcatctatgcaaaacttagagctacataaaggaaacagtatctatttttgtgatagtgggtattgaattgtagagagaatgagtcaattttcctccatgttcaatggattagcaaggtcattttctataagaagagggaaaaatccagggaatggtgatggaagagaagctgcagaggtcatggcaaaggatgc

SEQ ID NO: 24625 - DNA, 355 bp, Gossypium hirsutum
  Clone ID: LIB3272-040-P1-K1-B9
tttttcttccttacttcttctatactgtgccggcgcctgcgacccattaggttctcgcctaacacaggttatcatccgttttggatctttgtccaagatggggttggacggtccaactggaaacgaaggtgtgaggagactaggatgttcattcaccaaagatgattttcttccagaggagtcatttaagagctggggtaattatgtccaagcacttcagcaaactccgagaagggttatggatcgggtatttacccgatcacttgactcaacggaactccatgaaatcaaggctcggggccagcatgaaatgaagaagaccctcttctggtgggacctcatatgggtcggtatc

SEQ ID NO: 24626 - DNA, 378 bp, Gossypium hirsutum
  Clone ID: LIB3272-040-P1-K1-C10
gcgaaaatctcgaagcttccttttccgttttagatctcaaaattggaaagggtctctttttcatctgatggctgctactatcgtctccgtcaaagctaggcagatcttcgacagccgtggaaatccaacgggtgagggtgatgtggaaacatcgaacggtataaaggctagggccgcagttcctagcggtgcatccactggaatttacgaggctcttgagttgagagatggaggttccgattacctcggtaaaggtgtatcgaaggctggtgctaatgttaacacaatcatcggccctgcattgattggaaaggacccaaccgagcagactgcaattgacaatttcatgggtcaacaactggatggaacccaaaatga

SEQ ID NO: 24627 - DNA, 306 bp, Gossypium hirsutum
  unsure (1)..(306): unsure at all n locations
  Clone ID: LIB3272-040-P1-K1-C11
gaaagtcgtttctctacgaccaaaatcacctttcagattctctcggtctgtgcctgtcttcttatttgctcttanatgcttttgggggcaaacgaaaaaaaaagggtattatctcttcttcttgattgattgatttttcattgataatctcatcaacaagaagaagaatctgctcaaaagaataataacaagaaacacaggagagaagagaagagaggataattttttttttacttttattttttgagaggcaaaaaaaccccaacaatattcccatggatttgacttcaacaacgacgacgacga

SEQ ID NO: 24628 - DNA, 392 bp, Gossypium hirsutum
  Clone ID: LIB3272-040-P1-K1-C12
cttttctcaagctttttcccaaatagccatggctatggcgatggggggggcggcaaccttcagtatctcatcagctacttcaatcttccggacttcatcttcacttaaattctcttcaaaaccagtgcttattccaatgcgtttttctccaaaaacccaatctcctcccagaactctccggatttacgctttgactagtaacgatatcaaagtgggtactaaccttgaagttgacggtgctccttggcgaattttggagtttcttcatgtgaaacctggaaaaggggctgcatttgtgaggaccaaaatgcgcaattatatcactggaaacactgtggagaaaacgtttcgagctggaagtacgattgaggaggcaaacgttttcaaggaat

SEQ ID NO: 24629 - DNA, 381 bp, Gossypium hirsutum
  Clone ID: LIB3272-040-P1-K1-C2
gtctctacttaaggaacttgaagatatggggttcaagcaggttgatttggacaaggacattttgaggaggaatgaatatgatctggagaagtctgttgatgatctttgtggggtggctgaatgggatccgatacttgaggagctgcaggaaatgggtttctgtgatgctgaaacgaacaagaagctgctgaagaagaacaacggaagcatcaagggagttgtcatggatctgttaacaggagaaggtgcttaaattattaattatggatgatggctcgtggtttctaggcattttattatatataaataaatgagtgtgcgcatctaaaccatgtctttatgaagcagctgccttttaatttcttgtcttctgaagtatgc

SEQ ID NO: 24630 - DNA, 386 bp, Gossypium hirsutum
  Clone ID: LIB3272-040-P1-K1-C3
ctttcatcattgaccttgttgtctttcatgggaacttgactttcaaaccggggtgcggtctttgtcgtggggtgaaccttaactttatacatcctctgtttatcctactgtgcgagctacaattacctcatcaccaggggaaccaaactatgattgctttgtggacaaccgtcaataacatctaccgctctgaaaattcaccctgttcccatctctcttctcgtcatacctcttccctctgtaccggaactttccttactagtattcctcaaatgtaccacaccggtaggggttttaattcgtcggcgtaaaaccgcttcaacgtcaaagacccatggtcacacattggtcgtctccaatttcatcctttcaattcatctggattg

SEQ ID NO: 24631 - DNA, 391 bp, Gossypium hirsutum
  Clone ID: LIB3272-040-P1-K1-C4
ctaactttttctccttcaatttctcaggttttagggttcggcggattaaggtatggggttggggtgaagatgtgggcttcttcatgccttgcatcgtgctgtgcggcgtgcgcctgcgatgcgtgccgcacggtggtttcggggataagccggaggtctgcaaggatagcctattgtggactatttgccctttctctgtttgtttcgtggatcctacgtgagggtgccgcccctctcatggagcagctgccttggatcaatcaatttcacaaaacacccaacagggaatggtttgaaacagatgcggggctgagggtcagcttgggaaattttctctttttcactatcctatcatttttaatgattggtggtaaaaatcagagagatcctc

SEQ ID NO: 24632 - DNA, 395 bp, Gossypium hirsutum
  Clone ID: LIB3272-040-P1-K1-C5
gttcttcttcaaaggcttctttcttttcaggtgaaaatagcagtgaaaaggtaggggtaatggagacaggagcgcttatagaaaatactgctaaaacaggagggataggtcttgatcttagaggcaagttgatggaccagatagagtggctccctgtatcaattgggaaattaaaggatgtgagcgaattggacttatccgaaaaccgtatcatggcgctaccaccctccattggtggccttcaagccttgacaaagcttgatcttcactcgaaccaacttataaaccttcctgattcggttggggaacttgtgaatctaatagagcttgatctccgtgcgaacagggtaaaggcgctgcctgctacttttgggaacttgacaaacctcatgaat

SEQ ID NO: 24633 - DNA, 396 bp, Gossypium hirsutum
  Clone ID: LIB3272-040-P1-K1-C6
ggatgcatagtttaccctatctaattgggttgtttttgaatttaggagcggggcgcacttcactaggctggcctgaatgttaccaccacccatctccgccgccgaaatgtcctccgccacactatccgcctaaacatcatcatcctcccattgttaagccaccctatcaccctaaaccaccaaaacatcatcctccaaagccacctaagcctcccgtggtaaacccaccatatcaccctaaaccaccgtagccaccggtggtgaagccaccgtatcaccctaaaccacctaagcctccgatggtgaaacccccatatcaccctataccaccaaaacatccaccgcattctcccaagccacctgttgtaaagcctccctatgtacctaaaccaccta

SEQ ID NO: 24634 - DNA, 359 bp, Gossypium hirsutum
  Clone ID: LIB3272-040-P1-K1-C7
cttaaccatttcccaaatctcctccctcctcttctttagcgtccggatggtgtccgctcatgcagcgcgctttgaaatccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccgtttattgtggtggactccttcaatgcaaaggttggggtgttcttccaaacaccctggctggatatgcacttaaccaatttgtatacatggatttctaccacatatttc

SEQ ID NO: 24635 - DNA, 389 bp, Gossypium hirsutum
  unsure (1)..(389): unsure at all n locations
  Clone ID: LIB3272-040-P1-K1-C8
agggagaaggcagattatgcgaatgtgaattgggatgaacttggggttggggtaactaagactgaggatatgtaccttatgaaattcactgaagagtagcaaatgttttgcaacggaaccttaactcgctttggcaacattcagatgtgcccttcatctggaatattaaactatggccaggggttattcgaggggctaaaggcgtataggaaggaagacgagggtattctgctcttccgaaccgaagagaacgctctgaggatgaaggtgggtgcggatcgaatgtgcatgccatcaccaaccggtgaccaattcatagatgctngcaaaaagactgtgctggccaacaagagatgggtacctcctcatgggagaggatcattatatat

SEQ ID NO: 24636 - DNA, 386 bp, Gossypium hirsutum
  unsure (1)..(386): unsure at all n locations
  Clone ID: LIB3272-040-P1-K1-C9
ccgccgcctgcgtctctctcttcatctctctggaccaaaaagtctgtagcgtgtcgcttcgagagagaccatnttggtttaccaggatctcatctccggtgacgagcttctttctgactcattcccctacaaggaaatcgagaatgggatgctgtgggaaggtgagggaaagtgggttgtgcaaggagctgtcgatgttgacattggtgccaatccttcanccgaaggtgctgatgaggatgaaggggttgatgaccaanctgtgaagggtgttgacattggtgacactttcaggcttcaggagcaaccccctttctacaagaagcagtttggcgtgttcatcaagaagttcatcaagaacttgacaccaaaactgggtgcggaaa

SEQ ID NO: 24637 - DNA, 391 bp, Gossypium hirsutum
  Clone ID: LIB3272-040-P1-K1-D1
gcagaggacattacctttgtttcttctaaaattaaaaacacaaaagtgagaaaaatggagggagatatggaaatgaaaccatccaagttcaagagaatttgtgtcttctgtgggagcagccctggaaggaagagcagttataaagaagctactattgagcttggcagggaactggtttcgaaaaacattgatctggtctatggaggaggtagtattggattaatgggtttgatttctcaagcagttttcgatggtggccgccatgtcattggagtgattcccaagacacttatgccaagagagataactggagaaacagtgggggaagttaaggcagtagcagacatgcaccaaagaaaagcagagatggctagacaatctgatgccttca

SEQ ID NO: 24638 - DNA, 340 bp, Gossypium hirsutum
  Clone ID: LIB3272-040-P1-K1-D11
ggaaatttcactggattttaaagaggagccaagggaagagaaatggtgcagggcgatgaaaatggaaacaccactatggtggtggtttgatactcctcagaatggatcaaagcgctctccatggctccaatccactatttatgaactgtaccataggacgaaagcgatgctgaaactgatagaggaagatgcagattcctttgcgcaacgtgcagaaatgtactacaaaaagcggcccgaactgatttgtctggttgaagatctctaccgagcccaccgttcacttgccggagcgggacgatcaagttaaaacagaccctggaactctcctactaacaac

SEQ ID NO: 24639 - DNA, 367 bp, Gossypium hirsutum
  unsure (1)..(367): unsure at all n locations
  Clone ID: LIB3272-040-P1-K1-D12
ggttcctgagttttgtgttcgntcggagaaatcatattgtgaggagaaaggggaaagaaaagaggttttgggagattggaagaatggggacaagagaagtatatgaggaaaagctaaggaatggaaatctgcaccacgatccaaccatcaaccctggcttaggttccgctcgttgtcctcgttgcctttctctcttacaccctgattccgacaaagctgaatggacaattacttcagttttggaggatgccactgcagtggctggctctggtatcgggggaatgcttagtgcagtacatggctttaatactgggatccctttcctttagaatcacatcaagggacctaagtggctcccttttgtact

SEQ ID NO: 24640 - DNA, 397 bp, Gossypium hirsutum
  Clone ID: LIB3272-040-P1-K1-D3
gcgatttctaactcctgtcctgcatattattgcttattggttcggggaacatggaatggcacaagcagaggagctgtcccattgagcactttggatcgaatgaaaatttccaccaagttatctgaattcaccacggtgttcaccacccctatcagcaaacaccagtttgattcactaatccctctagaatatttactttgctattccggtttcgagcgtttgagatcgatgcttataaaaggactatgcagttgtaatgtgagctgatttgtttgcttttaggtgtaggtcaaacaggagtattgtatccttttagttcactaatcattagttcattaaatctgaaaaaaggagaattggcttggcttttgattcttttggcattttccttttctat

SEQ ID NO: 24641 - DNA, 361 bp, Gossypium hirsutum
  unsure (1)..(361): unsure at all n locations
  Clone ID: LIB3272-040-P1-K1-D4
aaaaaaaggcattcttccaatcaaacgatttcgatctctgatctgagatggtgcgcatgagcgatnganaagaccctntacagcgcctaaatgccattgcggagtaccgaaagaaactccttcaacacaaggagtacgagtccagggttcgtgcaggtagggagaatctgagagctgctaagaaggagtttaacaaaactgaagacgatttgaagtctcttcagagtgttggacagatcattggagaagttctcaggccttttgacaatgagcgccttattgttaaagcaaggcagtggccctttctatgtggttggttgccgcaacaaagctaacaaggagaaactgacttctggactag

SEQ ID NO: 24642 - DNA, 376 bp, Gossypium hirsutum
  unsure (1)..(376): unsure at all n locations
  Clone ID: LIB3272-040-P1-K1-D5
cagccattagctcccttgctgcacatttgtgagcaagtaaaaatgcttcgtgcacgttgcttcatgtgctgtgctcttnttctctcttttgttgctgcctcttgctccaacaattggtatcatgagcctatgtcttacgggaccattgattttgcttcccctgcttgttgaaaagaaagaagctgtcaaagcacaagcaagtcattaaggactgcttgtagagaagataatatcggctcaaacttataagatccccaaactagcttgaataagctggaggagtttaaaggaaaggtgtgagctttccaaatgtgcaagcttagcaagatgtcaaagctgcaagcttagcaaagtgcgagcctgatgaagacacctg

SEQ ID NO: 24643 - DNA, 231 bp, Gossypium hirsutum
  Clone ID: LIB3272-040-P1-K1-D6
ttccattgtatgatgaagcctgagaaagtaccctatatgaacattttgaaggctgggttgtggtgctagaatgtgttttcttaaaattttctttatcaacttcaattgaactattactgtttgagctaatctttagaatcccatttggggatttgatttcaactattcaatgtcataagaaaactttgtttgctgcataaaaaaaaaaagacttcttataaagaatatatt

SEQ ID NO: 24644 - DNA, 169 bp, Gossypium hirsutum
  Clone ID: LIB3272-040-P1-K1-D7
ccggttccggattcccggggggggccacgccctccgcagaggacattacccttggtttttctaaaatttaaaacaccaaatttaggaaaaggggaggatggatataaattaaacccttccaagtccagggtattttgtgcttttgcaggagccaacccagtagggaagg

SEQ ID NO: 24645 - DNA, 390 bp, Gossypium hirsutum
  Clone ID: LIB3272-040-P1-K1-D8
aacattcccatttccaatctccagctcccaaggtaaatatgccgggcaggggcatagcagttggccggcccgaataggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaggtggccacgtcaaccccgccgtcaccttcggtgctttcgttggcgggaacatcactctcttgcgcggcattctttactggatcgcccaactcctatgctcaaccgtcgctt

SEQ ID NO: 24646 - DNA, 350 bp, Gossypium hirsutum
  unsure (1)..(350): unsure at all n locations
  Clone ID: LIB3272-040-P1-K1-D9
tttgacggttagtgagagaattggtgatgcttgtgtttcatngggggcaggggacaatgaaggctgagtcgctttctttatttacttgtgggacccgaaaacaaggggaacttcttatgtgtatgactccttctttagaccatatggtgcaaagcatgaaaatggaattgactgtaacttgttggaactaaggactagagctggtgatatggcagttctttactggcaaagaggtgctagctacggccagacaagagtttttgagatcctgcaatatggtggtgcacagtcaaccccaagacctcaccatgctaagaattctcaagcacaagttggtagggctcgccaac

SEQ ID NO: 24647 - DNA, 393 bp, Gossypium hirsutum
  Clone ID: LIB3272-040-P1-K1-E1
cttggagatgctcaacacgttgaagaggcagagaagataggtttggattagtatggatgtggaagcattgaagaaactaaacaagactaagacgttagttaagaagcttgccaagaagtatcatgcctttctggcttctgaatctgtcatcaagcaaatccctcgtttattgggtcctggtctcaacaaagcaggtaaattcccaacccttgacactcaccaggaattcctagagtcgaaggtgaatgaaacaaaggcaatgggtaagttccagctgaaaaagggtctatgcatgggagctgctgttgggaatgtagcaatggaggagaagcagatcttccaaaatgtgcacatgagcgtcaatttccttgcttctttgttgaagaaaaattg

SEQ ID NO: 24648 - DNA, 377 bp, Gossypium hirsutum
  Clone ID: LIB3272-040-P1-K1-E10
tgcactggtgctaaaagtgaacagcagtctaaactggctgcaagggagggtgccagaattattcagaagcttgggtttcctgctaagtttaaggacttcaaaatccagaacattggtgggtcctgtgatggtaaatttcccatcagacttgaaggccttgcatactcccatggtgctttttcaagttatgaaccagaactgtttccaggtctgatttatcgaatgaaacaaccgaagattgggcttcttatttttgtgtcagggaagattgtgatcactggagcgaaggtgagagatgaaacatacacaggctttgagaatatatatcccggcctgacggagttcaggaagaaccaacaatgatataccaccggtga

SEQ ID NO: 24649 - DNA, 154 bp, Gossypium hirsutum
  Clone ID: LIB3272-040-P1-K1-E11
cttccacaggcccatttttcatgtcatccaaatcgcacttcatcggggagggggagagttaaagagaaagcttattttccactctgctaaagtatacacgaacatggtggattttatgctggagatctctggcgagcttacaaacattggtaat

SEQ ID NO: 24650 - DNA, 392 bp, Gossypium hirsutum
  Clone ID: LIB3272-040-P1-K1-E12
gttcctgcagagtgaggaagctcccctgaaagcttcagttgaaagggccggggcaaattcatgagatcaaggacttccttctcactgctagaaggaaagatgctcgctctgtaaaaatcaagaaaagcagagatgttgtcaagttcaaggtccgctgctccaagtacttgtacaccctttgcgtgtctgatgctgagaaggctgacaagttgaagcagtctcttcctccaggtttgagcgtccaagacctgtgaaattaaaactgcccttagcttgtactaggcaatgaaaactagattttgactcttagtttattgcttgcatttcgaatcgttttgcaacgatcaaaagtttttataatggatttttatttggggtgtttttatggacgt

SEQ ID NO: 24651 - DNA, 394 bp, Gossypium hirsutum
  unsure (1)..(394): unsure at all n locations
  Clone ID: LIB3272-040-P1-K1-E2
tcttcatccaaaatcttggcttagagatttcaaagggccttaagatcatgggcatcttaagcaagggtccaagcancaacatgggttcttctcctttcttccatgaattcaagaaacaagcttctttcttcctcaaggagaagatcaaaacagctcgtttagctttaactgatgtcacccctgctcagctgttgactgaagaagctacgaatgggaatccatgggcaccaaacacccagactcttggttccatctcaagggctgcttttgaattagatgattattggaggatcgtggagattttacataacaaattggacaaatttgaaagaaagacatggagaacctcttacaattctctgatagtgcttgaacatttgttgactcatggacc

SEQ ID NO: 24652 - DNA, 197 bp, Gossypium hirsutum
  Clone ID: LIB3272-040-P1-K1-E3
cttttggccaatcaattttctaagcaaatataactaacgacatttaggtgggtggggaattccaagccaaggactaccataatccttcaccaactccattaattaacggtgaggacttgtcaaaattctcattctatagggcttcaataatcgtctttattgccaccctcattatttttatacatcactgtttttac

SEQ ID NO: 24653 - DNA, 393 bp, Gossypium hirsutum
  Clone ID: LIB3272-040-P1-K1-E4
caccgcctctcttttcctctcagttccctgtcccaggtttcttttctccagatccgggccctgccccttttgctctaactccgatgctaccacaaacgaggaggatgatttttattttgacgttgacgatgatgggattgtttcttcagatgatgagacacaaccattgtctgaagacggtgtctttattgagataaaaaagcttggagggaattctcgtagaattcggtccaaaatcgggattgaagccaacctcgatactgtttggaacatcttgaccaactatgagaagttggctgatgttattccgggtcttgctgtcagcgaagttgtcgaaaagaaacacaaatttgctcgactttatcagaatggacagcaaaacttgccattggg

SEQ ID NO: 24654 - DNA, 328 bp, Gossypium hirsutum
  Clone ID: LIB3272-040-P1-K1-E5
aacgctctccttctgtttctggtcaagccaatctcaaaagactcccctttgagctgacagctcctctcttgagtactataatgggtaaggagaaggttcacatcaacattgtggtcattggccatgccgactctgggaagtctacaaccactagtcatctgatctacaagcttggtggtattgacaagcgtgtgattgacaggcttgagaaggcggctgctgagattaacaaaacgtcatttaagtatgcctggattctcgacaaacttaaagccgagcgcgcacgtggtattaccatcgatattgccctctcaaagttcgagactac

SEQ ID NO: 24655 - DNA, 379 bp, Gossypium hirsutum
  Clone ID: LIB3272-040-P1-K1-E6
atggaattcaatctgatgggcaaatgccaattgacaagaccgtcggagggggtggtgatgcttataacaccttcttcaatgaaactgcagctggtaagcacgtgcatcgtgctgtctttgcagatcttgaacctactgggattgataaagtgaggactagtgcctaccgcctatttttacacccagatcaactgatcaggagcagggacagacagctacaacaaccttgatcagggccactacactatcggcagagagatcgttcacttgatcttggaccgtttcaggaagcttgctgataactgtaccggccttaaaggttttcttgttttgaacgctcatagcggaggcactgcatcttggctttgctccctccttt

SEQ ID NO: 24656 - DNA, 353 bp, Gossypium hirsutum
  Clone ID: LIB3272-040-P1-K1-E8
tcgcgcaaatcggttgttaaagagaagaaaaataggacaaaagcttcggggaaggaacaatgggacggtggtggactaagtatgcggtggcgttcatggcgttggccctcttctctatctccgccacagcgaggccctgcaagaccttcctcgtttcctcctattccatctctttccataaccctaatgacccttcctccgctgtctcctcccgatttgtcaccgtcttcactgagatcggtcaatggaaccccttatccatgcctgttgatcccaagccctcctacgccttcagctccctccgtgatcgtagtagggacattctcagcgtcgccgtcgctctcctcttcggc

SEQ ID NO: 24657 - DNA, 199 bp, Gossypium hirsutum
  Clone ID: LIB3272-040-P1-K1-E9
cgctacttccgtcctaattttcaggaaaaaatcgccgccttgaggggaaggtcaacccactgtctgcgatcgtataaactcgtaacccaatcttttaaatatggatcgacccagattcgtaatccactccgtagaagtctatcatttggccaaacattcaggcaggacggttctcaaactcctttcttttttgggaaaa

SEQ ID NO: 24658 - DNA, 296 bp, Gossypium hirsutum
  Clone ID: LIB3272-040-P1-K1-F1
gagaaggggaaacatggattaagtgttgaaccataattcaatagcttcttgtggccggataatggagctgctaccgtttaaattagtggccgaagctgctgttcaaccgtcgttagagaacgtccggaaacgtcagaagctcgatctcgttcgcccgacttctcgcgatagcgataacgctgatcaaaactcgtttcatgataagctcgagaaagatcaagaacttaatggaagtctaacggttaatggaccaactaattcagatcccggccaatacgaacaggactaggagtatt

SEQ ID NO: 24659 - DNA, 362 bp, Gossypium hirsutum
  Clone ID: LIB3272-040-P1-K1-F10
gcgagcagccgcagtcagcaagcatcagtagcaacaacaggagcgggagggggtctcacaggaaatttgatcacccaaggcatggttcccttggatttcttccaaggaagcgagcctctcgtcacagaggaaaagtgaaggcattctcaaaggatgaccctaccaaaccttgcaagctcactgcctttctggggtacaaggctggtatgacacacattgtcagagaggtcgaaaaacccggatctaagcttcacaagaaggagacatgtgaagctgttacaatcattgaaacccctcctatggtgattgttggggtgggtggatatgtgaagacaccacgtggtcttcgcttcttgaacacc

SEQ ID NO: 24660 - DNA, 300 bp, Gossypium hirsutum
  Clone ID: LIB3272-040-P1-K1-F12
agctgatgattaattatacaaataataagaagaggcactctaatgggagggggtatgagaaggaaagatattaccatcttggcaattcaaaatctaaactcccagatgctggtgctttttttttttcctgcactggatgtgaaagaatgagccatttacttttggtgtaacaactgttgcatttctggatatttgcagacttaggtatctttccttctttaaaggatctttctaaaagaaaaaacaacttgtgtcatagcatttatcaccagaaatcaccttaaggagaaaattctaaac

SEQ ID NO: 24661 - DNA, 367 bp, Gossypium hirsutum
  unsure (1)..(367): unsure at all n locations
  Clone ID: LIB3272-040-P1-K1-F2
cttattgtttcttcctcttttatatgntctgtcgctccggtttctttccgggctgggtagaagccagttggaatattatcttcaattacctccatcttggggaaccgacttcttaaccgcacctccactcgcaccccttctgttgtaatgtacacttcttcacctaccaggagtcctcacgcgatggcatacgacaagaacctggatgatcaggtccatgcgactgtggttcctgatgatgggattcagcctcaatcttgcatgtactgggcttctgacccgggggcaggggtatttggtcccgttactgaacaacttaacgcatcttgggtgtggggagcaagtcacccattccagtgttgcaaac

SEQ ID NO: 24662 - DNA, 378 bp, Gossypium hirsutum
  Clone ID: LIB3272-040-P1-K1-F3
tgggtgttctttttttcagtagtgtacgttaagtcaaccaaagtcgctgggttagggaactcggaagctaaaatatactgatcttttttttctcccccctcccccttcactttgttgaaaaaccaaacaaaggaatcaatcatagcttgcaggtgatcaattttgttcctttgatttttcttttagctgattgaacgcaggcatccagccgcccaactccttcatacagtgagaatcagatcatcatgatcgcttcagcagcttccctatctgcgtgtattgctatcaccagcaccaatgaagagctctttatcgggctcgacaaattgactaggggttcttctctaccgtgcaatgttatcgaagtaaatccttaca

SEQ ID NO: 24663 - DNA, 368 bp, Gossypium hirsutum
  Clone ID: LIB3272-040-P1-K1-F4
cgccgctgctctcaaccttccttcggtttacccaatggcatcggaaaaggggctggcgaacccaatgagggagattaaagttcaaaaacttgtcctcaacatctctgtcggtgaaagcggtgatcgtctcacccgtgccgctaaggtcttggaacagctcagtggtcaaacccctgtcttctccaaggctaggtacactgtgagatcttttggaatcaggcgtaatgaaaagattgcttgctacgtgacggtgaggggagagaaggctatgcaacttctcgagagcggtttgaaggttaaggagtatgaacttttgaggagaaacttcagggatactggatgctttggatttggcattcaggagcaca

SEQ ID NO: 24664 - DNA, 392 bp, Gossypium hirsutum
  unsure (1)..(392): unsure at all n locations
  Clone ID: LIB3272-040-P1-K1-F5
tgcactggtgctaaaagtgaacagcagtctaaactggctgcaaggaagggtgccggagttattcagaagcttgggtttcctgctaagtttaaggacttcaaaatccagaacattgttgggtcctgtgatgttaaatttcccatcagacttgaaggccttgcatactcccatggtgctttttcaagttatgaaccagaactgtttccaggtctgatttatcgaatgaaacaaccgaagattgtgcttcttatttttgtgtcagggaagattgtgatcactggagcgaaggtgagagatgaaacatacacagcctttgagaatatatatcnccgcctgacggagttcaggaagaaccaacaatgatataccacccgtgaaatcgactgtgagtc

SEQ ID NO: 24665 - DNA, 318 bp, Gossypium hirsutum
  Clone ID: LIB3272-040-P1-K1-F6
aaaaaaaaaaagaagcaaattaacatggcctaagttctgttattcattggtggagggggacttgcgagcgtggttaatactacactcattcttaataaccaattggtggttgatggctatgtgtactgtgatactttccgggctgggtgtggaacccctaagactagaaggcttgctgatgccatgggtaatctggtatgctccgacaggaagacctgcggagttgttttctagaaggagggatttaccgacatatccgggaaataccagatttgtggatccggggatcacttggattagatttgtgatgcaattttt

SEQ ID NO: 24666 - DNA, 391 bp, Gossypium hirsutum
  Clone ID: LIB3272-040-P1-K1-F8
cgcagagtgaaaggcggggaggccgtagacaatctctcttgcgctcttgggggagaatggatcagattcaacatccatctgtcatgcagaaggtagctggccagctcctttcttctagcatttcccgagattttcaagggtatgatgggtctttcaggaggcctgctctataccaaggacattttgcatatgggaattattccaatgctggaatgcactatcctattgttccatcaacagctaccgccatttgtgttcaagcccctgcagagaaaggatttaccagctttgccattgatttcctcatgggtggaggttctgctgctgtgtcaaaaacagctgctgctccgattgagcgtgttaagcttttgatacagaaccaggatgaaat

SEQ ID NO: 24667 - DNA, 201 bp, Gossypium hirsutum
  unsure (1)..(201): unsure at all n locations
  Clone ID: LIB3272-040-P1-K1-F9
ggaagttagtttctcgctgtccagaagtcttttctttctacatcggggcgggtgtaaagaaagaggtttancttctttcagaatttgctatttccaatgaccaccttcctcgtgttatcaaaaagtatccagaggttcttgtttatgatttgtacaaaactctacttcctcaccacaatcattttatagagatgaggcttt

SEQ ID NO: 24668 - DNA, 387 bp, Gossypium hirsutum
  unsure (1)..(387): unsure at all n locations
  Clone ID: LIB3272-040-P1-K1-G1
aaatcgctgtctcatttcacgatccaaagtttccaaattcctctccggggtttgctcttcaccacttagtctcaaatggttcgtaggccaaacgacccggaacactcccgtttcgcctctctcgtcctcctcttggtggctctgttctcctgtcttctggtctatgcggttgtttccacactattgaaccccaccgtaaatcctcaggattccagctttgagtctttggaatcggtggcgggtattgattttggggaaaagaagggcgagtgttgcagaggcattgagaatttggagctgtggggtgcagctgtgaagtgggggtctgacttcaagtntaattcctctgtggaatgttgccaggcttgtaaggccatgtgtagtggc

SEQ ID NO: 24669 - DNA, 392 bp, Gossypium hirsutum
  Clone ID: LIB3272-040-P1-K1-G4
ctttctctgatatcttcattctttagctttgcttttctttctcatggcgcgggggtagacgacgctgagttttggcttccacctcagtttttaaccgacgacgacttgggcatcgacaatagtaaggctaagagcaatcccaagtatgttgatggtggttttggattagagcttgacagttctaagtctttgtttccctacgagttcccttatgggtttgggtctttgggtttctcttcggatccaagttctccggctgagtcagtggtgggttctactgagacagagagtgacgaagaagattatctttgtggggtaactcgtcaaatggctcactctaccctcgaagacggtatttgcagaaacgttcgtgcctttgcttctgaaaaacc

SEQ ID NO: 24670 - DNA, 135 bp, Gossypium hirsutum
  unsure (1)..(135): unsure at all n locations
  Clone ID: LIB3272-040-P1-K1-G7
gcccggttccggggtgggcgggtggccgcccgcagtcggtgtctcatttctcgatccaaagtttgcaaattcctctccntggggtggtgtttaccacttagggtcaaaaggtttgcaggccaaactacccggaac

SEQ ID NO: 24671 - DNA, 312 bp, Gossypium hirsutum
  unsure (1)..(312): unsure at all n locations
  Clone ID: LIB3272-040-P1-K1-G8
cgaaatttccttttctttttcgattttttcctggcgtttgnattgggagggagggatgcangatcgaaggggaataaaggagccttaggaaggaaaggcggcggtccaaagaagaagccggtttctctttcggggaatggcggagttcatgttcccgttggtcgaattggccgatacttgaagaaaggccgatactctcaacgtgtgggaaccggtgctccagtttaccttgctgctggtcttgaataccttgctgctgaggttcttggtgttgctggtaattcttcaagagacaacatgatgaattggttc

SEQ ID NO: 24672 - DNA, 389 bp, Gossypium hirsutum
  Clone ID: LIB3272-040-P1-K1-H1
ccttctttcactgaatcttctcttttccctatattttctatctccaaatgcatgggcggtctctacgaaatggcttcccacattgttggctatccccgtatgggaccaaagagagagcttaagtttgctttggaatcattttgggataagatgagcagtgctgaagatttgcagaaggttgcagctgatctcaggtcagctatttggaaacaaatggctgatgctgggatcaagtacattcctagcaacactttctcttactatgaccaggtgcttgatgccacctctatgctcggtgctgttccaccgagatatggttggaacggtggtgagatcggattcgatacttacttttccatggctaggggaaatgcctctgtgcctgctat

SEQ ID NO: 24673 - DNA, 280 bp, Gossypium hirsutum
  Clone ID: LIB3272-040-P1-K1-H10
atgtggaattcatggtgtttccttgccacccttaaatgggggtgagggaaaaatagggctaaaacccaaacttttttttttttttggtccctatccattgtagtatatacattatatgaatatatgagcaaaattggtcttattatatgaaattttaaatgaaccctgtgataccaaaatctaggaaaccaaattttctgaaggtgaaccaactgtgaacaattataaaactcatctttaataccaaaccttaaggatttcaatattgattctttgttaa

SEQ ID NO: 24674 - DNA, 230 bp, Gossypium hirsutum
  unsure (1)..(230): unsure at all n locations
  Clone ID: LIB3272-040-P1-K1-H6
atccaattatttttaattcaatttcattccccaaccaaattcaaaccatggggacagacccatatgggggttttaagaanatccacatctttgtgaaaacccttaccggtgagaccataacactcgaggttggaagcgtcgacaccattagtattttaaaggtcaagattcatgacaggggagggatcccacccgaccagtagcatttcatttttgctggcaaacagttc

SEQ ID NO: 24675 - DNA, 246 bp, Gossypium hirsutum
  Clone ID: LIB3272-040-P1-K1-H8
tagccttttcttattcacctattcaaaagaaccaaatatgcaatggagaagggtgtgcagatcagggttaaaggtaaatcaactatcgtatggagcatgggttagtttcaggaaccagctcgatgttaaagaagcaaagtaactgggtcggttgtgtaaagacaactggattaactttttcgacatcgccgaggttaatgccaatggtcgagccgaggagatcatgggtcatgcctattaaggaac

SEQ ID NO: 24676 - DNA, 413 bp, Gossypium hirsutum
  Clone ID: LIB3272-041-P1-K1-A10
aaaaaagagaaaaaaaaaagaaaattgagagccttctccactttttagctttaggggtaagcaaaaaatcctgcaaaagaaggggaagattcctatttctttctccttttttggggtgcataatgacagggttttggtttcactagttttggctgcctcgctttccaatcataggcgggtttctttatttctttctttctttcactttagtttcgatgcttttccttttctatttatcaaagtagtaaatttgggtaagtttttctttttccagaaagcattttggtgaaattaaagttacaggctttgattcatgaatctttcttggcaaagcatgggtgtggtctgagatatttgagggctagtttggcctaatgcgcttatgtttaatgggcctttttttctgccttttc

SEQ ID NO: 24677 - DNA, 433 bp, Gossypium hirsutum
  Clone ID: LIB3272-041-P1-K1-A11
ccgggatgccggggcgcgccacacgtacgcttgcaatctttagagagatcgaccacaatttatgacttgaatggttcacaggggatcgggcttattctggggcgggggggaaaacgcttataatatcaaagccggacttgtaactcccaaagacaccagcagggatccaattttcattaaaatcaagggaacgctggagataccctcaaggagcccgagccaggacagcacccaacttggagtacgtgttgccagtcgacggaacaaattcttcaggtgacagacgagcctgaggctggaagacgcagataatatcacttcctccaaaagcaaaggggggggatccatcacccttctgaagattgtgaccttcctcggcaggaatcttaactgaagaaacctggggcattccaaagggcaggacaaaaacctt

SEQ ID NO: 24678 - DNA, 382 bp, Gossypium hirsutum
  Clone ID: LIB3272-041-P1-K1-A2
cgcatacagaatttaaaattttcaaaaaggaatttctaaaaggtgatcttctttagttgtaattattctcttatttttatttatttttccagcaattatctttatcattttgcatgtaaaaacaaaaagaaagtcaaatcttaccttgcgaatcggctttggcctttgttcacttcgttgagattgaaattgaaaggagaatccaaaagcattatccatcaagcctcgagatggcgccaatgagatccctaatatctctaaaatactgagataaggacgagggtcagaggctgttgaatgtgttggttttcaaccttgtttttttttttctctttgagcaaatgatttgagatttgagatattttttttaaaaataaaataa

SEQ ID NO: 24679 - DNA, 235 bp, Gossypium hirsutum
  unsure (1)..(235): unsure at all n locations
  Clone ID: LIB3272-041-P1-K1-A3
cagtaccgnnccgaaatcccggatggacggcacgagccacgcgttcggtaatcgctaatcaggtgtgcgattaccgttcaaggttcttgatgtgagggcttggaatagcaatagtgaccggtgggatgtaaatattgtagaccgttaaaactatccttctcctaagataacacctacaaggttgctattttgtggaggattaaccttttgggccctgggctttgatgaacccaaa

SEQ ID NO: 24680 - DNA, 433 bp, Gossypium hirsutum
  Clone ID: LIB3272-041-P1-K1-A4
cgcctccaggacgcctccgcccaccgtcaattaacctccatcctttctcctttccactccaaaaccctccatcaagaaaacctcttcttcgacaccccagccaataccctttcctctcaactttccgttcttcgcctccgcttcctcaacaaggacgcccgctgcatcgtttccctcaaatccaaacctactctggtagatggtgtcagccgcgtggcggaagatgaggaggaactagatccgtgttctgcacgcgcttgcgtggaggacccggcgaggttggggaagattgagtcgaggattttgaagagggttaaagaggaatttgggggtggggaagaaagggggattttgttggttaggtgggtttgagaataaacgagaggtttttaattggaaaaatctgaagctggtaggggatgagactaatttt

SEQ ID NO: 24681 - DNA, 402 bp, Gossypium hirsutum
  Clone ID: LIB3272-041-P1-K1-A5
ctgaaattttatagcaagactccttatttctccgatgtcgatcttcgaatacaacgggagtgccctaatagccatggtaggcaagaactgcttcgccattgccagcgatcggagactcggagttcaactccaaactatcgccaccgatttccagaggatttataaagtccacgatcgcctctttctcggtctctccggcctcgccaccgatgctcaaaccttgtatcaaaggctcgtctttcggcacaaactgtatcagctaagagaagaaagagacatgaaacctgagacttttgctaaccttgtttctgcgattctttacgagaaaaggtttggtccatacttctgccaacctgtaattgctggattaggagatgaagacaagcccttcatttgcaccat

SEQ ID NO: 24682 - DNA, 427 bp, Gossypium hirsutum
  Clone ID: LIB3272-041-P1-K1-A6
caggttactatttttagtagtactagaacagtgtttcgtacacgtttctctgcttcttcaacccttctccatgttactttcttactattggcgttggctttgctctgtctttgaacatccttttctctctctctctgtgaatattcaaagcatcaaaggaataagtgtaaagggtatttgtttacctacatggatgagtatggtggtaaaagaggtgccggtgggcttggaaagggatcaggtctggctttggacgatcatgttaataacagagaacgaaacgctcggttttgcaatcgaaatggatgtggtgccaggctaaactccatgaatgatactcctaacggctgctcaagaaatggagagggaataattgggagttcatctaaagtcaaccctactgttagtaacaatagaaaatactcta

SEQ ID NO: 24683 - DNA, 395 bp, Gossypium hirsutum
  Clone ID: LIB3272-041-P1-K1-A7
cgcatacagaatttaaaattttcaaaactaggtttactaagggagactatctttaaatgggattaggctcttaatgggcgttgagtgttgcaaacagttatccttattaaaaggtgtagaaaaacaaacagaacgtcaaattttaccttgcgaatcggctttagccttagttcacttggttgactttgaaactggaaggaggattcaatggctttattcatccagccttaatatggctccaaatagactcctaatatccataaaatacttgcataagggcaaaggtcataggctagagaatgtggtggtttttaaccctgtttttttttttttttttcaccaaaatgatttaagattttggaacttttttttttaaaataaaaaaaatttgggta

SEQ ID NO: 24684 - DNA, 218 bp, Gossypium hirsutum
  Clone ID: LIB3272-041-P1-K1-A9
tcggttattatgagtacctaatcaaagggtggtttcagttccgggttactcaggatggtaacttaacttattttcatgacatggttgaggaaccaatggggggagttaaacccatgcttgttcaaaaatcaatcccaagggaattggttttgtggggggaattcccgtttggccccaagggttccttagatccaaaaagggacacccgggatgttttt

SEQ ID NO: 24685 - DNA, 283 bp, Gossypium hirsutum
  Clone ID: LIB3272-041-P1-K1-B10
tcattctcttcttctttataactaaattcctattctcaatgatgatattcataatacaggggtcgtgttatattcatacaaggaaaacattaattataatcaatataaaattaagcttaacaagcagttgccttacttattctacaacattgttgacatattcaaaatcaaccctcaatatcattcacataatgattgttccaacataaaactatactcacatatataattttaattttttgttcttaaatcctatattcatcataccatctttttacctatt

SEQ ID NO: 24686 - DNA, 169 bp, Gossypium hirsutum
  Clone ID: LIB3272-041-P1-K1-B12
tttaaaataatatttacaacaatatttggggcgtggaacctttggaggagggatctataaaccaacttaccgcttacacctttcctgtccatacccttaggcatacctttatttatacctccttttttaacacaaactctactcccctttttaaagatcattcaatttg

SEQ ID NO: 24687 - DNA, 266 bp, Gossypium hirsutum
  Clone ID: LIB3272-041-P1-K1-B2
tgcgacccactcgtccgatttggttgtcgagaactgaaacaaagaatatggaaaccgctactttgacaggattacttcacaaggctgcggacgagttccctaccaagcgagctatatcagtttgcagcaagctccatttgacgcatgctcaattacaacacataatcgatcatgctgcttgtctcctcatcgactacggcatccatcccggcgatgtagtcgctcttactttaccaaacaccgcggagcttgttattatgttcttg

SEQ ID NO: 24688 - DNA, 127 bp, Gossypium hirsutum
  Clone ID: LIB3272-041-P1-K1-B3
ctcctttcaaatactaattcttgactccttctcccatgaggccttctaatcgcttccgggttttttgtctactggggctaccttgcacaccaaatgaattttggtcttaactcggaacaaccaactt

SEQ ID NO: 24689 - DNA, 411 bp, Gossypium hirsutum
  Clone ID: LIB3272-041-P1-K1-B4
gattcaattgggttgttttagttcgaactaaagccagccgatgaatttaagacagaaaaagggtgacgtttgagggtttaacaaaattgggtgactgggaatggatactagcatggcatctgggaatccgtctttcgatgacttgcagaacaagggtgaggctattgatcatccacaaaatgaagacactatggattgtgagtctctaaatatttcttctcaagctgctgtaaaacctaatgggactgtgtctagcagtgttcgagagcttttggaatgccccgtttgttgtaattcgatgtacccaccaattcttcagtgtttaaatggtcacacattgtgttctggttgcaagccaaaggttgacaaccggtgccctacgtgcaggcatgaactcgggaatattaggtg

SEQ ID NO: 24690 - DNA, 349 bp, Gossypium hirsutum
  Clone ID: LIB3272-041-P1-K1-B5
ctcactcagttatgcatttattcttttgtgtggacttaaagacccaagtaccattataagcacgggtgttgtgacttatgactataactgtacctcccctgtcgttcccgccaggctttgcatggccttcgttctttaagctgacaagggctggcccatagctgcccctcatgcaatctagagtattgagggtggagctaatcctggccctggatgtatcgtaaagatcagactttgtttcatgccttgcattccactatatgaggcacctggttggaggacatgttgaaaacaaattttcatacagctacggtttgattggaagtgggcctcttggggacaagcttta

SEQ ID NO: 24691 - DNA, 348 bp, Gossypium hirsutum
  Clone ID: LIB3272-041-P1-K1-B6
caatatcggtgttgcggtacactgactacaaatagtatccttctgatcatctctctcttgctgatagccaaacgatggctggtattccgatcagattcggaatcattgggtgtgccgagatagcccgcaaagtttctcgagctatccagcttgctcctaacgccactgtctccgccgttgccagccgctccttcgacaaagccgccaatttcgccaaggctaatggcttcccacctgacaccaagatctacggctcctacgagtcccttcttgacgaccccgacatcgacgccgtttatttggctttacccactagccttcaacttaaatgggctggtttgacggctc

SEQ ID NO: 24692 - DNA, 166 bp, Gossypium hirsutum
  Clone ID: LIB3272-041-P1-K1-B7
tcgggcccacccctccggtttggttgaaaccaaaggggattccccgggggttccaggggtcttctagggtttaaaactctttttgggtggctgttaaaagatggtggttgccctcatcttttttttttcttggaaacaaacacttgttgttgccgctgttattcac

SEQ ID NO: 24693 - DNA, 299 bp, Gossypium hirsutum
  Clone ID: LIB3272-041-P1-K1-B8
actgctttcagttcttggctgatgactagatctccatcagggctatctctcgctcgagggtatattctatacgggctttacatgagcacaccaaatgaatatcgagctcaactggcaacaggcgccttttgttgtttgctctgatctgcacattacgaaccgtgggagattgaggtatatttcacaaaagattctctttcggcattggacttgtcctgtttttcacgagtcaggttatatgagaagaatatacgatgagataatgctgctatactcgaagaagcgggctcaaaaattaa

SEQ ID NO: 24694 - DNA, 420 bp, Gossypium hirsutum
  Clone ID: LIB3272-041-P1-K1-B9
aaccttgccaacaccaatgcattgatcctgaaggaatttgcaccttcaatccctgcaaagaacattacctgtttgacaaggttggatcataacagggcactaggtcaaatctcagagaaactaaatgtccaagtttctgatgttaagaatgtgattatttggggtaatcattcatcaactcaatatcctgatgtcaatcacgcaactgttatgactccatctggagaaaagccggttcgcgagcttgttaaggatgatgcatggttgaatggagaattcataaccactgtccaacaacgtggtgctgcgatcatcaaagctaggaaactctcaagtgcactatctgctgctagtgcttgttgtgatcacattcgtgattgggtccttggaactccccagggcacatgggtttccatgggg

SEQ ID NO: 24695 - DNA, 254 bp, Gossypium hirsutum
  Clone ID: LIB3272-041-P1-K1-C11
ggttaatctgaagcggggtgcgttattggggggggggtactcatatcactcatatccaacccaatcttgtacaaatgtgcaagcaagctcaatctggcttttgctcatcaacaccgagctggaattcaaaacattaactcccgccctgaactcctctcatttgcaggtggatcgccctgcttgtcgtttgtgggcaaagtgtctgggttgttacaccattacccagtatatagccgagcgcttatcgaacggtg

SEQ ID NO: 24696 - DNA, 215 bp, Gossypium hirsutum
  Clone ID: LIB3272-041-P1-K1-C12
cttttattttttttcaatcaaatcactgtgtatcttttctatctctttctgtgggtacctgtgatattttgagctgtgatttttctaatccataaaattacaacaaaaggaatgctttttatacattcatacagaaaatgaatatacacccaaagtatctacatatctgctctatctgaattttaacttctgtcatctttcaacttacttgggtg

SEQ ID NO: 24697 - DNA, 158 bp, Gossypium hirsutum
  Clone ID: LIB3272-041-P1-K1-C2
aatcccttttaaaacaaccttagtgaaaccttgtgggggggggaaagccaaaattttcgggggaagaaagcttgcaatttgaattggtttcctaccgaaaatggtcaagaaccagatccattccgacgttacttcatggagcccagctgggcgattgt

SEQ ID NO: 24698 - DNA, 117 bp, Gossypium hirsutum
  Clone ID: LIB3272-041-P1-K1-C3
attctatcgaatccttcgattctttctcgaagcttggatgctcagattaagccaactgtagagtttttatcccaatttttgaaacctgataaaatcccggtggctattaaaccatca

SEQ ID NO: 24699 - DNA, 421 bp, Gossypium hirsutum
  Clone ID: LIB3272-041-P1-K1-C4
aagaacagtcacaaagttgcttttcgaaaaggagtgaaagcaggaaaaaaatcgattaagatatagaaagatggcggtgatgcagaagctgaaaatattcgtggtgcaagagccagttgtcgcagcttcttgcctcatcgctggttttggtctctttctaccagctgttgtaaggcccattctagattccttagaatcatcaaagcaagtccctcagcctgctttaagagatgtggttgctggtgtgactggtaaaaagcagggctaatgtgatttatgagttgggaagaagcagaaacttaaatgtagctagtaatcagcaacaaaataaacttgattttaaaggtgaactcttgcgccttcaacttcatctttagcatgagaatttaggggtaattttgttttattttcaggggggggg

SEQ ID NO: 24700 - DNA, 268 bp, Gossypium hirsutum
  Clone ID: LIB3272-041-P1-K1-C5
gaaaaagtgaccaatggagcttgcgagtatttgaaaacgcttggaagtgcgcttaatggagaggaattctttgggggagaaaccattggaaagggagatattgttgctcgctctgttggggatttcatttggggcactctagaaattatggggcgaaatatgctgtcagctgacaaattttcccaattattccaatggtgtgaagatttcgcaaattgcagcattgttaaggaaagtttgcctccaagagacaaactactttcctttg

SEQ ID NO: 24701 - DNA, 324 bp, Gossypium hirsutum
  Clone ID: LIB3272-041-P1-K1-C7
gaagaaagctagcaatttgaatcggtgtcgtacggaaaatgttcaggaaccagtacgataccgacgtcactacatggagcccagctgggcgattgtttcaagtggagtacgcgatggaggccgtgaaacaaggttcggcggggatcggtctccgatccaagacccatgtggtgttgggttgcgtcaacaaggctaattccgaattgtcttctcatcagaagaagatcttcaaagtcgacgaccacattggggtcgccatcgccggtctcaccgccgacgggcgcgtgctctctcggtatatgcgaaacgagtgtataaactaca

SEQ ID NO: 24702 - DNA, 179 bp, Gossypium hirsutum
  Clone ID: LIB3272-041-P1-K1-C8
acgctatgctttctgttccttttcgtttgtagatacgtaattttaacacctggagaagtgtatcccgattatgaaaaattcctaaactccccgcctgtataagccaatcatctccatggcactgcctttgaacctaagttaatttgttcaaccaatttttttcccattcattgaccaac

SEQ ID NO: 24703 - DNA, 343 bp, Gossypium hirsutum
  Clone ID: LIB3272-041-P1-K1-C9
tcgatgtcattcaaaaggacattaagaatcttcttattcttcaagagatataccgggagatgggcctttcttagaggggcaattgagtttaggtaaaatggtttttcaaaaagagatcctgggattgcagccctataccataaagttcttttttcttaggaaatcttgtttttttgagagcgggtgagaaccaacttttgaaaaacttaaaacccttttcttcaaaatggttggcacaaaggactttttggaggggatccctaacttaaacgaagacttcgggtacttgtttattccttacccctcttaatgttttgcaaggcttcacacttaaaacttttcc

SEQ ID NO: 24704 - DNA, 189 bp, Gossypium hirsutum
  Clone ID: LIB3272-041-P1-K1-D1
ctaggaagacttcttttttagggtttttggccaaaaattttagggttcacttaccatgggttattgtttgatattttccatttttcgtgggcacatttggtctttattctataaaaacgtacttttgatggggatggggaggtactcgctcgataggtttctttcccattgtgtcttggggcgaaaaat

SEQ ID NO: 24705 - DNA, 352 bp, Gossypium hirsutum
  Clone ID: LIB3272-041-P1-K1-D12
ggacttttgagggtccataaacgcattgttgatggtttggagggtgatccatgggatacacctacggctgtgggaaccaaggtttcaactaggctgctagtccctgcctcacaagccggaagtttgattggaaaacagggagcaactgtcaaatccattcaggaatcttctaattgtattgtcagagttctgggagcagattctgcagaagaccttcccgtctttgctcttcaagatgatagggttgttgaagttgttgcaaaagcagctggtgtgcacaaagcaatggagcttattgcaactcatctcaagaaattcttattggaccgcagtataatttccgttattttga

SEQ ID NO: 24706 - DNA, 323 bp, Gossypium hirsutum
  Clone ID: LIB3272-041-P1-K1-D2
cttttatttgcttatttctttgaaagggtcaaaccttttttatgtttttggtcccaatttcgaagacctaattttggggggttttgattgtgtagtgggaggaaagaaaagttttcacaaaatggggtcttatagaatgctctccacaaagattgtggagactcaaatgcccatcatgggtcacatacaccaattgatccgcggggcgcaaaatgctgtgtcactcgctcacggagtgggttactgggaaccacccccacacgcgtttgatatggttaaagcactcgtagaggagtcttcagatagatgttatggggctcatg

SEQ ID NO: 24707 - DNA, 310 bp, Gossypium hirsutum
  Clone ID: LIB3272-041-P1-K1-D3
ctctcttctttgttttccaatagttcgtaacaatggcggtctcacttcaagctgcaggtaccctgatgcaaccaatcaaggttgctgcaccatcaaggaccaatgtgccgctcaggtcctcccagagcgtttctaaggccttcggtttggagcctgttggtgctaggcttacctgctctttgcaaactgacctcaaggacttggctctgaagtgtgttgatgctaccaagctcgctggtttcgctcttgctacatctgctcttgttgtctcgggagcaagcgctgaaggagtttcaaagcgggtaaccta

SEQ ID NO: 24708 - DNA, 378 bp, Gossypium hirsutum
  Clone ID: LIB3272-041-P1-K1-D4
ctttccaataaaaaactccccaaatataacataagcttatcatattactaatcattaaagatattccaacgaaaaccagaaaaaaaaatgtcttggaaattctttggctctcactctctccctctcttcttcctcttcttcttttattcctttcctttaatctcaactcaacacaatgatgatccaacatttaaaaccatgcatgatttctctgggtacccagttgatgaatcatcacacacttttacaccatcaaattcaatctcactttcagttgatattcaagctctgcaaaaacagattgatgagctatcaactttctcggacacacctgccccatcagtaactaggattctctacactgagaatgatgtattg

SEQ ID NO: 24709 - DNA, 341 bp, Gossypium hirsutum
  Clone ID: LIB3272-041-P1-K1-D5
gcagttcgtcgtcgataggaaggaacagcgatgattccggtggatcaccatcggatgatgatgactcaccggaacctgaagtacaaagccagcttaaaggacctttggatacaatggatgctctacaggagattttgcctttgagaaaaggcatatccaagttttataatggcaaatcaaagtcctttacaagtttagccgatgcggctgctgtttcctctgttaaagattttgcaaagcctgaagatccctacaataggaaacgcaagaacttattagctcgcagttcttcattggacaagaaacccaacaatcttttgggaaacattggaactaaaata

SEQ ID NO: 24710 - DNA, 379 bp, Gossypium hirsutum
  Clone ID: LIB3272-041-P1-K1-D6
gctttcaatgttcttttccccattgaaaaaatattttcgctagattctttaatccattaagatatcatgggcaaaggtccaggtctctacactgaaatcggcaagaaagccagagaccttctttacaaggattatcagactgaccacaagttcactctcaccaccagctctccaactggagttgctattacctctgccggaacaaagaaaggcgaactctttttggctgatgttaacacccagctgaagaataagaatgtcacaactgatattaaagtggatacctactccaatctgtataccaccataaccgttgatcaacctgcacccgggctgaaagcaatctttagcttcagagtccctgatcagaggtctggca

SEQ ID NO: 24711 - DNA, 382 bp, Gossypium hirsutum
  Clone ID: LIB3272-041-P1-K1-D8
gggggggccacgcgtcctaattaataaaaacaaaattaagaaaggagagagaacaaacaaaaaaagtcttgggtatgtttgttcttgcgctttaacatcaacaacaaaaagaaaaactgaattatcgaaggaaagatctgaaagagaatggcaacttttgcagggactacccagaaatgcaaggcttgtgaaaaaactgtttacttggttgaccagcttactgctgacaacaaagtttatcataaagcttgcttcatgtgccaccattgcaagggtacccttaagctaagtaattatagctcctttgagggtgtcttgtattgcaggcctcactttgatcaactatttaagatgactggcagcttggataaaaatgtttgaa

SEQ ID NO: 24712 - DNA, 324 bp, Gossypium hirsutum
  Clone ID: LIB3272-041-P1-K1-E10
gtttcattgtttatcagagcaagaaaaagaagggaaaatggaagggaaagaaggggatgttagattgggagctagcaagttctcataaaggcaacctattgggacagcagctcagtcccaagatgataaggattacactgagccacccccagcacccttgtttgagcctagtgagttgacttcatggtcgttttaccgagctggaatcgctgagttcgttgctactttcctattcttgtacatctcggtgttgactgtgatgggagttcttaaagacaaaaccaattgtacaactgttggggatcaagggattgccttggcttt

SEQ ID NO: 24713 - DNA, 233 bp, Gossypium hirsutum
  Clone ID: LIB3272-041-P1-K1-E11
atactcatttaacccctttcattagcatcgaaatcactccagttttctttatcacggaaaaatgtgttggtggggcggaaactgtggctgcggttctggctgcaagtgtggcattcgctggggtggatgcaagatgtacccagacctgaacgttttctatatgaccacaactgatacccttgttcttggtgtatcaccccagaaagcacactttgagggggctgggatggaat

SEQ ID NO: 24714 - DNA, 432 bp, Gossypium hirsutum
  unsure (1)..(432): unsure at all n locations
  Clone ID: LIB3272-041-P1-K1-E12
acgttcttttgtagtggaagaaaaaaaatagaaataattatggagacaaattcatgggcacgggtggtgatgataactgttacactcatgtgcggcgttcaaatggccactgcataactcagtgccgctcagtgcaagcaagaaaggaacctctccattaccgcttgcaagccggtggtttactgtaagcttccgtcccctgaatgcttccagcccgttatggttacccatcttgaatgcgtttgccccattatcacgcccaagatcgccgcccttattgacttcaaccttnccattcgtctcattaaggctgctgcaaaatgttcctctccactacaaatgttgaagtatcacatcttcattaaattggtataccttctagttatctactcgttacttatttttggatgtggatcaacctttgaaattaaa

SEQ ID NO: 24715 - DNA, 445 bp, Gossypium hirsutum
  Clone ID: LIB3272-041-P1-K1-E3
ttcctttgttcatattctccctttctgcttcttatttattttctttcaccttttcctttcaaggtacttctctttctcacccttttattttgtatttcgctgttcctctagtttgattcttttttttttatgatttgaattttagattgtagatctgatctttaagaaaattaaaatttaacagatcgagagaaaaaagaatggcagaggagcatagatgccaagcgccagaaggccatcgtctttgcgtcaataactgcggctttttcggaagttcggcgacgatgaacctttgctccaaatgttacagagatctctgtctcaaggaacaggaagcttcttcgatcaaatccgctctttcctcttccccttcgtcttcatcaacggtcgtcgaatccatttctcaggttcctcttttggctctccatgaagtcaacagagaatc

SEQ ID NO: 24716 - DNA, 456 bp, Gossypium hirsutum
  Clone ID: LIB3272-041-P1-K1-E4
ttcttctcgtctccactcttccttgaactcaaaccggtttctttccccttcgaatggaagatcgatccacttccaaacggtagcggttcgaatgccgcaacaagccccgaaaccgcagcagcgacaaccgcaattaccgtcgcatcgaacacgacgccgtcctcgaaattgagccatctgacggaatcgttaaaattagagcaccaattcttgcgtgttccttttgaacatttcaagaaaacaatccgaaccaatcaccgaacagtcgagaaagaagtctctgccgttatttcaagcgtcactgacgtggctgactccgacgaaatatccaaagacgatgccattttgagtctcacttcccttgtttcccgtttgcaaggcatcaagcgcaagttggaagaggggagtcatgcagagaacttgcaagctcataggtgtcgtgctcgtcttgatcac

SEQ ID NO: 24717 - DNA, 381 bp, Gossypium hirsutum
  Clone ID: LIB3272-041-P1-K1-E5
ttcatactcatttagcccctttcattagcatcgaaatcactccagttttctttatcactgaaaaatgtcttgctgtggtggaaactgtggctgcggttctggctgcaagtgtggcagtggctgtggaggatgcaagatgtacccagacctgaacgttgccgagatgaccacaactgagactctggttcttggtgtagcaccccagaaagcacactttgagggagctgagatggaattcggggctgagaacggctgcaagtgtggagacatctgcacctgcaacccttgcaattgtaaatgattagagaccgaagccaaagctccctggaagcagagacgcctttgtctttaagaaataatatgttgtgatgtttatgcttt

SEQ ID NO: 24718 - DNA, 386 bp, Gossypium hirsutum
  unsure (1)..(386): unsure at all n locations
  Clone ID: LIB3272-041-P1-K1-E6
cagtcaatattgagagagagtgagaaagatgggagagacagacaaagacagggaacacgctgagcatgggatggatctaccaactgattctggtggttatccagccatgcactgactttttcctggctctggctactacatttatttgctgcctctttttttatttaactttttcaccttatcccattttggaattattattatgactgtaatttacatccaaggtcatgatagggaccttttaacaagggaattgtggggacttttgttgagccccaatggncccagctcttttttcttcattttctctctattcttttcaatccaagtatagagattattcgttttactggtaatggaaatttgcattttgattcttcaaccat

SEQ ID NO: 24719 - DNA, 406 bp, Gossypium hirsutum
  Clone ID: LIB3272-041-P1-K1-E7
gaacatttgagaccatttctggtgttttagggtttgatcacagtgagaaagaccgatgggaggtggccatggagggagcacaacttacaaaggtgtaaatttgcaccacccaaagagatggcacgtcgccaccggcaagggcttgtgcgctgtcatgtggttttgggtcctgtacagggctaagcaggatggtcccgtagtgttgggttggcgacacccttgggagggccatgatgaccattctcatggccatggagacaagcattagcctgaagaagcttatctgcttaatggtgcgtggcacagatgctgttctagaatgtcttctgtttattttcttcggtgtcaataaagtgatggggaaatgggattgtaagcataatgaaatgaaaactgaaactttatt

SEQ ID NO: 24720 - DNA, 436 bp, Gossypium hirsutum
  Clone ID: LIB3272-041-P1-K1-E8
ctaatcactcgcccgctgcgcaatcaccgatcaaagctgaagatgggaagcctgggaaaagcaatatacaccggcggattctggattcgggagaccggtcaggctctcgatcgcctaggctgccgcctacaaggcaactattttttccaggagcaactttctaggcatcggactctgatgaacgtatttgataaatctcctctggtggacaaggatgcatttgtagcccctagcgcatctgtcattggcgatgttcaggtgggaagaggatcatctatttggtatggatgtgttttaaggggggatgtcaacagcattagtgttggatctggaactaatatacaagacaactcccttgtgcatgttgcaaagtctaatctaagggggaaagtgctaccaactaacattggaacaatgtactggaggcatagtgctg

SEQ ID NO: 24721 - DNA, 399 bp, Gossypium hirsutum
  Clone ID: LIB3272-041-P1-K1-E9
ctcaatcatccacttcttctcttctttgaactcaaagtcccagctaatattagaatcatgggtgttgtcacttatgactatgagaatacctccccagtcgcccctgccaggcttttcaaggcctttactgttgaagctccgaaagtttggcccacggctgcaccaaatgcagtcaagagcattgaggttgaagctaatcctagctctggaagtatagtaaaaatcaactttgttgaaggccttccattccaatatatgaagcaccagatcggaggacatgatgaaagtaatttttcatacaggtacgatttaatcgaaggtgggcctttgggggataagcttgaaaaaattagctatgagaacaagtttgaggcagctgcaggggggggaaggttttgc

SEQ ID NO: 24722 - DNA, 354 bp, Gossypium hirsutum
  Clone ID: LIB3272-041-P1-K1-F1
ctttgcgtttgcaccgtcttttgattcttcgtttctcatgttttttgttttgttgcattaattattctcctttttcttaatttattttcatcgattgatttttatatttatttcttacattttatttcttgaggggggtttcttgtgagcttatacaagaactaacaatgcaagcaactgaagctgttagcaatggagtttcaaatggttcttctcaggcaaattctcctgttccggaacccttagataacaagcctccaaggcccgaaacaagtgggcggcactctgatctttcacttcaaataccacctaaaccaataggatttggtcgtcatagtggaaagggtttacttc

SEQ ID NO: 24723 - DNA, 345 bp, Gossypium hirsutum
  Clone ID: LIB3272-041-P1-K1-F10
acgaaaaatagcatccatcgatagcgttacatcttattctccatactcctatcaggtattgggtgttcatacggatttcagttctcattgttctcatcgctatcctccaatacttcatatccaacctcatgcgctcctttcaagttccttatcctaagatctacaaaaaaagtcaacttaactttattactctgatttctcaaggtgctgcaaattttatccctcccaaatcttttagatctccgatgttttatatcatcaatcactaaattatattatctgttttcctcaatggccatactcaaaatgctcaaacacaaaatttctcttaccctaacatggctt

SEQ ID NO: 24724 - DNA, 431 bp, Gossypium hirsutum
  Clone ID: LIB3272-041-P1-K1-F12
cactcacccaacttgctgggatctaactagccggaaccactccataacttaagggatgggaaaccgttggttcagggggtgtaaggcaatatacctttcaactcctaaagctcgctcatacacacattacattcacttgtctagctcttaacatatatctattcaataacctgggggcttattaatttctttactacaaaacttctaattgggtggctttcaacatcccttctattcaaatatacaatgtaatcatccactgtgcacacaacattcctttttctaccttataagctaacctggcttcaaaacgtaatttattacttaccaactcctggtttcggcacttagattagttatgtctacaaaaagaaatcatcccaaggaggcatcccataccattgttacctcacctaaaaaagataaccttt

SEQ ID NO: 24725 - DNA, 476 bp, Gossypium hirsutum
  Clone ID: LIB3272-041-P1-K1-F2
accgatccggattccgcgctcgagcacgcgtgcgaatcatcaccttcagcataaaaaaccattccctttattgggggttgtttaagcttgtaaatcttatacccggtcgttgttacatggtccaggcctagatgagtaggaagtcgcggagggcgtcacattagatggatcgcgagcccgggcggagcggtcgtcggagcagatcttgggggttgtagcttatagtcaaatgggatctttgagggccgaagaggggaaaggttacatgtgtgctggaactctcaaatgagaaagcccatcctaagcggcgacagtagataatctaacagaacgattaaagcagagacttgaacgggtgctcgacactgatgttgctacatatgcaagatcacaagggaagagtccagttacttttggtcctacggatctggtttgttgcaggaccttgcaaggtcacactggcaaggtttacttct

SEQ ID NO: 24726 - DNA, 329 bp, Gossypium hirsutum
  Clone ID: LIB3272-041-P1-K1-F3
agcagctatcaaagctttgggatccttccgcagcacccccaccaactaaaaaaatcagcccaagtgctttggcttccctttactttttttttattttccccaattggtcggttggggggatggaaaggttattattaatggtgaatggtggtgaccctttcctttttaacaattttcctctattaaaaaatattaaacccttggtggtaggctttggcttctctcatgtatcactgttttttaacatggggggcagggtaaatctctttaagaatttagataatggattccttagggtcgtttcttaaaaaaaaaaaaatttattataa

SEQ ID NO: 24727 - DNA, 352 bp, Gossypium hirsutum
  Clone ID: LIB3272-041-P1-K1-F4
ggccaaaaagaccgccaaggaatggaagggtctccgcgtaaccgtcaagctcactgtccagaatcgccaggcgaaggtcacggtggtaccgtcggcggcagcgctggtaatcaaggcattgaaggaaccggagagggataggaagaagaccaagaacatcaagcataacgggaacatcgcactcgatgatgtcatagagatcgctaaagtaatgaggccgaggtccatggctaaggatttgagagggacggtgaaggagattctgggcacctgtgtttccggtgggtgtaccgtcgatggtaaagaccctaaagatttgcagcaggagattgatgatggggaatgtgatgtt

SEQ ID NO: 24728 - DNA, 355 bp, Gossypium hirsutum
  Clone ID: LIB3272-041-P1-K1-F5
ctgagtttaagcatatcaataagcggaggaaaagaaacttaccaggattcccctagtaacggcgagcgaaccgggaaaagcccagcttgagaatcggtcgccatcggcgtccgaattgtagtctggagaagcgtcctcagcgacggaccgggcccaagtcccctggaaaggggcgccggagagggtgagagccccgtcttgcccggaccctgtcgcaccaagaggcgctgtctacgagtcgggttgtttgggaatgcagccctaatcgggcgggaaatttcgtccaaggcttaatacctgcgtgtggccgatagcgaacaagtacccggaggggaagattaaaaggactttttaa

SEQ ID NO: 24729 - DNA, 396 bp, Gossypium hirsutum
  unsure (1)..(396): unsure at all n locations
  Clone ID: LIB3272-041-P1-K1-F6
cagatctcctcatctccactttttttccttcttcaaatacccaatggccgtcactttcgcaaatctccacaccgagtctggtcttaaagctcttaatgacttcctctctggaaaatcttacatctctgggaataagctgaccaaggatgacataaaagtttatgccgctgttctgaagaaccctggtgattctttccccaatgttagccagtggtataattctgtttcttctcaacttgccgccagcttccctggtaaagctgttggcgttgggtttggtggcaaagctgctccagctgagtctgctaaagctgaggctgctgatgatgaggaccacttggatctatnttgggatgagacggaggaggataagaaggctgcagaggagagggaagc

SEQ ID NO: 24730 - DNA, 378 bp, Gossypium hirsutum
  Clone ID: LIB3272-041-P1-K1-F8
attttgggttctttttgcttctagattttgggggggtttgttttaaattataaatccataactgagagatcatagaaaaagggctggtccttttatcgagctaaagcaaggaccctacttttttaattataaaaaatgctttttctttttaagttaaaaagattttaaaagacccaaaaaaagtaaaaaaaaaatgtctgttgcagagctgaaagagaagcacgcggcggcaacggagacagtgaataatctaagagaacgattaaagcaaagacgtcaacagttgctcgacactgatgttgctacatatgcaagatcacaagggaagagtccagttacttttggtcctacgggtctggtttgttgcaggaccttgca

SEQ ID NO: 24731 - DNA, 443 bp, Gossypium hirsutum
  Clone ID: LIB3272-041-P1-K1-F9
aaacaacatagatataataagcacctccccgtaagcgaaccacaaaggaaaggtgggagagagacccggaggcagtggctaaggaagttagtgaagaaggacagggtcgtaaggactatgtggaccctccaccggcacctctgattgacatggctgaactcaagtcatggtctttttacagagccctcatagctgagttcatagccactctcctcttcctctatgtcactgttgctactgtaattggtcacaagaaacaacatgttgcatgtgatggtgttggtctcttgggtattgcatgggcttgcggtggcatgatctttatccttgtttactgcactgccggtatctcaggtggacacattaaccctgcggtgacttttgggttgtttttggcccgtaaagtgtctttcattagggctgtgggttacatggtgttacag

SEQ ID NO: 24732 - DNA, 309 bp, Gossypium hirsutum
  Clone ID: LIB3272-041-P1-K1-G1
cttgatgcttataattatatcgtcattcatcatccaaagggtgtttcttctaagctttggtggagcttccatggaagcttagaattatggggtttgagggaaaaaaaatagtgccattgcttaataagccaataatcataattggggtttttacgggaaatgcgttcaataagggtttttttatttcaagggtgggttttaatggattatttgaaagttttcatttaaggcattaaactttataaattggggccggtgggctttttttgtttggaccgtttggaccaataaaaagtttttttttccttc

SEQ ID NO: 24733 - DNA, 401 bp, Gossypium hirsutum
  Clone ID: LIB3272-041-P1-K1-G11
aggaaatttggtatcaaaagctaggagttggggagtttcatggcggggcggaccaataatcttcattcactgagcaagatccatgcaggcttaattatggtggggtgagggattcgtctgatgacagcatcaatcaaagggggatatatagtagctgtcttaacactgatgcgagcaatggttgcagcaccttgattgatccttttgtttccagtgccattctagatgacttcttctcattggaagatgctgatttttcaaaaccctccacattgggtggttgggaactttagctcttgtcaggatggtcagtctcagattacctgtgttagccttgcagattctcaggctttttctcgtctagacttgcctgacaccttcggtggtaaaaggcgatcttt

SEQ ID NO: 24734 - DNA, 445 bp, Gossypium hirsutum
  Clone ID: LIB3272-041-P1-K1-G2
aaaaaagaagcaaaaatggtgctgtgggagatcgcattgggaacggcttatttcttggggcttaaacgaagttacaagcttgctttgaagattcagcgacggattattagtcgtaaccagccacggcttcaacaatttgttcaaagaagaacgcgtgttgtattcgacatagcactcaaggttcacaggaacatacagcatagagacttagaagttggtcgaaaccttggtgattgtatcctccgctggctccataaaataaaaccttcagctcaaatccgaggtcctccgcctcatcaagaacccaaccacggtactggcaaagcaaacatgaacatgccaaagcaagtgacaaacacatcttcaccgaaaactccacgaagcaaccagtcacctcgaaaccatgatgctgtagacatcttttagttcattaacaagtcatggc

SEQ ID NO: 24735 - DNA, 370 bp, Gossypium hirsutum
  Clone ID: LIB3272-041-P1-K1-G3
aggaaattaaatttctttaattttttctctttggcgacctaagtctcttttatttgcttgtttcaccatgaccaagcagcaggctaactggtctccttacgacaacaatggaggatcttgcgttgcgatcgctggagctgattactgtgttatcgccgccgatactcgaatgtcaaccggttacaatatactgacccgagagtactccaaaatctgtaaacttgcagataaatgtgtcatggcatcctcaggatttcaagctgacgtgagggctttacaaaagcaactggcagctaggcacttgatttatcagcatcagcacaacaagcaaatgagctgccctgcaatggctcaattgctttccaacaca

SEQ ID NO: 24736 - DNA, 66 bp, Gossypium hirsutum
  Clone ID: LIB3272-041-P1-K1-G4
cagtggaagaaagctagcaatttgaatcggtgtcgtacggaaaatggtcaagaaccaggacgatac

SEQ ID NO: 24737 - DNA, 435 bp, Gossypium hirsutum
  unsure (1)..(435): unsure at all n locations
  Clone ID: LIB3272-041-P1-K1-G6
ccattatctgctatctacaaggttgtgaagactgtttatgcatctcccagtcgagtaaattttcatttggactcaaaaaaggaagtagagacaacacctgcctatccggacatctgttttgcaatagatgattttgactctacttttgatgcagtggtcttgacagaaacagaacattgctattgtgttcttcttaatgcgcttgatggggcagcttttcctagtgaaaaggatacaaatgatagcaggtccagcaacanagtaccattaagagtagatactaattctatgaagacgaaaaatagtaagctcacacttttttctggatttgtcagctatcaaatggtccgggatgcatatgatgctgggagttctggatttggaagtcttctatcaatgggtcattcctctggcanaaaagacagactttacatg

SEQ ID NO: 24738 - DNA, 343 bp, Gossypium hirsutum
  Clone ID: LIB3272-041-P1-K1-G7
agaaaagaaaaaaagaatatggaaaccgtaactttgacaggattactttacagggctggggccaagttccctaccaggcgagctttatcagtttccggcaagttctatttgacgcatgctcaattacaacacatcatcgatcatgctggttctctcctcatcggctccggcatccatcccggcgatgtcgtcgctcttactttcccaaacaccggggagcttggtattatgttcttggctgtaattcgttgacgtgcaaccgccgcgccgttaaactcagcttatactgtcttggagtttgagtgttaccttttttgattcagaaatccaagcttgttattaa

SEQ ID NO: 24739 - DNA, 362 bp, Gossypium hirsutum
  Clone ID: LIB3272-041-P1-K1-G8
gaggaagtgaaaatgagtggggcgagactatgcacattacttgcggatttgggatacgaaggggcagagaaattggaccccgatagcttcgaatggcctttccaatacgacgacacccgcaccattcttgactggatctgctcctccctctgcccttccaatgtcctctccctctctcaactctccctgtatgagcaaatcgtacaagaagggaagctgttggagggggaagacttggactttgcttatgatagcatttcggccttctcgtcgaggagggacaaccaggaggcggtttttggagctgaagaaagattgaaagatattaaggatgcaactggagcatataaaagctgaagctt

SEQ ID NO: 24740 - DNA, 337 bp, Gossypium hirsutum
  Clone ID: LIB3272-041-P1-K1-H1
ggaaagcgaactcgaaactcgttggcatagctaactgagacagatatgaactcaccgcagcttccacagacgcgtgggcgcgtgttatcctcatccgagataaacaaatccccagccgggtcaggaggagatcttgaatcttctttaatccaaatctatcaccatcaccaccacaactccctcaagctccgggatcaggccgagaaagcgaagaaagatgcgattaagaaagcggggagagtgtcggatttgttggtggaggcggtgaacggaggtgtgcaagagtcgtttataaacgagaagcgaatcgaggcggagattcgtgctttggcttcta

SEQ ID NO: 24741 - DNA, 194 bp, Gossypium hirsutum
  Clone ID: LIB3272-041-P1-K1-H11
gatatcagtggcgagcaacatcttgacataaaacatgatataattaagaaaagaatcagtactaacggtgatgtgatagaatccaagccagatggtataggagcaccaaagattgagaaacctctgcaaagacatggtggcaggcttgaacaaaaagagaaatattgtgggtcgtgctttggtgcagagcaatc

SEQ ID NO: 24742 - DNA, 379 bp, Gossypium hirsutum
  Clone ID: LIB3272-041-P1-K1-H2
agaaacttgaggggaagaatcttgctatcccttgcttttctctcgcaaaaaattctcaaacttgtttttaacgttcgctgaatactatcgctcatttcttccctcagaaccctaatcgataactgaagccatttaatcatgtttgggcgtgttccaaaaaaatctgataacactaagttttacgaagtacttggggttcccaaaagtgcaagtcaggatgaattaaagaaggcttataagaaagctgcaattaagaatcatccggataaaggtggagaccccgagaagtttaaggaactggctcatgcttatgaagtacttagtggcccagagaagagagaaatatatggtcaatatggtgaagatgctcttaaagagg

SEQ ID NO: 24743 - DNA, 439 bp, Gossypium hirsutum
  unsure (1)..(439): unsure at all n locations
  Clone ID: LIB3272-041-P1-K1-H3
gctggttctgttattcattcgctttgctttagccccaacaggtactggctttgtgctgccactgagcagagcatcaagatctgggatctggaaagtaagagtattgtggaagacttgaaggttgatctcaaagctgaggctgagaaatctgatgtcaccgacaatgcaaacaagaagaaggtgatatactgcacaagcttgaactggagtgcagatggaagcaccttatttagtggttatacagatggtgtaatcagagtttggggaattggtcgatactaagaccaacattcatgcatgcatgttgtgccttccaatgagtaatcatatagtattaaggaacatgtagtgatacttntagttgcttctcttaacattttcaaacctttttaaagattttgtttaaaatgtgggaaggattggttttaatttgttggag

SEQ ID NO: 24744 - DNA, 132 bp, Gossypium hirsutum
  Clone ID: LIB3272-041-P1-K1-H5
aatggggaacggggataggagaggccatttttttaaaatagctgttttatacggaagccaccaacaaaagccgcctactaataaattaatttggggatgggggtccaatattataaaacgtgggtttttttt

SEQ ID NO: 24745 - DNA, 303 bp, Gossypium hirsutum
  Clone ID: LIB3272-041-P1-K1-H7
tatcacaccgtgaaacgtagccggtcggaaaacccagacaggcaaaagatgagcggaggggagctggagtggtgtgtgtcggttccaaaggttgaacttcatgctcacctcaatggttcagttaggaactctactctctttgaacttgcaagagttttgggtgataagggtgtcattgttttctcagatgtggagaatgttataatgaaagacgaccgttcgctacacgaagtatttaagcctgtttaccttatccacattctcactactgatcacttcactgttacaaggagtactaaagag

SEQ ID NO: 24746 - DNA, 402 bp, Gossypium hirsutum
  Clone ID: LIB3272-041-P1-K1-H8
agctttcctttttttctctctatattttctcatctccttttccaccgccgtcgatctcgatccttatccccgttttcaaaaaagctccaaaaagatggccaatgctgcatcgggaatggctgtgcatgatgattgcaagttgaagttcttggaacttaaggcaaaaagaacccaccgctttattgttttcaaaatcgaggagaagcagaagcaagttattgtggagaagcttggtgagccaaccgagagctatgaggattttactaaatgtcttcccgctgatgaatgtcgttatgctgtgtacgattttgattttctaacggccgagaacgttccaaagagcagaatctttttcattgcatgggtctccgatacatcaaggatcaggagcaaaatgatata

SEQ ID NO: 24747 - DNA, 414 bp, Gossypium hirsutum
  Clone ID: LIB3272-041-P1-K1-H9
gatggctgcggcggtgaccgggaggattgaacgtcggcgttaacgctgactgtatcggtcacaccggcgttaccaatgacgtggccatcttaagattccagccaaaaaaaagaaaagttggcgctttctttttctaatactgaaaaccttcttaattatttatttcattctgatctgatctttgtttttggtttgtggtgttggttgaactgtgggtccctaagagtgtgtggggggagtgcatctgagctggttcagttctgggttgatttgaaccggtttggcttagagctggtttcctccttttctcgcaatcctgctttcagcttttttgggttggtgattcagttgaatattgagagattggatttggcatgcttataaaagatgtcattgaagagtattatgcgagag

SEQ ID NO: 24748 - DNA, 412 bp, Gossypium hirsutum
  Clone ID: LIB3272-042-P1-K1-A10
ttttatagcagcatatctattattaatttttttataaaaccaaaaaatcaaataagaatgcgtaggataattgcgtgggtggttcctttttatataatttttatatcacaaattttttattaaaaaattttttaaattaatctactttagatgtaacttattttttgtttaaataaagcttctcgcaatgttaagaacataatataatgtttaatgcttacaaaattgtcaaatataatattttttctatggaggttaatttaaggcagctcattgcggatttttaatttttattgagaagtcttcctttactagttctacgttttcttatgaattaacatctttttgttcatcgatcttcttattttgatctaacccgactattaaaaaacttaaatttttaattgccatt

SEQ ID NO: 24749 - DNA, 417 bp, Gossypium hirsutum
  Clone ID: LIB3272-042-P1-K1-A11
aatttttagattttcaattataatcggaaaaaaaaaaccaaaaaatcaaataaaaatgcggaggataattgctgcaagttctttttgcagcaaaattttgagaaaagaaagacagcgggcttttttctcttcaacttccttactctttgatgaaactcaattacagttcaaagaaagtgttaggcaatttgcagaagaaaatatagcgcctcatgcttccaaaatcgaccaatctaattctttccccaaggaggttaatttatggaagctcatgggggattttaatcttcatgggataactgccccagaggaatatggaggacttgggcttggttacttgtatcactgcatagcaatggaagaaataagccgtgcttcggggtcggttggtctttcctatggggctcattctaatct

SEQ ID NO: 24750 - DNA, 392 bp, Gossypium hirsutum
  Clone ID: LIB3272-042-P1-K1-A12
ttttaatttgccacttaatctctctctgtcctttccttttctgttctctttcttccgggctccccctttcacatcaaccctaaccctacctcaccaatcaggatacaacatgaagggaggtaaatccaagtcagatactaagagctccaggctcgccgtgaacaagaaatctagcgccaaagctggaaagaaatcggggaaggcggctaaggatccaaacaagccaaagaggcctgctagtgccttcttcgttttcatggaggagttccgtgagcaatacaagaaggaacacccaaaaaacaaatctgtcgcttgtgtgggcaaagctggtggagaaaaatggaaaagcttgtctgatgctgaaaaagcaccttatatagcaaaggcagaga

SEQ ID NO: 24751 - DNA, 352 bp, Gossypium hirsutum
  Clone ID: LIB3272-042-P1-K1-A2
tattttttgataatccggagttcaatcatctaaaagacggcctaaaatcctttaatcaggtctgagcttatgggtcggtgggcctatttcatcaaactaagattgatgtctgatcttgacactcaaagtgctactggcttagagccctgtggtgaagcagatgctgtggactcaggcgcgggtgcacaggagtatgtgcatattcttattcagcaaaggcatgggcgtaaaagcctgacaactgtccagggggtgaagaaagaattcagttataacaagattcttaaagacctgaagaaggcgtattgctggaatgcggccgtggtccatgaccctgaattaggacaggtga

SEQ ID NO: 24752 - DNA, 434 bp, Gossypium hirsutum
  Clone ID: LIB3272-042-P1-K1-A3
cattaaaacagggaaagaaaagcagcgtaatgggtgaagaagtgaaggtttttggatgagctgggcaagcccttacagctacagggcagagcttgctttgaagttgaaaggtgtttcttatgagtacataaatgaggatatctttggcaacaagagcgatttgcttttgaaatacaatccggttcataagaaagtcccggttcttcttcacaacgggaaaccaattgtagagtctcttgttatacttgaatacattgaggaaacttggaagcataatccctatttgccacaagatccttatgacaaagctaccgctcgattctggatcaagttcatcgacgaaaagtgctttcctaccctttggctagctgcatggagcgccgagaatgagcgagaaaaagtgacgaatgaagcttgcgagtatctgaaaacgc

SEQ ID NO: 24753 - DNA, 417 bp, Gossypium hirsutum
  Clone ID: LIB3272-042-P1-K1-A4
cttttggtagcgtgcgtgtcttctactctcgctctctcttcgcgttcccttttccatccagctaagtattctcaggtttcttcttccttcctagcttgcttgcttggctccgtttttttattaaaaaattcttcgtatagatctggtttagatctagggtttcttttggttctttgctactgctcggctgtttatgtgcatgtccgatctgcagttcgtaaaacccggtcaatgattttagattttctatgaactctatcctcatgcgtcgaatccgtattcttcactcgttctcggtcggcttcctttactggttctacgttttctcatgaattagcatctctttgttcatcgatcttcttatcttgatctaacccgactattaaaaacttcaaatctctaattgccattcaattt

SEQ ID NO: 24754 - DNA, 389 bp, Gossypium hirsutum
  Clone ID: LIB3272-042-P1-K1-A5
cggaaaaaaaaaaccaaaaaatcaaataaaagtgcggaggataattgctgcaagttctttttgcagcaaaattttgagaaaagaaagacagcgggcttttttctcttcaacttccttactctttgatgaaactcaattacagttcaaagaaagtgttaggcaatttgcagaagaaaatatagcgcctcatgcttccaaaatcgaccaatctaattctttccccaaggaggttaatttatggaagctcatgggggattttaatcttcatgggataactgccccagaggaatatggaggacttggtcttggttacttgtatcactgcatagcaatggaagaaataagccgtgcttcggggtcggttggtctttcctatggtgctcattcta

SEQ ID NO: 24755 - DNA, 358 bp, Gossypium hirsutum
  Clone ID: LIB3272-042-P1-K1-A6
aatttttagtgcagcacgtgtctggaggatgttcctagtctttgggcattacaggctccgggtgttatatgggggcctcgcacggtggcgttcatcaggttatgatgttgaatccagtgcttgtagtgatgctattttgaaagccagtgctgctagtgcggcaatagagaaagtttatcgggggcaaactggtggaccactcacatttcagacaaaatttcaaacgcatcttgtctggacacttgctcaggttagaagaaacattgaggaaaagactcaccaacatatagctgcccgtaccaagcccagatgttatggtgctgcaccagaacctcgtaaaggaattagaagtggccat

SEQ ID NO: 24756 - DNA, 294 bp, Gossypium hirsutum
  Clone ID: LIB3272-042-P1-K1-A7
acgattttgcagatcggttctctaatccttttttcgggtgtagcgttgtttatacggtcggttgttgttgaagaagtgctactaccatggctacaaagaagagcgttggggacttgaaggaagctgatttgaagggaaagaaagtgtttgttagagtcgatctgaacgttccattggatgataacttcaacataactgatgacacacggatccgtgccgctgttcccaccatcaagtatttgacgggtcatggctctaaagtcatcctctctaggtatttgggacgcccaaagg

SEQ ID NO: 24757 - DNA, 344 bp, Gossypium hirsutum
  Clone ID: LIB3272-042-P1-K1-A8
attatgtatctcttttcaaccatttgagaatttttaaggcatttaatgaactaggccgactttctagcttgtatggggagcatctggcgttgaaacacaaagacttagttataatttaccaagacttgtttaaacacatgtgaaattcttcactgctatatttccttcaatactgggggggataatagtacactttacaaacagctgttaatattacatgctgggaatataactaaaccgataggcatggtgataagagattctagatagccacttgtattacctgggaatggaacatcatgcggttgtatagtacaatagtggacacgcatcacagccatatt

SEQ ID NO: 24758 - DNA, 430 bp, Gossypium hirsutum
  Clone ID: LIB3272-042-P1-K1-B1
ggagagccttttttttgtgtagcgattatcaggcactcttttctttaagcatacagcttgtctccaacagttttataatgggcaaggagaaagatcacatcaaccttgttgtcattggccatgtcgactgtggcaagtgctccactactggtcatttgatctacaagctagggggcattgacaaccgtgtgattgggaggtatgagacggaggctggtgcattgaacaaaaggtgattcaagtatgcttgggtgcttgacatgcttaaggcttagcgagcacggggtatcaccattgatattgcactggggaagtttgtgaccaccaaattctattgcaccgctattgatgcacctggacaccgagactgtattaagaacatgagtaccggtaactcacaggctgactgtgctgatctcattattgactc

SEQ ID NO: 24759 - DNA, 409 bp, Gossypium hirsutum
  Clone ID: LIB3272-042-P1-K1-B10
cttttctccgattagggttccttcattattctctttaggaaattttaattttcaactggttttcgtttattctcttcgattttgggttaaaccctagaaggctcctcgcgaaagtgtcagatggcaactttagctgattcattccttgcggaccttgatgaattatcagacaacgaagccgatgttctggaggaagaaaataatgatgttgcaaacatggaagaagatattgatggtgacctcgcggatatcgaaacgcttaactacgatgatctggacagtgtttccaaattgcaaaaaagtcagagatacattgatataatgcagaaagtggaagatgcgctcgagaagggttctgatatatcaaatcagggcttggtactggaagatgatcctgagtatcagctga

SEQ ID NO: 24760 - DNA, 326 bp, Gossypium hirsutum
  Clone ID: LIB3272-042-P1-K1-B11
atttattgaaacggttttgttgagaattgagagagcatcaaagcaaagcaaagcggggcaatgtctactttgagcgttccgcctgttcttacctctcctagagacgatgctattcagctttaccgtgcttttaaggggctgggatgtgatactgcagcagtggtcaatattgtttcccatcgtgatgtgacacagcgtactttcatccaacatgagtataaaacaatggatgctgatgacctactcaaaccactgaagtccgagctcagaggaaaactagagactgctgtcttgctatggatgctcgatcctgcgcaacgtggtgc

SEQ ID NO: 24761 - DNA, 290 bp, Gossypium hirsutum
  unsure (1)..(290): unsure at all n locations
  Clone ID: LIB3272-042-P1-K1-B2
ggaactcataactcctcaaaattcttcttcaatggcgtctcgagttcttgttttggcttcaattcttattttctcttggtttgcagagacatgctatggggcgatctcattctcatcccttcaaagaacacttgttgttactgcttctcatagacaaggacttttgaaagccggngaagacaagatcacagtgagatggggattgaaccagagtttcccggccggaagcgactcgtcttataagaccatcaaggtccagctttgctatgcacccatcagccaagtcgacc

SEQ ID NO: 24762 - DNA, 420 bp, Gossypium hirsutum
  Clone ID: LIB3272-042-P1-K1-B3
ggatgctagagagatattttgcagattctataatatttgtactctcatctgtattactcactcactctctttgttttgtcgccattaacaaagcagcaacaatgagtccatcttcttcgttaaccgccgcttcttcatcatcgtctctttggattctcaaaccttctcctgcttttaaatcctccagattccaatcaattcctccttcccttcctccgtcatctccgccgtgtttccgtctcctccgccgtgctgcatcccttccgcacgcttctgctactgattttgacttcgccttacatgatgctctcgaatcctctggaatcaacacctctcacgctagagaggcgaggaagggttttatttcgcaaattaatgaattatccgatgtcgagagagaaacaagtattagcataaata

SEQ ID NO: 24763 - DNA, 114 bp, Gossypium hirsutum
  Clone ID: LIB3272-042-P1-K1-B4
gaaggtgtagtataagtgggagctctcaggcgaaattgaaataccactacttttaacggggggttacttataccgtgaatcggatgcgtttcaccccccctttttttggaccca

SEQ ID NO: 24764 - DNA, 341 bp, Gossypium hirsutum
  Clone ID: LIB3272-042-P1-K1-B5
cttaaagcctgccatataatcatataaccaggctccgtcgtggtactcttcggccaccacaatgccgaaaatcgccttgggaacaagccaagaggctgctcagcctgactgcatcaaagcccttgtggtcgagtttatcaccactttcctcttcgtattcgatggagtaggagctgccatggccgccgatgagtcgggggcaaatgcgctggtgggattgattgctgcggcggtggctcatgcccttgtcgtgcggcgtatgatatcgcccggacacatactaagcggacattttaacccaggcggcacgcttgagttgctattatgagcccacatcacgc

SEQ ID NO: 24765 - DNA, 418 bp, Gossypium hirsutum
  Clone ID: LIB3272-042-P1-K1-B6
aacatagcagccatggcagtccgtatgcttcttgggttaggtgtcctgctactctgccttgcaaaggtttcatctgatctgaaggcagaagaagttataaccaatgtcggtgaggtgggttctttggttaccagaggcggaaacagaagactgatgctagagattgattgtggaggattatgcaagaaaagatgcagtcaacactcgaggccaaacagatgcaacagggcgtgtgggacttgctgcttgaggtgcaagtgcgtgccaccggggacttcagggaacagggaggtctgcgggacctgctatactggcatgaccacccatggaaacgttgccaagtgcccttaacctttacgtcgcccaatatgtgttgcagccatcaaggggaaaaatgaaatgtttgtttgtgtaatat

SEQ ID NO: 24766 - DNA, 423 bp, Gossypium hirsutum
  Clone ID: LIB3272-042-P1-K1-B7
atttgttttcctctaaaaggaacaacagagaagaaaacttcatcaaacaagggaaaaacttaacaagtaaaacaattgagagaagatgtcctggcaagcgtatgtagatgatcacttgatgtgtgatattgagggcaaccatctctctgccgccgctatcattggccaagacggcagcgtttgggcccagagctccaatttccctcagttcaagccagaagaaatcactggcatcatgaatgacttttctgaacctggatcgcttgctccgactggattgtaccttggtggcacaaaatacatggtgatccaaggtgaacccggagctgttattcgagggaaaaagggccccggaggtggtactgttaaaaagaccaacctgttcttgatcattgagatctatgacgagccaatgacttctgg

SEQ ID NO: 24767 - DNA, 361 bp, Gossypium hirsutum
  Clone ID: LIB3272-042-P1-K1-B8
ttctgatacttgtaccggtgaaaatggaggcattgggcggtaattgcgcgttttggggttggaaacttccggagataagaaacacaaagaggccgtttccgtcaaagtcaaaatcctcggattcatccgcagagtcaacgggcagtcgaggctaccgtttcccgttgaagcaagcggtgacagcttcctcactcgctctcacgggcgatactattgctcaactaagctcccattggagaaaacggaaagattccatttctggttccagtgatacaagtaaggatatcatgccaagcgtgatttcagatcatgattggcttcgagccttgaggatgacttcttatggtttccttttatatta

SEQ ID NO: 24768 - DNA, 393 bp, Gossypium hirsutum
  Clone ID: LIB3272-042-P1-K1-B9
ttttcttttgtagtggaagaaaaaaaagagaaaaaattatggagacaaagtcattggcaatggtggtggtgataactgtttcagtcatgtggggcgttgaaatggccactgcagaactcagtgccgctcagtgcaagcaagaaaggaacctcgccattaccgcttgcaagccggtggtttacggtaagcttccgtccccggaatgctgccagcgagtaagggttacccatctggaatgcgtttgccccatcatcacgcccaagatcgccgcccttattgacgtcaaccgtgccatccgtctcattcaaggctgcggtcgaagtgttccttgccactacaaatgtggaagtatcacaactccatgaaattggcataccttctgctatactactg

SEQ ID NO: 24769 - DNA, 192 bp, Gossypium hirsutum
  Clone ID: LIB3272-042-P1-K1-C1
aatttttagagcagtacgtgtctggaggatgttctctgtatttgggcatgacagggtgcgggggggtcagatggaggccgtgaaaagaagcacacactaaagcgtgatgttcaatcccgcacttcatgctttacggatgtgaaaggccaaggctgttgtaacataacgacagaatgtaatcattctcaaaca

SEQ ID NO: 24770 - DNA, 355 bp, Gossypium hirsutum
  Clone ID: LIB3272-042-P1-K1-C10
aatttagggtttgcacgagccgtagtgcgccgttcgcatcaggaagaaatggcgggccctttgctgtctaagaagattgtgaagaagcgtgtcaagaagttcaagaggccccaaagtgaccgcaagatcttcgtcaagacaaactggcgaaggcctaaaggtattgactcccgtgttaggaggaagttcaagggatgcactttgatgcccaatattggttatgggtccgacaagaagactcgccactatcttcccaatgggtttaagaaatttgtcgtgcataacgtccaagagctggagcttctcatgatgcacaacaggacatactgtgctgagatagctcatgatgtttcaa

SEQ ID NO: 24771 - DNA, 421 bp, Gossypium hirsutum
  Clone ID: LIB3272-042-P1-K1-C11
tttcatttcacccttttccgccatatcttcagtgtctcactctctccgtgcttcactgccgcttctcctttccctcttcaaagaaaatgcgtgagatccttcatattcaaggtggccaatgcggcaaccaaatcggagccaagttctgggaagttgtttgtgctgagcatggcatagatgcaactgggcgttaccaaggagacttggatcttcaacttgagcgaatcaatgtctactacaatgaagccagttgtggtagattcgttcctcgtgctgttctcatggatcttgaacctggaaccatggacagcatcagatctggccccgtcggtcagatttttagaccagataacttcgtttttgggcagtctggtgctggtaacaactgggctaagggccattacactgaaagtgctgagtt

SEQ ID NO: 24772 - DNA, 387 bp, Gossypium hirsutum
  unsure (1)..(387): unsure at all n locations
  Clone ID: LIB3272-042-P1-K1-C12
ccggaacggaagggccgacccaccccacccgtacgatcaattttactcttatcttccatactttatttgtcttatcatctatnctctgggctgccgattatgctatgcgtggcaaaactaaactccccagatccttgatatagacatttgccatacacgaaaccaaatggtaaccatttattgagaagtaattcgcgctcatcatactatatattcatctttgcgacaccaatgaaacttgaatctacaacctgagcgaattatttgatactaccctctatccacatctcgaacattcgtttctagtgcatagatcatcattaatgtaccgcggacaatgatacagcatcaatttgtgggccgtgttagttaaaatcctcgacccaa

SEQ ID NO: 24773 - DNA, 334 bp, Gossypium hirsutum
  Clone ID: LIB3272-042-P1-K1-C2
aaaataaagaagccccaagagaaaagaaaaaggaggtgtgtggaatcttcaaagaagaccaggaggaagaatccttcccttttttctttttttccccagaaagagcgattcctttcccttcccttctagttcctcgtttactttttcttcttctttcccttctgattataataagatttgggtttcgttatcctctgaaactctcgtctctggtttgaaaggagattgaaaaaatatggctgaagaacatagatgtcaagcaccacagttatgtgccaacaactgtggatttttcggaaccccgacgactcaaaatctctgctctaaatgtatc

SEQ ID NO: 24774 - DNA, 420 bp, Gossypium hirsutum
  Clone ID: LIB3272-042-P1-K1-C3
aaacacccaaagtaaaacgagtggagactttgagacaacatcttttaggtcccccctaaaaaagggtttgtaagagaaatggctactttcccagtgatcaacttagagaagcttaatggtgatgagagatcaagaatcatggagcaaatcaaggatgcctgtgaaaactggggattttttgaggtgatgaaccatgggattccacatgattttatggacactgttgagagattaacgaaagaacattataagaaatgtatggaacaaaggtttaaagaactggtagcaagcaaggctcttgaaggacttgaggctgaagttacggatatggattgggaaagtacatttcacttgtgccatctccctgaatcaaacatggctgaaatcccagatctcagtgatgaatataggaaagtgatg

SEQ ID NO: 24775 - DNA, 292 bp, Gossypium hirsutum
  Clone ID: LIB3272-042-P1-K1-C4
ctcgtgccatttagtggtttaagggattttttttcattcggtgcttctcacgctcgattagcttacaaaaagagagaatggccaactgttacccaactgtcagcgaggaataccagaagtcatttgaaaaggccaagaggaagctcagaggtgttattggtgagaagaactgtgctgcaatcatgcgtacggatagcgtggcacttacgtggaacttttgatgttaaaaccaagaccggacgtgctatttgaaccatgaatgcatgctgctgagctctacatgctcaaacaa

SEQ ID NO: 24776 - DNA, 302 bp, Gossypium hirsutum
  Clone ID: LIB3272-042-P1-K1-C5
atcaaaagcttaaaaaccctgaaagcctcgacctttccctagaaaaccaaacggcagaaaacgaactagagctgatcactgctatggttgtgatataaaccaaagcgggcctgttatgggtattgtgtgtagctaaacaaacaatggcggggagggcactagtggtagctgtatacaggaaaaggcgaagcttctggtctaaagagacgttgctctttaacttgagcggagcaatgtctactaccatgaaatcagttgtgggggacaaaggtcttgtgctcgtcttatgggtcaggatcctg

SEQ ID NO: 24777 - DNA, 414 bp, Gossypium hirsutum
  unsure (1)..(414): unsure at all n locations
  Clone ID: LIB3272-042-P1-K1-C6
aaaaaaacaagtgatctgataaattgaagactttatttctgttaacatccattatgagtactgctggtcaagtcatccgttgcaaagctgcggtagcatgggagtcggggaagccactgtcaatagaggaagtggaagtggcaccaccgcagaaggatgaagtccgtattaagatactcttcacttctttatgtcacaccgatgtctacttctgggatgctaagggacaaaaccctctgtttcctcgcatactaggtcatgaagctggagggattgtggagagtaggtgagggggtgactgatctaaagccaggtgatcatgttctccccatcttcacgggggaatgcanggagtgtccccattgcttgtcagaagaaagtaacatgtgtgatctcctcagaatcacactgata

SEQ ID NO: 24778 - DNA, 275 bp, Gossypium hirsutum
  Clone ID: LIB3272-042-P1-K1-C7
atcgagtacataagatttacattcctctgttccgttgctctagcagatgtgtgtctgggcattactgctggaatagcaattatcaagttgattagcggaactgttatgatgcctagattgcttcccgatgtcactgatttgacctcattctggaaactcttcaccgaattccccgttttagtcactgcatatatctttcactacaatgtccacagcatatataacaaacttggagattcaacccatataagaccggttgtgcgaacagctctagc

SEQ ID NO: 24779 - DNA, 387 bp, Gossypium hirsutum
  Clone ID: LIB3272-042-P1-K1-C8
attgaataataaatttccattatggcgttttgcaccgctctctggtcagaagcatacatggtttttaacagtggccgcagacaccacccataacgactgctaggttattgaggcgagtcctgtatgcagaggatgcggatgttgtatgttctgaagcgaatgcacgcgtacaaagactgtgcgagcgacactacttgcgaggagatagaaaatgcaaaattggatggacataacaagagggtttatgatattatttggatcggatgtgaaatgggctgattgcaactaaggatatttggaggacaggtaggattaattaccgattttgaatgagaaagaaccatttacttgtgccatctacttgatcaaacatgggtgaaaatccaa

SEQ ID NO: 24780 - DNA, 420 bp, Gossypium hirsutum
  Clone ID: LIB3272-042-P1-K1-C9
ctcactcaacatttccatttccaatctccagctcccaaggtaaatatgccgggcggggacatatcagttggccggcccgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaagtggccacgtcaaccccgccgtcaccttcggtgctttcgttggcgggaacatcactctcttgcgcggcattctttactggatcgcccaactcctacgctcaaccgtcgcttgcctgttgcttaagttcgctacc

SEQ ID NO: 24781 - DNA, 431 bp, Gossypium hirsutum
  Clone ID: LIB3272-042-P1-K1-D1
cggacgcgtgggttgaagtttcctttctcgattttctatttagccaaacaagatgcagatcggggttaagactctaaccggcaagactatcactctcgaggtcgagagctccgatacgatcgacaacgtgaaggccaaaatccaagataaggaaggcatccctccagaccagcagcgtctgatcttcgccggaaaacagctcgaagacggccggaccttggccgattacaacatccaaaaggagtcaactctccacctcgtcctccgtctgcgcggtgggatgcaaatcttcgtgaaaaccttgactggcaagacaatcactctcgaggtcgagagctccgacacgatcgacaacgttaaagcgaagatccaagacaaggaaagcattcccccagaccagcaacgtctcatctttgccggaaaacaactcg

SEQ ID NO: 24782 - DNA, 417 bp, Gossypium hirsutum
  Clone ID: LIB3272-042-P1-K1-D10
cggacacgtgggtgcattttatctttccttgctcttccccaacaaagcttacggtggactactactactagtgctactcaacaatggtgatgaatttatcttggagtttactatcatttactcctgtgatgatcacattcctcttcctctcaaccttcttaacattctcccatggagtttctgtttctctctctcccacacccctcgcacaacagctcacttcagggaaagtaaatggaagtgaggcaaagagtggggtggaactttcatgggggatcacaaggaggtctgtggtagaggtgccgatccgtcaacctctgccgccattggaggacactacttcatcccttgctttggctgctgaaaagacttacagaaaagatcctcttaatgggttcaagagatacacaagaggat

SEQ ID NO: 24783 - DNA, 379 bp, Gossypium hirsutum
  Clone ID: LIB3272-042-P1-K1-D11
ttttcttttaagataacacccaaaaatgtgtggaggtgcaattatttccgagcggggggcccccaaatatgaccggaaatttacccgcgatgacctttggtctgaacttgacatattctccgacctcctaggtttcgacaacaatggcaaaagctttgtcaatcatcagtttcataacaacaacaacaacaagctcattaatccaaaagacaatcaacttaacaaagagagaagcgagacgattcataagacaagccaagtcactaaaaaggttgaaaagactcatcgaactcggaaaaacttttacagaagaataagacaaagaccatggggcaaatgggcagctgagattagagaccctcaaaaaggcgtccgagtt

SEQ ID NO: 24784 - DNA, 419 bp, Gossypium hirsutum
  Clone ID: LIB3272-042-P1-K1-D12
cttcttctatggccacactatgatctatcgctacgcttttgtctagttagatcgtttgttttgttggttttgttcctcggcatggctgacgataaggaaatgtctacccctgttgttgaccggaacgatcccgtcaccggtcacataatttccacaactattggtggcaaaaatggagaacctaaacagaccattagttatatggcagagcgtgtagttgggacaggatcattcgggattgttttccaggcaaaatgtttggaaacgggagaaactgtggctataaagaaggttttacaagacaggatatataagaatcgtgaactgcaattgatgcgtgtgttggatcacccgaatgtgatttccttgaagcattgtttcttttccacgacaaccaataacgagcttttcctcaactt

SEQ ID NO: 24785 - DNA, 370 bp, Gossypium hirsutum
  unsure (1)..(370): unsure at all n locations
  Clone ID: LIB3272-042-P1-K1-D2
tgacgatctgatggatcaatatgcggctagggtttcggctgctgccgagaagattggaggtggagtgctggatgtgactaanctagttctcgaggcattctctgttcaaaagaaacttcttatcgagatcaagcagactcagaaacctgatatggcgggcttggtcgaatttctcaaaccactgaatgaagtgatcttgaaggttaatgctatgacggaagggaggcgatctgatttcttcaaccacttgaagagtgctggagacagtctttcagctttagcatggattgcttacacaggcaaagattgtggtatgagcatgcctatcgcacatgtggaagaaagtnggcagatggctgaaatttataac

SEQ ID NO: 24786 - DNA, 411 bp, Gossypium hirsutum
  unsure (1)..(411): unsure at all n locations
  Clone ID: LIB3272-042-P1-K1-D3
cgcatagataatcattcagaggattcaaggagaaaggattcagagaattggagagttgtggagagtatggatggagggagatccacnaanatttctagaccggaaaaaattcttcttgagattgtgtctgagtcgattcctgccatggctcaaataatgcaggagctgcctgaagaaaccctcgaatcgaccaaagaatacttgaggaatcttattggaaacccagagtggaaggaagaattagttggacttcaaaatcgacttgacaggagatctgatcttagcaaggagactctctcaaagtgccataaggatcaactagcaatcttagttgcagtgaaaatgggcctgaaaagcttcttgtcctagaaaataggactttccatgaccgaactgctggaaattttcttc

SEQ ID NO: 24787 - DNA, 418 bp, Gossypium hirsutum
  Clone ID: LIB3272-042-P1-K1-D4
ttcccatcctggctgttaagctcttccccacagaatttctcttttcaagtttcctttgtcatttcgatgatgaagaaagcggagctagtgttcctcccagcgcctggaatcggccatttggtatccgcagttgaagcggctaagcttttagtggatctcaatgccaacctctccatctatggtctcaccatcaagcaaccccttaactataaagccaccgcctacatcgactatctcaacgccgccactatcaccaccaccaccacccgcatcaaattcatcgacctccatcaatctgatgcagacatggataggcttaagtttgtggggagtttagttcaaacccacggaccacttgtgaaagaggccgtcgccaaaatagttgagcactccaactcagttcccggctcacctcgac

SEQ ID NO: 24788 - DNA, 422 bp, Gossypium hirsutum
  unsure (1)..(422): unsure at all n locations
  Clone ID: LIB3272-042-P1-K1-D5
ttctcactgccatgttttgccaaggaagtgtccattgtctctctcttgcttatgtgcgagacaatgttccggaagggcgacgagcttcancttttgggattctgtctggtattgggtcttgtgcatttgtctgcggaactctgtctactcgctttctctcgactgcctccactttccaggtttcgacagcaatggcgatgctttcagcggtttacatgagggttttcctcccggattcgatcataaatgataacctttcaaccccaattatctccgaaggaaaatctgatggtgttgctaatcaaaacgaggaaccggacaagaaaatgcaggtgttcaaaaccatgccttccatggaggatatgcttgccttgttgaagagcagcttgacattttcacaagcggcaattgtttcatttgtc

SEQ ID NO: 24789 - DNA, 404 bp, Gossypium hirsutum
  Clone ID: LIB3272-042-P1-K1-D8
gtcgatccatttcttggtttaactgaatttttctgaaaaccttcttctcatgggggagcgtctttaccaatatgggaaatacacatgtttttccaacttgacacaagttgatgacccacatgaggaggcaacggcgggccaatactgcatacaaaaaatccaaccttggaaatgaatggaagaagccatttgctggtttttcccataccaaaagcattgtacttgagaagataggttttgaaactattcaaccccactctgctattaagaagtgtgctacagtctaaatgattcaagaatgggaataagatttcctcatttcttccaaaatatggttgcttaaactacattgaagagaattttgaggtatttatatcctcatttagaccaaaggttcatacttt

SEQ ID NO: 24790 - DNA, 424 bp, Gossypium hirsutum
  Clone ID: LIB3272-042-P1-K1-D9
ataaaaccctcactttcttctcctactaattcatccattgatatggatatgggcggggagtcactatttccggtgtgattatcatctaatgaatatatctctctttctaagaagccatctaaggtgaaccagattgtcaacttcatacatcacaccatgtgtgatcgacataaaatggggccacaactggattgtattgtcgcttgctcacttttattgatcattcattaggctacttgtcaacatgcttgcgtatgttaaaagataaacatccaacctgcacataaagaacggatgagaagaacagcttctaatacataccatatatgtatgtggtatcaggggactctatcattcatcttaaattctatgtcacaagcctataaaaaactgactatctgatcttatttcatcaaacttaacg

SEQ ID NO: 24791 - DNA, 395 bp, Gossypium hirsutum
  Clone ID: LIB3272-042-P1-K1-E1
gttctttttcaaaaaaattttaacacacaaaaattggttctaacaatcaaacacaattgtagagggatattaatatcagcctgaacacattttcaaggatcatccttttttgtttcaaattttttctgctaagggaaaatgtccttctatcaggttggctcgaccattacattaccaccatttacaaaaacaacatcatataccttctcacaaaatattacactattgaccaaacatttactttatgaatactactcaccacccgaattgtacttacaaacacatgactcaagaatgaccatcattaattttgagacataaattctgggtataacagtggcagatcttctggggaaatctactgtgatacctattgtaatgggcatacaaaagtg

SEQ ID NO: 24792 - DNA, 417 bp, Gossypium hirsutum
  Clone ID: LIB3272-042-P1-K1-E10
ccggcaatccctatccctttcctgtccttccattctaagtaatacattctatgacaagtcgtcggccgccgcaaactagctgaaacgaagatggagcttggcttggaaactatggcggcggcaatcggcgtatcggtgccggtactttggttccttttatgtttcgtggcgaccattccggtgagttttctgtggcgatttgttccgggtacactacctaaacacgtttactcagctttttcaggtctcgtgctttcttatttgtcgtttgggatctcttccaatctgcttttcttggtgcccatgctcttgggttatgctgcaatgcttctttatcggcccaagtgcgggattatcacatttttcttgagtttcggttatttgattggctgccatgtatattacatgagtggggat

SEQ ID NO: 24793 - DNA, 417 bp, Gossypium hirsutum
  Clone ID: LIB3272-042-P1-K1-E11
gaaaccccatcactcatttcacctccaatcctcttaaaagcagggcattcaatgtgcaggagaccaataattctcgagtcaaccaacgaattgcaacaatctcggctcatctcaacccacccagcttttcccacatggagggtagttcgggtttgggtcgagctgactgccgagccaaaggtgggttaactggtttcaaggtggcgattttgggagcggcaggtgggatagggcaaccgttatcattgttgatgaagatgaatcctttggtttctgttcttcatctttatgatgtggttaacactcctggtgttactgctgatattagccacatggatactggagctgtggtacgtggatttctggggcaacagcaattggaggaggctctaacaggaatggaccttgtaattattc

SEQ ID NO: 24794 - DNA, 336 bp, Gossypium hirsutum
  Clone ID: LIB3272-042-P1-K1-E12
ctttgatgcaaatctttttcacattaactttacctccaatgaactctttcaggagcagttatcgtactgtaactatgtataaattaccataactccagttcataaacattatactcaacatcaattaaaaattaagcatggtatggcactcaagactccaacttacgatctcaccgccattaaaaactatggtatctttgacgttcttgataatccacctcatggggagtctatctctagcataaaaatcgttttaattaatacaataataactattataaaaataattagggttactaataatactggtaagtcatgcactttattcaataatgc

SEQ ID NO: 24795 - DNA, 430 bp, Gossypium hirsutum
  Clone ID: LIB3272-042-P1-K1-E2
gaatgatccctttgtgatgaaggcatggaccaaaacttaccctgagaacaaagatgtcaaggttctagctgatggttcagcaacatacacccatgcccttggtcttgagctcaaccttggcgataaaggtctcggcactcgttctaggaggttcgcactcttggtcgatgaccttaaggtgaaggcagcaaatgtcgaatctggaggggagtttaccgtgtcaagtgctgatgatatccttaaagctctttagatttgctttgtgcctaataaggtctatgttttcttggcctcggctattaatatagattgctttatttagcacaccttttatggtattgttaataataaaatacgtctcttggaggatgtaagatcgaacgtgtttaagagcgaatatgttccgttttgtatcgaagaaccatgttct

SEQ ID NO: 24796 - DNA, 432 bp, Gossypium hirsutum
  Clone ID: LIB3272-042-P1-K1-E3
ctgagtttattcttcttggtgcaaatactgtccaggtctgtactggtgttatgatgcatggctatggccttgtgaagaaactctgtgaagagctcaaggattttatgaagaagcacaatttcaaatcaatagaagatttcagaggggtttcccttcagtattttacgactcatacggatttagtgcggaggcagcaagaagcaatacgagagaggaaagctattaagaaaggtttgcagtccgacaaggaatggactggagatggcttcgtgaaagagactgagagcatggtttccaattaattgcagtaccaaagtgagccttctccagcgaatagtgaaaaacagatggtttttagttatgtttggttgcattgtagaaatggttaatcatctgaatgattgagggtgccgatgtaaaaactaaagcttg

SEQ ID NO: 24797 - DNA, 425 bp, Gossypium hirsutum
  Clone ID: LIB3272-042-P1-K1-E5
gtttcttttagcttacagcttccattgtttttcagtagtgaagagctaaaaaagaagggaaaccaatggaggggaaagaagaagatgttagattgggagcgaacaagttctcagagaggcaacctattgggacagcagcccagtcccaagatgataaggattacactgagccacccccagcacccttgtttgagcccagtgagttgacttcatggtcgttttaccgagctggaatcgctgagttcgttgctactttcctattcttgtacatctcggtgttgactgtgatgggagtccttaaggacaaaaccaagtgtacaactgttgggattcaagggattgcttgggcttttggtggaatgatctttgctcttgtttactgcactgctgggatctcaggtggtcatatcaatccagcggtgaca

SEQ ID NO: 24798 - DNA, 428 bp, Gossypium hirsutum
  Clone ID: LIB3272-042-P1-K1-E7
gtagggtgaagagagcagaaaaaaagagtcaatggcttccagttcagctgcttcaatggctctgcccttagctggagctactcaaaacaggatgccaagttctgaggcattctttaagccactcccggtaaagccatggagatcaatgggcgctgttaaaagacccaacggacggctccaagtcaaggctgcttcttcttcgttcaaggaaaaggtggtgacagggttgacagcagcggcgctgacgacatcgatgatgatcccagaggtggctcaagcagctgatggagtcaccccatctctcaagaacttcttgctcagcatagcggctggtggtgtggttctggtcgcccttgttggagctgtaattggtgtgtccaacttcgaccctgtcaagcggacctgatctgagttcatataattctctc

SEQ ID NO: 24799 - DNA, 425 bp, Gossypium hirsutum
  Clone ID: LIB3272-042-P1-K1-E8
ctttcctcctagcccaaaaaaaaaaaaccctctttcctttctctcgttcttttgcccgggcaatcatgtcttgcttcattagcaaatatgccgatgagttggctaaaaacgctgcttacattggaacccctggaaagggtatccttgctgctgatgaatccactggcaccatcggcaagcgtctttcaagcattaatgtagagaatgttgaagataacaggcgtgctctccgtgagctcctattcacaactccaggagctcttcagtacctcagtggtgttattctctttgaggaaaccctttatcaaaaaaccgcttcgggcaagcccttcgttgatgttttgaaggaaggtggtgtcctccctggcatcaaggtcgacaagggtaccgttgagcttaacggaaccaatggcgaaactttcacc

SEQ ID NO: 24800 - DNA, 348 bp, Gossypium hirsutum
  Clone ID: LIB3272-042-P1-K1-E9
attagttttttctcttctaccatttgagaattcttaatgaattctatttgttaggcggactttgcagataggcaagatatcaactggtgttagtgccctaggacgtaactctaatttaccgaacctcgctaaaactgttgtgctctctgttgatctattacactttcaacattggacgggattatgatgcatttatattgcgctattaaattactatagaagggctgttcctgagctcctatagactagcgtcatgagcacttcaatgaccgacacgtgtgtttctttttgatggaactgtttatcaaaaaacagcttcttacaagacatgcgtagaacacaagaagg

SEQ ID NO: 24801 - DNA, 433 bp, Gossypium hirsutum
  Clone ID: LIB3272-042-P1-K1-F1
ctttcttctccatattttcctctgtggagaacccatccccctcctttagggtttagcagtgaaaaagagaaaaacaaaagtatggcgaccgccactgtccccgccgccgtaaggcagctttctcctaaagaagccgacatccaaatgatgttggccgccgaagtccatctcggtaccaaaaactgtgacttccaaatggagcgttacgtcttcaagcgtcgcaatgacggaatctacatcatcaaccttggcaagacctgggagaaacttcaacttgctgctcgtgttattgttgctattgagaaccctcaggacatcattgtccaatctgcaaggccctatggtcagagagctgtactgaagtttgcacagtacactggttgtcatgcaattgctggaaggcacactcctggtaccttcactaaccagctct

SEQ ID NO: 24802 - DNA, 423 bp, Gossypium hirsutum
  Clone ID: LIB3272-042-P1-K1-F10
cgataaataaaaaatgagctttcttcaggccttgtcaattttccttttgctttggggggatgtagtcgtaggatcagctgagcagtgtggaaggcaagcaggcggtgctctttgccccggtggtctatgttgtagccaatttggctggtgtggcagtactgctgactactgcacagttcctggttgccaaagtcagtgcaacggtagtggccctgcccctgggcctggtgggctaaccaatcttatatcaagagagacctttaatcagatgcttttgcataggaacgatggggcttgtcctgcccgtggcttctatacatatgatgctttcattgctgctgcccgttcttttcctgcatttgctacaactcgtgaccaagctactcgcaagagggaaatagctgcccttcttagcccaaactt

SEQ ID NO: 24803 - DNA, 419 bp, Gossypium hirsutum
  Clone ID: LIB3272-042-P1-K1-F11
cagaaatggatgcaacgatcagtcctggattataccctttgcaccgttgtaaaactggccatctggtgaggcatgctcagggggttcataatgtagcaggggaaatagatcacgctgcttattcatctgaagaatatttcgatgcccatctcactcctctgggctggcaacaggttgatcatctgcgcaaccatgttcatgaaactggactttctaagaaagtggatttggtcattgtttcccctttgctcaggactatgcaaactgcggtgggagtctttggtggtgaggggtataaggatgggatagaagttcctccactaatggtggcaaatgcagggcaaagtgaccgtcctgagatttcaagcttgaattgcccaccatttgtagctggtgaactttgtcgagaacatttggga

SEQ ID NO: 24804 - DNA, 294 bp, Gossypium hirsutum
  Clone ID: LIB3272-042-P1-K1-F12
gaagaataggctttctggtgagatacataacctgttctcaaattccgtgtcttggaagattgaagacttgaatttgagtaataacattttctatggaagcttgcctcaatctttgggcaatttgacttatttgatgtacttggatcttcatggaaataaatttactggtgccattccttcagaaattggtaacttgatgcaactagagtattttgatgtatctggaaacagattatccggacagattccagaggaagtgtgcagtttgttcagtctgttctacttgaatctagc

SEQ ID NO: 24805 - DNA, 430 bp, Gossypium hirsutum
  Clone ID: LIB3272-042-P1-K1-F2
gtttacaacaagaaatccaagcacccaataaatctaaaaggaataatggtgggaaatgcagtgacagacaactattatgataaccttgggacagtgacatactggtggagccatgccatgatttctgataaaacgtatgagcaactcatcaacacatgcgatttccgacggcagatagagtcgaacgaatgcgaatcgttgtattcttatgccatggatcaagaatttggaaacattgatcagtacaacatatatgctcccccttgcaataactcagatggcagccgttttaccaggcataatatgcgattgccttatcgaccacattcgattttcaggcagttatcaggctatgatccatgcactgaaaagtatgctgatatttactacaacaggccagatgtgcagaaggcactccatgccaacacaa

SEQ ID NO: 24806 - DNA, 427 bp, Gossypium hirsutum
  Clone ID: LIB3272-042-P1-K1-F3
cagatggcgaagaggctaggtgaagtggggttagaagatttgtacagagcaggcgggggaacgcataagcataaaggaagccacccacatgtaccaagccatagcagcaagcaaagcctctgaccctgacccaagacgggtgtggaaagaggtggtgagtaggaaagtcttaaagccatggcacccgcatcacctgcatgaggtggtctactattctgtctatgccaactgggatgtcttcatcaatggccctcctctttactggtttccttccctagatgagtccaaaattacaaacctgggacgaataatggagattcatggcccaaagcttttagggactttatacaaagaccctattgaaagttttagcctctttcagaaattatctggtcagcatcctgagacttactggtctatctgtctt

SEQ ID NO: 24807 - DNA, 423 bp, Gossypium hirsutum
  Clone ID: LIB3272-042-P1-K1-F4
atttccaccacttattctctatggccaattctttgatcccatcatcttcacaaaaccgagcgttgtaagcacaaacaagcaaattcactagccacccatctccctattctcaatggcaatggcaacccaagcctccctcttcactccatcaaccctccgcaccccaaaatccggcgaccgcatcgccgccgtgttacggaaacaaccaccattcctaacactccctagcttcaagtccccaaaaatcatcatcgccccacgcaccatcaaagcctaagcaacctaagagaaagccgagacaaccgccacaaaggaagcaccagtcggtttcaccccaccagagctggacccaaacaccccatcaccgatcttcggcggcagcaccggcgggcttttacgcaaagcacaagtggaagagtttta

SEQ ID NO: 24808 - DNA, 334 bp, Gossypium hirsutum
  Clone ID: LIB3272-042-P1-K1-F5
aatctttccagtttcaattttctcacaacaaaactgaaaatgtcttgctgttcaagaaaatggggctgcggcgctgattgcaagtgtggcaatggctgtaacggatgcagtatgttccctgacataatagagaagactacaactgagactattgttcttggtgtggcaactcagaaaatgcactttgagggatctgagatgggagttggggttgaggttccattccccctgggagactacctaatatgctatccttggacttgtggaatgtgaacctcatacataagaacaatggggcttgtcattctaactaaatatatactattactgtttt

SEQ ID NO: 24809 - DNA, 427 bp, Gossypium hirsutum
  Clone ID: LIB3272-042-P1-K1-F6
aatttatttgcaagaaacaaaggttgtgatttagttagaataagaaactatggccaaagatggacccaactgggatggattgctgaagtggagcattgctaactctgatagaactcgacctactcgtaatttaagtgaggaagataaaagatggtttatggaagcaatgcaatcgcagaccgttgatgtgattaagcgaatgaaagagataactatggttatgcaaactccagagcaggttttggaagctcaaggagttacagctgctgatatccaagatatgttggatgagttgcaagagcacgttgagtctattgacatggcaaatgatctacactcaattggtggtttagtccctctccttggttatctgaagaattcacatgctaatattcgagccaaagctgcagaagtcgtatccaccatt

SEQ ID NO: 24810 - DNA, 345 bp, Gossypium hirsutum
  Clone ID: LIB3272-042-P1-K1-F7
gaaagagagagtttcttcttcgctgctgcggaaggtttattttctttcccaaagaatgaaagctttttctgcaggagcgttcaagtttttaccaatccaaaatttcaatttaaagaaaaaggagaaaacagaaatggctcgctctttctcaaacgctaagcttttctctactttcgttgtcgatggaatctctaacgttatctccagacgaggatatgcggcggcgtcacaaggaattgtgtcgagtggaataagagatgtctggcggagctaaagagaaggtttcatgggttcccgacccgggtaccggatgctacagacccgagaactgtgccaacgagatcg

SEQ ID NO: 24811 - DNA, 411 bp, Gossypium hirsutum
  Clone ID: LIB3272-042-P1-K1-F8
ctcgaagcgaagagacaaagatcgccatggcacctcctgcaaaagcaataactaggcccgtgcctgatgcgtggtatccaaccctagccgtcttcatgctcgccattggtcttgtcctcactgcttccttcttcatctacgaagcaacttcttccaaacgaaatcgcagtcttgcaaaggagctcacaaccgggggagtggcatctgtcttcctgggattcgggtcactgtttttgctactttcagccggcgtttatgtctgattttcatatattttttcaaccattttaaaaatttgctgagcagaatggtgttgaatggaggatcatggcttcgaccttgttacctatagactctttttttttttttgttattaatcagataaagagtgcttctatgagaatattttga

SEQ ID NO: 24812 - DNA, 347 bp, Gossypium hirsutum
  Clone ID: LIB3272-042-P1-K1-F9
tgatgataatgggaatgctgttgtcactgcacggcttcttgttccaaataatatgggaggatgtctcttagggagagggggtgatgccatttaaagactgcgaagtggcacaggtgctactatacgtgttcttacagatgatcatctttcttcttgaccaaatgcaacagatgaattagtgcacacatccggaaaacgagattttacatagatagctctatatgaacttttcactctttctcataaacattcactgaaagacaatcccatcttgagctttaactatgccacattcaagccagaatttaccttctagggctctaacaccatgccattcaattttggta

SEQ ID NO: 24813 - DNA, 426 bp, Gossypium hirsutum
  Clone ID: LIB3272-042-P1-K1-G1
agaggccttcagacaagcctctccgtctcccacttcaggatgtgtacaagattggtggtattggaactgttccagtcggccgtgttgaaaccggtgtcttgaagcctggtatggttgtgacctttggcccgtctggtctgacaactgaagttaagtcagttgagatgcaccatgaagctcttacagaagcacttcccggtgataatgttgggttcaatgttaaaaacgttgctgttaaggatctcaagcgtggttttgttgcatccaactccaaggatgaccctgctaaggaggctgccaacttcacttctcaggtcatcattatgaaccaccctggacaaattggaaatggatatgccccagtccttgactgccacacgtcacacattgctgttaagtttgctgagcttttgaccaagattgaca

SEQ ID NO: 24814 - DNA, 424 bp, Gossypium hirsutum
  Clone ID: LIB3272-042-P1-K1-G10
cggaaacatccccaactgaataaatttacgcaaaacaaaaaagaaagaaaagggtgtgggattcatttccttttttcttctcatctctgacaggtaatcggaaaagacaaacagttcgaataaatagaaaatggcgttgaatttggcgcatcagattggttctctagccgggacacaaattgcagctgaagtcaccaccggagaacaatcatcctcagcgacggctgatgtgtcgggatttcggaaagttccattggcgaatctccgatgcaacgccccaggagaagctctgtcccctccaatgttaactccaccgttgacgccgcgaagcgcggcaaacaggtcggctatgatgagtctgtcgctgcgtccggatctgtccgccgctttccaggctttcgggacgttatcaccgctggagacg

SEQ ID NO: 24815 - DNA, 407 bp, Gossypium hirsutum
  Clone ID: LIB3272-042-P1-K1-G11
gctcttacacctccgcaaatactcggccaactctgcgtcgacgacaccgccacgggaggcgacaccggcacagatccaagcaatgggccgcgtccgtaccaaaacagtgaagaaatcctcccgtcagggcatcgagcgctactactctcgcatgaccctagatttccacactaacaagaagatcatcgaagaagttgccattatcccatccaagaggctccgcaacaagatcgccggcttctcgacccatttgatgaaacggatccagaggggtccggttcgcggcatttccttgaagctccaagaggaagagcgtgagcgccgcatggatttcgtccccgatgaatcggccatcaaggtcgaccaaatcgaagttgataaggaaactcttgatatgctttcgggtc

SEQ ID NO: 24816 - DNA, 304 bp, Gossypium hirsutum
  Clone ID: LIB3272-042-P1-K1-G12
gttaattctccctgggaaactaaaattttatttttcctccaccacggtaactcgggggaccacactatatgttgtgaggagcaaataccccacaacccaattaacctgaccaaatcctcattactctttgcctgacgcttccgaaaccggaggaacctttatccccaaatctcctcagtaactttacacccaaccgcctagaaaccttccttgttgcaccgaactactgaaattgatcttctcatccccctaactgttacctgacatgatggtgtccttgcatgacttttgcacgaatttctga

SEQ ID NO: 24817 - DNA, 428 bp, Gossypium hirsutum
  Clone ID: LIB3272-042-P1-K1-G2
ataggtcttaaaacatgcctttccgtctgccacttgacgatgtgtacaagattgggggtgtgggaactgtgtcagacggccgtgttgaaacccctgtaatgaagcctggtatggttagaacctttggcccgtagggtatgaccactggagttaaagtctatgagatgcaccatgaagctcttacagaagctctcacaagggataatggtggaatgaatggataaaactttgttgtgaaggatcttaagcgtgtttttagagccatccaacttacgggatgaccttgctaaggggcgctggcaacttcacttttcagtgtattagtcaggaaccacactcgacaaattgaaaatggatattctctattcctcgactgtcacacgagatacattgctaagaagaatgatgagcttttgaccaaaattgac

SEQ ID NO: 24818 - DNA, 398 bp, Gossypium hirsutum
  Clone ID: LIB3272-042-P1-K1-G4
cttcacccggctcgttaccggactcaaccgtgtaaagatgggtcgggttgtcgtcggcgggggtgttactttgctcatgctgctgaccagctccgtctcgtaagctctactaaaacttacgactgatcaacaagtgggaaaacgctgacgttttggattgcatctgtatctggctcacacactgttagtgcagtgaccagcggataacaatcatactccagtaccgctgatgggtcaggatttaagaaagttccattgatcaatctccgatgcaacgccccaggagaagctatggcccctgcaatgttaactaaaccgtttacgccaagaaccgcggtaaacaggacggctatgatgagtctgtcagtgcgtgcggatctgtcctgcgctttccaggc

SEQ ID NO: 24819 - DNA, 258 bp, Gossypium hirsutum
  Clone ID: LIB3272-042-P1-K1-G5
ctcaacgctctccttctgtttctggtcaagccaatctcaaaagactccccttttagcgcacgaggtcctctcttgagggcgtataatgggtaaggagaaggttcacatcaacattgtggtcattggccatgtcgactctgggaagactacaaccactggacatttgatctacaagcttgcaggaattgacaagcgtgtgattcagaggactatgaaggaggctgctcgagagaacaaaagggtatttaagcgttcatg

SEQ ID NO: 24820 - DNA, 421 bp, Gossypium hirsutum
  Clone ID: LIB3272-042-P1-K1-G6
aagaggtgaaggaaaaaaaaatggaagattcatcatcaaagtcgttcttgagaaagcaatgggatgaatacaaagaattctgggccgatcgatttccgttcactaatgtctattcaagatacatcggccgggaacagtcccttccttcatggtctgaatccgatgttaacgagttcatcgcttctgatccggttcatggacccaccttgaagactgccaggggagcagcaaacatcgccttatacggaagtgctatcggagctatcacaactgcaggttttgcctggaaatactcgaagagtttacatggtgctggactgtcttttgtaggaggagccgtttttggttggacatttggacaagtaatcgcaaatcatgcgttttaactctacagtttggacacaatggctgtacaagccat

SEQ ID NO: 24821 - DNA, 399 bp, Gossypium hirsutum
  Clone ID: LIB3272-042-P1-K1-G7
gattgattactcaatcataaaaatcgatcaaagttagcagccgatggagaggctggagctgaaacacaagctcggcgataaatggatttcaaccctagccagcatatggatccagtgcaccagcggttcactctacaccttctccatctattccccaattctcaaatccacccaacgctatgatcagtcaaccctcgacacggtttccgtcttcaaagacatcggtgccaactgcggcgtcctttccggtttcctctacactttcgccactccatctaaccgccgcaacgcttattttggtggaccctgcttggtcctcgcggctggtgctatccaatgctttatgggctacttcctcatctgggctttcgcggttggattgatccctcgccctccggt

SEQ ID NO: 24822 - DNA, 422 bp, Gossypium hirsutum
  Clone ID: LIB3272-042-P1-K1-G8
gtggcactctagtcccgatcattcaactactccccattcagagagatggacacgggggcggcgtttcttggtcgggcatttctttgttttttccactctttatttctttccgacgccgatgttactggaaattcgtccgatcccggcctaactctctgcgtcgactctctctgcgcccagcttatcgagcccaatggttatttctgcactgaacacactattcaaactaagggtggctatttattagctctccaacgcgtctcatctcgttctggggatcttaaagttcagcatgggcatcctgttctgcttcagcatggattattcatggcaggtgaggcatggtttttggattccactgaacagtcgatgggctttattcttgcagaccaggggtttggatgggtgggttggtaatggtc

SEQ ID NO: 24823 - DNA, 371 bp, Gossypium hirsutum
  Clone ID: LIB3272-042-P1-K1-G9
gttacatgtgaacggcacttgcacatgggttagtcgatcctaagagacggaggggggggcgtccgacagcgcgtggagggcgagctttaaaagggaatcgggttaaaatttctgaaccgggactcggcggctgacggcaactttagggagtgcggagactgttgtgggggccttgtgaagagttatcttttctgtttaacggcctgcccaccctggaaacggttcaagcggaggtagggtccagcggtctgaagagcaccgtacgtttcgtggtggtcggtgcgcctcccgcggtccttgaaaatgcggaggaccgagtgcctgtcgtgcccggtcgtactcataaccggatcaggtcttcaaggtgaaca

SEQ ID NO: 24824 - DNA, 136 bp, Gossypium hirsutum
  Clone ID: LIB3272-042-P1-K1-H12
tctcgcctctcgcttattggttcaagatctggttttgatctgatcagatcgtgggaaggatatcataacaggtgggggagagcaccgaataaaagcgttaatttcaaatactatgagatttggggagtattgaaat

SEQ ID NO: 24825 - DNA, 350 bp, Gossypium hirsutum
  Clone ID: LIB3272-042-P1-K1-H2
gaatgaattcaaactgtttcacacagtagtcattttgaaggattcaagagaagcaagaggggggctactaaagggcggaaggggaggagttctgatatgccctacaaaacaagaaacaggagaaactgcctcggaatacgaaagctacatttgacaaaagaaaaaaggtacgttggaggatgttattgcccataagcaagcaattgcattccaacgcttctgtggaggaggtggacgaaccgaacaggctaagaagcgacattctaaaggacaaggccagtggcccgagaaattggaaaatttatgcacgaagtgatcaagaatgccgagagcaatgctgaggtaaaagg

SEQ ID NO: 24826 - DNA, 397 bp, Gossypium hirsutum
  Clone ID: LIB3272-042-P1-K1-H3
ctttgctgcatctcattctcacttcaccttttttttttattgtctggatcatcggagggaaattaaagaaccaatcatgaagcttgacaccagcggactagaatcggctgctcctgtctggggtgctcccagtgaacttgttgacgggttttcggctgctccgtcggtcgatctcccaaacactactgattttgatgggtttcaaaaagaagctatccagatggtaaaacctgctaagggtaccaccacgctagtttttatttttaaggaaggggcattggttgccctttattctagagctagcatgggaggcgtatatcttttcacaattagtgaaggaatttattgaaatcaatccttacatgcttggaacaatggctggaggagctgttgactg

SEQ ID NO: 24827 - DNA, 285 bp, Gossypium hirsutum
  Clone ID: LIB3272-042-P1-K1-H4
gcgggccagcgaccggcagcgtaatgggtgaagaagtgaaggtttttggatactgggcaagcccttacagctgcaggggggaacttgttttggaggggaaaggtttcccttatgagtacataaacgaggatatttttggcaacaagagcgatatgcttttgaaatacaattcggttcataagaaaggtccgctctttattcacaacgggaaaccaattggagcgtctctgttatactggaatacattgaggaaacttggaagcataatccctatgcgccacagga

SEQ ID NO: 24828 - DNA, 181 bp, Gossypium hirsutum
  Clone ID: LIB3272-042-P1-K1-H5
ctccctattaactctctcttcatctgcctttgatctgctctatatccctttttcgaggggatttagtggggtagggagaaaaagagtctctgtatataaagcgttagagacacatatattctgtaatcagtttatcttcattccctgaatgggtgtgaacacccccccaattttttttatt

SEQ ID NO: 24829 - DNA, 330 bp, Gossypium hirsutum
  Clone ID: LIB3272-043-P1-K1-A1
ccacgcgtacgtttttctttagagaaaatttattgaaaatatggttgtatgaattggagaggtccaaacccttttgtaaggtggctacctcctacatttttgaatcgacaaactcctgattgcttattaaattcccatgaggagacagaatattattaacgtcacaacactcgtgacgagattaatactaagactgtacttaaggttgttgaaaaccataatcttgccactacaaacaaccgactggttagccaaatatgccacactaggacccgcgcagcatacggaggagtcaaatgttgtggttgagagatttagaggtgataacat

SEQ ID NO: 24830 - DNA, 381 bp, Gossypium hirsutum
  Clone ID: LIB3272-043-P1-K1-A10
gaaagagtttctcaaagtcttttttttttttttcaaagaaaagtttccttcatatttatatcgaagctgaagaagccttaattcaacactttattccctcgttcattttctttgtcttccttatttgtcgatctcgatagagggatcgcgttgtctttgatgatcgcttgaagaatcgataagaggggcgtcgattttcagtttattattggtggaaggaaatagaagcttaaataaatttcgcccacttaaatttttttttttttggcggcggttaacttgtttaaggttttgggtaaaaggggattttttttttcaaaagatcgagttgtttttagttttaatgatgtttgccttaactgctgggttttgaagttgctt

SEQ ID NO: 24831 - DNA, 262 bp, Gossypium hirsutum
  Clone ID: LIB3272-043-P1-K1-A11
ctgaggccaagaagcctgaagattgggatgacaaggaatacatccctgatcctgaagacaaaaagccagagggttatgatgacattccaaaagagattcctgatcctgatgctaagaagcctgaagattgggatgatgaagaagacggtgaatggacaccctcaacaattcccaaccccgagtacaagggcccatggaagccaaagaaaatcaagaaccccaactacaagggcaagtggaaggcaccaatgattgacaaccc

SEQ ID NO: 24832 - DNA, 394 bp, Gossypium hirsutum
  Clone ID: LIB3272-043-P1-K1-A12
attgaagtttcctttctcgattttctatttagccaaacaagatgcagatcttcgttaagactctaaccggcaagactatcactctcgaggtcgagagctccgatacgatcgacaacgtgaaggccaaaatccaagataaggaaggcatccctccagaccagcagcgtctgatcttcgccggaaaacagctcgaagacggccggaccttggccgattacaacatccaaaaggaggcaactctgcacctcgtgctccgtctgcgcggtgggatgcaaatcttcgtgaaaaccttgactggcaagacaatcactctcgaggtgagagctccgacacgatcgacaactttaaagcgaagatccaagacaaggaaggcattcccccagaccagcaacgt

SEQ ID NO: 24833 - DNA, 408 bp, Gossypium hirsutum
  Clone ID: LIB3272-043-P1-K1-A2
gaaaaggggaaaaaatcgaatctctccggttctaaccataccttttaccgtaccagatatcatagttgacgccaaaagaaaagaagaaaaagagagaagaaggctttattaacagcgcgaaagtatgtatttccctttttcattttgagtgatttaatataaacggctgaggagccgagaatctgcaaaagctttctcttatacgcaacaacaggacgcctttttccacttggatcgaacggccgagtcgtttattttaattgagtggttatggcggagccatcttcgtctttatcggcttccaaggacgagctgtttcagctcatcaagcgtggtggaacttatctagcccttaagaggacaaatcttttctcgaactctctacaaaaactggatacgcgaactggt

SEQ ID NO: 24834 - DNA, 230 bp, Gossypium hirsutum
  Clone ID: LIB3272-043-P1-K1-A3
gagaaacggaaactgtcgtatctcttcgagacctaacacccactttaccggacctgacatcaaagtcgttcccaacactatggctccatataagagactagtcgctttattttcacaacgataaggtggctgtgccttgaaagctggtgtcgagaacttaatacggttcaagggccgggaatcttcataagatggcattaagacgcaggaaccttacaccacttgatact

SEQ ID NO: 24835 - DNA, 348 bp, Gossypium hirsutum
  Clone ID: LIB3272-043-P1-K1-A4
attgaagtttcctttctcgattttctatttagccaaacaagatgcaaatcgtcgttaagactctaaccggcgagacgatcactctcgaggtcgagagctccgatacgatcgacaacgtgaaggccaaaatccaagataaggaaggcattcctccagaccagcagcgtctgatcttcgccggaaaacagctctaagacggccggaccttggccgattacaacatccaaaaggagtgaactctccacctcgttcttcgtctgcgcggggggatgcaaatcttcgtgaaaaccttgactggcaagacaatcacttctcgaggtgagagctccgacacgatctgacaacgtt

SEQ ID NO: 24836 - DNA, 313 bp, Gossypium hirsutum
  Clone ID: LIB3272-043-P1-K1-A5
gttccatgtgaacggcacttgcacatggtttagtcgatcctaatacacgggggaagcccgtccgacagcgcgtgcagcgcgagcttctaaagggaatcgggttaaaattcctgaaccgggacgcggcggctgacggcaacgttagggagtccggagacgtctgcgggggcctcgggaagagttatcttttctgtttaacggcctgcccaccctggaaacggctcatccggaggtagggtccagcggccggatgagcacctcacgttttgtggtgtccggtgcgcccccggcggcctttgaaaatacggaggac

SEQ ID NO: 24837 - DNA, 411 bp, Gossypium hirsutum
  Clone ID: LIB3272-043-P1-K1-A7
tttttctttagagaaaatttattgaaaatatggttgtatgaattggagagtccaaacccttttttaagttggctacctcctccatttttgaatcgacaaactcctgtttgcttcttaattttccatgatttgagagattttgatttacttttcaacacttttgaggagattaaataggaaattgcactaaatatggttaaaaaccataatcttaacactacaattaaaagacagaagagccaaaaaagaaaaacaagggtccgcgcagcaaacggaggcgccaaatttcgagggtgggttctttagaggaaagaacaatcaataaacagttggtgtggcgtctcgacgttgtgggggaattctctcttcttcttaaaattttccttgaattctctagtttaaaaggggaaa

SEQ ID NO: 24838 - DNA, 404 bp, Gossypium hirsutum
  Clone ID: LIB3272-043-P1-K1-A8
gaaaaggggaaaaaatcgaatctctccggtactaaccataccttttaccttaccagatatcatagttgacgccaaaagaaaagaagaaaaagagagaagaaggctttattaacagcgcgaaagtatgtatttccctttttcattttgagtgatttaattaaacggttgaggagccgagaatctgcaaaagcttcctctcatacgcaacaacaggacgcctttttccacttggatcgaacggccgtgtcgtttattttaattgagtggttatggcggagccatcttcgtctttatcgtcttccaaggacgagctgtttcagctcatcaagcgtgttggaacttatctcgccctcaagatgtcaaatcttttctcgatctcttttcaaaaactggatccgcgatct

SEQ ID NO: 24839 - DNA, 395 bp, Gossypium hirsutum
  Clone ID: LIB3272-043-P1-K1-A9
gcgatacaaagactgcaatataacctcaagctctgacacccacttttcagaccttaacaccaaactcataccaaacactcttgctccatatatctgcctctctttctttctttacaattctcaggtttctgttctttgaatcctgctttcaagatcataatagaaacaaagaaaggcaaagcttagaagatgggatcaggtgaatggtgccttcaaaaacgagatagtttcaagagtgaaacgcttgtaggcaatgagactgtgccagaaattgggtgcctttcgattattgttcttggcgcctctggtgatcttgccaagaagaagacctttccctgctctctttcatctttattgccaggggatttttgccaccaaatgaggtgcacattttc

SEQ ID NO: 24840 - DNA, 400 bp, Gossypium hirsutum
  Clone ID: LIB3272-043-P1-K1-B10
ggcagttgccttcggtgttcccgatgagaaatatggcgaggagataaattgtgcggtgattttaaggggaggaagcttggatgaagcagaaatcacgaaatattgcaaaagaaatcttgcgagtttcaaagtacccaagaaagttttcatcacggattccgtgccgaaaacagctactggaaaaatccagaggaggatagtagcagagcatttcttggctcaaacgtctgccgctaaagtacccaaatttggagcttaaattcagcattgcttgtctattgcttaggtacatatttaagcgactgcaatttattgtttgtgtaaaaggggattactaaagcaccatgttacatgtaattctgattagaaattattggaaagtctacattcataaatattt

SEQ ID NO: 24841 - DNA, 398 bp, Gossypium hirsutum
  Clone ID: LIB3272-043-P1-K1-B11
ctcaactcaactctgttcatcaaatcaaaaaccctaccttttcttttagttactaggaaagggtgatcagtttttttttttttctcacattggcttttgcccaatgcctaaatatcaatggtggagtccctttacctctccctctgcaacggtgcaaccttaatctataactagtagttaagcgtgtcattagttagtgttatcttggtgtgttgaactcgcaggcatggcggccttatcaaccagaggcctcgtttctcgtctccaccagcagttcctttccctatcaaggccatccgcagcagccccgacatccctcccttttcattccttaactagaagattattcagctctgatgccttgatggatggctcccagatcctccataaaccacccg

SEQ ID NO: 24842 - DNA, 385 bp, Gossypium hirsutum
  Clone ID: LIB3272-043-P1-K1-B12
cgattctgaaattttgcctgccgctccatctctacatcacaggaatggcgacagatgttgcagcccccgccaccgccgcacccaaagacccaacccaacctcaccttgaagtaaaactcttcaaccgctggagcttcgaggaagttcaggttgctgatatctccttgagtgattacattggtgtccaagcttcgaagcatgctacctatgtgccacacactgctgggaggtactcagttaagcgtttcaggaaggctcagtgcccaattgttgaaaggcttacaaactcacttatgatgcatggccgaaacaatgggaagaagcttatggcagtcaggattgtgaagcatgccatggatattatttatctcttgactgatcagaa

SEQ ID NO: 24843 - DNA, 412 bp, Gossypium hirsutum
  unsure (1)..(412): unsure at all n locations
  Clone ID: LIB3272-043-P1-K1-B2
caaggatagccctatagcagcagcagcagaagcagaagcaaagggtttagagacgagaatggcagcgaaaaggaagactcccgtcaagaccagaaacccggatctgatccgtggtgtgggaaagtattccaggtctaagatgtaccacaagcgtggcctttgggcaatcaaggccaaaaatggcggtgctttcccccgccatgatcccaaacctaaggcccccgctgccgctgagaaacctcccaagttttacccggctgaggatgtcaagaagccgctccttaacaagcgcaaacctaaacccaccaaactcagagcaagcattacaccagggactgtgttgattttgttggctggaaggtttatggngaagagagttgtttttttgagcaacttacttctggctcctttt

SEQ ID NO: 24844 - DNA, 200 bp, Gossypium hirsutum
  Clone ID: LIB3272-043-P1-K1-B3
acgcgcaagattgtatgtatcaccaaaatcaaagggttcccagacgataacacagaacggcgcatcccttctgtggcatcctaatatagacactgttgagcggctaatttgctgggaacaacaggccactaaacttggagcgatctctacgagggaccaaggtggtaggctcaggacagagagcgaaagcgggggaaccc

SEQ ID NO: 24845 - DNA, 196 bp, Gossypium hirsutum
  Clone ID: LIB3272-043-P1-K1-B4
cccagtcactagtggaagggttttgttttgtgtttcttgaacaatgcagagagaggggatattagaatggaggcgttcaacctatgctttataaacaacaaggcaattatagaggagaacatatttctggactatctcaagagctttaggttcttcccgcgaatcggggagtcatcttactaggcaaaaatacagt

SEQ ID NO: 24846 - DNA, 400 bp, Gossypium hirsutum
  Clone ID: LIB3272-043-P1-K1-B5
gaatacttcagggatcaagagttctcttctatatgtgaatcatgaaattagggaggctggttcatcgagtaaagaccgacccatagacattgaagatgggtttgtaagggctcctcatgcttcatcagatactgctgataattctacctcacttctggagaatactggtactagtggcagctctagtggttgtttaatttttgatgggcctgtggacttgcatgcagttttatgcagaaacagttcattaaatgcaaccttggtaggggaagaaaatgctgtggctgctctggttccatcatcttctcaagaacaaatgcaagaagccctgagagctggtcttcattctgaaagtagtcactctagtgattctgagaaacaagaaagcggtgcattgggt

SEQ ID NO: 24847 - DNA, 402 bp, Gossypium hirsutum
  Clone ID: LIB3272-043-P1-K1-B6
cgattctgaaattttgcctgccgctccatctctacatcacaggaatggcgacagatgttgcagcccccgccaccgccgcacccaaagacccaacccaacctcaccttgaagtaaaactcttcaaccgctggagcttcgaggaagttcaggttgctgatatctccttgagtgattacattggtgtccaagcttcgaagcatgctacctatgtgccacacactgctgggaggtactcagttaagcgtttcaggaaggctcagtgcccaattgttgaaaggcttacaaactcacttatgatgcatggccgaaacaatgggaagaagcttatggcagtcaggattgtgaagcatgccatggatattatttatctcttgactgatcagaacccaattcaagtcattg

SEQ ID NO: 24848 - DNA, 348 bp, Gossypium hirsutum
  Clone ID: LIB3272-043-P1-K1-B7
gtgatttttgaggaaattaggcgacgtggcctcaaagtagctgttgctggaatcccaaagaccattgacaatgacattccggttattgacaaatcatttggttttgatactgcggttgaggaggctcaacgtgccattaatgctgcacatgttgaatcactaagtattgagaatggcattggacttgtaaagctaatgggacgctatagtggtttcattgcaatgtatgctactctagccagccgagatgttgactgttgcttgattccagagtcaccattctatcttgaaggaagtggtggactttatgaatatattgagaaacggctcaaagaaaatggacattat

SEQ ID NO: 24849 - DNA, 396 bp, Gossypium hirsutum
  Clone ID: LIB3272-043-P1-K1-B9
gttccatgtgaacggcacttgcacatgggttagtcgatcctaagagacgggggaagcccgtccgacagcgcgtccagcgcgagcttcgaaagggaatcgggttaaaattcctgaaccgggacgcggcggctgacggcaacgttagggagtccggagacgtcggcgggggcctcgggaagagttatcttttctgtttaacggcctgcccaccctggaagaggcagccgaccgcaggttgatggcactcgtatgtgaggcaaagggagattacgaggcggctcttgagcaccttgtcctagccagcatggcaatgattgccaatgggcaggagaatgaagtagcttcaattgatgtcagcattggcaatatttacatgtctctatgtcgctttgatga

SEQ ID NO: 24850 - DNA, 391 bp, Gossypium hirsutum
  Clone ID: LIB3272-043-P1-K1-C1
catcaacaaaaaaccaaacacccagagttaaccaaaagagaaaatggtcaccaaagtctacattgtatactattccatgtatggacatgttgagaaactggcccaagagatgaagaaaggagctgaatctgtcgagggagtggacgtcaaactttggcaggtagcagaaacactaccagaagaagttcttgggaaaatgggagcaccaccaaagacagatgcgcctatcataacaccagatgagctgacggaggcagatggtgtgctatttgggtttccaactagatttgggatgatggctgcacagtttaaagcattcatggatgcaactgggggtctatggagaacacaagcccttgctggtaaacctgctggcattttctacagcact

SEQ ID NO: 24851 - DNA, 395 bp, Gossypium hirsutum
  Clone ID: LIB3272-043-P1-K1-C10
ctcattttccgggaaaacatacaacgaaaaagaaaatttcgaagagagagagaaaaaatgtttgcatacgatcgcgtaagccactcgagtgccaacaaggcggatgagatagatctagaatcaggggagactttgtacccgggactcagctacggcgagaaccaactccggtggggttttatccgcaaggtttacggcatcttggcagcgcagttggttctaaccaccgtggtatccgcctttgaggttctttcggctccggtcaacgagctccttcggggaaattctggcctcttgcttttcctctgtttaatccccttcgtcttggtgtggcccttgcatgtttaataccaaaagcaccctgtgaacttggttatcctcagccttttcaccgt

SEQ ID NO: 24852 - DNA, 400 bp, Gossypium hirsutum
  Clone ID: LIB3272-043-P1-K1-C11
atcaaggacaaagcaatcaaagtagcagaaggtggtgatgatgcagacatggttccagaaccaaagccattatcaaaggaagctgtacaaatgcaaatgaaagaccttgaattccttaaacaaaacacggagacatgaaagagctgattttaatgaaaaaattggagtcggttcgcttcttcgaactgcacttggatggtatcagaaaatgaagctaaggaaatggctccatattgaaaccatccaacacttgattttcagattgcactcaatggcagataaatcataggtttactgggtcttcagtatgttttgtttcttggaggttgagttgaaactcatttttagggtgtaaccattaaaggcaacagtttgtgagtgaaatacacattcatagcaa

SEQ ID NO: 24853 - DNA, 401 bp, Gossypium hirsutum
  Clone ID: LIB3272-043-P1-K1-C12
aaaaaattccctttttcaatttttgcccttacctctccctatagaatgaagaagcactagaacgatcatcttctccctcggttcactggtgttagctgtggcagtttacaaccactataaaggatataccattccttcaagaaaaacgaggcatctgaattgggtgacaatgataaacatgttgccaatgattttgttgagctggaaaagagcaatgtactgttaataggtcccactagttcaggaaaaacattacttgtagacactagcacgcattgtgaatgtaccatttgtcattgctgatgcaacaagtttaacacagatgacaatgcccagagatgctttacatcttggtggagtggaacatcgggagttatataatgcctatggatattactttc

SEQ ID NO: 24854 - DNA, 257 bp, Gossypium hirsutum
  Clone ID: LIB3272-043-P1-K1-C2
acgcggaagcgagggggaaagaaccaaacatctggcttattaactcaagagtggggcggggagacagagacagatcattatactactacccaaagcaagatacgctctgaaactggaagacagcagactatatgagggtgctacaagttttggcaggttccatgattctcaccgaacagctttcttgtacgcaccgtctctttgtctttggttagatgaggtctgatgcttcttcgcttaaaaaatcccacatattt

SEQ ID NO: 24855 - DNA, 404 bp, Gossypium hirsutum
  Clone ID: LIB3272-043-P1-K1-C3
ctacgcgagcactctcagactactctttcgaaccagctacaccatcacccccaagaaacagagcaaattgtagaagatggcaacacaagcacttgtatcatcgcctcttacctactcagtggagactgcaaggcagattcttggagctaaacgacaaattgggtcttcaaggaaaggatcctttgttggtaaggcaggttcaactccacccgttaagcaaggagctgatagacctttatggtttgcatctaaacaaagcctttcatacttggatggcagccttccaggtgattatggatttgaccccttgggactctcagaccctgaaggaacaggagggttcatcgagcctaaatggctagcctacggtgagatcatcaacgggcgttatgctatgttgggtg

SEQ ID NO: 24856 - DNA, 379 bp, Gossypium hirsutum
  Clone ID: LIB3272-043-P1-K1-C4
aaaacaaccccttagaagacaacattaactactgtaatcccacttctttggaacctcaaagcaaaatctttgttttagttaatggctcaattcaccccacaaggacgtttgaagctgctctttcatggtgatggggtggaaccaaaggacccttttcattacaagcttgtcagcaatgtttttggtggttctggtgggctaaaatcacttcaaactcataagggcatgctcagattccttggttctactactagaagaagccacttttcttcttctttgaagaaaggcagcaaatttaatgccacggcaagcctgaatgtgagtgatgaaggactttatgatgaagaggattatgatagtgagtttgggactgatgagt

SEQ ID NO: 24857 - DNA, 372 bp, Gossypium hirsutum
  Clone ID: LIB3272-043-P1-K1-C5
gggacacttaacattattttggggcaaaaacacagaggatattttcccaggatggtcaggtggaagcttctgttcttatttctttgggttaatttgggtgtttcttctttcattcatggtggaacgactttcccacacaaagtttatcaagcaagggaccaatcatgtcgttgcagggcttttgcagacacttatgtatgcaaccagggtggctttggcttacttagtgatgttggctgtcatgtcgtttaacgttggtgttcttttagcttcggttggtgggtatgctgttgggttcttggtttatgggagtccggcttttaggaaggcagactttattcaatacgaggaatcttctgacattccaccttt

SEQ ID NO: 24858 - DNA, 403 bp, Gossypium hirsutum
  Clone ID: LIB3272-043-P1-K1-C6
aaaatcgctaaagcgatatggctttgcagctatgggaaacgttgaaggaggcgacaacggcgtatacgggtctatctccggccactttttttacggttctagctctgttatgggctgtttactatgtagcaaagggtctatttgggtcatccgatgatcatatccatcaacggtctacggctttcgaggagcagatggagccgctaccgccaccggttcagctcggcgagattaccgaggaggaacttaagcagtatgatgggtcggattcaaagaaatcactccttatggccatcaagggccagatctatgatgtttctcaaagcagaatgttttatggacctggtggaccttacgcgttgtttgctggaaaagatgcgagcagagctcttgcaaagatgtc

SEQ ID NO: 24859 - DNA, 403 bp, Gossypium hirsutum
  Clone ID: LIB3272-043-P1-K1-C7
cttttcgccactttcttgaacgggcttacaagtaccgcccagtcaaggttctagagtttgaaaagccaaaacaacagtgcgttgtgtacctggacctgaagcgcgaggaatgcgcgcatctgtttccaggtggtaaagtttattcacaagcattccatcttggtggacaagggttttttcttctccgcacattgccatatggaccagcaaagctcattccactgctttgggctatttttgggaatgcaagagaagggtgccgtcacttttgccgttgactatgagtttgcagcaaggtcaaaaccaactgaggattacgtaagtaagtacaaaggtaactacacattcacaggctgaaaggccattggctatcgtaacctgttcggtataccatggacgacat

SEQ ID NO: 24860 - DNA, 224 bp, Gossypium hirsutum
  Clone ID: LIB3272-043-P1-K1-C8
gagaattttacttctttgatccaatgttagtacttatatccaaagagaggaatggggtagcgccgcctatgtaccattgaagatggcgaacatatgtctaaagatgggcgctttgaaagtgttgcttcacttgcattcagggagtaaggtgtgctccctttcgatgaatgcgaacaacgtgccgtgggaataccaatttatgctttacaggggatacacgagtt

SEQ ID NO: 24861 - DNA, 209 bp, Gossypium hirsutum
  Clone ID: LIB3272-043-P1-K1-C9
attgaatgtggggtgtgccagcatccttttctcgttagtgcccattgatgaatgcgcttttgtcaccagtgaattgctctttttctctattaatttcttgttgaggtcgtgtttataataaactaatacggatgagctctctattatctcttttgtcatctcttcaagttattgtgaatatggaacttatctctttgttctttaatcag

SEQ ID NO: 24862 - DNA, 381 bp, Gossypium hirsutum
  Clone ID: LIB3272-043-P1-K1-D1
acccgccaattactcttcagtctcagccgatcttaaaccatgggtcgcgttcgcacaaagacggtgaagaaatcgtcccgtcaggtaatcgagcggtactattctcgaatgaccctcgattttcacaccaacaaaaagattatcgcagaagtagctataatcccatccaagaggctccgtaacaagattgccggcttctcgacccatcttatgaaacgtatccagaaaggaccagttcgcgggatttctcttaagcttcaagaagaagagcgcgagcgtcgcatggattttgtccccgatgaatcggccatcaaggtcgaccaaatcgaagttgataaggaaacacttgatatgctctcggatattggaatgggtgatatt

SEQ ID NO: 24863 - DNA, 386 bp, Gossypium hirsutum
  Clone ID: LIB3272-043-P1-K1-D10
gctattttctctctccccaaacacccttttaagccaaaaagaagacaatggccgatcagctcaccgatgatcagatctctgagttcaaggaggcctttagcctattcgacaaggacggcgatggctgcattactaccaaggagctcgggactgtgatgcgatcacttgggcagaaccctactgaggcagaacttcaagatatgattaatgaagttgatgctgatggaaatgggaccatcgattttcctgaattccttaacctgatggcgaggaagatgaaggatactgattctgaggaggaacttaaagaggctttcagggtttttgacaaggatcagaatggtttcatatcagctgctgagctgcgccatgtcatgacaaatctc

SEQ ID NO: 24864 - DNA, 391 bp, Gossypium hirsutum
  Clone ID: LIB3272-043-P1-K1-D11
attttcatcgaatggctgctcttatcccattttcttctgaagactagtaccctcatttcaaaatcataaacgaaatttccatggcaatatataacgtttaaacttcaatccaggcaaagagagagagagagaatcacatggaagaaggcctttctccaccgttacaccctctctctcagtttctttagctttcttttttaaactccctctatttatataaacctttcaataatctaagagcaaaatttctgtgctgggtttcgaatttggtgatctgggtttttgttctttctgtgctagagacagagagagaggggtaggggagagtgatggaagaagggagatttctgcagtggggtgttttcagatctcttcttgcgattctccaatg

SEQ ID NO: 24865 - DNA, 373 bp, Gossypium hirsutum
  Clone ID: LIB3272-043-P1-K1-D12
atgcatttcaagagcaggggagactatctggaaagaaagcttatttcttggcttgcccacattatctatcacttcttaacaaaggataaaacgaagtcattacattacctaaactcgtgggtgaggcttctaattaaccacctacagatagatatgttatcaactcaccagcagatcagaagctgattagatagactcaatcaaacagacgtaagtggactgttgcacatatcttccactagagagaagagaccgcctagttgatagattggaagcccaaatatttatttaaagctggactcaaagaaagaccgctttggaacaaatgaaaatagatcgactgaagatatacgagtatgggcagccttatttt

SEQ ID NO: 24866 - DNA, 385 bp, Gossypium hirsutum
  Clone ID: LIB3272-043-P1-K1-D2
acgcaaaccttaccttatatagggttagggttttgctccttctgtgttcatctgtctggaccaaaaaggttttagcttttaacttggagcgagaccatgttggtttaccaggatctcatctacggtgacgagcttcttttttgctcattcccctacaaggaaatcaacaatgggatgctgagggaacgcctggggatgcgggtccttagacacaacccccttacatgatgatgaacatgatgcatccgcctgagaggcatgctacgactatggtgccgccacaacaagggtggggtgtggtaccatctcaacaacattcagcgggtcaacctggtaacgcatatgagggtcggactttgtggatcggagatttgcagtattatat

SEQ ID NO: 24867 - DNA, 410 bp, Gossypium hirsutum
  Clone ID: LIB3272-043-P1-K1-D3
atcagatcaagagcctctctcatggaccttcattcgaccaatggttgaagatctggaaatgataacatcgtccttttgcccaccactatcaaatttccagattttccaggaaaaagaaaatcaaaaccccaaggtgaagaaggtaaaaaccagcagcggcaaaggcaataaaaggtgaagccaaagagagagagatatatacataataagaaagatttttcaaaagaacacaactatggctcctcatagagaaggatcggatgcttcagtggaagccatggttgctcaagtcgaaaaacacccaatttcatcgatccttatcatcattgctatgcaaacagaagctttgccggtggtgaataagtttcagttgaattgaaaacccttattcttcgttctcaaaaggggcc

SEQ ID NO: 24868 - DNA, 309 bp, Gossypium hirsutum
  Clone ID: LIB3272-043-P1-K1-D4
cacagtcttacaatgtctccccatctaccttttgggtgcaaaatctgaccaacaataacaccaccaaccactcatcgttatcttgtactcccaggattaatcctgtaatagccaaggcactgcgtactgaagcagctgccacagcacagcccataaaaatggtgaaagctatcagggttcatcaacttggtggacctcaggtccttaaatgggaggatgtggaacttggggaacccacagagggtgagatacgaattaaaaacagagctattggaccgcattgcatcggtatctattttcagagaggag

SEQ ID NO: 24869 - DNA, 335 bp, Gossypium hirsutum
  Clone ID: LIB3272-043-P1-K1-D5
ccaaaatcagaccacgaccaaaataagcttccttttcctatcatttcagggatcttgcccaggcatcaagggcaaggttgtttaaggaatacaaagaggtgcagcgagaaaagacggcggatcccgatattcaacttgtttgtgatgattccaacatatttaaatggactgctctaatcaagggaccatctgagacaccttatgaaggtggagtgtttcagcttgcattcgctgttcccgagcagtaccctttgcaaccccctcaagtgcggttcttgacaaaaatatttcaccccactgtgcattttaagacgggagagatctggcttgatata

SEQ ID NO: 24870 - DNA, 253 bp, Gossypium hirsutum
  Clone ID: LIB3272-043-P1-K1-D6
ctaagatattactgcaaggaaaaaaaaaaaaaaccagacatgttttacaacactgcggcatccgctgatcttgttattacctttaacttgctgtacttaactttggaaagctatacctacgtgccttggccaccaccaccaacagaggcacaaggcctctctacaagagcccaccctcggtacctaaacagtcagccactttttccaaagatacactgaatatagaagcctttgcagaattgaagagctaaat

SEQ ID NO: 24871 - DNA, 257 bp, Gossypium hirsutum
  Clone ID: LIB3272-043-P1-K1-D7
caaaatccaaactctactatccttaatattatggtcagacaagatgggagatgagggatcggggatggctatgcttgtgctgatgatgcacaatcaatgatcagggatatgacaagcctattaatagggctacaatgaacaccatactggcctgacaacgtctagtttgagaacagacgaccaatttaatgtcatatgctagaagaggaccgctgaggatggagatgcctacaacggtgctctacagaaagataggc

SEQ ID NO: 24872 - DNA, 283 bp, Gossypium hirsutum
  Clone ID: LIB3272-043-P1-K1-D8
ctctctcgctctctgtagccgccgcctgcgtttctctcttcatctgtctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgacgaccaagctgtg

SEQ ID NO: 24873 - DNA, 393 bp, Gossypium hirsutum
  Clone ID: LIB3272-043-P1-K1-D9
caaccgagggctccggtgatgtcggatcaaacaaaagcaaccctcttccaatcccactgtcgttgatgatccttacaagcgcctagaaatcactcgtaaccccaatggctcgcttacgcgcaaccctaataggtttcccaacacttcagccacacctgatccggacccaactgtcccggttctctccaaagatgtcactatcaaccaaacgacacacacatgggctcgtgtgttcctccccaggcagaagccgcttgatacgaacaagttccctctcatagtttattaccatgcaggaggcttcatccactgcagtgcggcatccacgatcttccatgttttttgctcaaacatggcgttggaactccaagccatcgtcgtgtccgtcgacta

SEQ ID NO: 24874 - DNA, 352 bp, Gossypium hirsutum
  Clone ID: LIB3272-043-P1-K1-E1
ataaaaaagaataaatacttctgcttggatgggtagagcgcacaccttcctctaatgatgcacctatggacggcactcaccgtcctctccgatctgactaaagtggcaggtcatgtgactgtgaggctcctcacatttgtataaatatagcgcccaaggcttatgatgtgccagcggagacatggaacccttgaccggcaaaacggttgaaggtcggttttttctgagagggcgttcgccttctgaaccaagggcgctttgtgtatcgagcatttagactttcaggatgccatacatgaagtgtgacgccatgtgacggcggagatgagcttattagtgcctgcaagcctgc

SEQ ID NO: 24875 - DNA, 407 bp, Gossypium hirsutum
  Clone ID: LIB3272-043-P1-K1-E11
ataaatagccccaaagcccaaccccttcccccatcgaatttgatatttataaaagaggatggggctgtcttttgctaagctgtttagtcggctgtttgccaagaaagagatgcgaattcttatggtgggtcttgatgctgctggtaagactaccattttgtataagctcaagctcggtgagattgtcactaccattcccaccattggctttaacgtggagaccgtagaatataagaacattagcttcactgtttgggatgttggtggtcaggacaagattcgacctttgtggaggcactacttccaaaacactcagggtctaatctttgttgttgatagcaatgaccgcgaccgtgtggttgaggccagggatgagcttcatcgtatgctaaatgaggacgagctgg

SEQ ID NO: 24876 - DNA, 365 bp, Gossypium hirsutum
  Clone ID: LIB3272-043-P1-K1-E12
ggggacccacccccccaactcaaatctcctcctcctcctcagaaatcttagtatcatcaccatggccggaaatcccaaggtcttctttgacatgactatcggtggtcagcccgctggtcggattgtgatggagcttttcgcagattgcactcctcgcactgctgagaacttccgtgccctctgtaccggcgagaaaggcgtctgccgcagcggtaagcccctccactacaaaggctcctctttccatcgggtgatccctaactttatgtgccaagggggtgacttcacggccggaaacgggaccggaggtgaatccatctacggatcccaggtcgctgacgagaacttcatcaagaagcacactg

SEQ ID NO: 24877 - DNA, 400 bp, Gossypium hirsutum
  Clone ID: LIB3272-043-P1-K1-E2
attaactctatatccatggctataatttccaccactgcaaaatttatgtcaacaggcttgtttattattcttcttctcttgcagttctccataacgaaaggtcatggtggagacgatcacgacgagaacaacggtggagtctccccttatttctttcgatgggacgaaagttttctcctcttaggcacacagtttgccggtggggtttttctggccacctctttgatccatttcttgagcgattctaatgaaactttcggtgatctcacaaccaaaacctaccctttcgccttcatgttggcatcggtggggtatcttctgaccatgcttggtgattgcataatcgttagtgttacatcgagtagtaaaagagaagttagagtgcaagtgcaagtggaag

SEQ ID NO: 24878 - DNA, 380 bp, Gossypium hirsutum
  Clone ID: LIB3272-043-P1-K1-E3
cggacgcgtgggtcattatttacgttaagttcaaagaaatggctgatcgtgtggggactcgcgtccacaggctccgtgagcgtttggatgagacccttcttgctcacaggaacgagattttggccttgctctcaaggatcgagggcaaaggaaaaggaattctgcaacaccatcaaattattctagagtttgaagctatccctgaagagaacagaaagaagctcgctaatggtgcattttttgaagtattgaaggctagtcaggaagcgatcgtgttgcctccatgggttgcacttgctgtttttccaagggctggtgtttgggagtacattttcagtgattggtcactcccttgttgttgaggtactcactgttccctg

SEQ ID NO: 24879 - DNA, 308 bp, Gossypium hirsutum
  Clone ID: LIB3272-043-P1-K1-E4
ggggtggaaaggaattctgggttttgagtatggaattgttcaaggaccttgggggccggatattgctggtccggagctagttgctgctgttgcaaacgctggtggacttggccttcttagagctcctgattgggaatcaccagattatgtgaaagagttgataaggaagactcggaagttaaccgacaaaccctttggggttggtgttgttctggcatttcctcacaaagaatatgtttaggctatactagagtggaaggtagcattgttgctactgtattggggagaatgcttaaaggagccttgta

SEQ ID NO: 24880 - DNA, 239 bp, Gossypium hirsutum
  unsure (1)..(239): unsure at all n locations
  Clone ID: LIB3272-043-P1-K1-E5
cgaaaanagccccaaagcccaaccccnncccccanngaaannngaanaaaggaaaggggagggggcnggcnnncgcgaaacagaaaagacggcggcncgccaagaaagagacgcgaancccnanggggggccnngaagccgccggcaagacnaccancnngnanaagcccaagcacggggagaagggcacaaccaancccaccaaaggcgnnaacggggagaccggagaananaagaac

SEQ ID NO: 24881 - DNA, 401 bp, Gossypium hirsutum
  Clone ID: LIB3272-043-P1-K1-E6
tctcaaatctcctcctcctcctcagaaatcttagtatcatcaccatggcctcaaatcccaaggtcttctttgacatgactatcggtggtcagcccgctggtcggattgtgatggagcttttcgcagattgcactcctcgcactgctgagaacttccgtgccctctgtaccggcgagaaaggcgtcggccgcagcggtaagcccctccactacaaaggctcctctttccatcgtgtgatccctaactttatgtgccaaggaggtgacttcacggccggaaacggtaccggaggtgaatccatctacggatccaagttcgctgacgagaacttcatcaagaagcacactggtcccggtattctctcaatggctaacgctggtcccggaactaacggatctcag

SEQ ID NO: 24882 - DNA, 396 bp, Gossypium hirsutum
  Clone ID: LIB3272-043-P1-K1-E7
gagcaggaaaacaagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaagatatgcgatgaaagagtcgtcgtcgtcggagacaagggcttattcttcagcttgggcgcctgaccct

SEQ ID NO: 24883 - DNA, 402 bp, Gossypium hirsutum
  Clone ID: LIB3272-043-P1-K1-E8
ctctaagatatcactgcaaggaaaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaagagcccaccctcggcacctaaacagccagccacttgccccaaagatacactgaaactaggtgtttgtgctgatttgttgggctcggtgcgcgttgttgttggaccgtcgaggaccaaatgctgctcactcatttcgggtttggctgatctcgatgctgctgtttgcctttgcactgctattaaagctaatgtgttgggggttaacctaaacgttcctgtttcattggctttgctcc

SEQ ID NO: 24884 - DNA, 401 bp, Gossypium hirsutum
  Clone ID: LIB3272-043-P1-K1-E9
caacattttcatattgcttgcctagcattaggtcacctaacttttctgggtcattgagacttggaccaagtgggcaacctgtgaggatcaaatacaccccgttgctcaagaaccctaggagaccctcactttattacgtcaatttgattggaattagggttggaagaaggattgttgatatcccaccaagtgccattgctttcaatccttccactggtgctggcaccattattgattctggtactgtcttcacccggctagttgaaccagcctatgtagctgtccgggacgcattccggagacgagtaagggtggcgaacgtgacatctctgggtgggttcgacacatgttactcggtcccaatcaatgcaccgaccataacatttatgttttcgggcatg

SEQ ID NO: 24885 - DNA, 403 bp, Gossypium hirsutum
  Clone ID: LIB3272-043-P1-K1-F1
attttctttatcattattgaaggaaaaaaaaaaaggaggaattagaaacctaaattgaagaaggaaaagatgttgggaattgtaaggcaaaagatgttggaacagtcattgaagaagattccacccgccgtgtcggtgttgagaagttactcatctgctgcaaaacagatgactataagagatgcattaaactctgctctcgatgaggagatgtcagctgattcgaaagtctttttgatgggtgaagaggtcggagaatatcagggtgcatacaagataaccaaggggcttctcgataagtacggacccgagagggttcttgatactccaattacggaggctggttttaccggagttgcggttggtgctgcttactatggtgtgaagcctggtgtggagttca

SEQ ID NO: 24886 - DNA, 320 bp, Gossypium hirsutum
  Clone ID: LIB3272-043-P1-K1-F11
atcgattcatcagtcttcttctctgagtagaggttttggatttgtaagcgtttacaatgtcttcgtcctatctcccagcaaccactgactcaattgctctggccttagaagccaaaacaccatctgaagccatctcaatcctttaccgtgtactagaaaatcctgcatctgctcccgatgctctacggattaaagagcaggccataacaaatctatctgatcttcttagacaagagaaccgagcagaggagctcagaagccttctgacccaactgaggcccttttttgcactaatttcaaaggcaaaaactgctaaaatt

SEQ ID NO: 24887 - DNA, 400 bp, Gossypium hirsutum
  Clone ID: LIB3272-043-P1-K1-F12
ggcagcaaacagcaccattgttggtgttatcaacttcatcaccttgcttgtctcgattccagtcatcggagcaggaatctggcttgcaaacgaaccggacaacgcttgcgtgaagatactgcaatggcctcttataatactaggcacctcaatcgcggtcgtggcactgttaggcttcgtaggagggtgttggcgcatcacttggctcctcatcttttacctttttgcaatgttcatcctgatactagtgtttgcttgtttggttgttttaatctatgtgatcaccaaccagggttcaggtcacccagcaccaggccgcatatacttggaacatgaccttgatgatttttccggctggcttcgtcgaaaagtaacgaatccttacaagtgggatcggatt

SEQ ID NO: 24888 - DNA, 381 bp, Gossypium hirsutum
  Clone ID: LIB3272-043-P1-K1-F2
gattaattgatccatcaaagccctctgcgaaaatccctactttcaagtttcgatgcgatcgacgctgctggtgttccttctgccgattactgataaaggagaaatgccatcgcagaagattgaaactggccaccaggacacggtccatgatgtggccatggatttttatggtaagcgtattgctaccgcctcatcagacagcacaattaagatagttggggtgagcaacaacacacatcagcatttagcgactctgacaggtcaccagggaccagtatggcaggtggcttgggctcatccaaagtttggctctttacttgcttcttgttgttatgatggacgtgtgattatttggaaggaaggcaatcagaatgattgggc

SEQ ID NO: 24889 - DNA, 120 bp, Gossypium hirsutum
  Clone ID: LIB3272-043-P1-K1-F3
acgttacttgtacttgtgttagtcagagcctaatagacgaatgatgactctgctggggaacgagcagcgagagctactataggtagtcattgtaaaatacatgaaccgaaacgcggatga

SEQ ID NO: 24890 - DNA, 149 bp, Gossypium hirsutum
  Clone ID: LIB3272-043-P1-K1-F4
aaaatcgctaaagcgagatggctttgcagttatgggaaactgtgaaggagggggggacggcgtatacgggtctatttccggccactttttttacggtgccagctctgttatgggctggttactatttattaaaggggggattttggtta

SEQ ID NO: 24891 - DNA, 167 bp, Gossypium hirsutum
  Clone ID: LIB3272-043-P1-K1-F5
gggcggcggcacgcgcccgctaacatattacgtggggggaaaataactccaaccagacatggcttccaggctggggcatccggtgcggtgcttcttacctttaactatgtaggcttcacttcgggtagctctacctacgggccttgcccacacagcgcctacgagcc

SEQ ID NO: 24892 - DNA, 389 bp, Gossypium hirsutum
  Clone ID: LIB3272-043-P1-K1-F6
tgtggctcctctagtcctcactgcatcttcccagctacttcttttcctctctatgggtctctgtttcctttcatttcccatttattttgcttcattttcagctgttggaactgtgagtccttttgccatttcatgtgatcaacattttggtaaaaaaaatggtagcggagtcttggtttcgtagtttttggaaaattccgcggaggcatgaaggaggttctgagagagttgaaattggagtattagcatttgaagttgcaagcttgttgtctaagcttgggcatttatggcggcgtcttagtgataagcaggttagcaggttgagagaggagatcatggcttgtggtggcgataagaccgctggtcatttgaagttgcaggtttctttt

SEQ ID NO: 24893 - DNA, 379 bp, Gossypium hirsutum
  Clone ID: LIB3272-043-P1-K1-F7
gtcaaacagtacttgcgaggctacttttggtcggatctttcaggcgtttaagaattcagagcaccaaaagcaagccaaaccaacgctgttcgtccggcacggtcgaaccctggttttgcttctgctgctctccgggctttaatcctcttacatcgaaacagaaatcccaagcgataaataagacaaaaaagaagaagaagaagaagaagaatagataggaagagagggagataaaggaaggcatgggagatctcttcatatggcttatttctttcttcatgctaattgccctttttgttctcattgtttatcagctcatgtgcttggctgatttagaggttgattacatcaattcttacgactctttatcacggataaa

SEQ ID NO: 24894 - DNA, 394 bp, Gossypium hirsutum
  Clone ID: LIB3272-043-P1-K1-F8
caaaatatgatgatcagaaaacccattacacgacccttccccaccgtcaatatccccgactgggaaccgttaaatgattcggcggataactttctggctgtcggctttaactgcaatgcaccctgcagcccttgtcccgtagaataccttacggcgctccgccgttacctcccctcgaacgatctcgagcccgacacccttagtgacgactccgacgtacacatcatcgatgcattctcgtgcgatcatttccgtatgtacgagttcaaggtgaggaggtgtgctcgtggcaggtcacatgactggaccgagtgtccgtacgcccaccctggggagaaggctcggcggagggatccgaggaagttccattactctggatccgcttgcccggatt

SEQ ID NO: 24895 - DNA, 401 bp, Gossypium hirsutum
  Clone ID: LIB3272-043-P1-K1-F9
cagaaacagcatgggccggcgctgcttataacctcattctctacatgctggctagccatgttttaggagcttgctggtatcttctcgcaatagagcgacaagaagcatgctggaggactgcctgtgatgtcgaggatccatggtgtcagtataaattttttgattgccacagggttaaagaccctggcagggatacctggttcaagtccagcaatattactaacctatgcagtccaagttccagcttctatgtgttcggtatatatggtgatgccttgacatttgatgttacaacttcaccattcttcaacaagtacttttattgcctctggtggggtttaaggaacttgagttcactgggacaaaatcttgacacaagcacttatgtgggtgaaataatt

SEQ ID NO: 24896 - DNA, 375 bp, Gossypium hirsutum
  Clone ID: LIB3272-043-P1-K1-G1
cacccaaacctgactcatcgttcaacacggtcatgaacatggcatcaaaagacccagcaagggtcaagtacttgtcgagccttgtagcccaaaagaccactgcggttcccattgcttcaggccaacaagtcctaaacattggcaactatatcgtccgggtaaagattggcactccgggtcagctcatgttcatggtattgcacactagcaatgatgtggcttgcttcccatgctccggctgcaacaggtgctcagccaccactttctcacccaacacttcttccacctatggttcgttagattgcggtttgccccaatgcgcccaggtccgtgggctgtcgtgcccggctacggggtctgcggctcgctctttta

SEQ ID NO: 24897 - DNA, 367 bp, Gossypium hirsutum
  Clone ID: LIB3272-043-P1-K1-G10
gtggagagtttgtgccctggtgttggttcttgcgctgatattgttgcaggtgctgctcgcgattctgttgctgctcttggagggcctagctggatagttcttttgggtagaagagatccaaccactgcaagcttgagtgctggtaattccaacatccctgctccaactttggatcttagtggtctgatcactgctttttcaaacaaaggtttcactgctaaagaaatgggagccctctcaggatctcacaccattggacaagccaggtgtaccactttccggacaagaatttacaatgaaaccaacatcggctccaccctttgcgacatcgataagagcgaactggccaagccatggtggagacaac

SEQ ID NO: 24898 - DNA, 340 bp, Gossypium hirsutum
  Clone ID: LIB3272-043-P1-K1-G11
gtgaacggcacttgcacatgggttagtcgatcctaaaagacgggggaaggccgtccgacagcgcgtgcagcgcgagcttctaaagggaatcgggttaaaattcctgaaccgggacgcggcggctgacggcaacgttagggagtccggagacgtcggcggcggcctcgggaagagttatcttttttgtttaacggcctgcccaccctggaaacggctcagccggaggtagggtccagcggccggaagagcaccgaacgtcgcgtggtgtccggtgcgcccccggcgggccttgaaaatccggaggaccgagtgccgtccgcgcccggtcgtactcataacc

SEQ ID NO: 24899 - DNA, 401 bp, Gossypium hirsutum
  Clone ID: LIB3272-043-P1-K1-G12
ttcagactcactgaattgaagcagagaacgaagtaaaaattaaagttagggactcaccggtgatacagctgtaagtgctctattcccaactctctattcaacaagacaatggctccttccacgttggtacctacgtttggccttgttctttggttctagccaaattcggagagcgctgggcaccatctttgcccaccaccaccaccgataacctttattacgaccttcttggttatcacacccgtctgcgtcgtgccattaaattgggaactggttgtggagctgccgacttggctttccacctattgggtctccaagacatcattcttaccgatataatccctgatatgcctgcgctcaagcataacctaaaacgtaataaacccgttctgggaaagaac

SEQ ID NO: 24900 - DNA, 296 bp, Gossypium hirsutum
  Clone ID: LIB3272-043-P1-K1-G2
ctttcataaaatctaccgtaggtagcaacttataggatggcgagagtcaggggctcgcaagatacacttacgagcatgtacaatgcccctaagaggggcaaacgacaggtgatgatcaggcctacctcctaagcgatcattaagcttatattgttcatgcagaggcatggttctatcgcgagagtatagtattggcctgagcacagatcactgagacatgcgggtgaatcaaccgcggggctgctcaactatggcactaacactccttacatagatgtctgagacaaagagatcga

SEQ ID NO: 24901 - DNA, 375 bp, Gossypium hirsutum
  Clone ID: LIB3272-043-P1-K1-G3
aaataaaaccaagtaatcacattgacaaaagactttatttctgttaacagccattatgagtactgctggtcaagtcatccgttgcaaagctgctgtagcatgggagtcgggaaagccactgtcaatagaggaagtggaagtggcaccaccgcagaaggatgaagtccgtattaagatactcttcacttctctatgtcacaccgatgtctacttctgggatgctaagggacaaaatcctctgtttcctcgcatacttggacatgaagcttgggggattgtggagagtgtaggaaagggcgtcactggtctaaagccagggggtcatgttctccccaactttaatgggggaaagcaaggggtggccccatttgcttt

SEQ ID NO: 24902 - DNA, 205 bp, Gossypium hirsutum
  Clone ID: LIB3272-043-P1-K1-G4
tggcctctcactggtttccttcaaaaccctaatagctggcctctcctcctgaagggtgtcaaaaatggccgggtttcacggattgattctacatggcaccatgcgtgcccacaccgacatggtgacagccattgctcttcccatcgatgactccgacatgagcgtaactttctcccgggacaaatccatggtgcgttggcactta

SEQ ID NO: 24903 - DNA, 420 bp, Gossypium hirsutum
  Clone ID: LIB3272-043-P1-K1-G6
atcttgtgatttgagcttcgtgtttgtgttgggttaagcaattctccaagatgcggaaccaaagggggtcaaaaacataaatctttataatccccagaaaattttcgcccactaataggctgatcacctcgaaggatcatgcttctgtccagattaatgttgggcatttggatgagcttggcagatacactggaactttctccacttttgctctttggggctttgtccgcgcccagggtgatgctgacagtgcacttgacaggcttttgcagaagaagaaagctgaagtcccacagcactagtgggaggtggattgctttttactaattgcttgggacttttgaattttggagggaaaaatgggtttttttttttaatcaggggaccttttaaatttttacctagggttttttaaaatgg

SEQ ID NO: 24904 - DNA, 324 bp, Gossypium hirsutum
  Clone ID: LIB3272-043-P1-K1-G7
cgtcttcaagatctcagttctcaaatcgtagcgctcttttctatcaagccatggctctggtcttgcatgcaggaaaaacaaacaaaaatgcctttaaggcactcattgctgcagaatatagtggtgtgcaggtcaaaatggttgagaattttgagatgggtgtgtcaaataagactcctgagttcatcaagatgaaccctttggggaaggttcctgtgttggaaacacctgggggtcctgtatttgagagcaatgccattgctcgatatgttgctcgctcaaaggttaacaaccctatatgcgggtttacatagagtgcttatg

SEQ ID NO: 24905 - DNA, 387 bp, Gossypium hirsutum
  Clone ID: LIB3272-043-P1-K1-G8
cctctctcaaaatctcaaacccagatttgttctctctctctctctgtgtctatttacaatcaattaattcctccattggaggagcttacggtttggtggagttctggtctttgctttgtctgaaaaataaacagaattataaacgaacaccaacgccatgggaagatttgaagagagaggattcgattcagtggtttgccctaagcctatccgaacctttagatggtctaccaactgttatcagactgagatggctgattcaaaaactggtgcagagctttttgatataatcctccccgagggagggtatggggccgagaatcccaccaaccaaatgggttcatcaccaccgtatttctgtggatcaccctcgagcacggcgtcgaa

SEQ ID NO: 24906 - DNA, 389 bp, Gossypium hirsutum
  Clone ID: LIB3272-043-P1-K1-G9
gtagaagtacgcactctgatccttcattgcttagtgagatccaaaatcttgacctgtacaagtccgaacgtaatgaaacccaggaacacgtctttgctgagcttcctgcatgtacatctggatatcattcccaaggtgtattggcagatgagtttccacaccttgatataatcaacgacttgcttgatgaagaaaacaatgttgggagagcagttagggtaggaacagggttccgttctcttggcaactgttcacatttatttctaccggcaatttcttttccttccaatttgggcatgtcgggtgagatgggatcctcgaatggcgcatgcaggtttgaccgagcgcacaagttcaatgatgatggattccgacaagggtacagtact

SEQ ID NO: 24907 - DNA, 287 bp, Gossypium hirsutum
  Clone ID: LIB3272-043-P1-K1-H1
ccgtctagcgatgaacatgacgccacgtttgccgtcatcgaaagtggctccagcgtcgcggctggtgttggaccgttcttactccaccgaaacggaagctcaaaaggtggaaccgaaagcctccttcggcagcggcggcgccaacatgaaaaccttccaaatctattgatggaacccagataatgctacgaaaccccaacttcaagacttcaaaatcaacttaaaagaatgcggacccatggtgcttgatgccttgatcaagatcaagaacgagatggatccatcgc

SEQ ID NO: 24908 - DNA, 335 bp, Gossypium hirsutum
  Clone ID: LIB3272-043-P1-K1-H10
tttccatcccagcaaaagcctgaaacagtattaatcgtcgataaaatggaaggacaaggtgaagatgttaggctgggagcaaataagtacagggaaaggcagcctataggaacagctgctcaaacccaagataccaaggactacaaggaaccacctgctgcaccactgtttgagcctgccgagttatcctcatggtccttttacagggctggcattgccgaattcgttgccactttcttgtttctttacatcaccgctttaactgtaatgggtgtcgctaaatcttcaaccaagtgttctactgtagggattcagggcattgcttgggctttttg

SEQ ID NO: 24909 - DNA, 215 bp, Gossypium hirsutum
  Clone ID: LIB3272-043-P1-K1-H11
tcgggttgacatttgttcgagttatttggctataaaacccgtaaagcgcaagggagcttattggggggaattctttcgcggtacctcctcccaccaactttatttttttgagagggttcagtgggaaaatttctttttggacccccaaaagagggaaatttttctttgcggggcgaaacccaagggaaatcttggggggggccccaaagatattt

SEQ ID NO: 24910 - DNA, 270 bp, Gossypium hirsutum
  Clone ID: LIB3272-043-P1-K1-H12
tcgatattcttcattgtaccatattttacccttcaattttgtcagcaaggagggcttatgacgctttggtttgagattacttccaagacctgggctcccattatcctccaccaggttcattggtggactgggaggtgttgtcaaacaggtcattttatagggctgtcatagccgagtttattgccacgctcttatttttatacatcattgtggtgacagtgatcgggttcaagagtcaggttgaccctgatcagggcagggcccaatgtg

SEQ ID NO: 24911 - DNA, 312 bp, Gossypium hirsutum
  Clone ID: LIB3272-043-P1-K1-H2
tcgaattcgcgaagtatatggttatttctatagtgactatccttgtaaaggtgggagaggatcacacagatgttttgcatatactaaatgccatttatcataaaaatcattgagtatgcagactacctttctagaagatgttactgtctttgtgaaaatagttgattgagtgttgttatatatatcacactttgtggggattattccttagtcttttctattgtttttttaatatatacaacgttttaattgatttatttcttagagcttggaataatattttcgattggttttttaattttttaaatagtt

SEQ ID NO: 24912 - DNA, 62 bp, Gossypium hirsutum
  Clone ID: LIB3272-043-P1-K1-H4
taaaaatattatcagtataaaatttacaaatctaaggaacacaaattgaaatcgatgcacgc

SEQ ID NO: 24913 - DNA, 117 bp, Gossypium hirsutum
  Clone ID: LIB3272-043-P1-K1-H5
acgcgtacgcgtggatctaattacaaagcttttagatgcaaattctctattaagaccctggccgcaaagagaagatgttaggctgtgagcaaataacgacagggaaaggcagtctat

SEQ ID NO: 24914 - DNA, 280 bp, Gossypium hirsutum
  Clone ID: LIB3272-043-P1-K1-H6
gttttcttattttcctttgtccatatcttacccttctctttgtccaaaaaggagggattctccgccattaatatgagattccgatcaacacctgtgcacaaattagccgcgacggtgatctcggcggttatcttcctttttctgatacacggcgcccactgcttcgaccttcctggtaccgctaccgagatcttccaaaagataggagaagagagaaaaatttcgttagctcctcattgcggctcaaatccacccatattggaccctgacaggggaggtg

SEQ ID NO: 24915 - DNA, 290 bp, Gossypium hirsutum
  Clone ID: LIB3272-043-P1-K1-H7
gaagagccaaattataaaaaaggggtgctcctataacaatgttgatgctgggtgcatcttggtgatggactggtcttactccaccggaacggaatcttaaaaggtggaactcgaagcctcctccggcagaggcggcgccaacatgaaaaccttccaaatctatcgatggaacccagataatcctacgaaaccccaacttcaagactttaaaatcaacttaaaagaatgcggacccatggtgcttgatgccttgatcaagatcaagaacgagatggatccatcggtcacct

SEQ ID NO: 24916 - DNA, 319 bp, Gossypium hirsutum
  Clone ID: LIB3272-043-P1-K1-H9
cccacgcgtccgctaaagccaagaaagtaagccactaaggttttgagagaagatcaaaatggcttctaaaagatcatcttccatggtcctccttttggcactcaacattctcttttttttcctagtcagtgcttgtggctcttgctcttcacccacccctaaactaaggccaaacccaaaccccaacacccccactcctactccatctgcacgaggcaggtgccctagggatgccctcaaattaggtgtatgtgccaatgtgcttaacctattcaatgtcaccattggttcacccccaaggatgccatgctgtttcctt

SEQ ID NO: 24917 - DNA, 323 bp, Gossypium hirsutum
  Clone ID: LIB3272-044-P1-K1-A1
gctttggaagcatggacttcatagctactatcctgtttctagctcttgtcatggcctccaccaaagctttggacccttgcggccctcagccagatgactcggaccttttggtcatcccaatctatggcaaatgttcaccattcaacccacccaaacctgactcatcgttcaacacagtcatgaacatggcatcaaaagacccagcaagggtcaagtacttgtcgagccttgtagcccaaaagaccactgcggttcccattgcttcaggccaacaagtcctaaacattggcaactatatcgtccgggtaaagattggcactccg

SEQ ID NO: 24918 - DNA, 388 bp, Gossypium hirsutum
  Clone ID: LIB3272-044-P1-K1-A10
aaaaatgtctcttcactcttctctcaccatgtcattgctgtctttctgggtgtttgttgctgtttacttttagtgccaaagctattgttcctccatctgaaacttttaggtttgtcaacgacggagaatttgggccgtatgttgttgaatatggtgcaaattaccgtgtcataagcatagctaatgcccccttccagcttgcgttttataacaccacctctaatgccttcacccttgcgttacgcatggctacaacgcgttccgagtcgctcttccgatgggtttgggaggccaacaggtggaaccccgttcgcgagaatgccacgttctctgtcggaactgacgggacccttgactttcttttgccgatggtcggattgtttttcaa

SEQ ID NO: 24919 - DNA, 58 bp, Gossypium hirsutum
  Clone ID: LIB3272-044-P1-K1-A12
attttctgattattttacgagaatccggagaacaatcatctaaaagaagggctaaaat

SEQ ID NO: 24920 - DNA, 388 bp, Gossypium hirsutum
  Clone ID: LIB3272-044-P1-K1-A2
tcttcctcttcctcttactcttcctcttcctcttcctcttcttcacccaggggacccccgcccgaagctagggttactcttcttcttcgttctctctctgggttttttacattcctctttcttggggcattttagggttcttgaaatttttgcactcatttaatttttttattgttttctttggatctggatcagtgaaagaagttctctaatggatactcgtaaaaggggaagacgtgaagctgggttcaatgctaatggcggcatcaagaaatctaaaccagaattggaatctttatcaactggtgtaggaagcaaatcgaagccttgcaccaagtttttcagtactggtggttgtcaatttggtgagagccgccttttcctgcac

SEQ ID NO: 24921 - DNA, 387 bp, Gossypium hirsutum
  Clone ID: LIB3272-044-P1-K1-A3
cttccttcgcaaacaatattggcttactcttgttctttgttccactcctggggggcctacaagtggaacttgggggtgctgcaccatcggaaccaccccaagttcaaccgccccgcgcctatcgtcatctcatgctcctcctcctgcacattcgatccttcttcaaccactagttcctccaataacatctccccttcaccccaaaagaaccgtcgccttgccgatgagaatatccgtgacgaggctcgacgccaccggtccaccgccaagaacaccctcttcgccaaatatgttccggtcaacgccggtcccgactgcaccgagttctactccctcgacgagatcgtttaccggagtcgttccggtggattactcgacgtttaacac

SEQ ID NO: 24922 - DNA, 391 bp, Gossypium hirsutum
  Clone ID: LIB3272-044-P1-K1-A4
ttttaaattcattcattcattcattcacttcctctagtttcgtttccgtccaacgtaactaccacgccgaccgtcgtaaccaccgccgtaaattctcccaaaatggcgaaactacccttacagatcctcctcctcttcctcctttccctcatttcctcctccaccgcagagatcaaaaccctaaccatcacctccgactctcgccccatgatcctcttcgagaaattcggcttcacccactccggtcacatcgccatctccgtctcctccgtctcggtcacttcctccgccaatgcccccaatcccgacgcttcccgcctcggcttcttcctcttatccgaggaagctctcctccaagtcctcctcgagattcaacagaaacctcactttt

SEQ ID NO: 24923 - DNA, 400 bp, Gossypium hirsutum
  Clone ID: LIB3272-044-P1-K1-A5
atataattgaaagaaaagaaaaatggttctgctagagaaactttgggatgatgtagtggccggacctcaaccggaacgtggccttggccggctgaggaagatcacaaccaccccacccttgtccaccaaagatgaggcttcatcaatggcgatgccgacgagtccgacgacacctgggacaccgtcgacgccggtgtcggctcgtagggacaacgtgtggaggagcgtgttcaatccaggtagcaaccttgcaaccaaaggtattggcgctgaagttttcgacaagcctcaacctaactctcctactgtttatgactggctttacagcggggagacccggagcaagcatcaccgctgattgggcgatggctgacggcggcggagggtagcaaaaccacta

SEQ ID NO: 24924 - DNA, 400 bp, Gossypium hirsutum
  Clone ID: LIB3272-044-P1-K1-A6
ggagatcttaatgacaaaggtattcaaactagtgaagactacaggttttatgctatttcagctgagttcccagaagttaacaacaagggaaagactctagtcttccaattttctgtgaagcacgagcagaagcttgactgtggtggtggctacatgaagttgctcagtggtgatgttgaccagaagaaatttggcggtgacaccccgtacagcatcatgtttggccctgatatttgcggctacagcaccaagaaagtacatgccattcttacatacaatgggacaaatcacttgatcaaaaaggaagttccttgcgagactgaccaactcactcatgtttatacattcattctccgtccagatgctacctacagcatccttattgataatgttgagaaac

SEQ ID NO: 24925 - DNA, 389 bp, Gossypium hirsutum
  Clone ID: LIB3272-044-P1-K1-A9
agtactctcactgcctacaaatctgctcaggacattgccaacgccgagggggctcctactcacccgattcgacttggactggcactcaatttctctgttttctactatgagattctcaattctcccgatcgcgcttgcaatctcgccaaacaggcatttgatgaagcgatagctgagttggatactctaggcgaggaatcgtacaaagacagcaccctcatcatgcaactcctccgtgacaatctcactctctggacctccgatatgcaggatgacggggctgatgatattaaagaagcaccgaagcgtgacgaggaggagcaacaacaaaagccacagcagtagtgagagactgagagtcagcccggctcttactttcattatataat

SEQ ID NO: 24926 - DNA, 371 bp, Gossypium hirsutum
  unsure (1)..(371): unsure at all n locations
  Clone ID: LIB3272-044-P1-K1-B1
tacgcattgaggacgtctccgcaatggctcggtccacaaatcgaagtgatcggattcgcaaccaaatcgatcgaaagagagatcaattctgtcaacgacaaccctttgatcgacgtttcgaggaacaaagcattacatggtggcaatttccaaggtacacctattggtgtttcaatggacaatactcgtttagctatcgcagctattgggaaacttatgtttgctcagttttcggaactcgttaacgatttctacaacaacggtctcccatcaaacctttnngctagtaggaacccgagtcttgattatggtttcaaaggtgctgaaatcgcaatggcctcctattgttccgagctccaatacttagctaa

SEQ ID NO: 24927 - DNA, 329 bp, Gossypium hirsutum
  Clone ID: LIB3272-044-P1-K1-B10
cgcaaatatcacttaaccatgagcactgtcgcctaagtcatcttcttcaaaggggttttaacatccgaggatggggagcccttttaaatacagaaagagtgctcctacccaccctagacagatgactctcctattaagaactctccctacaccatgggacacctatgaccatctatggcctctaagaccaataccctcttattctggtaactccaacatcaatctcgatgcattgagtagagtcattgccaaaccggacattgttaagacagcttaaaagcaaaggctgatgttacctccaaacaccctggctgtatatacacttaacc

SEQ ID NO: 24928 - DNA, 366 bp, Gossypium hirsutum
  Clone ID: LIB3272-044-P1-K1-B11
aaaaatgtctcttcactcttctctcaccatgtcattgctgtctttctcctgttttgttgctggttactttgagtgccaaagctattgttcctccatctgaaacttttaggtttgtcaacgacggagaatttgggccgtatgttgttgaatatggtgcaaattaccgtgtcataagcatagctaatgcccccttccagcttgcgttttataacaccacctctaatgccttcacccttgcgttacgcatggctacaacgcgttccgagtcgctcttccgatgggtttgggaggccaacagggggaaccccgttcgcgagaatgccacgttctctctcgggactgacgggaaccttgtcttggctgatg

SEQ ID NO: 24929 - DNA, 347 bp, Gossypium hirsutum
  Clone ID: LIB3272-044-P1-K1-B12
gttgacctgagcgggaaagggaatcataaagggcatagtcactttaacagagggtttgatagtggggctgatacgctaaagtacaaatgatgcatgtggggctacaaactattctttagaagaacaactttagaaaggtctgtctacattaaggatgattgcctaatcatgaactggactggtggagcagtcacaactctgcttgagggaccaaaactgttttctattactgtcccgccatcagacatgggccaaaatcttacagctttgttataatccggaggtgggtgggatactgggtcaacgccgtcatgagacattcaacgcacataagttggatccttggt

SEQ ID NO: 24930 - DNA, 389 bp, Gossypium hirsutum
  Clone ID: LIB3272-044-P1-K1-B2
accctctcctatatattcaacctctacccctgccctacgcgtttttgtctaggatgagctctaactgaaacttacattcatccacttagccgtcatgccttcctcactgaagctccatccacctctcgccgccactattggcacctgcaaccagaaacaaaatcaacccatcacaaccagtaccgcgctgactaggtttttccctcttccttgcgggatctcgttgcctgacacggtggcgacgtaccatgtccacaccctgggacctaaccagtgtggttcagcagttgttcaagccatcgaagcccctatcgaaaccgtttggtcagaggttcgtcgttttgataaccctcaagcttacaagcaagttctcaagagctggcacatca

SEQ ID NO: 24931 - DNA, 253 bp, Gossypium hirsutum
  Clone ID: LIB3272-044-P1-K1-B3
atcaaagactagatgaataatcctttgggtatagcgtccacagaaaaatggggtggtcacagaggaggaggggcctaattaactcggacgggaaaccattctaaattgatcaatcggggacgcaggaacatgctacaaggaagccttatagcatggacgaatgctctaataacagggtaccggtgtctaatggatcgagctagatcttacatagggtgagcgtatgctggatgaaacgcggaaaggctactaa

SEQ ID NO: 24932 - DNA, 366 bp, Gossypium hirsutum
  Clone ID: LIB3272-044-P1-K1-B5
aaaaatttataataatgtaaatatattcctttcacctaaatttattaagcggaaaaaaaaaaaacaggcatagatgtgttatgttagtctggtcgattccaagtctaagttttggtcgatttcaagtctaagttttgaattaaaatattttcaactcaaattcttttgaatattttggaaaacaaaaagaactttgaaacataaacaaatcattcaatgttgtactaatctaatccagcattttccacgtttaagcatagatattcctatatttaatgcttgtaatcctaaaattgtatattgaaagtgggagtcaactttttcttttagctttttggtatttccaatcccacgctactctaaaac

SEQ ID NO: 24933 - DNA, 391 bp, Gossypium hirsutum
  Clone ID: LIB3272-044-P1-K1-B6
agcacttttccatctttggtaccttttttcaaccttcattctcacctttgggggctcctttggttggtgctgtgaaaacaaccacactacacacactttttttttttatatccattcccaaaattcattccttttcggaaccataatcaaggtttccggaagttaacaacaccttttaattggttctctttggccccaccccaaaaaggaggaggcgggaggttccagaaatgggctcaactacaatttccactgagatattcctcctgttttgtctcttattctctccaggtcgaggtgtttcaaagaaggtcgatatatctagtgaacaaaaggacataacaactccaataacaacgatgccaacaataattccaaccacgactcctac

SEQ ID NO: 24934 - DNA, 393 bp, Gossypium hirsutum
  Clone ID: LIB3272-044-P1-K1-B7
gattagtattactcaatgacgaccctaactccaaataacccagactccgtgtatgcttttactgttaaggatgctgagggaaacgatgtggatctcaatatttaccaaggaaaagtgatgttgattgttaatgttgcttccaaatgtggaatgacaaattccaactacacagaactgaaccaattatacgagaagtataaagatcaaggcttggagattcttgcttttccgtgcaatcaatttggagaggaggaaccaggatcaaatgttgagatttctgaatttgtttgcacctgctttagatcggaattccctatctttgataagattgaagtaaatggtgataatgcctcttcactgtacaagtacttaaaggtggtgaaatggggaatt

SEQ ID NO: 24935 - DNA, 343 bp, Gossypium hirsutum
  Clone ID: LIB3272-044-P1-K1-B8
aaaaaatttacagagcccacctccccattttttgttcttttcctctgctgggttttcaaagcctagcttgcgtagaaataaaaagaagcaaaataggttgtcaatttttctatgctagggcaaaagaggtagcccatccttgcagctgctccgttgtgtgcacaccaacgatggcggccggaaaaaaaaatcaacggctttgaaggaggtaatgggatggagcatatgagccaagcctccggacgaatcgcaagtggagcgcccgaagaggagcggcggtagctcttaggctaaggtttcttttttttttgcgctgaaagtaaacttatgggctttcaagcta

SEQ ID NO: 24936 - DNA, 393 bp, Gossypium hirsutum
  Clone ID: LIB3272-044-P1-K1-B9
caaaaccctaacggctacagctttagaattcaagcctttcgaccatggcggatgttgagacggaggtggcggcggctggagtgcccaagaagcgaacattcaagaagtttagcttcagaggtgttgatttggatgctctccttgatatgtccactgatgagcttgtcaagctctttcctgcccgtgctcgcagaaggttccggaggggtctcaagagaaagcccatggctttaatcaagaaacttcgcaaggcgaaaagggaggctccaccaggtgagaagccagaaccagtcagaacccacctccgaaatatgatcatagtacccgaaatgattggtagcattatcggtgtgtacaatggcaagacattcaatcaggttgagatcaagcccg

SEQ ID NO: 24937 - DNA, 401 bp, Gossypium hirsutum
  Clone ID: LIB3272-044-P1-K1-C1
tggcaaccttagaaggattgagggctcgttcatcccataaacaagagatcctggatattgacaacgaagacgaagagtgtaggccttggcgtcgaaggttctcaatggctttcacctggggttcctctctcaggatcactcttcttctcctccttattgctgctattgttttcgcttgtttcaccctccctgttgaaaagattctgaaggattttttgttatgggttgacaaggatcttggaccttggggtccacttgtgctggctgttgcttatattcctttgacagtcttggccgttccagcttcagtgcttacccttggtggtggttatctttttggattgcctgtgggctttgttgcggattctattggtgcaacccttggtgcgggagcggcattc

SEQ ID NO: 24938 - DNA, 396 bp, Gossypium hirsutum
  Clone ID: LIB3272-044-P1-K1-C10
caataattcaaccctcaaaaagcccatatccatggctacgttttctcctgctcctctacctacatctttctctgtcagaccacacttaacccacaattcaagtctttctctccctttcaagagaccctttcttctactatccactattcccaagtctttaccagacaatggagctggggtttccgcttctgttgctgctgtcgaagacccagcatccaaccagattgaaaacgccgcggaagtctctgctgggtctaacggagcggctatggccacatcggctgcaaatgctgaggtttcgagcaagtttgatgaccctaggtggattggaggcacttgggacttgcaacagtttgcaaaagatggaaccactgactgggatgctgttattgatgc

SEQ ID NO: 24939 - DNA, 362 bp, Gossypium hirsutum
  Clone ID: LIB3272-044-P1-K1-C11
aaaaaaattgagtgtcagtttgaaagtgttcttcagatatggctatgaagcgaggttgctaattctgctagcaaagcaattgccaattctgggtcatcctctcttcttaccagacaactgcatgcttctccagggagcaaaaagattgtgggggtgttttacaaggccaatgagtactttacgaagaatcccaactttgttggttgtgtggagggagccttggggttgcgccaatggctcgaatcacaggggcatcagtatatcgttaccgacgacaaagaaggaccgggctgcgaacttgaaaagcatatccctgatctccatgtgctcatatcgaccccattccacccggcttacgttac

SEQ ID NO: 24940 - DNA, 357 bp, Gossypium hirsutum
  Clone ID: LIB3272-044-P1-K1-C12
tgttgattctttgtgcaatctgggtattaaagaaaaaggcccgtttcgtggggttatcagcttctgataggcaattcttgtatcgcttctctctccctatctcttctccagccttcattccatctccagctcattgaaaaaagcacgcgccggttcggagattgcttgtgcttcctattaagtgttcatcttcagggccgagtcaagacactgagtcacaagctggcacgacgtccgtgccatcctctccttctcttcctagctcattggcctcgagcaatcccacgtataattgccttgcttggatcggtgccacccagatcattcaaactgcttactcgacttacctcatgctct

SEQ ID NO: 24941 - DNA, 378 bp, Gossypium hirsutum
  Clone ID: LIB3272-044-P1-K1-C2
ccacaatcgaaacctttaggcggcgactactactcgagcttcataacacacggagcttttaactatggcgggtgtagagacggaggttgcggcggccggtgtgcccaagaagagaacattcaagaagtttagcttccgaggtgtcgatttggatgctctccttgatatgtccactgatgagcttgtcaagctcttccctgctcgagctcgcagaaggttccagaggggtttgaagagaaagcccatggctctaattaagaagcttcgcaaggcgaaaagggaggctccacctggtgagaagccggaaccagttagaacccacctgcgtatcatgatcattgtacacgttatgattgggggggttaaccttgtgtacaa

SEQ ID NO: 24942 - DNA, 392 bp, Gossypium hirsutum
  unsure (1)..(392): unsure at all n locations
  Clone ID: LIB3272-044-P1-K1-C3
gctgagcatctggtagctttctctttgttcctccaaactgtgtgcttagatttgaagacctagtccctgtgaacaaatcttgttgttcatttctgggtttaatttctcaagaaaaagaagatgacaaaagataggcaaatcggtgtagcaatggatttctccaagggaagcaaagcagctcttaaatggacaatcgacaatctggtagacaaaggggataccctttacctcatccacgtcaaacccaatcagagcgacgagtctcgtaaccttctttggtccaccagtggctcacctttgattccattatcggagttcagagagaaggaagtgatgaaacattatgaggtggaacctgatcctgaggttntagacttggttgatacggcttc

SEQ ID NO: 24943 - DNA, 389 bp, Gossypium hirsutum
  Clone ID: LIB3272-044-P1-K1-C4
gataaattagatgtactagtgaaaaagtgcaattccttttcatcattgacctatgttgctgtcaacaaaaaggggaatttgttatcaaacattggcctcacagatgtgaatgcagtaacttggggagtcttccctgctaaagaaataatccaaccaactgtggtggatcctgccagttttgtggtgtggaaggacgaagcatttgaaatctggtctcgatcatggtccgccttgtacccggacggcgatccttccaagaatttgctcgaagagattcagagcagctactatttggtgagcttggtagataacaattacatggatggtaatatttttggtgtttttgaagatctttgaagatgagacttatgcttatgattttatgttta

SEQ ID NO: 24944 - DNA, 341 bp, Gossypium hirsutum
  Clone ID: LIB3272-044-P1-K1-C5
acgcctgcataaaaaattgactctcacaaagaaagtctcctggatttattcctctcaaggaggtccataattgggggggggaatcaaaccacacttaacccacaattcaagtctttctctccctttcaagagaccctttcttttactatccactattcccaagtctttaccagacaatggagctggggtttccgcttctgttgctgctgtcgaagacccagcattcaaccagattgaaaacgccgcggaagtctctgctgtgtctaacggagcggctttggccacatgggcttgatatgctgaggttttgagcaagtttgatgaccctaagtggattggag

SEQ ID NO: 24945 - DNA, 310 bp, Gossypium hirsutum
  Clone ID: LIB3272-044-P1-K1-C6
caaaccgaccccccccccaatttcgtagtaaacaatggctgctgcatcaccagcaattgcatgatcgccacagacattatcattctatttgaagaaaacccatctaagtatgttaccctcccatttacatggccgtactgctcgaagcaatgacctttttttaaggtcaaaagtcgaaaagcgggagtatgatccaattccttctagccgaactagagcttcctcaaatgggtatcttaatgcagctcatacaagcagagaagatgaaatattgccttcttttggggaggctccagtgaacatcatcttc

SEQ ID NO: 24946 - DNA, 383 bp, Gossypium hirsutum
  Clone ID: LIB3272-044-P1-K1-C7
aaagatatcactgcaagaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaaaagcccaccctcggcacctgaacagccaggcacttgccccagagatgcactgaaactaggcgtttgtgctgatttgttgggctcagtgcgcgttgttgttggaccgtcgaggaccaaatgctgctctctcatttcgggtttggctgatctcgatgctgctgtttgcctttgcactgctattaaagctaatgtgttgggggttaacctaaacgttcctgtttca

SEQ ID NO: 24947 - DNA, 398 bp, Gossypium hirsutum
  Clone ID: LIB3272-044-P1-K1-C8
gctttttcagttcttttactttggaaatctaaatcataaacagaatcatggccgccaaccatgccgccgaagtttgacccgacccaagtcgtcgacgtctttgttcgagtcgccggcggtgaagttggagctgccagttcactggcacccaaaattggtccactgggtctctcgcccaaaaaaattggtgaagatatcgcgaaagaaaccgccaaggaatggaagggtttacgtgtcacagtcaaactgactgtgcagaaccgtcaagccaaagttatggtggttccctctgccgccgctttggtcatcaaggcactgaaagagcctgagagggatcgtaagaagacaaagaatattaaacataatgggaacattagcctcgatgatgtgatagagat

SEQ ID NO: 24948 - DNA, 220 bp, Gossypium hirsutum
  Clone ID: LIB3272-044-P1-K1-C9
ctcatatcttacctggatggccccaacgctaggccgtatgcagacatgtgaggcctagagggatcaaataaaaaccaaaagaaaagtgtggtcctctgcaaatctaaaggcgaagaatgggattatcttgagcaccatattggaggacatgacgacattaatctgccatacagctatagtttgatcgaaggttggcccttgagtgacacgctctggaaaa

SEQ ID NO: 24949 - DNA, 355 bp, Gossypium hirsutum
  Clone ID: LIB3272-044-P1-K1-D1
gctgctgcaaattatctctcgtgggaaacagtacctccggttccaactggaggtcaaaaatatgtcaggggaagaagttgcggttgcccaacccgaggcggcgcctgcactcggtgagccaatggacatcaacacagccttgccccttgaggttaggaagtcacgagctcacggagggctcgcacggggcttgcatgaagctgccaaagcgatggaaaagcacattgcgcatctttgcgttatagctgatgactgcgaccagccggactatgttaagctgatcaaggcactttgtgctgatcataatgttaaagagctacgtgccccgagcgcaaaaacactctgcgagtgggct

SEQ ID NO: 24950 - DNA, 334 bp, Gossypium hirsutum
  Clone ID: LIB3272-044-P1-K1-D10
agctttttcgcaatcctctgttgtcaatggtactgggttgagtcattatgaaggaggaaaatttcagttgctggtcaataacaatctggcaaggatgctagcattaccctcaacaaggttgcttctattgtttggagaatcattaccctcatctaggctacctaatgtgtctaggaaagtttggggccagaccagtgtacggtttgtgagtcaagttaatcctgataatggacctctcactctttccagccttggtttcaaaagtggctttgagaaaacaaacaagatcaaagcggataaaattgaaaggcttgatgttcctagtgaagcacct

SEQ ID NO: 24951 - DNA, 398 bp, Gossypium hirsutum
  unsure (1)..(398): unsure at all n locations
  Clone ID: LIB3272-044-P1-K1-D11
ttttcaaatccctaatcccctctgctaaatgccgattcatcttcaccatgggggactgttcgagcctgaaggaatcttagcccgaaatccctcctcaactccgatttcgacgaagaagggagaagaaatccatggcttgctcgcacggtaaggtcctttcctcttcactttatttgcttttgaaataaaataaaataaaaaaacaaaacaaaacaagagaataatcacaaaaagaaagcccgtagatttagatcggaaaatcaccttccgatattggttgtctttttgtattgcctattgtgcgtccaaaaaaatacaatgatcaaatgcttttgctttatagccgaaaatgatnganaataaataaataaaaatacaaaattctttcttttgcttcg

SEQ ID NO: 24952 - DNA, 370 bp, Gossypium hirsutum
  Clone ID: LIB3272-044-P1-K1-D12
ggaaaatcgctgcccggcgcaaccaagcttgaacatctagcaaaggttagcggcgccgcccaccatcttaacacaactgggaaaaacccaaaacccactactctgaaccggcggattataagtgaagacaacatacccaattccaagaagaagatggagagctccagtgccagtcaacgcctgccactttccgaagtcgtctccgattgcgttaaacgttggttcaaagatactctcaaggaagccatagccggcgacgttaacatgcacgttcttgtgggtcaaatgtattatagcggttatggtgctccccgagatgcccaaaagggaatgatttggatgacaagggcgtgtaggctgcggtcttctg

SEQ ID NO: 24953 - DNA, 310 bp, Gossypium hirsutum
  Clone ID: LIB3272-044-P1-K1-D2
cggacgcgtgggttcgaagtcgtagctttggaagcatggacttcatagctagtatcctgtttctagctcttgtcatctcctccaccaaagctttggacccttgcggccctcagccagatgactcggaccttttggtcatcccaatctatggcaaatgttcaccattcaacccacccaaacctgactcatcgttcaacactatcgtgaactttgcatctttagacccatcttgggtcatgtacttgtcgagccttgtagcccaaaagaccactgcgcattgccttctgttcatgccaacaaatcctcaaca

SEQ ID NO: 24954 - DNA, 285 bp, Gossypium hirsutum
  Clone ID: LIB3272-044-P1-K1-D3
ttataagtctccatctaacctgattgattacgcactagatctctattaaagcggcgcataccaatataataactaatctaatcccacaaaaaattgcataatcaaactccactgaaatactataataccaaattctattaaatctttttaaatcccaaaaccatttaaccaaataattaactcaagactcatagaaattctttaatcaataatcattctaataaaggcgatgatccttataagttctaaaaattggctcaagcttatgaggtgctgagtgaccca

SEQ ID NO: 24955 - DNA, 393 bp, Gossypium hirsutum
  Clone ID: LIB3272-044-P1-K1-D4
gaagtttcctttctcgattttctatttagccaaacaagatgcagatcttcgtgaagactctaaccggcaagacgatcactctcgaggtcgagagctccgatacgatcgacaacgtgaaggccaaaatccaagataaggaaggcatccctccagaccagcagcgtctgatcttcgccggaaaacagctcgaagacggccggaccttggccgattacaacatccaaaaggagtcaactctccacctcgtcctccgtctgcgcggtgggatgcaaatcttcgtgaaaaccttgactggcaagacaatcactctcgaggtcgagagctccgacacgatcgacaacgttaaagcgaagatccaagacaaggaatgcattcccccagaccagcaacgtc

SEQ ID NO: 24956 - DNA, 298 bp, Gossypium hirsutum
  Clone ID: LIB3272-044-P1-K1-D6
gaaatatgggaccatgttggcgatgtgaacgacacaaacagtggtcacgtggttgccaccacaattggaggcaaaaatggtgaggccaaacagaccatcaagtatctggccagagcgcgtaggcggcaccaggatcttttgggattgctttgcaagcaaaatgcttggaaacgggagagactgtggctataaaaaaagttctgcacgacacactatataaaaatcgtgaactgcacatgatgcgtgtgctggatcatgcaaacgtgattgcctcgaagcactgcttctttcacacgac

SEQ ID NO: 24957 - DNA, 361 bp, Gossypium hirsutum
  Clone ID: LIB3272-044-P1-K1-D7
tatcaacctggtgggcattgtggctggcgtatcatatgctataaacaggggttaccaatcctggggtcctctttttggcaagcttttctttgccatctgggtgattgctcatttgtatcctttcttgaaaggtttggtgggtcgtcaaaatcgtacccctacaattgtcatcgtctggtctatacttcttgcttccatcttctcattgctgtgggtgcgtatcgacccctttacctcataagctacaaaagctgccgctaatggtcaatgtggcatcaactgctagtttcattttcggatcattttattccggtaaatgctctctccttcaagtggctattgtgttattaccaaagagaaa

SEQ ID NO: 24958 - DNA, 370 bp, Gossypium hirsutum
  Clone ID: LIB3272-044-P1-K1-D8
gagagtcgtttgtctgatgctgagacagtagctaaatcatttcctcagtggtctgtttctttatctgtgatatgtccgaagcagctttcaaagctaaaagcaatctacagtgctggaaagagaaacccccgagcatcagatccacctgttgacaatgttagaaaccctcagtttcttgttctgatttcagaaaattttatggagggctgtgctgctttaagtcgctctggagttccaagtttagcacccaatcagagtcctgtgaaaatggacatggcttctgtcaatgcggttgcagggacacctccgacttctgttccatcagtgaatggatctattatgagccggcaacctgtttctgctgtaaatg

SEQ ID NO: 24959 - DNA, 391 bp, Gossypium hirsutum
  Clone ID: LIB3272-044-P1-K1-D9
tctaaagccaagaaagcaagccattaaggttttgagaaaagatcaaaatggattcaaaaagatcagcttccatagccctccttttggcactcaacattctcttcttctccctagtcagtgctaattgtggatcttgttcttcttctggctctaacccaaggccaactcccacccctactccatcagcacgaggtaggtgccctagggatgccctcaaattaggtgtatgtgccaatgtgcttaacttagtcaatgtcaccgttggttcacccccggtgatgccatgttgttcccttcttaatggtcttgtggacctcgaagccgctgcttgcctttgcaccgctatcagagctaacatcttaggcatcaaccttaacatcccagtttccct

SEQ ID NO: 24960 - DNA, 296 bp, Gossypium hirsutum
  Clone ID: LIB3272-044-P1-K1-E1
ttcccccccatatctctcatcatcatcatcaaagttttcatatttcttcaaagtaatccctttttcttcatacaaaacccgccattttcaatgggtaattccaggttcaagttatcagacatgttccccaatgtctggttctacaatctcaaagacatgaacaaacccatacaccatgaaaaaaaacaccaccacccatcatcatcaaaacatgaataaccccattttaatcccagaaaatcctatcattttactagatagcttgttcctattcatgtttccccagatcaaccact

SEQ ID NO: 24961 - DNA, 359 bp, Gossypium hirsutum
  Clone ID: LIB3272-044-P1-K1-E10
acccttccgaaattaattaattacaaaatggttattagccgagaccaagatcgattctggattacaacttttgtcattccaaataaagggactataatcaaaacacccaaagagtttatatataaccaacatactctgcttttcaagaactcatatatcatagagttcttcctttttgccttttccgacccagcaaggcacatatacaacagggagaggctccatgtctctgctgtcctctcaccatcagattccaattaaaattatgctcatatagacaacaaaaaagagggctttggttttaaattaatattacaaataataaattggggcctatactctagatctacgctctcgaa

SEQ ID NO: 24962 - DNA, 336 bp, Gossypium hirsutum
  Clone ID: LIB3272-044-P1-K1-E11
caaaatttaagcttagagcttttttgtttgtgatttgatttaaaatgggggggttagagtttgagaacaagaatttaggcctcaagcacctaaacttcgtcagggtggctacaatccacgccttggtttgcgtctcgaacctttacgattactctaaacagatctcggggccgttgagatccaccgttgacaccgtcgagcatgccgttaccactgccgtcggtcccgcctacgggaaatttaaggatgttcctgatcattttcttggattgcttgataacaaggtagatgaggtttcacacaaatttgacgagcatgctccagcaccagccaagc

SEQ ID NO: 24963 - DNA, 308 bp, Gossypium hirsutum
  Clone ID: LIB3272-044-P1-K1-E12
ctaagtttatgcttacatattcttcgaaaccgtatccaacgaaactggggggtgtcacaggctgataacataaatgccggcctcactcacataaacctggtcaggtcgactgcaatccacaccttggatctcatcatcaacctttccgatttctataatcagaactaggagccgatgaaatccaccgttaccacggggatgcatgccgctaccactgccgctggtcccgcctacaggaaactcaaggttctacctgatcatcatatcgaatctcttgttaccagatttagtgaggggtccacacaaat

SEQ ID NO: 24964 - DNA, 260 bp, Gossypium hirsutum
  Clone ID: LIB3272-044-P1-K1-E2
cttgggttgagtgtaaaaatgaggtaaatcatgggtgccaaagttcttgaagatgttgctttgctttccttttcacctgactctgcatttgcacaggatgaggaagaccaaggtcttgttatgaacttctacaaggattcttgtcctcatgctgaagacattatcaaggtagccgttgagctactgtacatgcgacagaaaaacactgtttttatttgtctgagaaacattttccatgactgtgctgtgcagtcatgtta

SEQ ID NO: 24965 - DNA, 384 bp, Gossypium hirsutum
  Clone ID: LIB3272-044-P1-K1-E3
ctttcattttgcttagttcttgttaaaaagaaaatgtgtgggattttagctggtttgggctgttctgatgattctcaggcaaaaagggttcgagtgctggaactttcccgtaggctgaagcaccgtggtcctgactggagtggcctctaccaacatggagactgttatttggcccatcaacgccttgccatcattgatcctgcttccggtgaccaacctctctttaatgaagacaagtctattgctgtcactgtcaatggagagatttacaaccatgaagaactaaggaagaagttgtcccaccacatgttcaggactgtcagtgactgtgatgttattgcccatctgtatgaggagtatggtgaagactttgtggacatgttg

SEQ ID NO: 24966 - DNA, 196 bp, Gossypium hirsutum
  Clone ID: LIB3272-044-P1-K1-E4
gaagaatggggggggggaacgccgccgccagaaatcaactaatcacatagtgttgatgagcggagacaaatatcgggcgggttacagcttttgtcattccaaatgaaggtactataatcaagacacccaaagagtttatagatgaccaacatcctcggctttgcaaggacttagatttaatggaaattcttccttt

SEQ ID NO: 24967 - DNA, 216 bp, Gossypium hirsutum
  Clone ID: LIB3272-044-P1-K1-E5
atcaatggcactcctgaatttgttcgttcttcacttgaggctagccttcagcgcctcgatgtggattatattgatctttactatataatcagagtagaccgcaagactcctatagaagatactatggaagaactgaagaagtcggtggaagagggaaaaataaagtacatggtatatctgaagctagcccggaacctataaggagggcacaccctg

SEQ ID NO: 24968 - DNA, 178 bp, Gossypium hirsutum
  Clone ID: LIB3272-044-P1-K1-E6
ggagacgattatgaacataatagtagcagtgatgaaggaaggaaagaggtgggtgtttaccctttaagttgttactattttggatctaaagaagccatcgttttcatggttgtaacggtttcagctcggatttctaggacgaactttaagtattctgctaatcgaaagaggacgccgt

SEQ ID NO: 24969 - DNA, 288 bp, Gossypium hirsutum
  Clone ID: LIB3272-044-P1-K1-E7
aaaagccctaattcgacagctctctcaggctctgattttgaccgataacgatgtcgaggagaaaggtctgggatcccaaggtggagaatactaccctcgggccagctgtccaagatggcgagcatgttttagggggggctcacattttggcttcatctaatgacacatttattcatgtgacagattcgtctggaagggaaacactggttcgcattcccggttgcttgatcgtgaaagctgaatgggatgagtgttccccttatgctgacatgctcgcatgacaagatg

SEQ ID NO: 24970 - DNA, 320 bp, Gossypium hirsutum
  Clone ID: LIB3272-044-P1-K1-E8
tcgccgccgcctgaatatctgtctcgatatctctgaaccaacaagcgtggagccttaccctgcgagagagaccatgtaggcataccagaacctcatctgccgtgacgagcttctgtttgactcattcccctacagggcaatcgagaatgggaccgctagaacaagttgaggcaatgcggacatgtgcaaggagctattgatgtagacattggtgccaatccttcagtcaacgatgccgctgaggctgaaggtgtcgatgaccaatctgagaacgttgtcgacattgctgacacttacaggcttcaggagcaaccctcttt

SEQ ID NO: 24971 - DNA, 348 bp, Gossypium hirsutum
  Clone ID: LIB3272-044-P1-K1-E9
gcattttataactgtccaaaacctgtcttttctttgtctttttttcttgtgaagttcaaaatgtgtagggttaattcgacaagtatagcatttcttactgttttgctgatatgtttttcgagctttgaggtgacgtatagtgctcgggtaggcacacagtggaggaagcatagcatagctggtggtttccgccgtctaatggcgaagggaggaagctctgacgttgtagccgacgccactaccacctttaatgtgttggactacggcgccaaaggtgatggacgcacagatgactccaaggcattcgaagcagcatgggctgatgcttgtcaagttgaggcatcaaca

SEQ ID NO: 24972 - DNA, 302 bp, Gossypium hirsutum
  Clone ID: LIB3272-044-P1-K1-F1
gcgaaaccacatccaaaggaacggtcttggcataatcagcggggaaagaaaagcgtgtttagcttgactctagtacaactttgtgaaatgacttgaaaggtgtaggataagagggagctctcgggctaaattgaaataccactacttttaacgttattttacttattccgagaatcgtaggcggggcacggctccttttttttggacccaaagccatctttttccggtcgatccattcataagacttttttaggtggttagttatttcttttgcggctcatatgttaaattataacgcattt

SEQ ID NO: 24973 - DNA, 234 bp, Gossypium hirsutum
  Clone ID: LIB3272-044-P1-K1-F10
aatgagctcactttttccttttccctctttcgagaccctacttttgggaagtgggtagtcttggatctaactaccaacaaattctttataaaatttcaacctcttttagagatctcactagactacctcctcaagctcataccaatttttgtatccgtatactcccataatcaaggccttttatcctcttcccgacccatcccccgtatttctaaccttctatccaacctatcc

SEQ ID NO: 24974 - DNA, 406 bp, Gossypium hirsutum
  Clone ID: LIB3272-044-P1-K1-F11
caaatcttgacatatggtgagaggaaacccgaggagcatctcttgaagggggtcaatgaaattacaccaaaggatatttcttcagtagccaaaaagcttctatcttctaatctcacaatggcatcttacgggaatgtcattaacgtaccaagatacgatcccattagcagcaagttcaagggaaaatgaaaaactgctttgttctgtcgaacttgggtattccatctgtctttcaacagtattattatgcatctgcatatcttaaagagttgtttttcatataaatgatgcggatgaaaatatgaagttttaagctcttctattttgaacaaaataaattactggtctctagctagtgagcaaaacatattagttaaaaataatagcttctgcaaacaatggggtt

SEQ ID NO: 24975 - DNA, 356 bp, Gossypium hirsutum
  Clone ID: LIB3272-044-P1-K1-F12
cttcaattcctcatttcaagggagagagtgtatcagtgtttcttcccctgtttacttaatttctctccgccatggctctctccgtcgagaaaaccgccgccggccgtgagtacaaggtcaaagacatgtctcaggctgacttcggtcgtctcgagatcgagttagctgaggttgaaatgcctggtttaatggcttgtagaaccgagttcggccctgcccaacctttcaaaggagccaaaattactggttctcttcacatgaccatccaaaccgccgttcttattgaaacccttaccgccctcggagctgaagtccgttggtgttcttgcaacattttctctacccaagaccacgct

SEQ ID NO: 24976 - DNA, 363 bp, Gossypium hirsutum
  Clone ID: LIB3272-044-P1-K1-F2
gctttggaagcatggacttcatagctactatcctgtttctagctcttgtcggctcctccaccaaagctttggacccttgcggccctcagccagatgactcggaccttttggtcatcccaatctatggcaaatgttcaccattcaacccacccaaacctgactcatcgttcaacacagtcatgaacatggcatcaaaagacccagcaagggtcaagtacttgtcgagccttgtagcccaaaagaccactgcgggtaccattgcttcaggccaacaagtcctaaacattgtcaacgatatttcccaggtgaagatggtcactccgggtcagctcatgttcatggttttggacactagcaatgatg

SEQ ID NO: 24977 - DNA, 220 bp, Gossypium hirsutum
  Clone ID: LIB3272-044-P1-K1-F3
attcggggggcgaccacgcctgctctcaatttccccttcttcagagccgcattactcctttaaaaagcaacactgaatctctatattctgacacaaaattcctccaagaaaggacaacaggaagaaaaaaaagagagagagaaaaatacatcctttttaccctacgactccatatataagcaagttaaaataaatatttgttcgctcttgtccttacttt

SEQ ID NO: 24978 - DNA, 403 bp, Gossypium hirsutum
  Clone ID: LIB3272-044-P1-K1-F5
cggggggggtccacacccgccgggacacatgagcttcactattttcctttgtccctttcttcgagtgccgcagctctttttctaggggtttagttctttgactctaacctaacgcatgattattatagaaaatgtcaaggtgctttagagatgtcactagacgatctcatcaagcgcagccgtaagtctggatccggaaactcccggggtcgaggccgtgggtccacggagggacccgcccgccggattcctaaccgccgatcgaaccgcttcgcaccctattcctgtgctaatgcgccggatacaacgtggcagcacaatatgtattcggataagggagcaacgttgcaaggacaagccggtctggcctccgaaataaaaactgggacgaagctttatatct

SEQ ID NO: 24979 - DNA, 378 bp, Gossypium hirsutum
  Clone ID: LIB3272-044-P1-K1-F6
agcttagtcacagaggaaaatgatgatgcgattttcacttcaaaaagtgaagaatttaccggctttaaggcctcaggttttggcttctgcgagtcctcgtttctctactgctgccgaatcttcttttaatcaccgtaatccttcgagggttcctaatcttataggaggtgcttttgttgattcgaaatcaacatcaaccattgatgttataaaccctgcgacacaagaagttgtttcacaaattcctttaactacaaatgaagagttcaaagctgcagtggctgcagcaaagcaagctttcccgtcatggcgaaataccccaattacaactcgtcagcgtattatgttcaaactccaagagcttattcgtagggatat

SEQ ID NO: 24980 - DNA, 378 bp, Gossypium hirsutum
  Clone ID: LIB3272-044-P1-K1-F7
gttcgaagaaaaaaaacagccaaataagcttctttttttccttcacagatctcagatccaaaatccaaatctaagagtgtaagcaattacataaaatatattattataagagtaaaaagcaaagcaaaaatgtcaaggaggcaagtaagttccacacgccgctttgttgacagcggaaacttcccgttctctggtgctttacattctaaagcccgatcttctcctattttatctatcgctcttgtcgttgtgggagctatccttctcattggctatgcctatagtggttcaggtaaattccgaggtgaagcggttagtcggatcgaaggtgactatacatgcagtctagaagttcagagggcaataccatttttgaag

SEQ ID NO: 24981 - DNA, 397 bp, Gossypium hirsutum
  Clone ID: LIB3272-044-P1-K1-F8
ctcaatttccccttctttctctttgtaatatacccttaaaaagcattactgaatctccatgtgctgacacaaaattcctccaagaaaggacaacaggaagaaaaaaaagagagagagaaaaaattatgcttcctttagtcccttccatatttcttcattttattttcatcttcttcgtggttgtccacggcagcaagaacgattccatttacgagatactaaagcttcatgggcttcccacggggctgcttcccaaggggataacccgatttgaatacgacgatacgggccggttcgaggttcacttggatcaggcctgtaatgccaagtttgaaagcgagtttcattatgacattaacgtgtcggtgactttgagttacgggaagatcatggaatt

SEQ ID NO: 24982 - DNA, 388 bp, Gossypium hirsutum
  Clone ID: LIB3272-044-P1-K1-G1
aggaaaacaagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaagatatgcgatgaaagagtcgtcgtcgtcggagacaagggcttattcttcagcttgggcgcctga

SEQ ID NO: 24983 - DNA, 412 bp, Gossypium hirsutum
  Clone ID: LIB3272-044-P1-K1-G10
tgctttgttttgttttgctttgctttagcttgagaagatgcaaatggaagaaagaagagggaacatcaaagcagagaatgagatgaccatcaacatgaaggaagaacaaagcacacttgactggagagggaggccctccaaccctaacaaacatggtggcttccaagctgcttcatttgttcttgggcttcaggcatttgagataatggcaatagcagcagtggggaacaacctgattacatatgttataaatgagatgcatttctccctctccaactcggcaaacatagtgacaaactttgtgggaacaatcttccttttgccccttcttggtggttacctctctgactctttttttgggagtttctggaccatgctaatctttggctttgtggagctttctggattgata

SEQ ID NO: 24984 - DNA, 267 bp, Gossypium hirsutum
  Clone ID: LIB3272-044-P1-K1-G11
agctttgttttgttttgctttgctttaacttgaaaaaattccaatggaaggaaaaaaaaggaacctcaaaacatttaattcaatttcccatcaacttaaagaaaaaccaagcccaactttcttgaaaaggaagcccttcaaccctaacaaacattggggcttccaaacctgttcatttgtttttgggcctcaagcatttgatattattgcaatttccacaattgttgaacaacctgattacatatgttaaaaattaaatgcattttt

SEQ ID NO: 24985 - DNA, 412 bp, Gossypium hirsutum
  Clone ID: LIB3272-044-P1-K1-G12
gtctctctcttcatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctattgatgttgacattggtgccaatccttcagccgaagatgctgatgaggatgaaggtgttgatgaccaatctgtgaaggttgttgacattgttgacactttcaggcttcaggagcaaccccctttcgacaagaagcagtttgtcgtgttcatgaagaagttcatcaagaacttgacaccgaaactggatgcggaaaagcaagagtccttcaagaaaaacattgagggagcaac

SEQ ID NO: 24986 - DNA, 298 bp, Gossypium hirsutum
  unsure (1)..(298): unsure at all n locations
  Clone ID: LIB3272-044-P1-K1-G3
gggggggccaacccgcccccaagcagcaggccaaaaaccaaaagcaaagaagcaaaggcccacacncnggcagggaaaaaacaaaagcgaaaacccaaaaacccaaagagcagaacggagggaacgaaaacccagcaaagcgcagcccgacccagagagaagggaagagaagcagcccccgggccgacgaagaagcgacgaaaacaacaaacgcgacgcaaaagacacgcgcaagcgcggcaacggagaccgccaaggcgcagccggcaaagggaacaggaccgcacaggaaacagca

SEQ ID NO: 24987 - DNA, 328 bp, Gossypium hirsutum
  Clone ID: LIB3272-044-P1-K1-G4
tccttttttctgtaccaaatataattattaagaaaccggtttaattttacccgcggataaaaaaaggtttcgataattttatagaattaccatttaggaaaatcctgggagaggagaaagatggtatcctcacctgtcgtgaacacgtatccacttgtcaactacaccttctactccaaagtagcccgatatggataaagacacctcctttgccaatctccttgctctcttgaaagtcaatttttttaaataaggcatgaataccaattattaaaccatttttctggttctattacattatccttcctacattccttcttcttctaat

SEQ ID NO: 24988 - DNA, 412 bp, Gossypium hirsutum
  Clone ID: LIB3272-044-P1-K1-G5
aaaggatctagaaaagagaatatctccttttattttcatttcgtcttcattggatctcaaatccatcatcgaaattacttgtagttatcagaatggggacaataggcaaaactactacggccactatttttctttgtcttcttctgtttcctattgtcttttccacgcctaatgacagatttgttagaattggactcaaaaagagaaagattgaccgaaacaatcggatggctgcacaccttgaatccaaggaggaaaaggcatctgaagcttttcttagaaagtatcgtcttcatgggaacttgggggaatcagaggacattgatattgtggcactaaacaactacatggacgctcaatactttggtgagatcggtactggcactcctacacagaacttcactgtgatatt

SEQ ID NO: 24989 - DNA, 321 bp, Gossypium hirsutum
  Clone ID: LIB3272-044-P1-K1-G6
ttcacatctagaactactgctatggcgatggaaacgtctgttgctgggaaggcatcactggaaggttgctgataggatcttatgctccaccaccacaccagcatcatcgtcgtcgtcgccggcgtcacctagggtggcaagtccttgaactatcccctctgtcgagcgggctctacacattgccaagctgtattatctatgtttcttctggcgaacctcaatgcaccgctggttcagcggctttgattatgcatatttctttcctgtaccatctctctaatatgcgtatcagtcgccgctgttcgtcatattgccgcataa

SEQ ID NO: 24990 - DNA, 372 bp, Gossypium hirsutum
  Clone ID: LIB3272-044-P1-K1-G7
caaagttccaatagccccaatttcgtagtttacaatggctactgtatcaccagcaattgcaagttcgccacagacattatcattctatttgaagaaaacccatctcaatatcttaccctcccatttacatggccctactgctcgaagcaatgacctctttttaaggtcaaaatttcaaaaccggaagtattttccaattccttctagccgaactagagcttcctcaaatgggtttcttaattcagctcatacaagcaaagaagatgaaatattgccttcttttggggaggctccagtgaaaatcatcttctgggttgtcttctgggcttctttgtctcttgtttggtacgctgcatctggagacgctaaagc

SEQ ID NO: 24991 - DNA, 370 bp, Gossypium hirsutum
  Clone ID: LIB3272-044-P1-K1-G8
aaaaatctgaaaaaaaaaaaattctcttgaatggtagttaagctaaagctaaaacaaccccatcatcccatttcttcattgttcatgctttagagacctttgacatgttcatatggccttgtttggtagtccaggaaagttaagtggactattattaagaattgggcagtgtttttctgcagctgcttcaattggtttcatggtttctgctcatggcttttttaactccactgctttctgctatttgattgcgtcaatggggattcaagttttatggagctttggacttgcatgtctcgatttccatgctttgaggtcaaagacaaacctacacaatcctgtcttagtaagcttgtttgttattggtgat

SEQ ID NO: 24992 - DNA, 367 bp, Gossypium hirsutum
  Clone ID: LIB3272-044-P1-K1-G9
atcagaggttaaagagacggcgccaatcagctgtccgccttgactgaccgtccggcatcgtcttggccctcgattttgcccttttgtaaaccttttttttcaccaattcccgaaatggcagtgaaaccctccaaggccgataagaaaatcgcgtacgacgcgaaactgtgccagctcttagatgagtacacgcagatcttgatcgccgcagccgacaatgttggctcgaagcagctccagaacattcggaaaggtctccgaggtgactcagttgttttaatgggtaagaacactatgatgaaaaggtcttgtaggatgcatgctgagaagactgggaacgaagcttttcttaaccttatccctttgc

SEQ ID NO: 24993 - DNA, 213 bp, Gossypium hirsutum
  Clone ID: LIB3272-044-P1-K1-H1
ggcgcccactcgttcggcttgaaccaaaaagcacgataccagttcacagttgtctgccacttcatagcaaagcgtcccaactttccctcttcattcaaccaatgagaaagcttttccccttctaagttttggcacagcccaataccctttcggtgcttcaatgataccatgaaacaaccattttcgaagctaattaaagtaggttccggcact

SEQ ID NO: 24994 - DNA, 356 bp, Gossypium hirsutum
  Clone ID: LIB3272-044-P1-K1-H10
cgcattttctttattgtttttcacactatccaaacaatatcttaaaatagtagattaaagtgtaaaagttcttcaatggcgatggaggataataaaggaaacaagagaactcgagtagagtttgaggattttgaaacggagggtaacttggagtcggtccataattcaaagctcgctcgagttgactcggagaatacgggctcgaactcttctgaggttacttacgtggaacctgatcctgacgatgagggaattcagtcgccggatgtgaagcgtatccaggaagatttgcttgatatcttggacgattcggatccggttattggacttgatccggagattcagggtctcgactt

SEQ ID NO: 24995 - DNA, 415 bp, Gossypium hirsutum
  Clone ID: LIB3272-044-P1-K1-H11
ctccagcagctgcaccacaactacagagaagagagtaaaggggaaaaaaggggcggtggtcttgctttcttcttctacttcgctctctctctttctcggaggtccctcctcggtcctttatttattcaggattggaaaagatggcccgccgggagggtattcaacccctcggctgggataatgggaccggaaaggtgaaggccgcgtttgccggtgaggaggcccccagggccggttttcccacaattgtgggtcgcgcccccgccactcgggtgttatggttgggatgggtcagaaggatgcctatgtaggagatgaagcacaatctaaaagaggtatcctcactgtgaaatatcccattgagcatggtattgtgagcaactgggatgatatgggaaaagattggcctcataca

SEQ ID NO: 24996 - DNA, 371 bp, Gossypium hirsutum
  unsure (1)..(371): unsure at all n locations
  Clone ID: LIB3272-044-P1-K1-H12
ccacgcgtccgcactcatacatctattctttgctttcaactcaaagtcgcaagtaggattagaatcatgggtgttgtcacttataactatgactctacctcccctgtcgctcccgccaggcttttcaaggccttcgttcttgaagctgacaaggtctggcccatagctgcccctcatgcaatcaagagtattgaggttgaagctaatcctggccctggatgtatcgtaaagatcaactttgttgaaggccttccattccaatatatgaagcaccaaattggaggacatgatgaaaacaaattttcatacagttacaatttgattgaaggtgggcctttggggaacatgctngagaaaatcaactacgagaa

SEQ ID NO: 24997 - DNA, 181 bp, Gossypium hirsutum
  Clone ID: LIB3272-044-P1-K1-H3
gggaactatgtactttacctcgtatgcgcaaaagactcttccacctaggaaaaagaagccagtttccaagaagaagatgaagagagagaggctgaagcaaggagtctcagcgccaggagagtaggacttcgaggtctgatctcttcagctccccatgttaaactgtttgcaacttcctgtt

SEQ ID NO: 24998 - DNA, 414 bp, Gossypium hirsutum
  Clone ID: LIB3272-044-P1-K1-H4
atcccctcgtccattgatcttttgatcttctagagacttctcttcctcggtgggtgtctctgggtttgccctcgtaatggcgtctgctttagaaaccaaagccaaagaagcatacttcgatgaccacttcgaactcgccctcgatctctactcgcaagccatcggaatcaaccctaaaaaggccgagctctacgctgaccgtgctcaagccaacatcaaactcaacaatctccctgacgctgtggcagatgctaacaaagcaattgagttggatccgcccatgtctaaatcctacttgcgtaaagctactgcgtgtatgaagcttgaggagtatcaaactgctaaggctgcgttggagacttggggctgctttggcaccagaagactcgagattttccaagttgattaaagaat

SEQ ID NO: 24999 - DNA, 304 bp, Gossypium hirsutum
  Clone ID: LIB3272-044-P1-K1-H5
cctgagtaaaaaatctcaccttcctcacccaaatctccttctaattcaagagcgcggccatggccgttgctacctcttcttttacccgcaattctgcttccggtggttgcagctatagttgtttaccagcttgactcgttcgacgccgcccctatgcccctccacgagttgagtgtccccttcgagccgcccttgttgcataacgaccatatgctacaaggggcggagtttgtgggtgccggccagctttcgggaccggaagagtttgcgtatgattccagatctcaagtaatctacacgggca

SEQ ID NO: 25000 - DNA, 347 bp, Gossypium hirsutum
  Clone ID: LIB3272-044-P1-K1-H6
aagcaggtagccttccttttaccttatttcttctcgcttacaaaacagccatgggtgggaaaaagatgagctccgagcctgcgaccagacccgcttctgcaagcgagctcgatttcgcaaacccggcgcctgcactctaatcgcccacgatgtctccatctccgatggtgatctcactgccaagctcattcctaaagctccacacgaccaagaccaagatcagatcaagccgttgactctctctgtttcagtctaccaggatgggatcatgcggctcaagatcgacgaagatccctcgttgcacccacccaagaaacggttccaagtcgccgatgtggttatttccg

SEQ ID NO: 25001 - DNA, 396 bp, Gossypium hirsutum
  unsure (1)..(396): unsure at all n locations
  Clone ID: LIB3272-044-P1-K1-H7
gctagaaccaaaatgcaagaaagcagttcacagttgtctgccacttcatatcaaagcgtcccaactttccctcttcattcaaccaatgagaaagctattccccttctaggttttggcacagccgaataccctttcggtgcttccatcgataccatgaaacaaaccattctcgaagctatcgaagtagggtaccgtcacttcgatacggctgctctttaccaaactgaacagcctttaggtgaagcaatatcagatgctcttcgtctagggttaatcaaatccagagacgaactctttatcacttccaagctctggtgtagcgatgcacaccatgattgtgttctcccagcactcaaaaaaacactncaaaaatttgaagttggaatatcttgatct

SEQ ID NO: 25002 - DNA, 385 bp, Gossypium hirsutum
  Clone ID: LIB3272-044-P1-K1-H8
gaattttctccgtcctaaattcgttttggtcgggagctctacctttgagttcgcagccatggcagaagagtccgacttcgccgataaggttcctccctccttttatgaaatgggaaacaagatcatttatgaaactgaagccaaagggttgaacccgggattgatagtgctactagttgttctggggctgctgctgatattccttgtagggaactatgtactttactcgtatgcgcaaaagactcttccacctaggaaaaagaagccagtatccaagaagaagatgaagagagagaggctgaagcaaggagtctcagcgccaggagagtaggacttcgaggtctgatctcttcagctccccatgttaaactgtttgcaacttcct

SEQ ID NO: 25003 - DNA, 290 bp, Gossypium hirsutum
  Clone ID: LIB3272-045-P1-K1-A1
cacagccagaggcgaggagccagataagaaaaactaaaggaaaattgttttctggttcaaaaccacagccctatcccacatgcggttcggatccggattctctaagatccgattgacattcatcgctttaattttcattctgatctgatcccaaacgaatctattcggccgtgaaaaatgactcgtcgctgctcacattgcagccacaacggccacaactctcggacatgtcccaaccgaggggtcaaactcttcggagtccgcttgactgacggttcgattcggaagag

SEQ ID NO: 25004 - DNA, 415 bp, Gossypium hirsutum
  Clone ID: LIB3272-045-P1-K1-A11
gtttccttttcttacactgtaacagccatggaagctgtgaacatgaagaaaaaagacccaaaaatagtggtggccgtggacgagagtgatgagagcatgtatgcactttcatggtgcttagcaaatttgatttcccagacctcaaccagcaacctcgtccttctttatgtaaaaccttcaccccctgtctattcttccctcgacgctgcaaggtatatgttttccaccgatgtgatcgtagccttggaaaaatacggcagtgacatggtgaatacagtgatgagaagagctgaagctatttgcagaaaatccaccaccaaaataaatgtggagagaatcgtggggagtggagatgccaaggatgaaatatgtaacatagtgggcaaaatcaaagctgatacgtttggtatgggat

SEQ ID NO: 25005 - DNA, 279 bp, Gossypium hirsutum
  Clone ID: LIB3272-045-P1-K1-A2
cggcccgaagagctttacagcccaaaatcttatttccgggaaatccaccgataatcgacggactgtctctcgatctcacctaagattcgccgataatcgaaattttaaaaataacccgacaacaacaaagatgaagaaagaagacacagtgaaactgattagcgctgaaggaatggaattcgttatagacaaagaagctgctatggtttctcaaacaatccgtaacatgcttacttctccaggtggtttcgctgaggcggagcatggggaagtgacttt

SEQ ID NO: 25006 - DNA, 294 bp, Gossypium hirsutum
  Clone ID: LIB3272-045-P1-K1-A3
gcaaatccgaacccctagttaaattaaagatcacttttgattcttcagcttttgaaattcagagagtaggtcttcttcggagtaagccaaaaaactaatagaggaaaacgcatctttgttagttctgcccttctattcttcttgttcttgaaccttcttctttcccgtacttcttcttttatctgtaattttcgcctcaaacatggaaattaatcctccaactaaatcagttgaaattaaagagaaagacctcttcaaagctgcggagaagggcgattctttcatattcaaacc

SEQ ID NO: 25007 - DNA, 406 bp, Gossypium hirsutum
  Clone ID: LIB3272-045-P1-K1-A4
caaacatgtctaaagcctgcttgcttttgtttctcggtggagtggtggtttttatcatcactgcttctctagctaaccaacatcatggtaatgagcttcccaagggtaatggtaggaagcctttcccaggtgagaagcaaccacaacacaagccattccccgaacaccgaccaccaatacaccgtggacctggcggtaagggggaggagccaccacatggagaaaaacctcctcatagacacttattgactgtggaagttgaggacacacataaacctccacgatactcaggtggtaaaccttcaagacactcgggaggtaaacctccacatgttgaggggttccttgctggtaaagcacccatgaggccatttccctgtgacaaaccatctaagggtatggaaaa

SEQ ID NO: 25008 - DNA, 429 bp, Gossypium hirsutum
  Clone ID: LIB3272-045-P1-K1-A6
gcgcttcatctcttatcctttcttcttcactttcggcagatcccaatggcaccaaagaaagacaaagctcctcctccatcatcaaagcctgcaaagtctggaggtggcaagcaaaagaagaagaagtggagcaagggaaagcaaaaggagaaggtcaacaatatggtgctattcgaccaagctacttatgataagcttctctctgaagctcctaaatacaagctcatcactccctcgattctctctgatcgtatgaggatcaacggatcgcttgcgagaaaggctataagggaactgatggcaagagggtctattaggttggtttccgcccattcgagccagcagatttacactagggcaacaaacacctaggtctcatatttgtacgttttttgcttaatagttatacatagtaatgctttttgctga

SEQ ID NO: 25009 - DNA, 225 bp, Gossypium hirsutum
  Clone ID: LIB3272-045-P1-K1-A7
gaagaagataaagagccagaattctaaccaataagaaataactcttgctcggtcgggcgcttgatactccaaatggatctctcacggaaaagaaaacactacgcacgcaggtccgatcgaatcagccaagaaatatggccaatatatggatcgatctgtaggacgaggagcgtataatgtattagcgcattacaagctgggaaaaacgcttggaattcggtcctt

SEQ ID NO: 25010 - DNA, 312 bp, Gossypium hirsutum
  Clone ID: LIB3272-045-P1-K1-A8
aaccagttcgcgtcctcgttactggagctgcaggacaaatcgggtatgctcttgtacccatgattgctaggggagtcatgttgggtgctgaccagcccgtgatccttcacatgcttgatatcccacctgctgcggaggctttgaatggtgtcaaaatggagttggtggatgctgcatttcctcttctaaagggtgttgttgctacaactgatgctgttgaggcatgcactggagtcaatgttgctgtcatggttggtggtttcccaaggaaggaaggaatggagaggaaagatgttatgtcaaagaatgtgt

SEQ ID NO: 25011 - DNA, 243 bp, Gossypium hirsutum
  Clone ID: LIB3272-045-P1-K1-B1
gaaaaataacccagtttttgtttcccattttcattgtacatttaacgaccctttccgtcaaggtgatatataatacatatatacacacacactcttctcgtcattataaacaaaccccagttttaaggcagagagatatatggccagagagatgcaaaagaacaccatgttcattgaacaaaacactggcgactatgaaaatggtgaccttcaaaagaatttggatgatgatggtcgagaaaa

SEQ ID NO: 25012 - DNA, 436 bp, Gossypium hirsutum
  Clone ID: LIB3272-045-P1-K1-B10
caaagcttcatattatcttttttagttccgacaaaagaaaacgaaaaaaatagaaggggtacaatcgttttctttttgaagtcgggttttagtttttggggagaaaaaaatgttgggagtatttagcagtgcgatagtgtctccgccggacgagctggtggcggccggttgccgaactccatcacctaagataacggcggatgctctggtgaaacggttccttgagacgaactcctccggcgtgtccatgcagatcggagaccatgtccaattcgcttattctcaccataaagagtctcctttacggcccagatcatttgctgtgaaagatgaaatcttctgcttgtttgagggagcccttgataacttggggagtttaaagcagcaatatggtctggcaaagtcggcaaatgaagtgattttggtcattgaagct

SEQ ID NO: 25013 - DNA, 393 bp, Gossypium hirsutum
  Clone ID: LIB3272-045-P1-K1-B11
aaagcacgctcttcttccttgtgtaagcggcgccggcaagaagctaaggccagtccacctcggatctctcgtctctgccttccatcgacaacaatctatcttacatgtttcacttcttctttcatcaaagattttgatggcgtcaaaattgcagcagttgcaatctcaggcgtgccaagcttcaaagtttgtggcgaagcacggaactgcttactacaagcagttgttggagcagaacaagcaatacattcaagagccgccgacagtggagaagtgcaacgagttggctaagcaactcttttacactcgccttgctagtatcccaggtcgtacagagtcattctggaaggagctcgattatgtcaagcaactatggaaggaacaggaaagagc

SEQ ID NO: 25014 - DNA, 371 bp, Gossypium hirsutum
  Clone ID: LIB3272-045-P1-K1-B12
caatcagttccggcgaatcaaatggcaaaagaagttgttaatcccgatgagctggttgttgttggagaggaattagaccatgtaagaatcatcactttgaacaggcctcgacatttgaatgtcatctcatccaaagtggtctccctgctagctaaatacttaaaaaaatgggaaagagatgagcaagctcagcttatactgatcaagggagccgggcgtgcattttctggtggtggggatttaaaaatgttctatgagggaaggaaatcaaaggattcctgccttgaagtggtctatagaatgtattggctttgctatcacattcatacctataagaaaactcaggttgctcttgttcaaggaatttcaat

SEQ ID NO: 25015 - DNA, 346 bp, Gossypium hirsutum
  Clone ID: LIB3272-045-P1-K1-B3
agtttataaaagagaccaaaaggaggtctgtatccttggaagctccggcttcattggaccaagacgtttacccttaaccatacctcgaagttttaaacttcatccatcataaacacaaaaacaaaggcctcacgtcaacttaaaagaccatcatcttcatcaacaagtgatcgacgaacaaaatccaggttcaggatttctcaattataactcaaggggaaccgtaatcaaggcaagcttatcaggtggcaacttaaaataaggagctccatgttaaaggcctttttattttaggccacagccggttcacttaccagggattggcaccaccattaaaggcattaaa

SEQ ID NO: 25016 - DNA, 421 bp, Gossypium hirsutum
  Clone ID: LIB3272-045-P1-K1-B4
gttaaaaaaccttgagctgtgacagagagggagaatggcgagccgtacaaatggcggtggcagcaatggaccggtggataaaggagctgattttgccaattacttctgcacttacgctttcctttaccaccagaaagagatgcttagtgatcgagtccgtatggacgcttattacaatgctgtttttcagaacaagcatcatttccaaggaaaggctgtattggatgtaggaacaggaagtggcattcttgcaatctggtctgcccaggctggtgcaaggaaggtctatgccgttgaagcaactaagatgtcggagcatgcccggactcttgttcaggcaaacaatcttcaagacattgtagaagtaattgagggctctatggaggaagttgtcttaccagagaaagttgatgtgattatc

SEQ ID NO: 25017 - DNA, 443 bp, Gossypium hirsutum
  Clone ID: LIB3272-045-P1-K1-B5
gtgattcgaatttcagtgttttgatatggaacaaaaagccttcaaacgtccctttgttgactgggtttacatctttttcctgagtcacctggtgttttgtcaactcgattatagattctatgacagtacttgtcccagtctcacagggattgttagatatggtgtttggtcagccattgctaacgatactcggatggcggcctctcttgttcgacttcacttccatgattgttttgttaacggatgtgatgcttcaatcttacttgatgatattgactcaacatttgtgggggaaaaaacagcaagtgttaatcaaaactcagtaagaggctatgaggttattgacaaaattaaggctaatgttgagaaagcttgcccatcaactgtgtcttgcactgatatattaactcttgcagcaagagaagctgctaatattgcagggg

SEQ ID NO: 25018 - DNA, 430 bp, Gossypium hirsutum
  Clone ID: LIB3272-045-P1-K1-B6
catttctaacgtattctttgaatattatttctataataatatcaaagccctccctggttttctctgattttccctcattttccgggaaaatcttttttcttcctcattccgctaatctcatttactttcttgattccttatttttattttcttctttttttttgtgtttcaagatctgcatggtgaagtccattttcgcagcataaattttgttcctttacatagaaaggaaaaatccaactttaaatctattaaaaatattcttctgaagggatcggcgtggggattttgaagtttagggtaaaacggaagtgctgctccggttgtaattgagtcctctactgcttcttttgagggagtagccggggcctcggcctcggcgggtttaaagctcccacctttgaaactatcaaatctaccttttttttcg

SEQ ID NO: 25019 - DNA, 283 bp, Gossypium hirsutum
  Clone ID: LIB3272-045-P1-K1-B8
gcagtctctcccgctccttctcgctgcgatttcgtcttcaagatctcagttctcaggtcgtagcgctcttttctatcaagccatggctctggtcttgcatgcaggaaaaacaaacaaaaatgcctttaaggcactcattgctgcagaatatagtggtgtgcaggtcaaaatggttgagaattttgagatgggtgtgtcaaataagactcctgagttcatcaagatgaaccctttggggaaggttcctgtgttggaaacacctgagggtcctgtatttgagagc

SEQ ID NO: 25020 - DNA, 281 bp, Gossypium hirsutum
  Clone ID: LIB3272-045-P1-K1-B9
gctatctcaaaagagaagcagggctcctttcgctccaactccgtgttcactgcatcgactcagccatggacacacaagatggaactcagcagtcacagcaactcatccttgctcacaacgtcttcctcctcaagcatccagacgtctctgacattgagaaggtccgtctcagggatgaggtcctcaactcggtccaatccaatgatatgacttcatattatgaaacccttcttactgatgaagtgttggagcttgatcaaagccttttggaatcgatgcgt

SEQ ID NO: 25021 - DNA, 190 bp, Gossypium hirsutum
  Clone ID: LIB3272-045-P1-K1-C1
aaaaaaacaatgtctggtcctcagtgctgttcgaatccaccaacattggattctgcaggtggggctggtcacgtggagaatcttgctgatctcaacacttatgtttctgggtctacttaatctaagcttgctgtttttcttatctctgatattttcggatatgaggctccaaactttagaaaactcgcgg

SEQ ID NO: 25022 - DNA, 366 bp, Gossypium hirsutum
  Clone ID: LIB3272-045-P1-K1-C10
cctcttcgcatttcggagaagtcgcagagggagagagagagttgaaacggggtcgtgtttggtgatagaaaacaaatggccctttcatcatgttcatttactcttagccctagggtttgtaatccatattcttcatttgagtgccggccagatcccgatttctccagtgcgccgatcggggacaagccttgttttgcctccagccgaagggtgacggctttgtcgctttacgcccgaggtatcagtagccgagggttggctttctctgatctttcgcttcccggcgaattttgtgcgccagcttactattaaggctcgccgcaactttagcaatatttgggttgcgcaaaaaggcgctgcttcttg

SEQ ID NO: 25023 - DNA, 293 bp, Gossypium hirsutum
  Clone ID: LIB3272-045-P1-K1-C12
tttcaatcatcgccaccacctatggttgtggaattatcccagaaatacaggcaactatagctcccccagtgaaggggaagatgttcaaaggtttatgtgtgtgctttggtgtgatagttagcacatatttcagtgtggcaatctctgggtattgggcatttggcaatcaatctcaaccatcaattctttcaaattttatggatgaaaacaggccattgctgccctcttggtttttattgctcaccaacatctttactcttatgcaactggctacaatcactgtgatttacttg

SEQ ID NO: 25024 - DNA, 339 bp, Gossypium hirsutum
  Clone ID: LIB3272-045-P1-K1-C2
ctttgctcttaatcttaatatcttggatttatcctctccgctgcttgttggacgggattcgggatcgccccagtcaggttagttggcagtggccacgccgatgacaaaggggaggtggacgttacaatcttggcgtggaagagagtgggtccaattgtaactgacaggacaggacagaacagaacagaacagtacaggagatggcgttaagaataagcatttcatttctaaggattgaacagaacaggccaattgttttctttctaaggattgcctctactcagctaccctatttttgagttaattcgcatgtatgcatgaatgtcaatgttatcccaa

SEQ ID NO: 25025 - DNA, 379 bp, Gossypium hirsutum
  Clone ID: LIB3272-045-P1-K1-C3
cttatctctccaccggcgagctacctaattgagctacaccgctatgcatccatctaagccaggcaatctcttttttatggtaacggtcatgatccgtctctgcttcgccgatctgccttgttttcgggaggcaccggcatgccgaaacggcagagagtggccacaaacaacctggtcctccctcgacaaagagatccacaatgccttcattatgcatatcggtatgacattagacactgcttacctccggggctccggcgctggagtctattgcggtctacaccacgccacgtgtgcggaaaacatcgagtaccattttggccccacgccccgacacggagctaaactaacgcgcgccgatacctccatttttccttac

SEQ ID NO: 25026 - DNA, 428 bp, Gossypium hirsutum
  Clone ID: LIB3272-045-P1-K1-C4
cggacgcgtgggcttccaattatcttaaagcctgccatataatcatataaccaggcggcggcggggtactcttgggccaccacaatgccgaaaatcgccttgggaacaagccaagaggctgctcagcctgactgcatcaaagcccttgtggtcgagtttatcaccactttcctcttcgtattcgttggagtaggagctgccatggccgccgatgagtcgggggcaaatgcgctggtgggattgtttgctgtggcggtggctcatgcccttggcggcggcgttatgatatcggccggacacatatcaggcgggcatcttaacccagccgtcacgcttgggttgctattcggtggtcacatcacggtggtcccggcgatcctctactggatcgatcagttgttggcatcttcagctgctggatacttctc

SEQ ID NO: 25027 - DNA, 289 bp, Gossypium hirsutum
  Clone ID: LIB3272-045-P1-K1-C6
ggtttatgtcggccaattttgtatttaagtatatacgatcaacgtggcggccgtgcggggacggcaaactagcaggcaagtgggaaactatactgcaattcattttaccctccactctctgtttatgtatatatatatcattgtgaatcccttttttgtagcaagggtggtctttgatatttaaattttaactcttctttctcggacaatagggctttcggttttttttggggggttcctagcgcatggaaagtgactgtaattttttatagacgtctatttcaactag

SEQ ID NO: 25028 - DNA, 280 bp, Gossypium hirsutum
  Clone ID: LIB3272-045-P1-K1-C7
cgaaaagaaaaaatggctttgaattttaatgccatcgcctcgaaatctcagaagctgccttgctttgctcttccaccaaaggccacccttagatctcccaagttttccatgatctccaccattccttctggctccaaagaggttgggaatctgaaaaagcctttcacgcctccaaaggaggtgcctgttcagatcacccactccatgccgcctcacaagattgagatctttaaatctttggagggctgggctgagaacaacattctgactcacctcaaac

SEQ ID NO: 25029 - DNA, 321 bp, Gossypium hirsutum
  Clone ID: LIB3272-045-P1-K1-C8
cttccttgtatctttattttctcgcctttgacgaggagccgacgctaccatggttggggtcagtttctaccgcaactatgggaagacctttaagaagccacgacgtccgtatgagaaggaacgattggatgctgagttgaggcttgtaggagagtatgggctccgatgcaagagggagctgtggagggttcagtatgctttgagccgcatccgtaatgctgctagggaccttctcactcttgatgagaagaaccctcgtcgtatttttgaaggtgaagcccttcttcgtaggatgaacaggtatggacttttggatgagag

SEQ ID NO: 25030 - DNA, 395 bp, Gossypium hirsutum
  Clone ID: LIB3272-045-P1-K1-C9
atttctctctataaacttgtacggccaaagattccttcccagcaaaaaatcggaaagaaagaaaaaacatggggatgccgcctgccacgtgcgcctccgcctcttcctcctccatcgtcaactcttctccgatcggtggcgctggcggaggaggtggagagatcatgctttttggagtcagagtggtggttgattccatgaggaaaagtgtgagtatgaacaacctttctcaatacgaacaacctcatgagtcgaacaagcataacaacaagagcaacaaagatcaaggcgatgataacctcaccgctggttacgcctcccgcgacgatgccgttcctcactcctctggaaatcgagagcgcaaaagaggggtgccgtggacggaagaggagcac

SEQ ID NO: 25031 - DNA, 314 bp, Gossypium hirsutum
  Clone ID: LIB3272-045-P1-K1-D1
cggacgcgtgggtctgaaactcaccttccatattatttaaactaaatacaggactcatttgtgttgggggaatgcctgagaaaatggctcgcattcaatatataggagctgctctatgctttgcagatttacttgagggatcgctatcaaaagctcaactgaccccgacattttacgatgaaacatgcccaaacgtgacagccattatccgacatgtgctcgagaatgcttcgttttcagatccaaggattggcgccagtctcaccaggcttcactctcatgattgctttggcaacgatgcgatgcgacgattt

SEQ ID NO: 25032 - DNA, 361 bp, Gossypium hirsutum
  Clone ID: LIB3272-045-P1-K1-D10
cttccttcgccgtctactgctcttgtgacctcgatttcaagtgaaacagggggggtggggaaaagactcacattaacattgtggtcattggccatgtcgattccggaaaatcgaccaccactggccacctgatctacaagcttggtggtattgacaagcgtgtgattgaaaggtttgagaaagaagctgctgagatgaacaagaggtcattcaagtatgcttgggtgcttgacaagctcaaggctgaacgtgagcgtggtatcaccattgatattgccttgtggaaatttgagaccaccaaatactactgcactgtgattgatgcgcctggacaccgggaactttatcaagaaacatgatt

SEQ ID NO: 25033 - DNA, 388 bp, Gossypium hirsutum
  Clone ID: LIB3272-045-P1-K1-D11
caagatgcaaattttcgtcaagaccctcaccggaaagaccatcacattggaggtggagagttctgatactattgacaatgtaaaggccaagattcaggacaaggaaggcatccccccagaccagcaaaggttgatcttcgctggtaagcaacttgaggatggccgcacgttggctgattacaacatccagaaggagtccacactccacttagtgcttcgcctccgtggaggaatgcaaatttttgttaagactttgactgggaagaccattacattggaggtagagagttcagataccattgataatgttaaggcaaaaattcatgacaaggagggaattcccccagaccaacaaaggctgatttttgctggtaagcaactggaggat

SEQ ID NO: 25034 - DNA, 419 bp, Gossypium hirsutum
  Clone ID: LIB3272-045-P1-K1-D2
aaacagaaggggaaagttctaaaattcaaaaaagtgaatgaagatggataaggaatagtcatgggctgtgtgccccaactcatcctacaccctttggctcaagactattacacactctatcgtattaaataataatggtacttgcaatccataaaggccattcacacaaaatataagagagactcaccctttctttttgccctgaccttctctctgcattctttcttctattgctgctcctttgaaatcatgagttcttgtgtcatcattactatgaaaagcctcactttctctctcactttgtttttgttctctttttacaattttagatacaaacacgtttttcccatctatataacacttggtttttttctcctacttgattataacaaataattttttatcaatttttttaaaca

SEQ ID NO: 25035 - DNA, 375 bp, Gossypium hirsutum
  Clone ID: LIB3272-045-P1-K1-D3
atgggatttggggctttaagaagtatcgttcgaccactatgtcggactctcctactatcccgggcttcccctgcttctggaactatgtcgactctcccttcttatttgtgcccaaaatcctgtttgaattcccttttgtgtgggtctatttaccgccaatctccatggatctcgatgtccaatcagttgcatagcttaaccaatactcgtttcccaaagagaaggcctcaagacaaggcacgccgaaaaagagccagcttgaaacctcctgggccatatgcatgggtgaagtatacaccaggggagcctattcttccaaataatcctaatgaagggagtgtcaaaagatggaatgagaaaaagagaatgaggctg

SEQ ID NO: 25036 - DNA, 409 bp, Gossypium hirsutum
  Clone ID: LIB3272-045-P1-K1-D4
gcttcaagtgccaaaatctagggatttgcgggtggagaagacgagagcccatctctctgcttcaaagctcctgtccaggtagaattctcttcttcccttgcgttgtgttctttcctgttcaatcgccatggcttcaaagcggattttgaaagaactcaaggatttgcagaaagatccacccacttcttgcagtgctggtccagtagctgaagacatgtttcattggcaagcaacaatcatgggaccctcagatagcccttatgctggaggtgtgtttttagttactatccatttccctccagattatcctttcaagcctcctaaggttgcatttaggaccaaggtcttccatcccaacatcaacagcaatggaagcatttgtcttgatatcctcaaagaacaatggagt

SEQ ID NO: 25037 - DNA, 386 bp, Gossypium hirsutum
  Clone ID: LIB3272-045-P1-K1-D5
actttctggactgatctgtttgtcttctgcaaaacccagagtttttttttttcatttgttttcagaaattgtccaccatggctggtggagggtttggtaatgaaggagggaatttgaagagagctcatctctatgaatacaagattaccaattattttatatttgcttgccttgttgctgctacagggggatctctttttggatatgatcttggtgtttctggtggagtgacttccatggatgatttcttgaaggaattcttcccaaaaatatatagaaggaaacaagcacatcttcatgaaactgactactgcaaatatgacaaccagctcctcacactctttacgtcttcgctctacttcgcaggccttgtttctacatttgga

SEQ ID NO: 25038 - DNA, 409 bp, Gossypium hirsutum
  unsure (1)..(409): unsure at all n locations
  Clone ID: LIB3272-045-P1-K1-D6
gaattttctaattatatttccatttctcttttcctcttttgtgaaatctccggtttgcaaatataccccccgtgatctcaaaactccggcgattaaaaattcttgtttcgatctcgagatcttattatcattgccggtttctttctggaaaaacggggattaaagacgaagaggagggatagaatcggaaaaagaaaggaaatcgcatgagctggttgggaaatctgggttttacttgcttctcttcgttgaattcttccaaccattttataacgtgtcttttaatttttattcttcattactcccctcaattacctccttcgttatttaaattcgaaaaaaaatcaactgagcctttattattattggctaattctaattccaaacatangcctcccttacatcttaa

SEQ ID NO: 25039 - DNA, 393 bp, Gossypium hirsutum
  Clone ID: LIB3272-045-P1-K1-D7
atttcatccacgatgaatcccttcaaaaccttgccaaccctttctttcctcttctgaacccttttcagcttagcccatgcagccacatttgatataagaaacaactgcccttacaccgtttgggctgccgcatctccgggtggtggcaagagacttgaccaaggtcaagcatggcaaatcactgcagcctctggaaccacacaagcccgaatttgggctcgaaccaaatgcaatttcgatgcctccgggaaaggctcatgcgagacaggcgactgcggtggagtcctcgaatgcaagggatacggtaaagctcccaacacactagccgaatacgcaatcgaccaatttgagcaccaagacttcattgacatctccaacatcgatggctttaat

SEQ ID NO: 25040 - DNA, 169 bp, Gossypium hirsutum
  Clone ID: LIB3272-045-P1-K1-D8
tacataagctttttattattcagaacaaataaaaaaagcactttcaaaatgttgaggctatcatcgcatcatcatatatatcttacgtcacagaaaatcccatcaccgacccttcatattataacactactctaccacctaaagggaatatatcactacaacactacac

SEQ ID NO: 25041 - DNA, 424 bp, Gossypium hirsutum
  Clone ID: LIB3272-045-P1-K1-D9
caaaaaacccttctttttttccctcatcaatccaccatgggaggaggaaatggccggaaatccaagatggcccgtgagaagaacttggaaaagcaaaaagctgctggcaaaggaagccagcttgagtctaacaagaaggccatgtccatccagtgcaaggtgtgtatgcaaacattcatgtgtaccacaacggaagtgaaatgccgggagcacgctgaggcgaagcatccaaagtccgacgtgtacgcgtgctttcctcatcttaaaaaataaacatcgaaactccacagaaagaacggagatgtcaagacagcttggaatgcatatcatctatctatgttggatcttgggactctataatttatcttaaattctcttttacaaggctggaaaaaaaaaaaatatatttatataaatatttttt

SEQ ID NO: 25042 - DNA, 298 bp, Gossypium hirsutum
  Clone ID: LIB3272-045-P1-K1-E1
acaccaagaagccctatctgaggctctacccgaagacaatgttggattcaacatcaggaacggtgctgttaagggtctcaaacacaatttctttgcttaaaactataaagatgaatctgcaaaggcagctggccgctacacctctcaggccatgatcatgaaccaccctgggcagattggaaacggatactccccagtacttgactgccatacctgctacattgctgtgaagatctctgaattgctcaccaagatcaacaggcgatctggaaaggcccttgataaggagccaatgttc

SEQ ID NO: 25043 - DNA, 432 bp, Gossypium hirsutum
  Clone ID: LIB3272-045-P1-K1-E11
gcaagccattaaggttttgagaaaagatcaaaatggattcaaaaagatcagcttccacagccctccttttagccctcaacattctcttcttttccctagtcagtgctaattgtggatcttgttcttcttctggctctaacccaaggccaactcccacccctactccatctgcacgaggtaggtgccctagggatgccctcaaattaggtgtatgtgccaatgtgcttaacttagtcaatgtcaccgttggttcacccccggtgatgccatgttgttcccttctcaacggtcttgtggacctcgaagccgctgcttgcctttgcaccgctatcagagctaacatcttaagcatcaaccttaacatcccagtttcccttagcttgcttctcaacgtttgctcaaggaatggtcctactggtttccaatgctaag

SEQ ID NO: 25044 - DNA, 414 bp, Gossypium hirsutum
  Clone ID: LIB3272-045-P1-K1-E12
caaatctttgcatcaaaaagaaaaagagagcttttttgaaggagcggaacgtcatacatcaatacaaaaatcctcaattttcaaataaaaaatggaattcgttgttgaacaaggcaaacaaccacaccaagaatgctctactttgcttctgcctgctttgtcgattgggaatgtggggcaactagcggtggatttattagtatcatcaatgaaagcagagagaattgggtacttagatgatccctttgtgcttccttgtgttggaaatgatgcttatggccctattccttgtggtgaccttgctcttcctcttgaagcttacgagtcagcttttagtcgagttgctctcctccaacagcggtctcccgtcgttaagggacgaatggttgaatttgccaaaaacttggcaaattt

SEQ ID NO: 25045 - DNA, 392 bp, Gossypium hirsutum
  Clone ID: LIB3272-045-P1-K1-E2
aaaaaaaccaaagatgcagtacaaaaacctgggcagatcaggcttaaaggtgagtcagctagggtatggagcatgggttagtttcggtaaccagctcgatgttaaagaagcaaagtcacttctccagtgttgtaaagacaacggagtcaactttttcgacaacgccgaggtttatgccaatggtcgagccgaggagatcatgggtcatgctattacggaacttgggtggaaacgatcggatatcgcggtgtgtaccaagatcttttggggtggtcctgggccaaatgataagggtttgtctagaaaacatattgtggaaggaaccaaggcgttcttgaagaggcttgatatggattatgttgatgtgctctattggcataggccagacacac

SEQ ID NO: 25046 - DNA, 422 bp, Gossypium hirsutum
  Clone ID: LIB3272-045-P1-K1-E3
attttcttgttccttccttcgccgtctattgctttttgttacctcgatttcaagtgaatcagatgggtaaggaaaagactcacattaacattgtggttatcggccacgtcgattctgggaaatcaaccaccactggccacctgatttacaagcttggtggtattgacaagcgtgtgattgaaaggttcgagaaagaagctgctgagatgaacaagaggtcattcaagtatgcttgggtgcttgacaagctcaaggctgagcgtgagcgtggtatcaccattgatattgccttgtggaaatttgagaccacgaaatactactgcactgtgattgatgcacctggacaccgtgactttatcaagaatatgattactgggacgtcacaggctgactgtgctgttttgattattgattccaccact

SEQ ID NO: 25047 - DNA, 383 bp, Gossypium hirsutum
  Clone ID: LIB3272-045-P1-K1-E4
aattcatcgagaaggagccgattattaccgaggccacacctatgcattactgcatgcggggcatgaagctcacgctgtaacttgcttccaccggggacaggactacaccaagaaatgagtcacttggtatgctagcattgaccacccacggggggcgaacacgctccctagaggttaaccgcaatgggaacaaatactactatagcgatagtgggaagagaaaacataacttgtgcgtggcatatatccgaatctttctagaaaaaacatagaacgtatctttgtgaagcacaaatcctgttagaacatcactagctgtttatagcgaaaacatattgtgaacgacacactaatttttgggtgggtcaataataaataaataa

SEQ ID NO: 25048 - DNA, 406 bp, Gossypium hirsutum
  Clone ID: LIB3272-045-P1-K1-E5
tgcttaggagaaaagagaagaaaacaatgtcaggtcctcagtgctgttcgaatccacgggacattggattctgcaagtggggctggtcacgttgagaatcttgctggtctcaacacttatgtttctgggtctcttcaatctaagcttgctgtttttcttatctctgatattttcggatatgaggctccaaactttagaaagctcgcggacaaggttgcagccgctgggttctatgtggtggctcctgacttcttttatggagaaccctatgaccctaataaccctgatagacctctatctggttggataaaggatcatggaccggataaaggttacgaggatgcaaagctcgtaattgacgctttgaaaagtaaaggggtttcatccattggagctgctgggttct

SEQ ID NO: 25049 - DNA, 405 bp, Gossypium hirsutum
  Clone ID: LIB3272-045-P1-K1-E6
cttgttcttcttgtttgcaggaggctttaaatgaatttataaaattaaagcatctcgagcaggcgttttctaaatttccgtctactctttttttagtaatatgtttcagttatcgctggtactttgagggttgactgtttcttgaatggttattttggctacgagcttcgattcagcttaagcaatccgggatcccagtaattgcatgtctagggtttgctagcagctcgaattcgaaggtgtttcattttccgcaactaaatagggcagatcgtgtagagattgtgccatcaaatgagtgtcaagagtttgggctaaagaaatctgcttatcctgggttttatcatttggggtttcattcatgattgggaaaatggtcgagggtcctaaatttactggacttat

SEQ ID NO: 25050 - DNA, 376 bp, Gossypium hirsutum
  Clone ID: LIB3272-045-P1-K1-E7
ggaacttgtgctggtgtttggacttggattacttggagggacagagtgatcatgggggggtcaactgcaatgtgtgatgggaatggtcttggtgggacttgcaatggtggttgttgaaagtgccgttacatctatatacatctgttatgcagaagacccttccttgattcgaagatgggatcctcagttctttaaccaaatgtcggagatgctgcaccagcgtctgcaacataggagtgcacgagccagggaagtattgactcagaaccagcttgacagccacatgcaagatacattccatctttgaaaacttacctatatcaagtgtaattcatactctaaaattactattccaaatatagaagagtttgttaat

SEQ ID NO: 25051 - DNA, 331 bp, Gossypium hirsutum
  Clone ID: LIB3272-045-P1-K1-E8
ctaacacagccagaggcgaggagccagataagaaaaactaaaggaaaattggtttgtggttcaaaaccacagccctatcccacatgcggttcggatccggattctctaagatccgattgacattcatcgctttaattttcattctgatctgatcccaaacgaatctattcggccgtgaaaaatgactcgtcgctgctcacattgcagccacaacggccacaactctcggacatgtcccaaccgaggggtcaaactcttcggagtccgcttgactgacgggtcgattcggaagagcgccagtatgggcaacttaagccaatattccgggtcg

SEQ ID NO: 25052 - DNA, 331 bp, Gossypium hirsutum
  Clone ID: LIB3272-045-P1-K1-E9
ctatttgcgagtatgttttggctcccttattttccttgaatttttaaccaattttggggtggtttttgtgatggattaaatcaactcgttaatatcaaatccgtaataattggttttgtacatccttttctggaaacttttggcattcattatgtatctctcctcatccagtgcgcttttatgatgtgcaagcagctgtgagaaatcacattttcattttgatttttttaaaatctactgcttttatttttttgttgttgttgttcagtgaattgtgtttggtagtagttattatttcttcaaaagaatacaaatagtattatattattac

SEQ ID NO: 25053 - DNA, 361 bp, Gossypium hirsutum
  Clone ID: LIB3272-045-P1-K1-F1
cagattcagaaagaaataaaggaagaagaagcaatggccactcttacagtgcccacgacagttccttcggtgtctgaagattgtgaacagctaagaaaagccttttcaggatggggaactaatgagggcttaatcatagatatattgggtcacagaaatgccgagcaacgaaacttgattcgaaaaacctacgctgaaacctatggagaggatctcctcaaggcactagacaaggagctctcgaatgactttgagaggctggttttgctttgggctcttgatcctgctgaacgtgatgcccttttggctaatgaagccaccaaaaggtggacttcaaagcatcaggttctttatggaaata

SEQ ID NO: 25054 - DNA, 418 bp, Gossypium hirsutum
  Clone ID: LIB3272-045-P1-K1-F10
aaacggtatcgttttagtcagtctttcatcaatggcgaaagaaccggttcgcgtccgcgttactggagctgcaggacaaatcgggtatgctcttgtacccatgattgctaggggagtcatgttgggtgctgaccagcccgtgatccttcacatgcttgatatcccacctgctgcggaggctttgaatggtgtcaaaatggagttggtggatgctgcttttcctcttctaaagggtgttgttgctacaactgatgttgttgaggcatgcactggagtcaatgttgctgtcatgggtggtggtttcccaaggaaggaaggaatggagaggaaagatgttatgtcaaagaatgggtctatttacaagtctcaggcttttgccttggaacaacatgcagcttctaactgcaagggtttgggt

SEQ ID NO: 25055 - DNA, 340 bp, Gossypium hirsutum
  Clone ID: LIB3272-045-P1-K1-F11
gcacgcgaacgatttacgtcgctaacactcaacggctaacaaatccaattgaggtcggtacggactggctacacgatcttatatataatgcatgccatggatgtggactcgagctgcatcgaaagactaacaaatgctccgaggactgacacaaagtgcgattgtatataacatagacttatggttgcgctttaccgggatctgcataggacagggagaggatgcaatgctgtgtatatgaagcacctctacatgtgccgagttaacaaggctgctttgcctctattcatacggacgggataaacacacggcattgaggacaaaagggcagttattggta

SEQ ID NO: 25056 - DNA, 381 bp, Gossypium hirsutum
  Clone ID: LIB3272-045-P1-K1-F12
gtcaaagagaggtatcctcactttaaagtaccctatcgaacatggcattggcagcaattgggatgacatggagaagatttggcaccatactttctacaatgagcttcgtgttgcccctgaagagcatccagtacttcttacagaagcaccactcaaccctaaggcgaatagggagaagatgacccagattatgtttgaaacattcaattctccggctatgtatgttgctattcaggcagttctttcactttatgccagtggacgaacaacaggtattgtcttggactctggtgatggtgtgagccacactgtgccaatttatgaaggctatgccctcccccatgctattctttcgttggaccttgctggacgtgatcttac

SEQ ID NO: 25057 - DNA, 356 bp, Gossypium hirsutum
  Clone ID: LIB3272-045-P1-K1-F2
ctcaaagaaaaaattgagtgtcagtttgaaagtgttcttcagatatggctatgaaacaggttggtaattctgctatcaaagcaattgccaattctgggtcatcctctcttcttaccagacaactccatgcttctccagggagcaaaaagattgttggggtgttttacaaggccaacgagtactttacgaagaatcccaactttgttggttgtgtggagggagccttggggttgcgcccatggctggaatcacaggggcatcagtatattgttaccgacgacaaagaaggaccggactgcgaacttgaaaagcatatccctgatctccatgtgctcatatcgaccccattccacccg

SEQ ID NO: 25058 - DNA, 319 bp, Gossypium hirsutum
  Clone ID: LIB3272-045-P1-K1-F3
ggcgatcccaactcagttagtcctctcctttctcctcctttctttttcccctgtcgttttttgagaccgtgaagattgcgtttactcggtctacataaggacgggatccatcatcaaaggcggaaccgactccatcatcggcctacggctctacgatgccaatggctactcagtggagatcagcaacatcgaagcatggggtgggttaatggggccaggatacaactatttcgagaggggtaatttggacattttctcaggtaggggacgttgcttggatgcccctctttgtgccatgaacttgaccttcgatggttcg

SEQ ID NO: 25059 - DNA, 379 bp, Gossypium hirsutum
  Clone ID: LIB3272-045-P1-K1-F4
acaaacttcaaatcattattgtcgcaccaaaaaacaaatctgcatatacaccgggagagggtagcgaaaatggcaagcgagggacctgcaccaaaacatttctggcgtggtatgccagaggaagactattaccggtgagcaaggaatacgcaacatcaaatgttacttctacactcacaacggagcgctcttcacccagagctacttacccttggataaaaaagtgaaggcctacgactacacgacccacgggtatgggtccgacactggctggctcttccagaccatctgcgtcaacttttacaattggggccacgctcgtttcgcccatgatcttatcggccatggtagatacgagggactaccctgctatttaagt

SEQ ID NO: 25060 - DNA, 434 bp, Gossypium hirsutum
  Clone ID: LIB3272-045-P1-K1-F5
gcagcatgcgctgcacatccaactgccgatgtttttattaactttgcatcatatcggagtgctggtgcttcgtccatgtctgctctgaaacaacctaccattcgagttgttgctataattgctgaaggtgttcctgaatcagacaccaaacagctgattgcatatgcacgttccaacaacaaggttgttattggcccagctactgttggaggaattcaagctggagcttttaagataggtgacactgctggaacaattgacaatattgttcattgcaagctgtacaggcctggatctgttggctttgtctccaaatctggtggcatgtcgaatgaaatgtacaacactattgcccgtgttacagatggaatctatgaaggcatagctattggaggagatgtcttcccgggatccaccttatccgaccatatttt

SEQ ID NO: 25061 - DNA, 409 bp, Gossypium hirsutum
  Clone ID: LIB3272-045-P1-K1-F6
gagggtcctcctcctcctgaagagtcgcgttcaaagtctgccgctgctaatgctgtggctggacctggtattggtcgtgctgctggtcgtgggattccgactggtcctcttgttcaagctcagcctggtcttgctgggcctgttcgtggtgttggtggaccggctcctgggatgatgcagccccagatttcacggccgccggttccgcaactgtcagctccgcctatgacttaccctgctgctagtggagcacctcctgttatccgtgcacctggacaaatgccacctggtggttaccctggtcaaccacaggctcctcagatgcaacgtggtcctccttcacaggtaccaccacctgcttttggagtaaggccacctcaacaattccctgtcccaccaccacaatatg

SEQ ID NO: 25062 - DNA, 320 bp, Gossypium hirsutum
  Clone ID: LIB3272-045-P1-K1-F7
gcgaacgaaagagagagagagagagaaagagagagatcgagatcgccttctgaggcgtggtgtgccctaagaattctcacttttctcgctgtaaataagggcaaaaggcggggaacttttggggacgtgttcttacttaggttcagagccttcattcgagggttcttgttgttccttagcatggcaaccaatggaaatcttccaccaaatgctataaaggaactggcaaaggaattgaagggtcttgacgaatcacctccggaaggcattaaagtgggcgtaaacgatgaatcacttttcgatcatttatgctgacattg

SEQ ID NO: 25063 - DNA, 349 bp, Gossypium hirsutum
  Clone ID: LIB3272-045-P1-K1-F8
gcagctatttggtttaccaccaagatatagggactctgttcgggcaattacacctggcgttacctctatttctctataactatactactcatcagttgcatggtatttttgaggcagcaacttttgggggttctaacatcgatccaactgcttgggaagacaaaaatgcaaaggcgagtcaaggtttcctgctcaggtgagaatctgtattaggaaactctgcaaggcattggaagagatgcgtttaggccagtcttgcaccactatgatggccccaagtttcgtctcgagctctcagttcctgagacgttggatctattagacctttgtgaacaagcaggttcttcat

SEQ ID NO: 25064 - DNA, 399 bp, Gossypium hirsutum
  unsure (1)..(399): unsure at all n locations
  Clone ID: LIB3272-045-P1-K1-G1
accgnccggaancccggtcgaccgcgcgtccgaaagccctaaaattgaaatgccctcgaatatggccgccaccgccacaagcaccnccacattcgggcttggcaatccccttgcctcttcctcttcctcatccgtttactcctccaagaaattgcctgtcaatttcagaaaatttgcgcttcagacgtcgcctgtgaaaagcttttctgtttcttgtactctaactagaaaaccagtcccagctgctccggtttccatggattcggacccgaacggatggcaacgacccgactcgtttggtcggtttggcaaatttggcggcaaatacgttcccgagaccctaatgtctgccctctctgagctggatgcggcttttcattccttctccaaggatgaaaa

SEQ ID NO: 25065 - DNA, 430 bp, Gossypium hirsutum
  unsure (1)..(430): unsure at all n locations
  Clone ID: LIB3272-045-P1-K1-G10
tcttaccaaacgcacctcttttctcttccaatcctcctcccctttctccgcgttcctgcagctccggtgacggccgaggccgtggccgcggccgtgagggcgcctccccttctggtgcgttcggtggtttcactccagcccttggaaaacctgattcagaggacacgaagcgtgactcggctgaatcacaagctgttggatcaggccatggccgtggaagaggaatacccttatcgtctgaaccaattatcccttctttctcttcttttgtttcccaaaatgggtctggtcgaggccgagtcaccaatgagtcagttcggccgatacctncgcctccgccttcgccggcttcgagggaagcaaagcagccgatctttgttatgaagcaggatgagattgaaactgatttgtctgccaagctacctgctga

SEQ ID NO: 25066 - DNA, 430 bp, Gossypium hirsutum
  Clone ID: LIB3272-045-P1-K1-G11
tgaagtcaaacaaggaaaagaaaatcattcagctcagattcatggctacgcttatgacaaatctgctgctcacggcatgcattgctcttttcttggtatcagctgccaccgccgtcggcgactcccccttcatcatcgctcacaagaaggcatcgctcaccagactcaaatccggcgccgagtgcgtctccgtctctatcgacatctacaatcaaggcttctcgacggcatatgatttgagtcttgtggattatagctggccccaagatgcatttgatgttatcagtggaaatatttctcagtcatgggagaaacttgacgctggtggtattctatcacattcatttgaattgaggccaaaaaacaaggcatgttctatggtgccccagcagttatcttttttcgcattcccacaaaggctgctctacag

SEQ ID NO: 25067 - DNA, 433 bp, Gossypium hirsutum
  Clone ID: LIB3272-045-P1-K1-G12
acttcttctcttatttgaactcaaagtcccagctaatattagaatcatgggtgttgtcacttatgactatgagaatacctccccagtcgcccctgccaggcttttcaaggcctttactgttgaagctccgaaagtttggcccacggctgcacctaatgcagtaaagagccttgaggttgaagctaatcctagctctggaagtatcgtaaaaatcaactttgttgaaggccttccattccaatatatgaagcaccagatcggaggacatgatgaaagtaatttttcatacagttacgatttaatcgaaggtgggcctttgggggataagcttgaaaaaattagctatgagaacaggtttgaggcacctgcaggtggagggagtatttgcaagagctcaatgaaattctacactataggcgataatgttatcact

SEQ ID NO: 25068 - DNA, 355 bp, Gossypium hirsutum
  Clone ID: LIB3272-045-P1-K1-G2
gggtgatcttttggagtccttgtctaagatgggacaatcctacttgagtcctgcttcccaacctggagttggtgctgattctggcattcctgttggatcttctgagagcccttctggaccatatgctccaactggtgttttaccaaaatttacagctgttgattcaagcttcaagactggcaaggaagccaacactgaaaacgcagcagatggtgtggatgtacctgctgtttctgatccagctgctgttgatttgaatgctgaccctctttatgatgccaaccttactggatatactaccatgccctctggaccatctgcatcgaacatttgtgctcataatgacaagaaaaac

SEQ ID NO: 25069 - DNA, 422 bp, Gossypium hirsutum
  Clone ID: LIB3272-045-P1-K1-G4
gaaaaaaacaccttttttctctttcaaaaggacagtttttttttcttacacacacagcaaaatgccaataaattgccttaatttctcttagtttttgcttacgaaaatactttatacgtattcaccaaggcatgatctttcgatccaatgtaatttcgacccataaaacacgcttgatttgactcactgagttggagaaaaaattatgatagaagcactggagagatccgtcgtcaatggcagtggtttcactcagttacaacagagctatggagatagtagagaagaagagctatcggtgttgccacgtcacactaaaggggttgtcactgggaataaccgtaccaaatcggttcttgttggtcttcaaggtgtggttaaaaaagctggtggacttgggggatggcattggctggttctta

SEQ ID NO: 25070 - DNA, 374 bp, Gossypium hirsutum
  Clone ID: LIB3272-045-P1-K1-G5
aaaatataagaaaaaaaatcatacgcaatgagcactgctggtcaggttattcgttgcaaagctgcggtggcatgggaggcggggaagccactatcgatagaagaagtggaagtggcaccaccccaaaagcatgaagtccgtattaagattctcttcactgctttatgtcacactgatgtatactactgggagtgtaagggttacactcctctgtttcctcgtatacttggtcatgaagcctcagggatcgtggagagtgtgggtgagggtgtgaatgatttgaaacctggagatcatgtgctccctatcttcaccggagaatgcaaagaatgtcgccactgtctgtcagaagaaagcaataacatgtgcgaact

SEQ ID NO: 25071 - DNA, 155 bp, Gossypium hirsutum
  Clone ID: LIB3272-045-P1-K1-G7
cttagctttctttttagttttcctttaacttttgtaatatccttttagccttccgggatactctgtgaaccctgctcatcttctcccccagaattggtatcagagggggtggtgtaaccattttttggggaaataatattataatgttcattgga

SEQ ID NO: 25072 - DNA, 314 bp, Gossypium hirsutum
  Clone ID: LIB3272-045-P1-K1-G8
atggcatcaaaagacccagcaagggtcaagtacttgtcgagccttctagcccaaaagaccactgcggttcccattgcttcaggccaacaagtcctaaatattggcaactatgtcgtccgggtaaagattggcactccgggtcagctcatgttcatggtattggacactagcaatgatgtggcttgggtcccatgctccggctgcaccaggtgctcagccaccactttctcacccaacacttcttccacctatggttcgttggattgcggtttgccccaatgcgcccaggtccatgggctgtcgtgcccggctac

SEQ ID NO: 25073 - DNA, 439 bp, Gossypium hirsutum
  Clone ID: LIB3272-045-P1-K1-H1
aattccggggcgcggacgcgtccgggtaccggaaaatttgtttggcaaggtttgcatcatcatagacaagattgaaaagatcccaatagatgagattaagagagagttgaacgctactgggttatcagaagaggctattgaggaactattacaagtgctttccataaagtcattgactaagttggaagagatacttggaggtgctggggaagctgttgctgacttgaaagaactgttctcactttctgagaagtttggttactctgagtggattcagtttgatgcatctgttgttcgcggtcttgcctactatacgggtatcgtttttgagggttttgatagacaaggaaagctaaaagctatttgtggcggtgggcgatatgatagactactttctacttttggtggggatgatggtccagcttgtggctttgggttc

SEQ ID NO: 25074 - DNA, 322 bp, Gossypium hirsutum
  Clone ID: LIB3272-045-P1-K1-H10
gctttgtatattgaagtttcctttctcgattttctatttagccaaacaagatgcagagcttcgttaagactctaaccggcaagacgatcactctcgaggtcgagagctccgatacgaacgacaacgtgaaggccaaaatccaagataaggaaggcattcctccagaccagcagcgtctgatctttgccggaaaacagctcgaagacggccggaccttggccgattacaacattcaaaaggagtcaactcttcaccctcgtctccgtctgcgcggtgggatgcaaatcttcgtgaaaaccttgactggcaagacaatcactct

SEQ ID NO: 25075 - DNA, 383 bp, Gossypium hirsutum
  Clone ID: LIB3272-045-P1-K1-H11
ccccccttctcaattttctccttcaactccaacccactgctccactctttgaaaattcaactcttcttttcttccccaaaaagccccactcactgagtcacttctcactctcaaaccccgtaaaaaagcaatttcccagaaaatgtctttctccacccggcagaggcgagcgacggtgtcggatcttccttcatcgtcgtctccaccacaaccgtcgaagcctgaatcatacacgaaagtggataagccaggacgatcatcatcggacggcgttggcgaagaccgcggattggggtggttcacggggttgtttgctttgggaatgctacggtatatgagcgccacaataaatataatacacgactgcgatgaagtctttaata

SEQ ID NO: 25076 - DNA, 400 bp, Gossypium hirsutum
  Clone ID: LIB3272-045-P1-K1-H2
caaccctgggaaacttttggcataagggagggaagagcagtgattgttggtgttgttgaatcatgagttgcaacgggtgccgcgtcttacgaaaaggatgcagcgagtcatgtattttacgaccttgtctgcaatggatcgacggccctgaagcgcaaggccatgccactattttcgtcgccaagttctttggccgagcggggctcatgtccttcatctctgccgtgccagaatctcaacgttctgctttgttccaatcactgttgctcgaagcttgtggtagaacagtgaatccagtgaacagagctgtcggacttttatggacagggaactggcatgtttgccaagcgggagttgaaactgtcttacgaggaggaactgtcgggcggtcctgaactta

SEQ ID NO: 25077 - DNA, 314 bp, Gossypium hirsutum
  Clone ID: LIB3272-045-P1-K1-H3
atccaatatcgctgctaaaaatgatgacccagttatccctaaggttgagataacacagaaaatgcgtgttgatggggaagtcaacagggctagatgtatgcctcaaaacccggttattatcggcgcaaagaccagtggctccgacgttttcgtgtttgattatgccaagcaggctgcagctaaagagcaggagggtgactgtgttgctgatttgaggttgaggggtcatgaaaaggaagggtatggattatcatggagtccatttaaggagggttatcttttgagtggttcacaagaccataagatatgccttt

SEQ ID NO: 25078 - DNA, 307 bp, Gossypium hirsutum
  Clone ID: LIB3272-045-P1-K1-H5
atccgctgcgtccaaaccgcatccgaggtcgtcgccgccctgtgtgccgtcgatgtcgaggccaatgccaagtcatctgccgacgtcataaaattcgacccatcaaaagtcaaggtttctattgagtatggtttgtgtgagatgttaaacaaagaagcgattagggttgatgtagcgccgaaagatggaaacttcggtttcgatgttccactgcttgagactatgttcccgagtgggacgtttgatcctagtcttggacgagtttacggaaagatgccacaatgggaagaaacggtggtttaatcta

SEQ ID NO: 25079 - DNA, 381 bp, Gossypium hirsutum
  Clone ID: LIB3272-045-P1-K1-H6
gccactaagcttttgagagaagatcagaatggcgtctaaaagagcagcttccatgggcctccttttggcactcaacattctgtttttttccctagtcagagcttgtggctcttgctcttcacccacccgcaacccaagggcgaacccgaccgcgaacaaccccacttctacgtcatctgcacgaggcaggtgccctagggatgccctcaaattaggtgtatgtgccaatgtgcttaacctagtcaatgtcaccgggggttcacccccagtgatgccaggctggtcccttctcaatggccttggcgacctagaagcgtgggcatgcctttgcaccgctatcagagcaaacattttagggcttaacctcaacatcccaatttc

SEQ ID NO: 25080 - DNA, 352 bp, Gossypium hirsutum
  Clone ID: LIB3272-045-P1-K1-H7
tgaaatctcgttccccatcgacgcctctgcttatcgcatcatcagccatgtcgaggagaaaggttagggagccaaaggaagagactacaacccttgggcctgctgtacgagacggagagcatgttttcggtgttgcccacatttttgcatcttttaatgacactttcattcatgtgactgatttgtctggaagagagactatggttcgtattacaggtggtatgaaggtgaaagccgacagggatgaatcttcaccttatgctgctatgcttgcagcacaagatgttttccagagatgcaaggaacttggaatcacggcccttcacattaaattacgtgccacagaggtaac

SEQ ID NO: 25081 - DNA, 333 bp, Gossypium hirsutum
  Clone ID: LIB3272-045-P1-K1-H9
caatcagttccggcgaatcaaatggcaaaagaagttgttaatcccgatgaactggttgttgttggagaggaattagaccatgtaagaatcatcactttgaacaggcctcgacatttgaatgtcatctcatccaaagtggtctccctgctagctaaatacttagaaaaatgggaaagagatgagcaagctcagcttatactgatcaagggagccgggcgtgcattttctgctggtggagatttaaaaatgttctatgagggaaggaaatcaaaggattcctgccttgaagtggtctataaaatggattggctttgctatcacattcatacctat

SEQ ID NO: 25082 - DNA, 320 bp, Gossypium hirsutum
  Clone ID: LIB3272-046-P1-K1-A1
acgcttttcttacactgtaacagccatggaagctgtgaacatgaagaaaaaagacccaaaaggagtggtggccgtggacgagagtgatgagagcatgtatgcactttcatggtgcttagcaaatttgatttcccagacctcaaccagcaacctcgtgcttctttatgtaaaaccttcaccccctgtctattcttccctcgacgctgcaaggtatatgttttccaccgatgtgatcgtagccttggaaaaatacggcagtgacatggtgaatacagggatgagaagagctgaagctatttggagaaaatccaccaccaaaa

SEQ ID NO: 25083 - DNA, 469 bp, Gossypium hirsutum
  Clone ID: LIB3272-046-P1-K1-A11
cggtccgacctacccggttcgatccactccagtcgctctctgcgccatcttttctttttctttcttcttcatttaaagagaaggttgaggaaccctagctgattttttttttccaaaataaaattgaaggttgaggctttagctttccattgagaccatgacgacatcgtttgggagtgcaacgagtaccgtgatacccaacgatcccaagattagaatgcaaagctttacggggttgaaatctttgcattctatagctttggcgaggaatcatcgcgtgtttccacttcccttctccactccttctgttattagagctgtctctacgccagtgaaacccgaaaccagtacaacagagccaaagcgaagtaaagttgaaatattcaaagaacaaagcaatttcattagataccctcttaatgaggagatattgactgatacacccaatataaacgaggctgcgacacaa

SEQ ID NO: 25084 - DNA, 453 bp, Gossypium hirsutum
  Clone ID: LIB3272-046-P1-K1-A12
ctgcgcgtgcttatgccatccctctctcactaaaaacactacactgggctcaaacccctacgggtgaccattctttgcggcaccaccgtacatcccttatataactatccaacactgtctgcattggagcccatacggaccgaatcgtatcacccgagcggcgaggattttgtgcacatcgacaaccctaaccctaatgtcgtggacgcattgagcgatagcatcgtgaacgttgaaaaggaggaggaggaagaagaacaagaagaagcagcatcagcatcataagagatccgagacgaggattattactacagaaacgatggcgatgtttttaggagcgaaagatcttattcctcggagagaaggaatgttgaactcccggaggagattgcgaggagcgttattgttctctcgagccaatcctcttctgagggcggaaatttcgatgtttac

SEQ ID NO: 25085 - DNA, 317 bp, Gossypium hirsutum
  Clone ID: LIB3272-046-P1-K1-A2
gtttccttaaacccaaaatttcccccttcattggaatcttggtggtactgttagtctagaattacataaacaggctctgtggttcatgatcttcaatattaccagcaccaatgtcatccttcttgcaccaacgacccatccagaatccattctcgaacgcctatccagtctccccacgttcttcatcaacctcgcaaagacccatttcgatctttagtccaacaggcctaattatcctcctctccctaatggtaatcctcggagtgttcgtgccttggtctggcatggcccgagccaccttttctaactctaaaaag

SEQ ID NO: 25086 - DNA, 217 bp, Gossypium hirsutum
  Clone ID: LIB3272-046-P1-K1-A3
acgcttctttttcgttttttaatttgctttctataatggctaaatcttatttacctgcagactgtgggtttatggcttaaagaatgctgctttttgggctgtttatggtatccctatataccacaagtgctcaaataggtgtttgctatgggacaggtcggcaacaacttaccatcaagggccgaaggtatattcctgttcaaccagagaaacatta

SEQ ID NO: 25087 - DNA, 463 bp, Gossypium hirsutum
  unsure (1)..(463): unsure at all n locations
  Clone ID: LIB3272-046-P1-K1-A4
ggaaatgccggctggaccaacgcgtacgattataagcacctncggataagcaaaccacataggactgcttggagagagacccaaaagcaatgtctaaggaagtgagagaagaatgacagagtcgtaaggactatgtgtaccctacaccggcacctctgattgatttggctgaactcaaggcatggtctttttacagaggcctcatagctgagttcatagccactctcctcttcctatatgtcactgttgctaccgtaattggtcacaagaaacaacaagatgcatgtgatggtgtaggtctcttgggtattgcatgggctttcgggggcatgatctttatccttgtttactgcactgacggtatctaaagtggacacattaaccctgcggtgacttttgggttggttttggcccgtaaagtatctcttatcaaggctggggcttacatggtgtcacagtgctt

SEQ ID NO: 25088 - DNA, 444 bp, Gossypium hirsutum
  Clone ID: LIB3272-046-P1-K1-A5
tagcaaagcaagtggcacaaagacatatggaggcgaaagtagtgacagtgaagtcgatgggagagtacataaacatccaatgaatatacagggaatgagttctggtgtttcaagtgagaagagggaaggtgtcaagaggagggctgctggagatattgcaccgactgttcggcactacagaagtgtttcaatggacagttacatgggaagtctgcagtttgatgaggatccaccaaaaattcctccttcaggaaatcatggcaatcatcactctcctggtagctcaagcgatgcaaattcaagtaaattcaactttgagcttgggagtagtgagttcaatgaatctgagcttaaaaagatcatggaaaatgagaagctggctgagatggcatctgtagatccaaaacgcgtcaaaaggattttggctaatcgtgaatcagctgg

SEQ ID NO: 25089 - DNA, 435 bp, Gossypium hirsutum
  Clone ID: LIB3272-046-P1-K1-A6
ccgacaccggaatttagtccaactcttgggatattgccggcgcaaagatgagctgctgggggtctatgactacatgcctaatggaagtcttgataagtatttgcatgaccagccaaaagtcaccctaaattggagacaaagattcagagtcatcaaaggtgtagcatcaggattgttctatttacatggagaatgggatcaaggtgtggttcatagagatgttaaagccagcaatggtttactggatggcgaattaaatggaagattgggagattttgggcttgctagattatatgaccatggaacggatccccaaacaactcacgttgtgggaactcttggttatttggctcccgagcatactcgaaccgggaaagccacgccgtccaccgatgtgtttgctttcggggcatttttgcttgaagttgcgtgtgg

SEQ ID NO: 25090 - DNA, 162 bp, Gossypium hirsutum
  Clone ID: LIB3272-046-P1-K1-A9
gtcggcagcactcctctcaattttctgtagttattacacctacatcctacaaccataagaaacttggacttaactggctaaagacttggaaaaataaattctggaatcttggctttcctataccagaattgaccccacatgtgcttaattttgcatttgggc

SEQ ID NO: 25091 - DNA, 373 bp, Gossypium hirsutum
  Clone ID: LIB3272-046-P1-K1-B1
ggcaccttaacttattacaatatccaaaaacaatccaccctccaccgggtacttactgtgtgagggggcatgcaaatcttaatcaaaactctcactttaaatacaactacctttgaagtccaaagttcctattccattttcaatctcaaaaccaatattcactacaaaaaaatttcttccaccataccaacaaaaatttattttttctccaaaacaactttcattattcataactcttccccactataatatacaaaaagagtctacatctccatttttgtctccttcttccgattttattctaatctttttaaaaactcttaccaaaaaaccatcatttttaaagttaaaagatccaatcctttacattttt

SEQ ID NO: 25092 - DNA, 154 bp, Gossypium hirsutum
  Clone ID: LIB3272-046-P1-K1-B10
ggatccgtaacctagggaaaaggattggctcttagggctgggcacggggatcccagaggggaacacttctggtgacggcgcactgatcgagctgctcccgcagcgagagcggttctacgtgtgccggccgggggacagactgggaacggctccc

SEQ ID NO: 25093 - DNA, 483 bp, Gossypium hirsutum
  unsure (1)..(483): unsure at all n locations
  Clone ID: LIB3272-046-P1-K1-B11
ccggcccgcatttccggggcggacgccacgcgtccgaatacaaatacccattttcaccaccatcaaaccacatcccacagacatgggtgcccacgaagaanaagccggaggtgaagagtacttgtttaagatcgtgctgatcggtgactcagctgtgggaaaatcgaaccttttgtcacgttttgctaggaacgagttcgacaataactcaaaggcaactattggagtagagttccaaacgcaatgcgtggaaattgatgggaaagaaggtaaagcacatatctgggacactgctggtcaagaaagggttcgagctgttacttctgcttactatagaggagctgttggtgctcttattgtttatgatattactaggaggagtagctttgacagcattaaacgttggcttgatgaacttaccactcattgtgaaactacattgacaagaatgctggtggggaacaaatgtgatttggagaacat

SEQ ID NO: 25094 - DNA, 423 bp, Gossypium hirsutum
  Clone ID: LIB3272-046-P1-K1-B12
agacaccactttgaaacccggaaatgtcggacgaggagcatcatttcgagtccaaggccgacgccggcgctgggaaaacctaccctcagcaggccggcaccatccgcaagaacggttacatcgtcataaaaaatcgcccctgcaagggtggtgaagtttccacctccaagaccgggaagcatggtcatgcgaagtgtcactttgttggaatcgatatcttcactgccaagaagctcgaagatattggtccttcttcccacaattgtgatgttccgcatgtcaatcgtactgactaccagttgattgacatttctgaggatggatttgggagtttgctgactgagagtggagacactaaagatgatctggggctcccaactgatgagaacttattgaaacagatcaaggatggttttgctgagg

SEQ ID NO: 25095 - DNA, 218 bp, Gossypium hirsutum
  Clone ID: LIB3272-046-P1-K1-B2
acacctgcaataccggtccgggactcccgtgccggccgatgcattcaaaaaacttaaaaaacaaacgttcatctcggttttgccctaaatcagggttctattctgcgccggcgccggatcaactttataggactccaaccccatacaaatggtatccaatggcctcagccgcttcgaatccttccttcttcctctcatcagtcacactcaccatgctc

SEQ ID NO: 25096 - DNA, 342 bp, Gossypium hirsutum
  Clone ID: LIB3272-046-P1-K1-B3
aaagaagccaccgctttgtggaaacagcagctgtcgattgagggtggtctttggtggggaaagcaaagccatggcgttgaacggtggtcttagatcggcttcgaagtttctgacttcgtcctctcaatcacttctccacaagtctggcaatagagggtttcattcaactggagtgaagagaatggggggagggcatgggcatgatgaaccggattacctccatgctaaacatatgtacaacttggataggatgaaaaatcacaagctgacaatgtctctttggagttttgacaggcttcaacattgggtgtggttggctcactatctaatgctgggcatttt

SEQ ID NO: 25097 - DNA, 442 bp, Gossypium hirsutum
  Clone ID: LIB3272-046-P1-K1-B4
cagaatttgaggagtctattgcgcaggcattcttcgatttggagagtgccaatcaagagcgtgaaaagggaccttaaagatctctatattaattcagcagtccaaattgatgtttctgggagccggaaagctgttgttatccatgtcccgtatagattgaggaaagctttccgcaaggttcatgttaagcttgtgagggaacttgaaaagaagttcagcggcaaggatgtgattcttattgccaccaggaggatattaaggcctccaaagaaaggttctgcagttcagaggccacgcagccgcacattgactgctgtacatgaggcaatgctagaagatgttgtcttacctgctgagattgttgggaagcgcactagatatagaattgatggatcaaagataatgaaggtggatttggaccccaaggaacgtgataacacag

SEQ ID NO: 25098 - DNA, 422 bp, Gossypium hirsutum
  unsure (1)..(422): unsure at all n locations
  Clone ID: LIB3272-046-P1-K1-B5
gaaccgtgaaaggcagtctctcccgctccttctcgctgcgatttcgtggtcaanatctgggttctcaaatcgtggcgctcttttctatcaagccatggctctggtcttgcatgcaggaaaaacaaacaaaaatgcctttaaggcactcattgctgcagaatatagtggtgtgcaggacaaaatggttgagaattttgagatgggtgtgtcaaataagactcctgagttcatcaagatgaaccctttggggaaggttcctgtgttggaaacacctgagggtcctgtatttgagagcaatgccattgctcggtatggtgctcgctcaaagggtaacaaccctatatgtgggtctacattgattgattatgggcatatccagcaatggattgatttacagccatggaaatggatctaatattgca

SEQ ID NO: 25099 - DNA, 418 bp, Gossypium hirsutum
  Clone ID: LIB3272-046-P1-K1-B6
aaggattctacccgccgctcggtgcgaattactctccacaaaggcgcgggcaacttggccggcgcgggcgctgcacctacaacacatacccttgggagccagaagctcctactaaaaaatgcaatctgactactgtcgcatacttcacttctaaccccgattctgacttaaatgcggtcaatcataatccaccacacggtagcttcactccactagcttttaaaccaaatgcgattaccaattatgcgaatcaacggttcctttcgaactaggctgaattacatattacgacaccgccatcaataggggtaaactaacttgctttatgacgatctaaccactaactacgttccctattggtggataaacaaacacacacttgaacaaatttgcttcacatttattgggggaaccaaca

SEQ ID NO: 25100 - DNA, 445 bp, Gossypium hirsutum
  Clone ID: LIB3272-046-P1-K1-B7
tgaggatgcagtcagtggctgtgaaaacaaaggttcatctcggttttgtcctgaatcaagtatttcatctcctcaagggcttgaagattcacatcggatacctgttgagaatcaattgcgtgaagtaatgacagtccatagctcgggttctgagaccactcctcatgactctgaactggcgaccttacactcccttggagaagaatcgataccttcgggtttaggatttctcgtgtccaatagggaacaaggccacggagatggaggtgtgcttcatgttgatgttgtgagcattacttccaatattatatccaatggcggtgctgatacaagtaatcgtgaagccaggaagaacagtagaagattgttctgggatgcattttcgaggcacagttctagaagacttaatgattccccgtcaaatgataggaacgatgtagcatct

SEQ ID NO: 25101 - DNA, 445 bp, Gossypium hirsutum
  unsure (1)..(445): unsure at all n locations
  Clone ID: LIB3272-046-P1-K1-B8
tgaggacgcattcagaaaacttaataaacaaaggttcatctcggttttgccctgaatcaggtatttcatctggtgaagggcttgaagattcacatcnnatacctgttgagaatcaattgcgtgaagtaatgacagtccatagctcgggttctgagaccactcctcatgactctgaactggcgaccttacactcccttggagaagaatcgataccttcgggtttaggatttctcgtgtccaatagggaacaaggccacggagatggaggtgtgcttcatgttgatgttgtgagcattacttacaatattatatccaatggcggtgctgatacaagtaatcgtgaagccaggaggaacagtagaagattgttctgggatgcattttccaggcacagttctagaacacttaatgattccccgtcaaatgataggaacgatgtatcatt

SEQ ID NO: 25102 - DNA, 417 bp, Gossypium hirsutum
  Clone ID: LIB3272-046-P1-K1-B9
attaaaccttctgcttagcttaaaaaatcttgaatctgcactctcctacttccctcggtgtcgccaatgggttggggcgggaagattaagatcggcattaacggatttggaagaatcggacgtttggttgccagagttgctcttcagaggaacgatgttgaactcgtcgccgttaacgatcccttcatttccaccgattacatgacatacatgttcaaatacaacagcgttcacgggcaatggaagcaccatgatcttaaggtcaaagactctaaaaccctgctcttgggcgaaaaacccggcactgttttcgggatcatgaaccctgaggagattccatgggctgaagccagcgctgagttcgttgttgagtcaactggagtgttcactgacaaagacaaggctggtgctcacttg

SEQ ID NO: 25103 - DNA, 241 bp, Gossypium hirsutum
  unsure (1)..(241): unsure at all n locations
  Clone ID: LIB3272-046-P1-K1-C1
aacgaaaagagtttgcaagttccaggttccttttctgctttagtatgaagtcgatgcatagtcatattaggttgtttatgtgcttgcttgttagtccctttattggaataaaactagtcatgtaattgaatatgcattcttctggttatatggtggaatttggatttggagagttatatcactggttctttcgggttnaacctaataaggctacatttataggaaatgttgatttaaaacc

SEQ ID NO: 25104 - DNA, 475 bp, Gossypium hirsutum
  Clone ID: LIB3272-046-P1-K1-C10
cgggccggaattcccggggcgcgcgacgcgtgcgcggggatatcactgcgagggaaaaaaaaaaaaaccagacatgggttccaacactatgggagccgctactctggggcttaccttgaacgtgggtggtcttcactttggttagctctacctacgtgccttggccaccaccaccaaagaggcacaaggctaccgacaagagcccaccctcgggacctaaacaggcaggcacttgccccaaagatacactgaaactagggggttgggctgatttggtgggctcggtgcgcgttggtgttggaccggccaggaccaaatgcgggtgactcatttcgggtttggctgatctcgatggtggtggttggctttgcactgcgtattaaaggtaatggggtgggggggaacctaaacgggcctgggtcattggctttgctcctcaattcctgggaaaagcgaatggctgctgggtacaaat

SEQ ID NO: 25105 - DNA, 410 bp, Gossypium hirsutum
  unsure (1)..(410): unsure at all n locations
  Clone ID: LIB3272-046-P1-K1-C11
acgcgtgcgggacaacatggggaggagacctgcaaggtgttatcgccaaatcaagaacaagccatacgcggaaatctcggtattgccgtggtgttccggatcctaanatcagaatttatgatgttgggatgaagaaaaaaggtgttgacgagttccctttctgtgtccatcttggcaggtgggagaaagagaatgtctcaagtgaggcgttggaggctgctcgcattgcctgcaacaagtacatggccaaatttgctggaaaggatgcgttccatttgagggtaagggttcatcccttccatgttctgcggatcaacaagatgctttcatgtgctggtgctgataggcttcaaactggaatgaggggtgcttttgggaagcctcaaggaacatgtgcaagagttgacatt

SEQ ID NO: 25106 - DNA, 434 bp, Gossypium hirsutum
  unsure (1)..(434): unsure at all n locations
  Clone ID: LIB3272-046-P1-K1-C12
ggcgcacacgtccgcttgggttgagtgtanagatgaggaaaatcatgggtgccaaaggtcttttcttctttggggtgctttccttgggagctggctcagcatttgcacangatgaggaaaaccaangtcttggtatgaacttctacaaggattcttgtcctcaggctgaaaacattatcaaggagcaaggtaagctactgtacaagcgacacaaaaacactggtttttcttggctgagaaacattttccatgactgggctggccagtcatgtgatgcttcactggtgctggactccacaaaaaggagcttgtctgagaaagagacagacaggagctttggcctaangaatttcaggtacattgagaccatcaaagaagctgtagaaagggaatgtcctggagttgtttcttgtgctgatatccttggtctggct

SEQ ID NO: 25107 - DNA, 105 bp, Gossypium hirsutum
  Clone ID: LIB3272-046-P1-K1-C2
cccgcaataccgggtcgggcctaccccttcgacccacgcataccaaaatatctcatatgttctcctacttcttataaatcttattataagggccaaacccttaaa

SEQ ID NO: 25108 - DNA, 366 bp, Gossypium hirsutum
  unsure (1)..(366): unsure at all n locations
  Clone ID: LIB3272-046-P1-K1-C3
gccgggtctgaattaccggggcggggacgcgtgtcgggccacgcgtccgaaacgatcaaccaaccagaaaagagaaacatgatggtttcagggtcagggatctacacgaagagagtgggtgtggatgcaangcatcacatgctaggaaggtgcgcttccattttgggcaacgagttggtgaatgggcaaaaaggagtgggtggtcgatgcgaagagatttgtatgtcgggtggtttagtgaggcagaaaatgaattacatgatgttcttgaggaaacagatgaacactaaggcttctcatggccccattcattttcgggctcctgctaagatcctctggcgtaccattcgtggcatgattccccac

SEQ ID NO: 25109 - DNA, 427 bp, Gossypium hirsutum
  Clone ID: LIB3272-046-P1-K1-C5
gggatagagaattgtgacctgagattattggcttgcaaagacccaattgactatggaacaagaagtatggtaagggatagagcaaggttggtttgggcagaaaacacgcaagcaaggagtgcttgcattgatagccctgatagctatgattatggagcttataaatggaccgttcaactcgttaccaacgatagtccgtctcgagaaaatactttttcctatcttgtggggtcttatgactctcagcacatttgggaacttggagagcacaacagaatggctggagggtgttttcaacatcattgatcttactaggggacttgttctagtcacaatgttgattggtaacattaacgtgtttttgcatgcaacaacgtgcaaaaaacaagcaatgcaattgaagatgaggaacataaactggtggatg

SEQ ID NO: 25110 - DNA, 352 bp, Gossypium hirsutum
  Clone ID: LIB3272-046-P1-K1-C6
ctcaaagccaatggcttcctctctcaacagcacccactctatacggggcttcatttattgatcttggtgctcttcctccccccccactaaactatcactcccttccacttacctatctttctcttcttctatcaaatccctcgctatctctcctctttctcaccacaaaatgtgatcggctgtcacaatatccattaccggatggtttacctatctacccagtccaaaatgctctgcttcagatcctgatcaccagaagagtgctatatacaatatcaaggatcttttcaaatacaaattctgccatcctattctgattcaactaaggtgacacgatactggtacctacaac

SEQ ID NO: 25111 - DNA, 363 bp, Gossypium hirsutum
  unsure (1)..(363): unsure at all n locations
  Clone ID: LIB3272-046-P1-K1-C7
agaaaagcagagccgcatcactttttgctagctaagctactgtgggagttattgttctgcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcangtgcaccgccggcggcagtgacggctagctttggtaggcctggagcgatggggaaagtggaacgaagatatgcgatgaaagagtcgtcgtcgtcggagacaagggcttattctt

SEQ ID NO: 25112 - DNA, 164 bp, Gossypium hirsutum
  Clone ID: LIB3272-046-P1-K1-C8
tgtgaatcagagaaaaccctacctttgtttgtttatctaatgtgtttgaattggaacgggcaaacaaagggaggggttgttaatgatcacagttatattaccaaaaattatacatctttgaacatttgctaatgtaaagcgggtaaaaaggactgtagtatgaa

SEQ ID NO: 25113 - DNA, 456 bp, Gossypium hirsutum
  Clone ID: LIB3272-046-P1-K1-C9
gcggagcaaacgagctcaaaagccttctgacccaactgaggcccttttttgcactaattccaaaggcaaaaactggtaaaattggccgtggtataattgatgatgtagctaagataccaggaacatcagatctccagatttctctttgcaaagaagtggtgcagtggactcgtgctgagaagcgaactttccttcgccaacgagttgaggcaaagcttgcggcacttttgatggagaacaaggagtactctgaagcactgaatctcctttctggtctaatcaaggaggtcagaaggttggatgacaagcttcttctagtcgacatagacttgttagagagtaagcttcatttctctcttcgaaacctgcgcgaaagcaaaggcatctctaacagctgcaaggacagcggcaaatgcaatttatgtgccaccagcgcaacaaggtaatatagatttg

SEQ ID NO: 25114 - DNA, 180 bp, Gossypium hirsutum
  Clone ID: LIB3272-046-P1-K1-D10
gctggactcacttttctcttcacccttacttttctcctcttcaccttatctcaagcccgcttcatcacatgggaatcccaacatgatgtcacccccaaaaaatacgatacccattttccctaaatccacccccaattccccattctttttcccaacgagaaaccccacttttaacccccc

SEQ ID NO: 25115 - DNA, 458 bp, Gossypium hirsutum
  unsure (1)..(458): unsure at all n locations
  Clone ID: LIB3272-046-P1-K1-D11
ggggggcacgcgtgcgggggccttattgtttcttcctcttttagattttctttctctccgttttctttccttacgggtatngcagggcaatgtgaagagtggtggacggatcgccagcttggggaagcgacttcttaaccggacctccactcgcaccccttctgttttcatctgcacttcttcacctaccaggagtcctcacgcggcggcatacgacaagaacctggatgatcagggccatgcgactgtgggtcctgatgatgtgattcaacctcaatcggacaagtactgggctcctgacccgcggacaggggtatttggtcctgctacggagcaacttaacgcatctgggggtggggagcanggcacccattccagtggtgcaaactcggtcctggaggaaaaggcgtgggtccgccccacaagtattgaggacttggagaagccacaccatcact

SEQ ID NO: 25116 - DNA, 446 bp, Gossypium hirsutum
  Clone ID: LIB3272-046-P1-K1-D12
ggaaaacaagaaaagcagagccgcatcactttttgctagctaagctactgtgggagttgttggtcttcagaggagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctatctttggtaggcctggagcgatggggaaagtggaacgaagatatgcgatgaaagagtcgtcgtcgtcagagacaagggcttattcttcagcttgggcgcctgaccctgttacggggtattaccggccggagaactgtggggctgagatcgatgcggcggatc

SEQ ID NO: 25117 - DNA, 375 bp, Gossypium hirsutum
  Clone ID: LIB3272-046-P1-K1-D2
tggaaatccaaaaatctcctcctgaaattcactcaatcttagtcttcccctacccttcggttctctttctcattccctctgcttctccctccttcgccttcggaacccttcattttccagaagcttgaaataccatttctctcttttggtatttcaaatcccccccccaaacaaaaaaccctaattttctctacaatcctaaaccaagtctctttctttcttttccggataaataatcagaatcgatgtgaattggagcggttggaattttccttctacagaattactcctcatctggtgcttcagattataataaactggatttaatggaggctaacgtttgtgacattaatcacttaaatgccgatgttcttt

SEQ ID NO: 25118 - DNA, 300 bp, Gossypium hirsutum
  Clone ID: LIB3272-046-P1-K1-D3
cgtgcggtgcacaatcatagtgtaaaatagccatgtattttatcttcttgtcaccctacattgttgtgctacttctcgtgggtactccaaactgggctactaactataataccgtgtatttgacaagcattaaaaataccattgatgactcttggtattacaaacccccttcatggacaaaaaaccccaatactgtataaaaattgaaccaattacatgtatttatttctcgaaaaataatcagaacagatgtgtaattataacgctgtcttttttcttactcaggagtactcctcatct

SEQ ID NO: 25119 - DNA, 439 bp, Gossypium hirsutum
  unsure (1)..(439): unsure at all n locations
  Clone ID: LIB3272-046-P1-K1-D4
gggatattgaacaagctgactcctgagaagtatgatcttctgaagggccaacttattgggtctggtatcacatcagctgatatcttgaagggtgttatttctctaatatttgagaaggctgttctggagccgacgttttgccctatgtattctctcttatgttctgatcttaatgataagctgccctcattcccatctgatgaacctggtggaaaagatattacatttaagcgagtcctcttgaataactgccaggaggcatttgaaggagctgacaagcttanggaagaagtgaggcttatgactgcccctgagcaagagatggatcgtagagataaagaaaggatggccaagctccgcactttgggtaatattcgtttaattggcgagcttctgaagcagaaaatggtacctgagaagatagtccatcacattgtac

SEQ ID NO: 25120 - DNA, 441 bp, Gossypium hirsutum
  Clone ID: LIB3272-046-P1-K1-D5
tttgactggtggaatatgtcctattaccaagacgatgatgctgaatggatggcaaatgggtgtggcatggaggacatagatgacatggatgaagagttccgtgccagagatatgtctggctcggagtctgatgttgatgaatatgatttctcgaataacaaaatatctgatacttctgctgctgaagctagaagaggaaaagacatccagggaataccttgggatcggctaagcatcactagggaaaagtataggcaaactaggctagagcagtacaagaactatgagaatatcccccactctggagaagtctccgggaaggattgcaagattaccaagaagggtgcctcatactatgacttcaggctaaattcaagatctgtggaatcaacaatacttcattttcagttgaggaacttgatatgggctacatcaaaacat

SEQ ID NO: 25121 - DNA, 443 bp, Gossypium hirsutum
  Clone ID: LIB3272-046-P1-K1-D6
gtgaactaaaaaaagaaaacccgtaattttaaagacaaaaaaatgcggggttctccatgggttcttctgtcaaaaaccatgattttcccataccaaaaatcaaaccttgaatacctcaagctttcaatttccaatctttctatactatcttgccattacattcaaaaagggtgcctctttactctcccttcaatccccattaattcactgatttcccttctcaaacaatccttgtccaagacgctgtcatttttccctcctctcgccggccgtttttacacaaacccaaatggttacatttacattacttgtaaccacgccggcgttgaattccaccatgccaaatgtgacaccaaattcattcgtgacgtcatcagtcctgttcatgtaccacaagtggttaaagagtttttcacctttgataaaacggtgaggtatcgagg

SEQ ID NO: 25122 - DNA, 400 bp, Gossypium hirsutum
  Clone ID: LIB3272-046-P1-K1-D7
caagtgtgttttgcttttcatactcatttattccctttcattagcgggaaaatcactgggggtttctttatcactgaaaaatgtcttgctgtggtggaaactgtggctgcggtactggctgcaagtgtggcattggctgtggaggatgcaagatgtatccagacctgaacgctgccgagatgaccacaactgagactctggttcttggtgtagcaccccagaaagcacactttgagggagctgagatggaattcggggctgagaacggctgcaagtgtggagacaactgcacctgcaacccttgcaattgtaaatgattagagaccaaagccaaagctccctggaagcagaggcgcctttgtctttaagaaataatatgttttggtggttatgtgttttt

SEQ ID NO: 25123 - DNA, 396 bp, Gossypium hirsutum
  unsure (1)..(396): unsure at all n locations
  Clone ID: LIB3272-046-P1-K1-D8
atacggaaaaaatggctttgaattttaatcccatcgtctcnaaacctcaggggcttctttcctttgctcttccacgaaaggccaccctcacatctcccaagttttccatgatctacaccattccttctggctccaaaaagggtgggaaaatgaaaaagcctttcacacctacaaatgagttgcctgttcatatcacccactccatgccgccttacaagattgagaactttaaatatttggagggctgggctgagaacaacattcttactcacctcaaaccacttgaaaaatgtgcgcaacccatcaactttcttacatatactaattctgacggatttcatgatcaagtcaaagagcttaaggaaagggcaaatgaaataccagaccattactttg

SEQ ID NO: 25124 - DNA, 366 bp, Gossypium hirsutum
  Clone ID: LIB3272-046-P1-K1-D9
caacaattggtatcatgagcctatgtcttacgggaccattgattttgcttcccctggtgggtgaaaagaaagaaggtggcaaagcacaagcaagtcattaaggactgcttgtagagaagataatatcggctcaaacttataagatccccaaactagcttgaataagctggaggagtttaaaggaaatgtgtgagctttccaaatgtgcaagcttagcaagatgtcaaagctgcaagcttagcaaagtgcgagcctgatgaaaacacctgttgaaaacaatatgcaaagatgtgagtctgtcaaaagggtgagctcaacaacatgtggaagctcaatgcgtggtggataagtgcaaggcttttgaaa

SEQ ID NO: 25125 - DNA, 442 bp, Gossypium hirsutum
  Clone ID: LIB3272-046-P1-K1-E1
ccgagagtagcgaatccctccaccgtcgctgtaaattgaaaagccaacctctacccttcctcttttgtcacggacaagaaatctaagtctggctgttcaatccctcaccacaccattattatatcccctctggaaatcttttgttttcttagaccatatagatcgcaaaggagttaagaaatgggggctgggcgagaagtagcaatatcacttgatggagtgagggacaagaacgtgatgcagctgaagaagctcaacacagctctcttccctgttcgttacaacgataagtactacgccgatgctctcgcttctggcgaattcaccaagcttgcatattacagtgacatctgtgtcggatcaattgcttgccggctggaaaagaaggaaggtggggccatccgtgtgtacatcatgactttgggtgttttagcaccatatc

SEQ ID NO: 25126 - DNA, 455 bp, Gossypium hirsutum
  unsure (1)..(455): unsure at all n locations
  Clone ID: LIB3272-046-P1-K1-E10
ctgattcangcatttccgcaaacactttctcaaaagaaacgtgttcttttacactaacatgggtagaccacgggaacgatatcaaggggtccgacaaacgcattggggttcttgggtttctgaaattcgccatactcttttgaaaactagaatttggctgggaacatttgaaacggcagaagacgcggctcgtgcctatgatgaagctgcaaggcttatgtgtggacccaggactagaactaacttcccttacgatcccaatgcacctcagtcatcatgatccaagctgctctcagcaactttgacagctaaactacataaatgctacttggcttgacttgaaatgaccaaacaacaatcagtgcaggagccaaaaagagagccaccgactccacatatcatcaccaacaatggcatttcatatagaggtagtgagactggagttcgtctgctgg

SEQ ID NO: 25127 - DNA, 458 bp, Gossypium hirsutum
  unsure (1)..(458): unsure at all n locations
  Clone ID: LIB3272-046-P1-K1-E11
gggggccgcgtgcgggtgatctttcaatcatgggttctcttcagtatcttctcttcatttcattcttantttgtgttnttggtggtgggttagcccaacagtcgttccaccccaaggccctggtcgttccagtctctaaagacgcctccacacttcaatacctcaccactattaaccaaaggacaccctttggtcctatacgcgttggggttgatctcggtggccgatacttgtgggttgattgtgaacgggattatgtttcatcgacttaccggcctggcaggtgcgggtcancccaatgctcgctggctggagccaatgggtgcggagattggttcgatggaccaaggccagggtgcaacaacaatacatgtgctggcggacccggcaacaccgtcactaacaccggcggtcctggtgagggtgcacaacatggtggctctctgcaatcaactggt

SEQ ID NO: 25128 - DNA, 455 bp, Gossypium hirsutum
  Clone ID: LIB3272-046-P1-K1-E12
cacggatgtattcctcattttctctgcttcaacaacgattagccattccgtttcaaaagtgacgattagctgattggttctgttttatcctccccaaccaaaatctgctgctccaccccaccctctccctcccaacatcaacagcaggtttcttcgaaccaaatctccaccgtctcgcgtttgggaagcgagaaagtgcgagaaaaatgagcggaccggggaagaaagtcgttgatgtcgcgttcaaagcatcaaagaacattgattgggaagggatggctaagcttttgatctccgatgaggctcgcaaagagttcgctacttttcgtcgcacttttgatgaagttaactctactttacaaaccaaattcagccaggaacctgaacccattgactgggagtactatagaaaaagaattggctctcgcctggtagatatgtacaaagaggcatat

SEQ ID NO: 25129 - DNA, 346 bp, Gossypium hirsutum
  unsure (1)..(346): unsure at all n locations
  Clone ID: LIB3272-046-P1-K1-E3
ataccgggtcggggcacccctcccgacccactcgtacccaaaagattcttactagcatatctttgctatttatcatcaattttgtgctgatnaaatagctcgaacagtttcttatattatcactantattaataataattactacgacttggttgagctttcttaatactttcagcattgtcctggtaaacctataaccaacatctctattactcatagacgtgtcacaacagcttttcaacaagctgataacccaagatttttgtctacattgttacaaacaaattgtggatataataatgccaactaacttggagcattttatttatacactctttttaattaa

SEQ ID NO: 25130 - DNA, 435 bp, Gossypium hirsutum
  Clone ID: LIB3272-046-P1-K1-E4
gagcataactgcggcatttcttcctcagaagacccatcaaacagagatgaagttcaagagtgcaaatccgactactggttgccaaaaaaaggtggaaattgatgatgaccagaaacttcgagccttttttgacaagaggatctcacaggaagtcactggtgatgccctcggtgaggagtttaagggctatgtattcaagatcatgggaggctgtgataaacatggttttccaatgaagcatggagttctcactcctgggcgtgttcggcttttgcttcacagaggtactccctgcttacgggggtatggtaggagaaatggagagcgtaagaagaactcagttcgcagatgcattgtgagtcaggatctttcagttttgaacttggttattgtgaaaaaaggatgaaaatgatcttcctggactgactgacactg

SEQ ID NO: 25131 - DNA, 437 bp, Gossypium hirsutum
  unsure (1)..(437): unsure at all n locations
  Clone ID: LIB3272-046-P1-K1-E5
atgctcctacagctgactcataaatcttcatcaagctgcatggctctgtacgtnatggggatgaatcgaggggcattatgaaaaggtatcaggcatcgagctcacatcctgctaatcctgagaaatttttaacatacatggtgccgtctcttggtgagctatcaaaggatatgtatgacgaacacgaagacatcacatattcttgggttcgagaataccattgggatgtacgtggcgacgatgcaaatgacccaacgacataccttgtttcgttcgatgaaggagaagctcgctatgtgcctcttcccacgaagcttaatttaagaaaaaagagggccagagagggaagatcaggtgatgagattgaacattttcctgtacctgctagaattactgggaggagaagaccaacagttgcagcaatagaactccatgag

SEQ ID NO: 25132 - DNA, 370 bp, Gossypium hirsutum
  unsure (1)..(370): unsure at all n locations
  Clone ID: LIB3272-046-P1-K1-E6
ggactcgaatctgatcccatctgctgctgcgagtgaatcaaangttgggtatttaaagaggaaaggggattatcatcggtatttaccaaagtttaaggttggtgatgacaggaaagctgctgctgacgatactatgctggcttacaaggctgctcacgatatcgcactgacggatctagcaccaacgcacccgatcaggctgggacttgcgctgaattactcggggttttactatgagattctgaatcactcccataaggcttggagcatggctaaacacgcatttgaggaagccattgctgagcttgacacgctgggagaagagttttaccaggaccagcactcttattatgcaacttcctaaagggat

SEQ ID NO: 25133 - DNA, 439 bp, Gossypium hirsutum
  Clone ID: LIB3272-046-P1-K1-E7
gagaaatacaaatacccatttcactaccatcaaaccacatcccacaggcatgggtgcggaggaagaagaagccggaggtgaagagtacttgtttaagatcgtgctgatcggtgactcagctgtgggaaaatcgaaccttttgtcacgttttgctaggaacgagttcgacaataactcaaaggcaactattggagtagagttccaaacccaatgcgtggaaattgatgggaaagaagttaaagcacagatctgggacaccggtggtcaagaaagggttcgagctgttacttctgcttactatagaggagctggtggtgctcttattggttatgatattactaggaggagtagctttgacagcattaaacgttggcttgatgaacttaccactcattgtgatactacattgacaagaatgctgggggggaacaaatgtgat

SEQ ID NO: 25134 - DNA, 452 bp, Gossypium hirsutum
  Clone ID: LIB3272-046-P1-K1-E8
acaaaattagaggcaaaaatgcttacttcactttgcttcgtctttatcttcatctttgggttctcccctttcgcaacccctaccttattgttccagggtttcaactgggaatcatccaacaaggctggtggatggtataactttctccagagttctgtttccgatatttctaacgccggtgttactcatgtttggctcccaccaccctcccagtcagccgctccccagggatacttgccaggaaggctatatgatcttgatgcatcaaagtatggatctcaggctgaattgaagtcattaatcgatgctttccatcaaaagggagtcaaatgtgtagctgacatcgtcataaatcatagaacagccgagaggcaagataacaggggtatatattgcctcttcgaaggtggaacttcggatgatcgtctagattggggaccatccttcatttg

SEQ ID NO: 25135 - DNA, 366 bp, Gossypium hirsutum
  Clone ID: LIB3272-046-P1-K1-E9
acaactttagagataaatatgcacttatgaacgtacttaacgtttaccatcaatttagggtgggctacttggggcaccacgagcttaaagttccatcggcacatacttcatactatgcaaaatgggtggtggaatgtataactcattccagagatgggacctcaatatttctaacgccggcaccactcatgttacagtcccaccacccttgacaatatccacattaaagcgatacttgacggcaacgaatatatacatcttgaaacatcaacaatatggaccccaagctggatggtacacattaatggatgctactcatcaaaatggcgtacaatgtttgggactcatggtcttaaatcatataac

SEQ ID NO: 25136 - DNA, 445 bp, Gossypium hirsutum
  Clone ID: LIB3272-046-P1-K1-F1
ctgcaattaaaatcccagaattacttaaacaacaatggctacctatgaaggtaaagtttggactgaagaacaagaagcttgggtggtcaagtcatggactgtaatgaagaagaatgcagctgaattgggtcttaaattcttcttgaagatatttgagattgcaccatcagccaagaaactattctcattcttgagagactcaaatgttccattggagcaaaacacaaagctgaagccccatgccatgtctgtctttgtcatgacatgtgaatctgcagttcaactgcgtaaagcaggcaaagttacagtgagggaatcaaatttgaagaaattaggagctacccattttaagtatggggtagttgatgaacattttgaggtaacaaaatttgctcttttggagaccataaaagaagcagtaccagatatgtggtcagatgagatg

SEQ ID NO: 25137 - DNA, 451 bp, Gossypium hirsutum
  unsure (1)..(451): unsure at all n locations
  Clone ID: LIB3272-046-P1-K1-F10
gcggcttatcctctcgaacactctcgactcttatcaaattgaacttatatatcaccatggcacaaacccggcgcgtgccggcacatgcaccctcacacaccaccttactctctcctttatcctcccaaagggcctcctttcctccaaatgcatcacccatcctcctcccatcccttccctacggttctcccgacggcctcttacccctctttcccacgccgtccgatgtctccctctcgctcccacgcgcttcacttacatccgttggcgcgtgaaccgctccgggaactccgcctactctgcgatcaactcggggtcgaacttcagcgaccggccggcgactgaaatggccccgctgtttccgggttgggattatgagcattggcttatcggtatggataaccccggtggagaaagaggctctaagcanggaatgatcgattggtatatc

SEQ ID NO: 25138 - DNA, 437 bp, Gossypium hirsutum
  Clone ID: LIB3272-046-P1-K1-F12
atcccttctccttcttctctgtaaactgtgaagtccaaccggtaggggcaagatagcagcgcggtctacccttatgcgcatttaacctccacttccatggccctcacttccactctccctctatactgtcatcccaagaggcttgtccttcaagcgttggcttcggaccacggccggtgtcttggtcatgattccgcttggtttattactaggagacgttactccagggccaagagattggtggtagcggcagcgtacggtgcggagggaggcgcgaggcggcgtgtttacagacaggcgcaggcgaagcagcctctcagtagtgctccgaagcagattgcaacctttgtggcgcccgctggcgtttttatcgcccgtacttttgctgacagtgttatggaaattgggggagaaactccttatgccgaagccatcta

SEQ ID NO: 25139 - DNA, 447 bp, Gossypium hirsutum
  Clone ID: LIB3272-046-P1-K1-F2
cacgattcccctacaacgacgcccttctctaacgtacgccctgctcgttcttaaccaagggctccccagattcactcctcttctctggaaccacgctcagcttcacctctgtgctgacggtggcgccaatcgcttgtatgacgaaatgcctctgttcttccctcaggaagatgcctctgatgttcgacgcagatacaagccggatgtaattaaaggagatatggattcgatacgaagagaagttcttgagttttatgccagccttggaactgaaattgttgataaatctcatgatcaagataccactgatctacataaatgtgtaacatacattcgggactctgcttcgggtttggataagtctaatctttgcattcttgttgttggagctcttggtggacgatttgatcatgagatggggaacctaaatgtcatatgccggttctc

SEQ ID NO: 25140 - DNA, 419 bp, Gossypium hirsutum
  unsure (1)..(419): unsure at all n locations
  Clone ID: LIB3272-046-P1-K1-F4
ggagatccatcactgaaccagcaccagcaacgtcaatggctagacgggcctcacgactggctgcgatctttgtcatcccagttttctcatcgcaaatccccactcagtcccctccattcacggtcgttctcggcggctccggcgcctcaaccggcggttttcgtagacaagaacacccgcgttatttgccaaggcataaccggaaagaatggcactttccacaccgagcaagccatcgaatatggcactaagatgggggggggagttacaccgaagaagggcggcacagagcacttangacttcctgttttcaactcagtagctgaagcaaaagctgaaaccaaggccaatgcttctgtcatatatgttcctcccccttttgctgcggcggctatcatggaggctatggaagctgagct

SEQ ID NO: 25141 - DNA, 430 bp, Gossypium hirsutum
  Clone ID: LIB3272-046-P1-K1-F6
ccatgagctacttaaccatttcccaaatctcctccctcctcttctttagcgtccttttgatttccgctcatgcagcgcgctttgaaatccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccggtgattgtggtggactccttcaatgcaaaggttggggtgtacctccaaacaccctggctgaatatgcacttaaccaatttggaaacatggatttctacgacattttcttagttgatgggtttaacatccccatggtgtttggtccaactaatggcgggtggcacaacat

SEQ ID NO: 25142 - DNA, 279 bp, Gossypium hirsutum
  Clone ID: LIB3272-046-P1-K1-F7
acgcggacacgtggtctcaaaacaatgttgacggatcctatatcttaatgggtggacctaaacagttggttttgcagtacaaggtaatcaactctactaaaccacttgtctatttcaaatcatctgtttggccaaatacacaagatggtactttacaaactgtgacactaaattttgacgaaacaaataatggctttgcttataacgatgtgttagactacacacgggctaactctttcatttttactccaaactttatcttgacaaggccgaaataca

SEQ ID NO: 25143 - DNA, 306 bp, Gossypium hirsutum
  Clone ID: LIB3272-046-P1-K1-F9
tcgctcttacaagcctactttctcttctgagtctttcgtcgcttttgcaggcgatgattctcggggctactatgatatgcactgataactcaaagtggatacgaaacagcgattattctccggctcgatatcaagcccaagctgatgctggtaggcttatctgtggtgctaaaacccaatctaatccggagtatacgggggggattttgactatggcgggcaaaagagtacgtgtttggctacttctactatcgatcttggaaaaatattggtttgcattcacggtcttgaaatgtggggggagat

SEQ ID NO: 25144 - DNA, 335 bp, Gossypium hirsutum
  Clone ID: LIB3272-046-P1-K1-G1
ctgctctcccactgtttctctcttcacccttggccatacatctccaaagaagtggattattttaaccagagaggaaacaagaaacaatttggagccatttagttaaaaaaatgaaggggaatttctagaaccccaaaatgaaggtgaaaaccccaatataatatgtttcaaggcttaccaccctttttctcatcattttaactcagtcatgattccgatgacaccccactcccaaacgccgacccgtggagtgggcggggaggagcacggactagcatgaatcagcgcaactagggccgcctctggtcaaaacagccagccacatgcgcactctg

SEQ ID NO: 25145 - DNA, 423 bp, Gossypium hirsutum
  Clone ID: LIB3272-046-P1-K1-G11
aagtggggtagcatcaatattgatatgggtgaagaggtgaagggggggggagcatggggaggcccttttaaccggaagggagaactaactttgcagttaaaaggtgttccatatgactacatagaacaagacttgaataacaagagctctttgattttgcaatacaactcggctcataagaaaggcccaggtcttgttcacaacgggaaatcaattggagaggcgatgggtatacttgaatacattgaggaaacttggaaaacctatcccatcttggcacaagatcctaacgacaaaggcatggctcgattctggatcaattacatcgatggcaagagctcgtctgccattaggaaaggtgcatttaggcctgaggaggagagagagaaggcagtggaagaagctgggagttgttgaaaacac

SEQ ID NO: 25146 - DNA, 328 bp, Gossypium hirsutum
  Clone ID: LIB3272-046-P1-K1-G12
gacccacgccttccctttctagcttcagaaaggaagagtctcttcttgtttacaaaaaagggaaacccctagggacgaggaatgaatgaaaaagataacacaagtatcacactcataaccaatgcacatgaacttagttatcttgaggcttttgtattcactcctttcttctcccctttgaatctgtttcttctttaacaaaataaactgaattcttatcttatagcctagtgacagactaatacaaaaaaaatacacccattagcatattttgaaggacaatacaccttatcgggcttgctttagatttttgctactatgaagtact

SEQ ID NO: 25147 - DNA, 296 bp, Gossypium hirsutum
  unsure (1)..(296): unsure at all n locations
  Clone ID: LIB3272-046-P1-K1-G3
gtttgacgcaactgctatttcttttttgtggttttcaacagcagcttgtatttagaagaatggtgagggggagcgttttgaatgatgcactcaagancatgtacaatgcagagaagaggggcaaacgacaggtgatgatccgaccgtcctcgaaggcgatcattaagttccttttggtcatgcagaaacatggttatattgggggaggttgaggatgttgatgatcatagatctggtaaaattgggggtgaactgaatgggaggctgaacaaatgtggggtgatcaagcctctttt

SEQ ID NO: 25148 - DNA, 375 bp, Gossypium hirsutum
  Clone ID: LIB3272-046-P1-K1-G5
gtgggatattatatcttttttcatttttcccacacttttttgaaaacccattatctaaggatccactatggggtgtgctgtgaacttccaaatatctccttctcctccactcggtgggtgtaactcctggtagggggtgaccgccacgagacgcacgtgaaacctaaaagatccgagttaatggttggaaggtttaagaaatgtgtgggctgataaccaattgccatatgaaataccatatgggggcatagcgtactagtcatattaccatccacccaatttggtgcggtcggtggggtaaatcacaaaagaaactgattcgagagggcattaactaaatctgcaacattgattccaaacacacttcggtaggtg

SEQ ID NO: 25149 - DNA, 414 bp, Gossypium hirsutum
  Clone ID: LIB3272-046-P1-K1-G6
aaactcacccctcccttcctctctgcttttttggagatgtggaggccctttttccaggcgtaccatctcatgattggtcaagatggcgatccttccaaaaccatcaagggtccggagggcttctactatgagctttacaataggaacgatatcaacaggattttgggtcctaagtcttcttgtatctctttcaaggattctgcttggcgctgctttggttacatggtttccaagaagaagtacatttataccattgatgatgactgctttggtgcgaaagatccatccggcaaagacattaacgcactggagcagcacataaagaaccttctttggccatctactgcggttttcttcaacactctctatgacccgtaccgagctggtgcacatttcgttcgtgggtacccattc

SEQ ID NO: 25150 - DNA, 289 bp, Gossypium hirsutum
  Clone ID: LIB3272-046-P1-K1-G7
gggacgcgacgcgttcgccctgacaagattccatttgttcccatttctggttttgagggtgcaggatgattgagggggctaccaacttggactgggacaagggccctactcttcttgagggtcttgaccagatcaacgaggccaagagggcttcagacaagcctgttcggctcccacttcaggatgtgtacaagattggtggtattggaactggtccaggcgggcgggttgaaaccggggtgttgaaacctggtatgggtgtgacctttggcccgtctggtctgacaac

SEQ ID NO: 25151 - DNA, 420 bp, Gossypium hirsutum
  Clone ID: LIB3272-046-P1-K1-G8
acgctttagtttcaatatcaaagcaaaaatgggttcttcttgtaatggtggttcaatggccggactggcttgtttggtgttgaactacttggtttttgttgcccacggtggtgacttttaccaggatttcaacctaacatggggtgacagaagaagcaagattttcaatggtggcaagctcttgtctttgtctttagacaggggttcagggtctggttttcaatctaagaaagagtatttgtttggaaggatcgatatgcaactcaagcttgttggtgggaaactagctggcactgtcactggttattatctgtcatctcaagggccaacccatgatgagatagactttgaattcttaggggatctgagcggtgacccttacattttacaaaccaatgtttttacacaaggcaaagggaa

SEQ ID NO: 25152 - DNA, 443 bp, Gossypium hirsutum
  Clone ID: LIB3272-046-P1-K1-H1
aaaaagcaaggcgcattttccagccttatcgccgctaaatcgatcccaaaaagcttacattgtttggcaatgaggttgatggaggaacgaatctcgcatccggacaaatatacagatgaagggaaaccaatgcctccggaattcgaggatccgaagctttaccattacgctatcttttctgataacgttcttgctgcatccgtggtggtgaattcagccacgaagaacgcgaaagagccatggaaacatgttttccatgtggtgacggacaagatgaatcttggggcaatgcatgttatgttcaaattgaaagattataatggagctcatattgaagtgaaggcgggagaggattataagtttttgaattcatcctatgttccagtggtaagacagttagaatcggctaatctgcagaagttttattttgagaacacgctgga

SEQ ID NO: 25153 - DNA, 474 bp, Gossypium hirsutum
  unsure (1)..(474): unsure at all n locations
  Clone ID: LIB3272-046-P1-K1-H11
tgcacgtaccgcgccggaatgtaccggtccgggttcccgggggggcgacgcgttcgatttttcaaccatgtcggagatggcgaacacggatcccgaaggggtggacgccatgcggaggacgtggaacgtgtggccacncaccaaagtcgaagctaggaagggcgtgatcccggtggcggctaccatcgctccgatccgtcctcacccggacatcccgacgctcccttacgcgcctctacggggcaggatgtggtcagctgcgctcaacggctttgcgcgtgttgacttcgttgccaagatctggatctgccctttctgttaccagcggaaccactttgcggctcactatgctatgatctgcgaaacgaacctaccgtgcgaactctacccagaatacaccaccgtgcaatacacgctccaactggatccgaacaaccctttcaggctcctaaatggccggcggggtttggattt

SEQ ID NO: 25154 - DNA, 386 bp, Gossypium hirsutum
  Clone ID: LIB3272-046-P1-K1-H12
agcggtggggtgggagtcgcagacgattaagcatatgatcgaggacgattgcgctgataacgggataccgttgcctaatgttacgagcaagatcttagcgaaggtgatcgagtactgcaagaaacacgtcgaggctcctaagacagacgatcgatccgccgatgacgagctcaagagttgggacgctgactttgtcaaggtcgatcaagctactctctttgatctcattctggcagcgaactatttgaacatcaagggcttgctggatctcacttgccaaactggtgctgacatgatcaagggaaagaccccagaagagatcaggaagactttcaatatcaagaatgacttcaccccggaagggaagaaaggttcgtcggagaacc

SEQ ID NO: 25155 - DNA, 455 bp, Gossypium hirsutum
  Clone ID: LIB3272-046-P1-K1-H2
ctgacttgctctgtaaccgtagaagtgattattggttgagaaatcatggggaaggacaagcataagcctgatgataagggtctgttttcacatcttgctcatggtcttagtcatggtggtcatggacaccctcctggtgcataccctccacctcctggcggatatccacctgctggagcttacccacctcaaggctatccaccagctggctaccctcctcaaggaggatacccccctcacggctatccaccatctggctatcctggtgcatcccattcacggcacggtggcatgggagcgctgcttgcaggtggtgcagcagctgccgcagctgctatgggggctcaccacgtgtctcacggtgctcatggtgctcatggtgcttatggtgctcatgggtttggtcatggtcatcatgggaagttcaaacatcatggtggtgggatgtttaagca

SEQ ID NO: 25156 - DNA, 468 bp, Gossypium hirsutum
  Clone ID: LIB3272-046-P1-K1-H4
ttaccggtgggcgcacgcgtgcgagcgagtttactggaaaaccctagaaaccagcggctctttcttcaattttcacttcttggggcggcgataactgagagggtgttttcttcttcacaagacacaatggcagatggtcatgaaactgacaagaacatcgagatttggaaaataaaaaagctaatcaaggcactagaatctgcgcaggggaaatgggaccagcatgatatccctcattatgcctgctcgtgatcaaatatcccgtgtcacaaagatgttaggtgacgaatttggaactgcatcgaacatcaaaagtggggtcaaccgtcagtctgtgttggctggcattacttctgcgtaacagagggggaagctctataacaaggttccccctaacgggctggtgctctacactgggacaattgttactggagatggcaaggaaaagaaggggacaattgactttga

SEQ ID NO: 25157 - DNA, 440 bp, Gossypium hirsutum
  Clone ID: LIB3272-046-P1-K1-H5
tacgcctgcagtaccggtccgggaatccgtgcggtgcgatgcgcttgtataaaaaagaagaagaaaaaaacagaggaaagaacggacttttggaggaacaactgggggtccacctacaagaataggacttgctgatttggctgttatgggccaaaatcttgctcttaacattgccgagaaaggctttcccatttctgtttacaacagaactaccttcaaagtcgatgagactgttgaaagagctaaacaggaaggggatcttcctttatttggtttccatgatcctgaatcttttggtcagtcgatccagaaacctagagtgataatgatgcttgttaaggcaggggcccctggtgaccataccattaaaactctattttgatacattgagaaaggtggttgtatcattgatgggggctaaaagtggtactagaacaccg

SEQ ID NO: 25158 - DNA, 252 bp, Gossypium hirsutum
  Clone ID: LIB3272-046-P1-K1-H6
ttacgatccgtcctcacccttacatcccaaccctcccttacactcctatacagtgcaggatttgttcaactgcgctcaacaccttttcgcctgtttacttctttgccaaaatcaagatcttccctttcttttaccagcggaaccacttttcgcctcactatgctatgatctccgaaacaaacctaccggtcgaactctacctccaatacaccaccgtgcaatacacactccaacttgatccgaacaaccctt

SEQ ID NO: 25159 - DNA, 400 bp, Gossypium hirsutum
  Clone ID: LIB3272-046-P1-K1-H9
aggaaattcattcttatctcacgctctcaattatgtcctgcacatttcttttggccatgggcttaactcacattgatctttaccacagttcacttggaacttgttcattacccttcctctttgccttcatcaacaagagattactctactaataatcacacacaaattggtgaaagaagcagcattttctttggttttttttttttaatggtcagtaaggaatccatgttgcagagatctggactggctagacattctttgagaaaccttcatggcggcctcctccattgaaaagaaaaactccaactaccactgcttttcttgtcttaaccggttttctcatggctgcttttggtacatattcctcatggagtgacacttctgggggttttttcgagca

SEQ ID NO: 25160 - DNA, 381 bp, Gossypium hirsutum
  Clone ID: LIB3272-047-P1-K1-A10
gaaaaatggaaaaaggagggacaattggagtggagaaaagaatgagaaaaggttaaaagctttgttggacatttttttttttcatttatttgattttgatttgtgatatgaattatgggtttctgagttctttttttcaaaaagatctgtttttagtcttgggttttgttttcgagtgtttaaaagaaaggggaatggctggaagtaatgaagtcaacctcaatgagtgcaagacggtggttcccctaaatacatgggtcctaatctccagttttaagttggcttacaatcttctccgtcgaccggacggcactttcaatcgtcacttggcggagtttcttgatcgtaaagtccctgctaatttgaacccagttgatggag

SEQ ID NO: 25161 - DNA, 383 bp, Gossypium hirsutum
  Clone ID: LIB3272-047-P1-K1-A11
ttgtacttttaactctaagccaagaaagcatgtcactagggttttaagagaagatcaaaatggcgtcaaaaagatcagcttccatggccctctttttggcactcaacattctcttcttttccctgggcagtgcttgtggttcttgctattcacccacccctaaaccaaagccaaacccaaaccccaaccccacccccactccatcttcacaaggcaaatgccctagagatgcccttaaattaggcgtatgtgctaatgtgcttggcttagccaagcccgtcattggttcacccccagtgatgccatgctgttcccttcttgatggcctcgtcgatctcgaagctgctgtttgcctctgcaccgctatcaaagctaacatctta

SEQ ID NO: 25162 - DNA, 382 bp, Gossypium hirsutum
  Clone ID: LIB3272-047-P1-K1-A12
tttctcgagaaccatacttcgagatggcatttctcatgccttcacctgaaatttccaccgcctctgcaaattttttctctaaccctaccccccgccctaaattcctcaagagctgtgcgatttcgaagaacgacgacgagaaagtttggtcaaggaccaacgctagggtcggtgttaaagatgccggcagtacggtttcgtgtttgagccaaaacttgaggttgtacgtacaattttcggctccagtgaagcgaggatcgaagcccagcaaagaggaagaggagaagcaggattattacgtgaatatgggttacgctattcggaccttgagagaggagtttccggacatcttctacagagagcttagttttgatatttacag

SEQ ID NO: 25163 - DNA, 399 bp, Gossypium hirsutum
  Clone ID: LIB3272-047-P1-K1-A3
catttcttcaaccccttcactaaacaaggaagtattcgctcaaatccgacccgacttccttgattttgcaaagaaaccagagattatggattggatggttggtattagaagaaaaatacacgagaatcctgagcttggttatgaagagtttgagactagtaagcttataagagccgagcttgatctgatggggatcccttacaaatacccagttgctgttaccggtgttgttggctatattggcactggcaagcctccttttgtcgcacttagagcagatatggatgctcttgccttggaggagctggtagagtgggaacataagagtaaggttcctggaaagatgcatgcttgtggacatgatgctcatgttgctatgcttcttggtgctgcaaagat

SEQ ID NO: 25164 - DNA, 384 bp, Gossypium hirsutum
  Clone ID: LIB3272-047-P1-K1-A6
cccgctccttctcgctgcgatttcgtcttcaagatctcagttctcaaatcgtagcgctcttttctatcaagccatggctctggtcttgcatgcaggaaaaacaaacaaaaatgcctttaaggcactcattgctgcagaatatagtggtgtgcaggtcaaaatggttgagaattttgagatgggtgtgtcaaataagactcctgagttcatcaagatgaaccctttggggaaggttcctgtgttggaaacacctgagggtcctgtatttgagagcaatgccattgctcgttatgttgctcgctcaaaggttaacaaccctatatgtggttctacattgattgattatggtcatatcgagcaatggattgattttgcagccatgga

SEQ ID NO: 25165 - DNA, 398 bp, Gossypium hirsutum
  Clone ID: LIB3272-047-P1-K1-A7
cttgaatcattgaatgtaacaaattaaaagaaaagaaaaaaaagacaatggcagacactggagacactgccagctccagtagaactggtgatttgccggagctctcatcggaagcaaccctgttcgggaaatacgagcttgggaagttgctgggatgtggggctttcgcaaaggtttaccacgcgcgcgacgtcgactccgggcagagcgtggccatcaaggccgtcagcaagaagaaggttttaaaaggcgggttcatggcacatgttaagagggagatcgctatcatgcgccggttgcgccaccctaacatcgtcaagctcatcgaggttttggctaccaagactaaggcttatttcgtcatggaattcgccaaaggcggagaattgttcacgagg

SEQ ID NO: 25166 - DNA, 391 bp, Gossypium hirsutum
  Clone ID: LIB3272-047-P1-K1-A8
gaaccaccctgggcagattggaaacggatatgccccagtccttgactgccatacctcccacattgctgtgaaattttccgaatcgctgaccaagatcgacaggcgatctggaaaggagcttgagaaggagcccaagttcttgaagaatggtgatgcagggatgataaagatggttcccaccaagcctatggttgtggagactttctctgagtacccaccacttggacggattgctgtcagggacatgcgtcagactgtggctcgtggagtcatcaagagcgttgagaagaacgacccaactggtgctaaggtcaccaaatctgctgccaagaagaaatgagattgcatttgatagtatcagagcctttggattttggttatctttgtagat

SEQ ID NO: 25167 - DNA, 388 bp, Gossypium hirsutum
  Clone ID: LIB3272-047-P1-K1-A9
gctacttaaccatttcccaaatctcctccctcctcttctttagcgtccttttcatttccgctcatgcagcgcgctttgaaatccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccggtgattgtggtggactccttcaatgcaaaggttggggtgtacctccaaacaccctggctgaatatgcacttaaccaatttggaaacatggatttctacgacatttccttagttgatgggtttaacatccccat

SEQ ID NO: 25168 - DNA, 394 bp, Gossypium hirsutum
  Clone ID: LIB3272-047-P1-K1-B1
atgcgcacgatcaaggttctgatggccaccaatcggattgatatcttggatcaagctcttcttaggccaggacgaattgacaggaagattgaatttccaaatcctaatgaggagtctcgtttcgacatcttaaaaatacattctagaagaatgaatttgatgagagggattgatctaaagaagattgctgagaagatgaacggtgcttctggtgcagagcttaaggctgtgtgcacagaatcaggaatgtttgctttgagggaaaggagagtccacgtaacacaagaagattttgagatggcggtggcgaaagtaatgaagaaggagagcgagaagaacatgtccttacggaagctatggaagtgattatgttttattatttattgggctttcg

SEQ ID NO: 25169 - DNA, 381 bp, Gossypium hirsutum
  Clone ID: LIB3272-047-P1-K1-B10
cggacgcgtggggttccaggaggcatgctttctgttccatatgatatgggcagcatgccaatgcgtgatgcaccactttctcaaccaattccaattggagctttggcctcagcacttgcaaatgctactccagaacagcaaagaacgatgctgggggagaatctctatccactcgttgagcagctggaacccgatgcagcagccaaagtaacagggatgcttctggagatggaccagacggaggttttacacttgctcgagtcaccagaagctctaaaagccaaagttgcagaagcaatggaggttctgaggactgtagcacagcaacagcagcaagctggtggagctgctgatcagctggcttcattgtctttaaatgac

SEQ ID NO: 25170 - DNA, 338 bp, Gossypium hirsutum
  Clone ID: LIB3272-047-P1-K1-B2
ctgacgcgtgggtttcagtcgtcttctcttttagtcctctcgatcccaaagcaagctctggatcgcgaatctgtcccagaagacacatatttttgtgcaaacccttactgataaaaccagtccccttgaggtggaatgcttcgatactatagattacgtggaggcctgaatgcatgacacagaaagcattcctgcagaccaacagaagcttatttttcggcggaaaacagctcgaggatggtcgaactgttgccgactacaacatccacactgtgcccacccttcaactagtgctttggcttaggcgtgggatgcaaatgtttgtgcatacccttacg

SEQ ID NO: 25171 - DNA, 397 bp, Gossypium hirsutum
  Clone ID: LIB3272-047-P1-K1-B3
atcatccgccacttccttcgctaccattctctcttttccttgtatctgggtgtcttttagataaaagatgagtacgctggacgcaactagagcagaacttgctcttatagttttgtatttgaataaggctgaagcaagggataagatatgcagggctatacaatatggttcgaaattcttaagtaatgggcaacctggcacagcccaaaatgttgacaagtcaaccagcttggctcggaaagttttccgtctttttaagtttgtcaatgatttgcatggtcttattagcccagttcctcgaggaactccccttccacttgctctgctgggaaagtccaaaaatgcactgttgtcaactttcttgtttctcgatcaaattgtctggcttggcagaaca

SEQ ID NO: 25172 - DNA, 381 bp, Gossypium hirsutum
  Clone ID: LIB3272-047-P1-K1-B4
catgtccttccccttgatctcccactcgactcggatcacgactcgctcgactcgtttagcgtttttctttcaataggtgtacccgcctcgacgacttagtcagtaactcgaattaaacgatggagccgatggatatcgtagggaagtcgaaggaggacgcttcgcttcccaaagcaacaatgaccaaaattataaaggaaatgttaccgccagatgtacgcgttgcaagagatactcaagatcttttgattgagtgctgtgtagagtttatcaatctcatttcatcagaatcgaatgaagtttgtaacagagaggagaagcggaccatagcacccgagcatgtactcaaggctttagaggttcttgggtttggagaataca

SEQ ID NO: 25173 - DNA, 382 bp, Gossypium hirsutum
  Clone ID: LIB3272-047-P1-K1-B6
ttcagaaccaggatgaaatgattaaaagtggtaggctctctgaaccctacaagggtattggtgattgtttcaagcgaacgattaaagatgaaggatttgcctctttgtggagaggaaacaccgcaaacgttattcgttatttccccactcaggccttgaactttgctttcaaggactacttcaagaggcttttcaacttcaagaaagacagagatggttactggaaatggtttgctggtaacttggcatctggaggagctgctggtgcttcttcccttctgtttgtctactccttggactatgcgcgaacccgtcttgccaatgatgcaaaggctgcaaagaagggaggagagaggcaattcaatggccttgttgatgtcta

SEQ ID NO: 25174 - DNA, 393 bp, Gossypium hirsutum
  Clone ID: LIB3272-047-P1-K1-B7
gttctttgttaacgaataaggatcttttaagatacgccggatccgataaaatacgccgatccccgttcgtcttccgatcatatggggctgcttgaccagttgtgggatgataccgttgcgggtccccgacccgataatggtctgggcaagctccgaaagcactccactttcactttccggcctaactctgccaaggaatcggatggcggtagtgtaagatcgtacggtgatgaagcgccagatgaagcgacgagagtgacacgtagtattatgatcgtaaaaccgcctggttaccagagcggatcgcctgcggtttctccggccggatcgaccccttcggtatctactttttgcggaggcagagaatcatatcggtttcggagaatgtccaca

SEQ ID NO: 25175 - DNA, 394 bp, Gossypium hirsutum
  Clone ID: LIB3272-047-P1-K1-B8
taacgttcgatcgtttaacgcaaacccatttttaagtgagggaaaggtttcagttcagagtcataagcaacatcaatggctccttcaactctgacggctcttgcggaagagaaaaccttgcaggcaagcttcgttcgtgatgaagatgagcgtcctaaggttgcttacaaccaattcagtaatgatatccctgtcatctctcttgctggtatcgatgatgttgatggcaagaggggtgagatatgcaagaagattgttgaggcttgtgaggattggggtgtcttccaggttgtggatcatggtgttgatactaaactcgtgtccgaaatgacccgtcttgcgagagagttttttgctttgcctgctgaagagaagcttcggttcgatatgtctg

SEQ ID NO: 25176 - DNA, 391 bp, Gossypium hirsutum
  Clone ID: LIB3272-047-P1-K1-B9
gcttgacgttcccctttgctcccttcttccagaagccaaaagtttgagttaagaacaatggcttatgctacaatgaagccgaccaaacctggtttggaggagtcccaggagcagattcacaagatcaggatcactctctcctccaagaatgtgaaaaaccttgagaaagtttgtgctgatttggttcgtggtgccaaggataagagactgagggttaaggggccagtgagaatgcccaccaaggttcttcacatcacaacgaggaagtctccctgtggtgaaggaacaaacacatgggatagatttgagctccgtgttcacaagcgagttattgatcttttcagctcccctgatgtggtcaagcagatcacctctatcaccattgaacctg

SEQ ID NO: 25177 - DNA, 280 bp, Gossypium hirsutum
  Clone ID: LIB3272-047-P1-K1-C1
gtttgtgcacaagcatcttaaactcaaacatccagagcttgtgatggagctaacggataaaatgcgtgcagagctttatttccagaactacatgaatgatccaggtgcacctggtgctgacacctgttatgcaacaatctggacctgatgacaagcctatgagacgtaaaatgttggaaaaccgtttgaaagatgagcgtagctcacgtagcgaacgttgtaatcgagctaatggaagtgatagatatgataggcatgggaaccctcaatgaagtgattt

SEQ ID NO: 25178 - DNA, 378 bp, Gossypium hirsutum
  unsure (1)..(378): unsure at all n locations
  Clone ID: LIB3272-047-P1-K1-C10
ggctaatgggcttgcccgaaggtgcatcgtgcaggtctcttatgctattggtgtgcctgagcccttgtctgtctttgtagacagctatggaactggaaagattcctgacaaagaaatcctccaaattgtgaaggagaacttcgacttcaggcccggtatgatcaccatcaacctggatctcaagaggggtggcaatggccggtttttgaagacagctgcctacggacactttggaagggacgacccggacttcacctgggaaggtgtgaagcccctcaagtgggaaaagcctcagtcttaaaatccagctttggctgtcctcgaatgtctctaatctcatacatatgatgccccccattcattttcattntcattttc

SEQ ID NO: 25179 - DNA, 382 bp, Gossypium hirsutum
  Clone ID: LIB3272-047-P1-K1-C11
ctctcccgctccttctcgctgcgatttcgtcttcaagatctcagttctcaaatcgtagcgctcttttctatcaagccatggctctgatcttgcatgcaggaaaaacaaacaaaaatgcctttaaggcactcattgctgcagaatatagtggtgtgcaggtcaaaatggttgagaattttgagatgggtgtgtcaaataagactcctgagttcatcaagatgaaccctttggggaaggttcctgtgttggaaacacctgagggtccggtatttgagagcaatgccattgctcgttatgttgctcgctcaaaggttaacaaccctatatgtggttctacattgattgattatggtcatatcgagcaatggattgattttgcagc

SEQ ID NO: 25180 - DNA, 301 bp, Gossypium hirsutum
  Clone ID: LIB3272-047-P1-K1-C12
gttctttgctccatgaaagtccctcctcgtttgctgaacgctggtaatttcttgcacggtggagctactgcatcactggtggatttggttggatcagcggttatttactcctacggaggtagtaccagtggagtttctgtcgaaatcagtatcacttacttggatgctgcttatgttggcgaggaaatcgagatagaggctaaggcattgcgtgttgggaagactgttgccgttgtcacggttgagtttcggaagaaaaaaactgggaaaatcattgcgcaggggcgtcatactaagtacc

SEQ ID NO: 25181 - DNA, 356 bp, Gossypium hirsutum
  Clone ID: LIB3272-047-P1-K1-C2
cgacgaaggattatgctgtggagttggtagattctttcaagtgtgaactggagctattttatggcaaaaacccattggcgtcaaaagacttgtctcgcgtagtgaattctaatcactttgcccgcttgctaaagcttttagatgaggacacggtttcaagtcagattgtctatggcggtgaaagagataactcgaacttgcagattgctgccactgtcttgcttgatgccccacaagattcactgatcatgaacgaacagatatttggtacattgcttccaattatcacgattgacatagtggaagacagctctgatctgataactgctggaacaaaaccactagcagcatgtatg

SEQ ID NO: 25182 - DNA, 392 bp, Gossypium hirsutum
  Clone ID: LIB3272-047-P1-K1-C3
cttttaactctaaagccaagaaagcaagccattaaggttttgagaaaagatcaaaatggattcaaaaagatcagcttccatagccctccttttggcactcaacattctcttcttctccctagtcagtgctaattgcggatcttgttcttcttctggctctaacccaaggccaactcccacccctactccatcagcacgaggtaggtgccctagggatgccctcaaattaggtgtatgtgccaatgtgcttaacttagtcaatgtcaccgttggttcacccccggtgatgccatgttgttcccttcttaatggtcttgtggacctcgaagccgctgcttgcctttgcaccgctatcagagctaacatcttaggcatcaaccttaacatcccag

SEQ ID NO: 25183 - DNA, 349 bp, Gossypium hirsutum
  Clone ID: LIB3272-047-P1-K1-C4
gatggtgtaaaattgggcgtcttttctaatagggtgggggaaacatttgttcgaatttggagaggggggtcaggcttacacaaaaaggtggatatggtatttcttggggactccattactcagtgctctccgggtttgaaaggtgatgtttgtgatatctacccttcagctattcaagcagcactttctcgtctactcaacgcttgagcttcccctggacctaatgcacaagaaaatcgtcgacaatgcttgaaggttttgagactgaagctggaaagaagaatccttccagaatctgttgttcggcaccatatacgagaacttgattcccttagtgtttcatcttctg

SEQ ID NO: 25184 - DNA, 200 bp, Gossypium hirsutum
  Clone ID: LIB3272-047-P1-K1-C5
cggccaactctcatctctttcaatttcttaccccaaaacatcatttttttcccacggcaaaggaatggctacatctcaattaacagcatcatcaatgacagcatcagtaaggaatttggcttcatttgaaggactaaagccatcatccattgtgaagttctctagcttaggatctttaaagcccccctctaggactcaaa

SEQ ID NO: 25185 - DNA, 382 bp, Gossypium hirsutum
  Clone ID: LIB3272-047-P1-K1-C6
aaaaaaacagaaaaccctgcgaaaaagaatgcaaaaccgccacaacgctttgttttgaagcttcactcatgtcgcatgcacttcatctcgtccccaataacattcctggttatggaccgacagactgccgatatctctcctactcgggcatttccggaagagcagtgactctatctccttgctcttcacatagtgaccacaaaatttgtacacaggtgaatgttagatctttgaaatgtagttcgaggggaataatatcttttgtatgcagagcaggtcctggtggccataggagaaaccctgacttctcgaggcaaagacctgggtatcgagggaagaatagacaaaatgaagaccgggagaactttgaaaatctagatga

SEQ ID NO: 25186 - DNA, 368 bp, Gossypium hirsutum
  Clone ID: LIB3272-047-P1-K1-C7
gggacatccaagagtcattccatttttgcaagtataggagggatgaaaatcaactgtatatattcgctgatgatgttgatccgagatggcttactgcatcataccatatagattttgacaccatggctggtgcagacaagttcggtaatgtctattttgtgcggctaccacaagatgtctcagatgaaatagaggaagacccaactggtggaaagataaaatgggaacaagggaggctcaatggagctcctaacaaggtagaggagatagttcagttccatgtcggggatgtggtaactagttcgcagaaggcatctcttataccgagtggtggagaatgtgttctttatggaactgtgatggagagc

SEQ ID NO: 25187 - DNA, 384 bp, Gossypium hirsutum
  Clone ID: LIB3272-047-P1-K1-C8
tttccctttctttccttttcctgtaaaaatggagggttcctcgtctgacaagctgatcgttgtgacccgtgaacctgatgggatcgctattgttaccatcaatcgacccaaatctctcaactccttgacccgacccatgatggtggacttggccaaggctttcaaggctcttgcgaaggacaactcggtgcgggtcatcatcttgtctggagctggacgggctttctgttcaggcgtggatttgacggctgcacaagatgttttcaagggtgacgttaaggacccggagacggatccggttgttcagatggagcaatgccccaaacccatcatcggagctatcaacggcgttgctattactgccggcttcgagatcgccctcgc

SEQ ID NO: 25188 - DNA, 375 bp, Gossypium hirsutum
  Clone ID: LIB3272-047-P1-K1-D10
cttaataatgaagggtccaataaagattgcaatcgctgacatgttgatctctttcatgtgggtattttgttcatctgcgtttggtctattaacttattttataaccaccgccgctggtgttcaaaccgtaccttgggcttctattgttatcatcaccgtcgtctttttcgttttcctttccatctttaatattattggtggatttcttggtggtgctagttttgatcctgctgctacaactgccttctacgccgccggttccggcgccgatacccttatctgcatggccctccgcttcccagctcaggcttttggtgccgtgggtggtgccctggcaatcatggaggcaatccctgaacaatacaagcacatgat

SEQ ID NO: 25189 - DNA, 378 bp, Gossypium hirsutum
  Clone ID: LIB3272-047-P1-K1-D11
cggacgcgtgggtgaaagtaggtgacgacagaagagggttgtggaattgggaagccgaagaagaagctactgcgattgcgattgccaactcattcttccgtcatgggcaactgtggcactagagaggaatctgacgttgttactcatgctcaagttcagcagctccacaaccacatcttatccgacaagaagcttactcaaagtcagagccagactcagaatcgtaccctctcagatctgagcgacttcgaggattccaggaaaaatgcgcttctctatacccacattattgccttcactttattcgagcttgagactattaccaagagcttccgttctgactatattctcggggaaggtggcttcggaacagtctat

SEQ ID NO: 25190 - DNA, 367 bp, Gossypium hirsutum
  Clone ID: LIB3272-047-P1-K1-D12
cttcaataccgaagatacagagctaagtgagttggtgtgaggatgagtcgcggtgcatcagctggagctaagggaaagaagaagggagcctacttcaccatcgactgtgcgaagccggttgaggataagatcatggacatcgcttctttggagaagttccttcaggaaaggatcaaggttggtggcaaagctggtgctctaggtgactccgtcactgtcacccgcgacatgacccgtatcacggttacctatgactccaacttctctaagcggtaccttaaatacttgactaagaagtacttgaagaagcacaatgtccgggattggcttacggtgattgcttacaacaaggaccgttatgtttatg

SEQ ID NO: 25191 - DNA, 387 bp, Gossypium hirsutum
  Clone ID: LIB3272-047-P1-K1-D2
gccgccgcctgcgtctctctcttcatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgaaggttgttgacattgttgacactttcaggcttcaggagcaaccccctttcgacaagaagcagtttgtcgtgttcatcaagaagttcatcaagaacttgacaccaaaactggatgcggaaa

SEQ ID NO: 25192 - DNA, 387 bp, Gossypium hirsutum
  Clone ID: LIB3272-047-P1-K1-D3
tctcactttctatccagtgagcttttgctaaacggtatcgttttagtcagtctttcatcaatggcgaaagaaccggttcgcgtcctcgttactggagctgcaggacaaatcgggtatgctcttgtacccatgattgctaggggagtcatgttgggtgctgaccagcccgtgatccttcacatgcttgatatcccacctgctgcggaggctttgaatggtgtcaaaatggagttggtggatgctgcttttcctcttctaaagggtgttgttgctacaactgatgttgttgaggcatgcactggagtcaatgttgctgtcatggttggtggtttcccaaggaaggaaggaatggagaggaaagatgttatgtcaaagaatgtgtctatt

SEQ ID NO: 25193 - DNA, 380 bp, Gossypium hirsutum
  Clone ID: LIB3272-047-P1-K1-D4
aaattgctgttagcagcaaggaaggtcagaagggctacctgcacggattttgttatatctttggttgctgatgatttttctagggccagctatacatatgtcggtaaactaaggtctaatttttttggtactaagttcacaatacatgacagtcaacctccgtgtgactcaataatcccatcaagtacccgatcgagtcgaagattccactcgaagcaggtgtttccaaaactatcttcgtccaactacaatattggtaccattacctatgagctcaatgttctgcgaacacgaggaccaaggagaatgcattgtgttttgcactcgattcccatgtcttcgattcaggaaggaggcactgcaccaacaccattagcgtt

SEQ ID NO: 25194 - DNA, 375 bp, Gossypium hirsutum
  Clone ID: LIB3272-047-P1-K1-D5
gtcttttctacactaaaatagatgctcgccactgttgcgtctttggctacttgtcttgcagttgaatctgttgttcctttgtgttattcatggcacacactcttggtcttactcaaccagcaaacatagaactccccaagatctcttttgctgcaaaagagatcgatgtggcagaatggaaaggggacttacttgcagttggggtcactgaaaaagacatgaccaaagatgaaaactccaagttccaaaacccaattttgaaaaaattagatggcctgttgggtagtctcttagctgaggcctcttttgaggaggatttcactgggaaagctggccagtccttggttcatagacttccaggccttggctccaaaa

SEQ ID NO: 25195 - DNA, 374 bp, Gossypium hirsutum
  Clone ID: LIB3272-047-P1-K1-D6
cttgctaaacggtatcgttttagtcagtctttcatcaatggcgaaagaaccggttcgcgtcctcgttactggagctgcaggacaaatcgggtatgctcttgtacccatgattgctaggggagtcatgttgggtgctgaccagcccgtgatccttcacatgcttgatatcccacctgctgcggaggctttgaatggtgtcaaaatggagttggtggatgctgcttttcctcttctaaagggtgttgttgctacaactgatgttgttgaggcatgcactggagtcaatgttgctgtcatggttggtggtttcccaaggaaggaaggaatggagaggaaagatgttatgtcaaagaatgtgtctatttacaagtctc

SEQ ID NO: 25196 - DNA, 368 bp, Gossypium hirsutum
  Clone ID: LIB3272-047-P1-K1-D7
ctcttcttatgttaagaaagttggttacaaccctgagaagatcccatttgtcccaatctctggttttgagggtgacaacatgatcgagagatctacaaacctcgattggtacaagggtcctactctccttgaggctcttgaccagatcaccgagccacaagaggccctcggataagccactccgtcttccacttgaggatgtatacaagattggtggtatcggaactgtccctgctggtcgtgttgaaactggtgtcctaaaacccggtatggttgctacttttggtgctactggtctgaccactgaagttaagtctgttgagatgcaccatgaatacctgccggtagctttctctggtgacaatgtt

SEQ ID NO: 25197 - DNA, 342 bp, Gossypium hirsutum
  Clone ID: LIB3272-047-P1-K1-D8
ctcccttactaacaacaaaaacttggaaatgtcggacgacgatcatcatttcgaatccaaggctgatgccggcgcatccaaaacctatcctcagcaagccggtactatccgtaagaacggctatatcgacattaaaggccgtccctgcaaggttgtggaagtttccacctccaagacggggaagcacggacatgctaagtggcacttggttgggatcgatatcttcactggcaggaagatgctagatattgttccctcctgccataactgtgatgttccgcatgtcaatcggactgactaccaattgattgacatttctgaggatggatttgtgagtttgct

SEQ ID NO: 25198 - DNA, 353 bp, Gossypium hirsutum
  Clone ID: LIB3272-047-P1-K1-D9
gtctcgtgctaagtggcaagcatggcacaaattgggtgctatgcctccagaggatgcaatgcataaatacattgatgttgtgacagagctatatccatcttgggctgctggttcagctatgggcaaaggtggggctgataatgcttcaagtaaagatgtcaaaggaccaatgggaccggttttcagctcttttgtgtatgaagaggaatctgaaaatgatttgaaaatggatgctatccacacttttgccagagaaggagaactggataatttgcttaaatgcattgaaagtggtgtttctgtgcatttgcaagacagtgaaggcaggaccccgatgcattgggctgtagatc

SEQ ID NO: 25199 - DNA, 393 bp, Gossypium hirsutum
  Clone ID: LIB3272-047-P1-K1-E1
gtaaagagttacagctgagacacggacgaagatgccttgcctaaacctttcaaccaacgagaatctcgacggcgtcgacacctccgtcatgctttccgaagccacctattccgtcgctaaactcatagacaaacccgaggcctatgtgatgattgtgatgactggttcagcacccatgtcatctggtggtactgagctaccagattgctatggagaactggcatgaattgcaggccttagttcagatgtgtacaagacactgcgtgctgcaattgctgcaattattgcaaccaagctacaagggccagagtcacggcttttgctcaaactgtatgacaccgagggttacaactttggacggaacggatacaccttatgagcactgcatggtct

SEQ ID NO: 25200 - DNA, 379 bp, Gossypium hirsutum
  Clone ID: LIB3272-047-P1-K1-E10
catgtctcaatattaacagaaaaaactgggtgtttacacttatgagtgcgagatagctacatgaatcccaccagctaaaatgtacaaggctcgtatccttgacggtgacactgtgattcagcagattcttgcttaggcttacaagagtgatgagtacattgaacgcaatggtgaggccgctagcatcaatatggtcactgtcggagaaggtagccacttcaaatacgtgaagctgactgttgtagcagtacacaaagacaaatttgcgtatatttacagtgtgatcgaacgtgatgcattgatggataagctagcgatgatctattacgagacgaagttagacacctctccggatgggggatcagtatgcaagactact

SEQ ID NO: 25201 - DNA, 377 bp, Gossypium hirsutum
  Clone ID: LIB3272-047-P1-K1-E11
ttcgatctttgcaacctccggaacctattgtaactgctgagaaagtgttcgatgaaatgcctgtgacagttatgactgaggaagacgaagaaataattagatccgttgtttgtggaatgactccttcatattctttggaatctaaattagatgattgcaagagagcagctgcgatcaggcgtgaggctttgcagagaataacagggaagtcattatcaggattgcccttggatggttttgattatgagtcgatattgggacagtgttgtgagatgccgggtggttacgtgcagattcccgtgggcattgctgggcctttgctgcttaatggaagagaatactcggttcccatggcaaccaccgaatgatgcttggta

SEQ ID NO: 25202 - DNA, 378 bp, Gossypium hirsutum
  Clone ID: LIB3272-047-P1-K1-E12
ctttttgagctttcgtgtttgtctattgaattctttccttcactttctcgagaaaaaaaaaatgtcttcaggttgcaattgcggatctagctgcagctgcggatctggctgcaattgcggtgagaactgctcaatgaaccttaaccttggatactcggagaagacaaccagcactcagaccatcatctccggagttgcgccagtgaagatgacctttgagggaccagagatgggcactactgaatcaggacatggatgcagctgtggatcaagctgcaaatgtaatccatgcacctgttgaaaagcttgatgaaagccatagattatgaaaaaagaaagcagcaaaataacaggcctctgtaatgatttattttcaag

SEQ ID NO: 25203 - DNA, 376 bp, Gossypium hirsutum
  Clone ID: LIB3272-047-P1-K1-E2
cggacgcgtgggcattttcacagcttaaaacacaatctgactaaggatattgagaccacggcggagcaaggccgcggagcggagttctcagcgtaggactaccaggacccaccaccggcaccgttgattgacttggaagaactcaccaaatggtcgctttatagggcggcgatcgctgagttcattgccacccttcttttcttgtatgtcacggtgttgactgtgatcgggtataaagtgcaaaccgacccggcaaagaatactgtcgacccggattgtggtggtgttggtatacttggtattgctcgagcttttggtggcatgatctttatccttgtttactgcactgctcgtatctctggaggacacatcaacc

SEQ ID NO: 25204 - DNA, 382 bp, Gossypium hirsutum
  Clone ID: LIB3272-047-P1-K1-E3
tttttaaagaaccctagtttccgaaattacctttccaaaatgccttcaattccagaagagccactgctggccgcgaacccagaccgattctgtatgttcccgatccaatacccagaagtatgggaaatgtacaagaaagccgaagcgtcgttttggaccgcagaggaagtcgatctgtcttccgatcttcgtcactgggaagctctcaccgctgacgagcaccacttcattagtcacgttctcgccttttttgccgcctccgatggcatagtccttgagaaccttgctgttcggttcatgaaagaggtccaaatctccgaggcgcgtgctttttatggtttccaaatcgctatcgaaaatatccactccgagatgtacagtc

SEQ ID NO: 25205 - DNA, 378 bp, Gossypium hirsutum
  Clone ID: LIB3272-047-P1-K1-E4
ctttgacttcccttcatcatttcaagaaatgggttcaggagaaaaggtatttgtttatgaagatctggtgaagcacaaagacagaaatgattgttggcttttgatctctggaaaggtgtataatgtaacccaattcttggaggaccatcctggtggagatgaagttttgcttgctgctagtggaaaagatgcgaccaatgatttcgaagacgtaggtcacagtgatgatgcaagagagcagatgcagaagtactatattggtgaggtcgatgccaccaccattcccgcacgaaggatgtacaaagcacagacgtcaaccgcggcaactcaacaagaggagcctggctttctgtttaagattatacagttcctggtacc

SEQ ID NO: 25206 - DNA, 386 bp, Gossypium hirsutum
  Clone ID: LIB3272-047-P1-K1-E5
gcgatgtataagaagatttacagaggagatttcaagtgtccgccatggttctcacctgaagctcggaggctaatatccaagcttttagacccgaacccgaaaacccgaatcgccatctccaagatcacggaatcatcttggttcaaaaaatcaatccccaagactaaaacaactaaggaagaaatagaattcgaagcattcaatggagagaaatcttctaaacccgagaccttaaacgcattccacataatttcattgtcggaaggcttcgatttatctccgttgttcgaagagaaaaagagggaagagaaagaggagttgaggttcgccacgacgaggccggcaagcagcgtgatatcgaggctcgaagaggtggccaaatcggg

SEQ ID NO: 25207 - DNA, 383 bp, Gossypium hirsutum
  Clone ID: LIB3272-047-P1-K1-E6
ctttaactagaaaaaaaaataaaaataaaacatcaatcaattcccagccatggaaggagacttactagattgggaggtgctccacaactcggattctgactctaattctatcctggttaactcgccgcagttgaggaatcttgagggaatcgaaggtgatactggagggatgataaggtctgattacttttctcttgataatcagagtatgtatgcgaaggaaggggatgcaagtgaagaaggctctattgagtcagataatccgagttggattgatcccaagccggagactcagtttaggaggaataattcgggtgatttttggtccgattcgggtagtgatcggtcagatgatcgtaaattaagtgatttctctgtgaaaa

SEQ ID NO: 25208 - DNA, 390 bp, Gossypium hirsutum
  Clone ID: LIB3272-047-P1-K1-E7
tttgttttcaattttccatgtctttcttctctgttaaacaaccttagaaactcatttccttaattaccaaacataaaaaaaaaaccttatttttaaacagcaaaagaaaatggtgtctcctgagttttctctttcgcagttttctccaatggcgaaacctcgaaaccggtcgttttggtgtctgtccgatagtttcctttactgcggcggtgtctttttagctatcttattagtatgttcattttggtcgtttttcacaccgaccctcaacttcagctccgccattaccgacccgtcgtctgcggtcagctgtaaggaaagtgggttcggagttaacttaaaatccgacccgaaagacctgaccttctacgacgacccagagttgagtta

SEQ ID NO: 25209 - DNA, 386 bp, Gossypium hirsutum
  Clone ID: LIB3272-047-P1-K1-E9
aagagagcgaacatggcgataggagttaaggccttgcacttgtcgtttgtgcctcatgccctcgcgattgccggcgctgttatggtattggtttggtgcattcacttcaggggtggattagcttgggaatcttctaacaaaaatctcatctttaatctccatcctgtattgatgttgattggcttcattatcttaggaggtgaagccattatgagctacaagtctttgccactgaagaaggaagttaagaaagtcatacatcttgtgctccatgccactgctctgattctaggcattattggaatctatacggcattcaagaatcataatgagagttcaatacctaatctctacagcgtgcattcttggccttgggattggaatca

SEQ ID NO: 25210 - DNA, 383 bp, Gossypium hirsutum
  Clone ID: LIB3272-047-P1-K1-F1
gaagaaacgcggctgacgagaacattgcagaataatggcgtcgctgtgtcttttagttttgctgttactttgtcttccttttatttccgttgcttacaggccaggggacatcgttcctatgagcaagatgggtcaataccactcctctagaactgtttggcatgacgtgatcgggaaacattgcccaatttttgctgttaatcgggaggtgttaattcctatagcaaagccgactggttacacgggagctgatccctataaaatatcattccaagttgggaaggagaagtttcttgttccttggctttttcttataaatcgtaaaagttctgaagttccaatgattgacatgcatttgaggtactcaggtggtgatttgcatg

SEQ ID NO: 25211 - DNA, 381 bp, Gossypium hirsutum
  Clone ID: LIB3272-047-P1-K1-F11
cttgcattgagtctctaagatatcactgcaaggaaaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaagagcccaccctcggcacctaaacagccagccacttgccccaaagatacactgaaactaggtgtttgtgctgatttgttgggctcggtgcgcgttgttgttggaccgtcgaggaccaaatgctgctcactcatttcgggtttggctgatctcgatgctgctgtttgcctttgcactgctattaaagctaatgtgttgggggtta

SEQ ID NO: 25212 - DNA, 381 bp, Gossypium hirsutum
  Clone ID: LIB3272-047-P1-K1-F12
cattttctcctttttatctttaaaacacgcacccaaaaaataaaaccctttgaaaaccaaagaaggaagaagaagatgtcgtggcaagcttatgtagatgatcacttgatgtgtgaaatcgaaggaaaccatctctctgccgccgctatcatcggccaggacggcagcgtttgggcccaaagcgccagtttccctcagctcaagcctgaagaaattagtgccatcatgaatgactttaatgaaccgggttcactcgctccgaccgggttgcacctcggtggcacaaaatacatggtgatccaaggcgaaccgggagctgttatccgagggaagaagggacccggaggtgttactgttaagaagaccaatatggccttgatt

SEQ ID NO: 25213 - DNA, 361 bp, Gossypium hirsutum
  unsure (1)..(361): unsure at all n locations
  Clone ID: LIB3272-047-P1-K1-F2
ggatattcaacccctcgtctgtgataatggaactggaatggtgaaggctggttttgctggtgatgatgctccaagggcagtttttcccagtattgttggtcgtccccggcacactggtgttatggttgggatgggtcagaaggatgcctatgtaggagatgaagcacaatctaaaagaggtatccttactttgaaatatcctattgagcatggtattgngagcaactgggatgatatggaaaagatctggcatcatacattctacaatgaactccgtgttgctcctgaggagcaccctgtgcttctcacggaggcaccctctcaccccaaagccaatagagaaaagatgactcagatcatg

SEQ ID NO: 25214 - DNA, 381 bp, Gossypium hirsutum
  Clone ID: LIB3272-047-P1-K1-F4
gcagtcacagctttacccatttcagcttccaattaactatttcgcttcgtttgctttagcatcagtaagacgctgcaatcaatcaaaggtgatataacctttagttggaaataacgtaactggtacgttgaaagattttaatggcaggcaatggcctgccatctctgggtcgtgtaaagcttactgatctcataccttctgaaggcattccttcagattcttacaagctatcagtctctactctatcacaatcatttgctcaatattcagctgccatcattcagtttccagctagtgatggagctctactgagatccggtttagattctgctcgcctttacttccaacaaaaggctgcatacccaccagaggagctgattc

SEQ ID NO: 25215 - DNA, 355 bp, Gossypium hirsutum
  Clone ID: LIB3272-047-P1-K1-F5
gcagtcacagctttacccatttcagcttccaattaactatttcgattcggttgctttagcatcagtaacacgctggaatcaattaaaggtgatataacctttagggggaaataacgtatctgttacgtggaaagattttaatggcaggcaatggcctgccatctctgggtcgtgtaaagcttactcgaactttaccttttgaaggcattccttcatattctcacacgctgtcagtctgtacactatcacaatgattacctcaatattcaactgccatgattgacctaacagatagtgatggacctctactgagatccggcttagattgcgctcgactttacttacatcaaaaggc

SEQ ID NO: 25216 - DNA, 384 bp, Gossypium hirsutum
  Clone ID: LIB3272-047-P1-K1-F6
cttggggtgacagatgcttataacaaggatccaagcccaaacaagttgaatttaggtggtggcgcttacagaactgaggaaggaaaacctgtagttctaaatgctgatcgaaaagcagaacagcttcttggtaatgacctgtggagagtcaaggagtctcttactattcttggtattgcatagttcaatggatggagtgctaagctcatttttggagatgacagtcctgctattcaagagaacagagtgtctactgctcagcgcttgtctgctactggttacttgagggttgctgctgagtttttagcagagcattaccaccaacgtactatatacattccacagtcatcatggcgaaaccatgtgaacgttttcacgatggct

SEQ ID NO: 25217 - DNA, 387 bp, Gossypium hirsutum
  Clone ID: LIB3272-047-P1-K1-F7
gttctgcactgctgccttttcttcttcttcgagcgatctaaacccctaaatcagaatgaattttacggcttcaaagcaacctgaaaattgcttgcttggccctgaatctgactcccaaaggacactgtatccatatgtgacaggaacatcagtcgtggctttaaagtataaagatgggattttgatggctgctgatatgggaggttcgtatgggtccaccctgcggtacaagagtgtggagcgaatgaagcctattggcaagcattcccttctgggtgctagtggggaaatcagtgatttccaagagattttgaagtatcttgacgagcttatcttatatgacaatatgtgggatgacggcaactctttggggcctaaagaggtgca

SEQ ID NO: 25218 - DNA, 235 bp, Gossypium hirsutum
  Clone ID: LIB3272-047-P1-K1-F8
agattcataaatatttggatcaaaaaagaagaagttgctttgttttctcgagaaaatggagtcaaattcatggagctttcgattctccaattcttcttcttcttcttcgtcttcgtcaaggcgtcgtcaatcacgatctgatctgtttctaggaggaggatatgaagaaattgacggagatgaggatttcaaggcacagtttttatgtccattttgcgctgaggatttcgacatt

SEQ ID NO: 25219 - DNA, 305 bp, Gossypium hirsutum
  Clone ID: LIB3272-047-P1-K1-G10
aaaaaagaagcaaaaaaacatggccaaagttctgttgttcattgcactatgtgtgcttccagctttggttagtgctacacgcattctgaataatcaattggtggtagaaggctatgtgtactgtgatacttgccgtgctggttttgaaacccctaagactagaagcctagctgatgccatggttaggttggtatgctccgacaggaagagcggccaagttgtcttcaaaaaggagggatacaccgacaaaaccggaaaataccagattcgtgtatccgaggatcacttggatcagatctgggatg

SEQ ID NO: 25220 - DNA, 375 bp, Gossypium hirsutum
  Clone ID: LIB3272-047-P1-K1-G11
gtttgagaaatggggatgatggcaagtgtttcttcaatggaattttggtgcgtgcttaacctcagagccactcttattactcttcttcttattctcttttttcatctttgcaagaaactctactctaaattctttcctgctccttccgctcttcatcttccttctccttcttcatccacttcccttcctgaatctcaatcaagaatcccagagattgtatctgattcagacgtggggttttcgattgataatctggatgagaagctcgatgaggacgagaaatgggagactgtaattgataagaaaaccaactctatatcctacaaggcgaaatgctgcagacctaagaataaaccactaaaatacctgagcacg

SEQ ID NO: 25221 - DNA, 378 bp, Gossypium hirsutum
  Clone ID: LIB3272-047-P1-K1-G12
aaaacatcttctatttgagagaaattgatgatgctgataagttggtagaagcaatcaaagcaaagaagaatggaaaggctgttatcgttggtggaggttatattggtcttgagcttggtgcagccttgaaaattaacaatcttgatgtcagcatggtgtacccggaaccatggtgcatgccccggcttttcacctctggcatagctgctttttatgagggttattatgctaataaagggatcaaaattataaaggggacagttgcggttggattcacctctaactccaatggagaggtgaaggaagttcaacttaaggatggcagagttctggaagctgacattgttgtggttggtgttggtggaaggcctcttacag

SEQ ID NO: 25222 - DNA, 364 bp, Gossypium hirsutum
  Clone ID: LIB3272-047-P1-K1-G2
gacgcccggaaggggccgggatttattgggggggccccacgcgtcgggttccgacccatacactggggcttttttctgttttcaccgattcaaaaggaatttaaaaggaaataaggttgggccaaataggaattttaataccgttctggaaactcttgccaagaaaaaagcagacgcaatggcccgacagcggttagacagaggcgatctatggaagaacaaggctcgcgttttgcaactccagctcatgcagcgctttacgttgtaaggcgatcgccaccgaccttcagtccttgctgatcgttacttggccaagtcggttcagcgccagtttattcaccacttgcgccatatttttcttttc

SEQ ID NO: 25223 - DNA, 384 bp, Gossypium hirsutum
  Clone ID: LIB3272-047-P1-K1-G3
cttgaggggaagaatcttgctatcccttgcttttctctcgcaaaaaattctgaaacttgtttttaacgttcgctgaatactatcgctcatttcttccctcagaaccctaatcgataactgaagccatttaatcatgtttgggcgtgttccaaaaaaatctgataacactaagttttacgaagtacttggggttcccaaaagtgcaagtcaggatgaattaaagaaggcttataagaaagctgcaattaagaatcatccggataaaggtggagaccccgagaagtttaaggaactggctcatgcttatgaagtacttagtgacccagagaagagagaaatatatgatcaatatggtgaagatgctcttaaagagggaatgggagg

SEQ ID NO: 25224 - DNA, 380 bp, Gossypium hirsutum
  Clone ID: LIB3272-047-P1-K1-G4
cttccatatccaacactatctcacacacacaaacaccaaaaatgccgtttaagagatacgtcgagatcgggagagtggctctcgttaactacggcaaagactacggcaagttggtcgtcatcgttgatgtcgtcgaccagaacagggcacttgttgatgccccggatatggtaagaggccaaatgaacttcaagaggcttacattgacagatatcacaattgacattccccgtgttcctaagaagaagacattgatcgaagctatggagaaggctgatgttaagaacaaatgggaaagtagctcgtggggtagaaagttgattgtccagaagagaagagcatctctcaacgacttcgacaggttcaagcttatgttggct

SEQ ID NO: 25225 - DNA, 377 bp, Gossypium hirsutum
  Clone ID: LIB3272-047-P1-K1-G5
aaacgttaaaccctagaatttgttagagtgaaattagacgtgtgtttgtttgggtgaagaataatgagtgaaaggcaagagcttcaacccgatccgcagattcaatcgccccagggttcatcaagagatgacatgatttcctgggtggtggcgttagagacggctttgctcccctgcttgcccgccagagagcttcaagctatcgaccgttctccgcacccttctcatcagattgatgtggagagacatgctagagatttcatggaagctgccaagaagcttcagttatatttccttggcttgcaacgcgaggatcagccaaccaaggctgaaatgctcagaaaagagattgcaacaatggaagaagagttgaaaac

SEQ ID NO: 25226 - DNA, 382 bp, Gossypium hirsutum
  Clone ID: LIB3272-047-P1-K1-G6
caggaaaacaagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaagatatgcgatgaaagagtcgtcgtcgtcggagacaagggcttattcttcagcttggg

SEQ ID NO: 25227 - DNA, 382 bp, Gossypium hirsutum
  unsure (1)..(382): unsure at all n locations
  Clone ID: LIB3272-047-P1-K1-G7
cctcaacccaaaaactggtaacaatggccatatccgtccctattttagccatcatctttgctctccatctcatcgccttcgtcttcgccgtcggcgccgaacgacgccgtagcttcgctgaggtggtgcctgatcagtacgacgagaggacctactgcctctacagtacggatgcgtcgacggtgtacggactatctgcttttggtctgctccttcttagccaggttgttgttaacggcgttactagatgtctctgctttggcaaaggccttgtctccgccacttcatccaccacttgcgccatctttttcttcgttttctcctggttaagctttttgggagctgaggcatgtttactggcgggatcagcananaacgcata

SEQ ID NO: 25228 - DNA, 350 bp, Gossypium hirsutum
  Clone ID: LIB3272-047-P1-K1-G8
cggacgcgtgggctttgactgaatcctatatcctctctctgatttcgtttttagggttgtatttttctttgttctaattcaaaaaagaaaatgtcaagtgctttagagatgtcgctcgacgatctcatcaagcgtaaccgtgagtcgcgatccgcctcatctcgaggacaaggactcggtttcgcaactgcaccggaccgacggtttcatggtggcagagcatccccaccggcccttagtgcttgctgtacggctcctgtgacgacgtggtcagcgcttgctccgtccgttccgcgacttgcgtcgcgattccctcccttcttgctcttctttctacgcgaaaaaagtga

SEQ ID NO: 25229 - DNA, 342 bp, Gossypium hirsutum
  Clone ID: LIB3272-047-P1-K1-G9
tttgaaggccgaagaggggaaaggttccatgtgaacggcacttgcacatgggttagtcgatcctaagagacgggggaagcccgtccgacagcgcgtccagcgcgagcttcgaaagggaatcgggttaaaattcctgaaccgggacgcggcggctgacggcaacgttagggagtccggagacgtcggcgggggcctcgggaagagttatcttttctgtttaacggcctgcccaccctggaaacggctcagtcggaggtagggtccagcggtcggaagagcaccgcacgtcgcgtggtgtccggtgcgcccccggctggccttgaaaatccggaggaccgagtg

SEQ ID NO: 25230 - DNA, 387 bp, Gossypium hirsutum
  unsure (1)..(387): unsure at all n locations
  Clone ID: LIB3272-047-P1-K1-H1
ctcctcgcgaaagtgtcagatggcaactttagctgattcattccttgcggaccttgatgaattatcagacaacgaagccgatgttctggaggaagaaaataatgatgttgcaaacatggaagaagatattgatggtgacctcgcggatatcgaaacgcttaactacgatgatctggacagtgtttccaaattgcaaaaaagtcagagatacattgatataatgcagaaagtggaagatgcgctcgagaagggttctgatatatcaaatcagggcttggtactggaagatgatcctgagtatcagctgattgtggactgtaatggactatcagttgatatcgagaatgagattgttattatccataantttatacgtgataagtaccg

SEQ ID NO: 25231 - DNA, 383 bp, Gossypium hirsutum
  Clone ID: LIB3272-047-P1-K1-H10
gcggttcacagagacatcaagcctgcaaatttgctcgtaaatcttaaaggggagcccaaaataacagattttggcataagtgctggcctagataattcaatggcaatgtgtgctacctttgtcggaactgttacatacatgtcacccgagcgaattcgaaatgagagttattcttatcctgctgatatatggagccttggtcttgctctctttgagtgcggaactggagaatttccatatatggctaatgaaggacctgttaatctcatgttgcagatcttggatgatccttccccatcaccgccaaaacacaaattttcaccagagttctgttcatttatcgatgcttgcctgcagaaggatgcagatgccagaccaacagc

SEQ ID NO: 25232 - DNA, 282 bp, Gossypium hirsutum
  Clone ID: LIB3272-047-P1-K1-H11
acccgtgcggagtaaaggcccatccccttagccacaattcctctttctctggctggggggtccgaatctacggatttgcgggtggagcaggccagagctcatctctgtgcttcaaagctcgctcctttattcctttcaaaccctttcctttttataacttgattacattttctcagatctgttcttgttctctatctctctctctctccaggctcctgtacaggtagaatgctcttcttccttagcgatgtgatctttgtcgctcagtcgacatggcttcaa

SEQ ID NO: 25233 - DNA, 271 bp, Gossypium hirsutum
  Clone ID: LIB3272-047-P1-K1-H12
caggtgttcaaggtgaacagccgctggccaatgtatcattgtatgtttgagcaaaaaggactttggcttctcgcttcgagagaaaccatgttgttttaccaggatctcatgtggcggggacgagcttctttttgactctttcccctacaaggaaactgagaatgggatgctgggggaagttgagggaaagtgtgttgtgcaaggagctgtcgatgttgacattggtgccaatcctttacccgaaggtgctgatgaggatgaaggtgttgat

SEQ ID NO: 25234 - DNA, 378 bp, Gossypium hirsutum
  unsure (1)..(378): unsure at all n locations
  Clone ID: LIB3272-047-P1-K1-H2
gtttggtgcatatatctgatttttaaccagattgttgataccaacattccaccatcccatccatcccttctctgtttttgactgtcactctctcaagcacacaagttagcagtgggtgtgctttctttgccttcccttttccagtgtttttctgaatatctctcccttcatgtggtctttaccttccttatttcttgcatcattttctgctattaaaaacccccaaatcctaaggagaaagatcaccactttcaaatctgtctgtcattgaactcgttataatcccaagaggagtcatttttataccttntttttttggaggggggtgtacccttatgaagaatgatctgcgttcacattggagtttaagaagatggt

SEQ ID NO: 25235 - DNA, 383 bp, Gossypium hirsutum
  Clone ID: LIB3272-047-P1-K1-H4
cggacgcgtgggttctctttggcttatctatcgctttgatttcgcatccttgctgtgcactcgatggcaaatcgatggttgaggcctgaggtgtatccgctgtttgcggccgtaggtgttgctgtcggaatctgcgggtttcagttggtgcgcaatatctgcatcaaccctgaagtcagggtaaccaaggagaacagggctgctggggttttggacaactttgctgagggagaaaaatattctgaacatttcttgagaaaatatgtccgcaacaagacgccagaaatcatgcccagtatcaacagcttcttcactgacccaaagtgaggcttcactcttgctttatgctgaaactaaaaaataaaaaaaatagaagaactaag

SEQ ID NO: 25236 - DNA, 370 bp, Gossypium hirsutum
  Clone ID: LIB3272-047-P1-K1-H5
gtgtagagatgaggaaaatcatgggtgccaaagttctcttcttctttgctttgctttccttttcagctgtgtcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaagaatttcaggtacattgagaccatcaaagaagctgtagaaagggaatg

SEQ ID NO: 25237 - DNA, 356 bp, Gossypium hirsutum
  unsure (1)..(356): unsure at all n locations
  Clone ID: LIB3272-047-P1-K1-H7
tgcttgttcccttggttagctggagggttcttgatgagtgtggtttggagttacatcatagctcaagaattggttggcttattgatttcacttggccacatacttggaatcactcagtcaatccttggtttcacagtccttgcttggggcaactcacttggagacattgtcaccaacttgacaatggcattgaatggtggtccagaaggggttcaagtggctatatcaggctgctatgctggtcctatcttcaacactctctttggtttaggcatgtcattggttggctcagcctggcatgggtacccttcacctgttcagatccctaaagacccgtatctncttgaaacactggg

SEQ ID NO: 25238 - DNA, 345 bp, Gossypium hirsutum
  Clone ID: LIB3272-047-P1-K1-H8
gaagaagaagaaaaaggaaacaaaagatggcaattgagattcctagagtgaaacttggaactcaaggattagatgtttcgaagctcagattggtatacgctagtctgacacggcactacagatcgaatacgaaccgagaaagcgtggcctatcaatcctctagaccttcggaaatgggagactgacatgtgtacaaacgtcctctatggacccaaaactaacgaaattctcgtccgaaaggcattgcatcatttttcactcctgaaaaggcagttttctacaaaattcggagttgaaaacaccaagtgtcggattgtccacccaccaatggcgcacgtgagctgg

SEQ ID NO: 25239 - DNA, 379 bp, Gossypium hirsutum
  Clone ID: LIB3272-047-P1-K1-H9
gcgtgtgctttgtatattgaagtttcctttctcgattttctatttagccaaacaagatgcagatcttcgttaagactctaaccggcaagacgatccttctggaggccaaaggctccattccaacgacaacgtgaaggccaaaatccaagataaggaaggcatccctccagaccagcagcgtctgatcttcgccggaaaacagctcgaagacggccggaccttggccgattacaacatccaaaaggagtcaactctccacctcgtcctccgtctgcgcggtgggatgcaaatcttcgtgaaaaccttgactggcaagacaatcactctcgaggtcgagagctccgacacgatcgacaacgttgaagcgaagatccaagac

SEQ ID NO: 25240 - DNA, 308 bp, Gossypium hirsutum
  Clone ID: LIB3272-048-P1-K1-A1
ctcattccccctaaataccgacttttttcttcaaattccccaccaacggccgtcactgtctcagatctgcacaccgaatctggccttaaatcccttaacgacttcctcaccggcaaatcttaaatctctggggataagctgactaacgatgacataaaagtttatgctgctgttttgaaaaatcctggagattcatttcccaatgtgagccaactggatcactgtgtgtcttgccatctcgctgatagctttcctgggaaagctgttggctatcacttgctgcaaagctgatcagctcaatctgtgag

SEQ ID NO: 25241 - DNA, 339 bp, Gossypium hirsutum
  Clone ID: LIB3272-048-P1-K1-A10
gaaagtgggagagaaaaggaaacaatagagttagatgaagcacggctacaggggcaagcggagatatggcgatacatgttcagctttgcagattctatggcgcttaagtctgccgtggagctccgcatagctgacataatacactctcatggtgtcgccatcactctatcgaaaatagcttcatgcattaatggcagccttacttcggcggacaccaccacccttgctcgcataatgagattgctcgtccgtagaaagattttcactggccaccacccttcagacgggggagatcccttggacgaactgactcactcatcgagatggctactacatgac

SEQ ID NO: 25242 - DNA, 397 bp, Gossypium hirsutum
  Clone ID: LIB3272-048-P1-K1-A11
attccaaaattccttcctgccgactgccccgatttcattcccaaatcttgcttctctaaccgcgcagaaaatctggtaccagcaacagctctattctgattctccagaactttcattttgtttcctcgcttctctcgccgagaagacctcctttccaccagcatccatggcccgaattttgggccttttcctttgatgattgatgtatattttttcccgttcaagcactccgccgaaaaaggtccctctacggccgtcgactcctcacgaggattatttgccgggttcaccaaatccgcagatttttgggtcgccataaccgcgatgacccgggattcggcaattgaatccatgttaataccacactcgggtaacgttgcattggattgaaatgctt

SEQ ID NO: 25243 - DNA, 406 bp, Gossypium hirsutum
  Clone ID: LIB3272-048-P1-K1-A12
caccgtcactagcggcgccgtcacaaaatgtcgtcaacggagtctctcatcctccaactccatgaaatctctgccgttaaattcggtaacttcaagctgaaatctgggatcttctcccctatctacatagacctccgtctcatcgtctcttacccttccctcctccaccaaatctcccactccctcctctcctctctccctccccaaacacactttaacctcatatgcggtgtcccttacactgccctccctatagccacctccatctctctcgacacctccatccccatgctcatgcgccgcaaagaagtgaaagactacggaactgccaagtccatcgaaggtgtttacgaaaagggtcaagcttgtttggtggtggaagacctcgtaacgtccggtgcatcgg

SEQ ID NO: 25244 - DNA, 335 bp, Gossypium hirsutum
  unsure (1)..(335): unsure at all n locations
  Clone ID: LIB3272-048-P1-K1-A2
ctcgtggcactttcggaaccgttcatcgtgggatgtatgatggccaagatgttgctgttaaacttcttgactggggagaagagggccacagatccgaggccgaaatagcttcacttcgagcagcttttactcaagaggttgcggtgtggcataagcttaatcatcctaatgtaacaaagtttataggggcgacaatgggctcatcggacctgaacatacagatggaaaatggtcaaattggcatgccaattntgtgtgttaatgtggaaatattgtcctgggggtgcactgaaatcctacttgataaagaatcggagaaggaagttggcttttaa

SEQ ID NO: 25245 - DNA, 331 bp, Gossypium hirsutum
  Clone ID: LIB3272-048-P1-K1-A4
catacctaaaattactttctgacgactgctccgatttcatttccaaatctggctgggctaaccgcgcagaaagtggggttccaggaacagccctattctgattttccagaaccgttattttgatatctcgattctatggccgtgaagaccttcttcttaccaacatgcatggcccgaattttgggcgctctttctttgaggatagatgcatatttatataccgttcaagcgacttcgacgaaaaaggaacctttacgggcggggactcctcacttggattattcgccgcgttcaccaaatccgcagattttgggaacgccataacacgaat

SEQ ID NO: 25246 - DNA, 149 bp, Gossypium hirsutum
  Clone ID: LIB3272-048-P1-K1-A5
cttgaactctcatggcttcaagtgctgcaacccttccatctaaaatgaaagcatgggcgttaccctgagtacggaaaatcatcttatgtttcgaaactacaatccgatgttgttgttccccaacccagggatgttcaagtttttcttca

SEQ ID NO: 25247 - DNA, 422 bp, Gossypium hirsutum
  Clone ID: LIB3272-048-P1-K1-A6
cccacgcgtccgtaccattcatagcatagcagcttagtccaacagtccaactccacacccaccaccattggctgtttctgatcatccgaaaaagaatggtgaccgtggaagaagttcgtaaggctcaacgtgcccaaggccctgccaccgtgttggccatcggcacatcaaccccgcctaattgtgttgatcagagcacataccctgactactatttccgtatcacaaatagtgagcacaagaccgagttgaaagagaagttcaagcgcatgtgtgaaaaatcgatgatcaagaagcgatacatgtaccttacagaagagattttgaaagagaatcccaatgtatgtgaatacatggctccttcactggatgctaggcaagatatggtggtagttgaggtgccaaagctaggcaaagaagca

SEQ ID NO: 25248 - DNA, 337 bp, Gossypium hirsutum
  Clone ID: LIB3272-048-P1-K1-A8
acgctcgctgcacgtctgactccgatcatagccgtatgtactctgccatatgggcctttacacacgagtggactggaccaaaaagggccacactctccctggcgtaataccgtctctctatgcacatcttactaacaaggtttctgggcggtcttacctaaatcctcctcacggaacaaattttctaggggctaaaacggcctcatcggggctgtacagacgagtggcaagtggtcaatattggcataccaattggttggggtaatgaaatgtattgcactgggggtgcacgtgaatccgacttggtaaaatactccgaaagggagacttctattga

SEQ ID NO: 25249 - DNA, 372 bp, Gossypium hirsutum
  Clone ID: LIB3272-048-P1-K1-A9
ctttaccataaattgaacgttgaactcctcaaaaatcttcaaagcttcaacttttccaaacatcagcgatccctttcactccaaatttcatcgggtgaataatggcgacgtttgagctttaccggaggtcaacgatcgggatgtgtttgacggagactttagacgagatggtttccagcagtactttaagccctgagctcgctattcaggttctcgtccagttcgataagtctatgactgaagccctggaaagtcaagtgaagagcaaggtttccattaagggacatctgcacacctatagattctgtgacaatgtttggaccttcatcttacaagatgctttgtttaagaacgaggatactcaagaaaacg

SEQ ID NO: 25250 - DNA, 126 bp, Gossypium hirsutum
  Clone ID: LIB3272-048-P1-K1-B1
ctatatgctatttgacacgatattcctatcatctaataagctatataactcagattcaatttggggactatggcactgcggaagccatccgtctttggtaccggacgccctggaacagaggacaaa

SEQ ID NO: 25251 - DNA, 318 bp, Gossypium hirsutum
  Clone ID: LIB3272-048-P1-K1-B10
acgttttctggctacatgtgtcgacatggagtgtaatggcagcaactggagcaggggctgtcaggcaaagaacagcgaatcgttgctttgtccaagaagatgccaaaagagctcccaagttagcttgctgccaatcatcatctcattgtaaacaggctgattctagccccactggtgtagcagatgctcgtgatcaccctgcagttgatctcaatgctctcaacaggaaccctttctgatccaatctactgcctagaatgaggtggtggcttcagttgcagcctaactatggaccccaaatgggcttaaaaaatgagc

SEQ ID NO: 25252 - DNA, 402 bp, Gossypium hirsutum
  Clone ID: LIB3272-048-P1-K1-B11
attacagcccatttttctaaactccatcaatattcaaaaaggaacttcaatggctttaaagaaacctggtttgattgctttatttgatgttgatggaacacttacagctccaagaaaggtggctacccctgaaatgctggagttcatgaaggaactgagaaaggttgttactgttggagtagtaggtggatctgatcttattaagatatctgagcaacttgggaaatcagtgattaatgactatgattatgtattttctgaaaatggacttgttgctcataaagatgggaaactcattggaacccagagtttgaagtcgtttctcggagaagataagctgaaggaatttttaaacttcacattgcattatattgctgacttggatatcccaataaaaagggg

SEQ ID NO: 25253 - DNA, 400 bp, Gossypium hirsutum
  Clone ID: LIB3272-048-P1-K1-B12
agcagaaaatatctcaaatctcctcctcctcctcagaaatcttagtatcatcaccatggcctcaaatcccaaggtcttctttgacatgactatcggtggtcagcccgctggtcggattgtgatggagcttttcgcagattgcactcctcgcactgctgagaacttccgtgccctctgtaccggcgagaaaggcgtcggccgcagcggtaagcccctccactacaaaggctcctctttccatcgtgtgatccctaactttatgtgccaaggaggtgacttcacggccggaaacggtaccggaggtgaatccatctacggatccaagttcgctgacgagaacttcatcaagaagcacactggtcccggtattctctcaatggctaacgctggtcccggaact

SEQ ID NO: 25254 - DNA, 358 bp, Gossypium hirsutum
  Clone ID: LIB3272-048-P1-K1-B2
attctttaatccattaagatatcatgggcaagggtccaggtctctacactgaaatcggcaagaaagccagagaccttctttacaaggattatcagactgaccacaagttcactctcaccaccagctctccaactggagttgctattacatctgccggaacgaagaaaggcgaactctttttggctgatgttaacacccagctgaagaataagaatgtcacaactgatattaaaggggatacctactccaatctctataccaccataaccgttgatcaacctgcacccgggctgaaagcaatctttagcttcagagtccctgatcagaggtctggcaaggttgaacttcagtatttgca

SEQ ID NO: 25255 - DNA, 339 bp, Gossypium hirsutum
  Clone ID: LIB3272-048-P1-K1-B3
gtggagagccttctacagcgagcgcattcttagttccaggtctctacacggggatcggtacgacagccagagaccttcttttcaagggatgataagaccgtccacacctacactctcaccacctgctgtccaactggagttgctattacatctgccggaacgaaaaaaggcgaactctttttggctgatgttaacacccagctgaagaataagaatgtcacaactgatattaaagtggatacctacttcaatctgtataccaccataaccgttgatcaacctgcacccgggctgaaagcaatatttagcttaagagtccctgatcagacgtttggcaag

SEQ ID NO: 25256 - DNA, 292 bp, Gossypium hirsutum
  Clone ID: LIB3272-048-P1-K1-B4
gggcgacccacgcgaccggcaggcagccaaggcaaggaacaaggtgcacgagacaaggaacaaaccagaggcagagctgatgaggcagcgcaaggaaataaaagcgcaaccaccccaaccacgagagccaaggacaccgggggggcccccaagaagcgcaccaagagaaaaggggagaggcaaagcaaagcacaaggagcgacggggaaacaccaaaaacagaaggcggccgagagggaagcttataagaacaagaagcccacagccgcgggagccccggcccaagaagacc

SEQ ID NO: 25257 - DNA, 268 bp, Gossypium hirsutum
  Clone ID: LIB3272-048-P1-K1-B5
atttaatcccctcccaacaatcttagggtctgtaattctcctataacatgcatagggtttgtggaaaagtgaggggggtcatcaatcttaacctctttacctatttattgtactcttttttttgtctaaaccccactaaacccccaagcaactttcaatatggtgttgttgggctaggcttagtatcagctatgactgattcaactcatacacaccaatttatgtgattagcttccattcacaacatccactcctatacctattttat

SEQ ID NO: 25258 - DNA, 408 bp, Gossypium hirsutum
  Clone ID: LIB3272-048-P1-K1-B6
atagagtcatttgcaaggagcagtgtgacgatgggaagagggctcaaaggcagtgaactgttgcctttcacggtacagttcctgagaggaagatggtttgcactttttgcatcctttctaatcatggctggagctggtgccacatatctatttggaacctactccaaagagatcaaagctgcactggattatgatcagacaacgctcaatctcttgggcttctcaaaggatcttggtgctaacgttggggttttttccggtcttattgctgaggtaactcccacttggtttgttcttctagttggtgctgcattaaacttcggagggtatttcatgatatggttagctgtgactggtagaatagccaagccaaaggtttggcaaatgtgcatttacatctgcatagga

SEQ ID NO: 25259 - DNA, 207 bp, Gossypium hirsutum
  Clone ID: LIB3272-048-P1-K1-B8
gttgcttcggaagcatggacttcatagttactatgctggttttaggtttgggcattttccgcagcaaagcgtttgtcctttgcggtcctaagccagaggactcggaccttttgtcattccaatatatggaaatgttcccattgacttacccaacatgactgattgtaccaaactgactttaacatcgcatgcaaagaccgagctagg

SEQ ID NO: 25260 - DNA, 389 bp, Gossypium hirsutum
  Clone ID: LIB3272-048-P1-K1-C1
gggaagcaacaaccgttgaaaagatcagttagtgctgggctttacatgagcccggggagcccatctgggtccgatttgagcgattccagcgtccccgttttatcatcttcacacgtgtacaagcccatcccgaggaccggcggagtcagcgttgacgtcaatgttatgccattacctggggtcgaagcggcggcgtcttcttctaacgatccaccgacttcactgagtttgtctttacctggggctgaatcgtatgagttgtcagtttcaaccctcccagttaccgagtctactcagacgaggaacgaagcaaaaaatgatggaaagggaggcgaggtgatggggttcagtgcggagtttatggcggtgatgcaagaaatgataagaat

SEQ ID NO: 25261 - DNA, 389 bp, Gossypium hirsutum
  Clone ID: LIB3272-048-P1-K1-C10
caaatgggcatccttggcaatgacccttcagttcaagacctgttggtgatggtgttattggtattgacctgggtacaaccaactcatgtgtatcagttatggagggaaagaattccagggtaattgagaatgctgaaggagctagaaccacaccatctgtggttgccttcaaccagcagggggagctaattgttggaacaccagccaaacggcaggctgtgaccaacccaacaaacacattttttggaacaaaacgtctgattgggagacggtttgatgatgctcagacacagaaagaaatgaagatggtaccttataagatagttagagcttccaatggggatgcttggcttgaagccaatggaaaaacttattccccgagccagatt

SEQ ID NO: 25262 - DNA, 404 bp, Gossypium hirsutum
  Clone ID: LIB3272-048-P1-K1-C11
ttcaattccccccacaaggtcttcaatttccctgcaaaagccaacaattcttgagctgtgagaaagcactttctctaaaactactaaccttcaccaaacaaaaatgggtgcaccttaaccccaaccctgaacccacttcactagtcgtcttcaacagatagcaagctggcggtactggttctgatcctggtcctgatccacacccatcatcttcttcttcacttttactttgaaccacaatgccccatgttccttcttcaactccttgtatttgatcaacaaatatcaccccatcgggcatagctctttcccctttcttccacttctgtttcatcgaaacccagttttcttccaccgccgttgtttccatcgtggcgttttcagagtagacgtggatcaagagt

SEQ ID NO: 25263 - DNA, 393 bp, Gossypium hirsutum
  Clone ID: LIB3272-048-P1-K1-C12
ctccttgtcattagtttctgttactacttcactctccctctgtcttcaagaaatggatcgtagaagtgcatttgcagttgttttgatttgttttgtggtgaccgctgtcggtggtcaatctccggcagcctcacctactaaagctccgccggccgcgactactcctgctactgctactgctcccgctactgcccctgttagcaaacctaaatcaccggctccaactgctgcccctaccacttccccaccaacttcttcaccaccggttgcggctccggagaagtctgcggcggttccagccccatctaaatctgctccgtcttctcctccggctgctgcgccggtgagttctccaccggctccagtacctgtgagctctcctccagccagatc

SEQ ID NO: 25264 - DNA, 202 bp, Gossypium hirsutum
  Clone ID: LIB3272-048-P1-K1-C2
acttaaccattttccaaaactcctcccttctcttctttagcggcctttttagttttgcccaatccagcggcgtcttaaaaacacaaaaaggggtcctacaacccctggggagcaaactctcctggtggtggccgtcgcctagaccctcggcaaagttggaccatcgatgtgcctgctggcactgctatggctcgtatttggg

SEQ ID NO: 25265 - DNA, 328 bp, Gossypium hirsutum
  Clone ID: LIB3272-048-P1-K1-C3
caaaaccttcattacattccactcactttttacaacctccctccaccaacatggggaaaacacgtggtatgggagctgggcgcaagctgaggacccaccgcatgctgcagaggtgggctgataaggcatacaagaagtctaacctttgaaatgaatggaagaagccatttgccggttcttcccatgctaaaggaattgtccttgagaagataggtatcgaggctaagcagccaaactctgccatccgaaagtgtgctagagttcaattgatcaaaaacggcaagaagattgctgcttttgttccaaatgatggttgcttaaactacat

SEQ ID NO: 25266 - DNA, 411 bp, Gossypium hirsutum
  Clone ID: LIB3272-048-P1-K1-C6
caaaatctcaaacccagatttgttctctctctctctctctctctatttccaatcaattaattcctccattggaggagcttagggtttgttggtgttctggtctttgctttgtctgaaaaataaacagaattataaacgaacaccaacgccatgggaagatttgaagagagaggattcgattcagtggtttgccctaagcctatccgaacctttagatggtctaccaacagctgttatcagactgagatggctgattcaaaaactggtgcagagcttcttgatataatcctccccgagggagggtatggggccgagaatcccaccaaccaaatggcttcatcaccaccgtatttctgtggatcaccgccgagcagggcgtcgaatccggtaatccaagatgcccgattcaac

SEQ ID NO: 25267 - DNA, 241 bp, Gossypium hirsutum
  Clone ID: LIB3272-048-P1-K1-C7
tcgaaaaagagaaaataggaggagttttatggttggggatgaagagtaccactgacatcatatatgttatttacatcaaattttcccattaccttcatatcttctgttgggtcctcttctctttttaattgcgtttgctttttttgtttgtggtttaagggaaaaaaatacttcctttttgtgtttccacttggttttggggtgaaatgcgcccacattaccttccgattttaaaccttgg

SEQ ID NO: 25268 - DNA, 232 bp, Gossypium hirsutum
  Clone ID: LIB3272-048-P1-K1-C8
gctttagaatccatcccttcttctttgtttgattatagcaatttcctatatcaatgggcttttgctattgcatctgctggtattaccagtggctccattgcagaaagaacccaattcgttgcttatcttatttactcgtctttcttgactggattagtttacccccttgtttcacatttatttttggcggctgatggttgggctagtgcttttagaacacatgattttcttt

SEQ ID NO: 25269 - DNA, 361 bp, Gossypium hirsutum
  Clone ID: LIB3272-048-P1-K1-C9
cccacgcgtccggatcagtgttctttctccaaaacccagaaaaaagaaggtttcgaatcgacttcaaattctgacaagtaattgttaaaattttgattgagggtccttcggatttcctctggtaaatcctttcagcgctctcaagttggttcccaaagagagggtaaaaagcctgggaatgctggaagatgtgcctcatcgttcaaaattccatttttgaagttgatgagcttacggcttttcgatcctttttcatctttgatgattctggatttggagttattggcgaaccatcactaactctccatgcacagaagcagaattggcatataagtgatacgagagcccctttttttgtatt

SEQ ID NO: 25270 - DNA, 408 bp, Gossypium hirsutum
  Clone ID: LIB3272-048-P1-K1-D1
caaatttactactactctcttagctctcctctgtttcagtctcctttttatttccataataagatcacaatttttttctcatttattttttattttcacttcattttttctcagctttaacaaataaagaagaaaaagattcaagtaatttataccttatggaatatgatacagagaaaacatgaagagaattcaagccaatcgataacatttcatcacctacctgttcttcttcgtttcagaaacttctgttttttgaccggccatgggaaagaaagggagtggatggttctcgacggtgaagaaagtgttcaaatcttctcacaaagacttgcctgacaaaaaaagagagaataatgtggagaaatggccaaatgaggccccggatgtagtgtcggttgaacattt

SEQ ID NO: 25271 - DNA, 399 bp, Gossypium hirsutum
  Clone ID: LIB3272-048-P1-K1-D11
ctcttattggggaccaaaggctggttataatatttatcatatgaagagtgcagatatgttgtttggaggggttacaattgtatgtgggattttaggaacaatatctggtggcttcatcctagatcgcatgggtgctacaatatctaatgcttttattcttctttcaggtgcaacatttctgggtgcaatatcttgcttctctgctttctgtctcaggagcttgtatggttttatagttctttttgctgtgggtgaattacttgtttttgcaactcaggctccagtcaattatgtatgtctccattgtgtaagaccgagtttgagaccattatctatggcaatctctactgtatcgattcacatatttggcgatgtaccttcctcaccacttgttgggat

SEQ ID NO: 25272 - DNA, 388 bp, Gossypium hirsutum
  Clone ID: LIB3272-048-P1-K1-D12
cttgagaggtcttgcaggacagtgatgagcaaatctcctaacaagcacaaccgtctgtacatggaggctcgacccttggaggaaggtcttgctgaggctattgacgatggacgcattggtccaagagatgatcctaaggttcgttccaagatcctggctgaggagtttggttgggacaaagatctcgctaagaagatttggtgttttggccctgagaccactggccctaacatggtggtcgatatgtgtaagggagttcaatatctgaatgaaattaaggattcagttgttgctgggttccagtgggcatcaaaagaaggtgccctggcttgagaaaacatgagaggcatctgcttcgaagtctgtgacgtggtccttcatgctgatg

SEQ ID NO: 25273 - DNA, 322 bp, Gossypium hirsutum
  Clone ID: LIB3272-048-P1-K1-D2
attatcgattcttcttgattcatcttttcttttaatctttcttctttaaagactcggtataagcagcacgaacagtatcaccacgacatgttaatatgtttaatctctgtgctatcttagacgaatactaatgggagatgctttcctttggattgctctagacgttttctgatatcaccgagagttctcgtttaaactggggaagctgcaggagtatttttagggtctgcaagcatcgcagcaaaagaggctcctaaccatggctaccgaggaccaaattgaaagtgcaggatttcctactgatcttaaatgcggtgtgcgc

SEQ ID NO: 25274 - DNA, 399 bp, Gossypium hirsutum
  Clone ID: LIB3272-048-P1-K1-D4
aggcaatccattttccccgagtaaaacgccaaagaaaacaaaaaatatgagagaggtcttgcacatccaagggggtgaatgtgtcaaccagatcggggctaagttctgggaagtcatatgcgacgagcatggagttgacaacactggaaaatataacggtgactccgaccttcagttggagcgcatcaatgtctactacaatgaagccagtggtggaaggtatgtcccacgcgctgttctcatggatctggagccgggcactatggattccgtcagatctggtccttttggacaaatctttcgccccgataacttcgtcttcggacagtctggtgctggcaacaactgggccaagggtcattacacggagggagctgagctcattgattctggtcctga

SEQ ID NO: 25275 - DNA, 420 bp, Gossypium hirsutum
  Clone ID: LIB3272-048-P1-K1-D6
ggcggacccacgcgtccggaaaatcaagaaggaaaaaaaacccttaaaatcaaaaccctaatcctattggttgggcctttttgattgtggaaaacaaagcaagccctcaactggacaacatggggtctgaacagaatcaaggaaccagctttcccccgtcggagccgaagctttgcgctaacggttgcgggtttttcggaacggcggcgaacatgaacctctgctccaagtgttaccgggacctccgtgctggggaggagcaagcggcgaaggcgaaagctgccatggagaaatcccttagcgtcaaaccgaaagaagatgtcgttgtggagacgtttaagcccgttgagaagctgcctcatgcgggttcatcatcagcggcggttgagcaaccggccgtggctctttccggcgatgaac

SEQ ID NO: 25276 - DNA, 363 bp, Gossypium hirsutum
  Clone ID: LIB3272-048-P1-K1-D7
ccttgagattatcaatttgaagccttcttcgaatttcctcattcaagatgcaaattttcgtcaagaccctcaccggaaagaccatcacattggtggtggagagttctgatactattgacaatgtaaaggccaagattcaagacaaggaaggcatccccccagaccagcaaaggttgatcttcgctggtaagcaacttgaggatggccgcacgttggctgattacaacatccagaaggagtccacactccacttagtgcttcgcctccgtggaggaatgcaaatttttgttaagactttgactgggaagaccattacattggaggtagagagttcagataccattgataatgttaaggcaaaaa

SEQ ID NO: 25277 - DNA, 401 bp, Gossypium hirsutum
  Clone ID: LIB3272-048-P1-K1-D8
aaacgcttcgatcttcactgtgaaaatggcttggcgaagtgcaggatccttgtctcgctctgtcatctctgccgcgagggctccttcactccgctcccctccaccgctaccccggctacgtccctcggtttcctctgctcctcgcctccagtcccgccgcctctcttatgctccttccagaaatttgggagaattgggatgtgtccaatcgttcttgcctctgcatagcatggttcctacggcttgtctcacgtcacacctgactgttaacgtgcgggcttgttgcgagctgtctcacggtacttgaaaggccatggatgagcacagcagagtgcaattggatgtcgaagataagtttgttacccgggggaaccagaggcttaagtcgtctgattagaaaa

SEQ ID NO: 25278 - DNA, 406 bp, Gossypium hirsutum
  Clone ID: LIB3272-048-P1-K1-D9
cttgacgcaaagaaagagggtaacagctgtggttctgagaaagagtaaagatggctggttacagagctgaggatgactatgactatcttttcaaggtggttttgatcggtgattccggtgtcggaaagtcaaatctgctctcgaggttcaccaggaacgagtttagcctcgagtccaagtccactattggtgttgagttcgctacacgtagcttgaatgttgatggaaaggtcatcaaggctcagatttgggacactgctggtcaagaaaggtatcgtgccataacaagtgcctattatcgaggagctgttggtgcacttcttgtgtatgatgttacacgacactccacattcgaaaatgtcgagaggtggttaagagagttgagggatcacacagatcccaacat

SEQ ID NO: 25279 - DNA, 66 bp, Gossypium hirsutum
  Clone ID: LIB3272-048-P1-K1-E1
ctgcaagcaaaaacttcaccaagcaccatggctgcggctgggagctggacgcggggcaaaactgtt

SEQ ID NO: 25280 - DNA, 402 bp, Gossypium hirsutum
  Clone ID: LIB3272-048-P1-K1-E11
ctctcccgaaatttcttacttaaaaccaaaaaacaaaaacagagcatgcactctttttttcttgagtgtgctttgtaaattagttacaagctggcgatcgaaaataaagaaaccactgttcgttaaatcaagcccaagaacagaaggataatgggagctggtgggcctgatgaagaagataacaggtggccgccatggttgaaacctttgctgaaagaacagttctttgttcagtgtaaacatcatgttgattttcacaagagtgaatgcaatatgttctgcttggattgcgataatggcgctctatgatctttctgcttagcttatgacaaggatcatcgttatattcagataaggaggtcttcataccatgatgtgataagagtctctgagatacaaaaa

SEQ ID NO: 25281 - DNA, 287 bp, Gossypium hirsutum
  Clone ID: LIB3272-048-P1-K1-E12
ctcctccgaatttgttaaatccttaataacattccactcactacgggcaaccttttttcactagcatggggaaaacacgttggatgggagctgggcgctagctgaggacccatcctatgcggcagatgaggctctgataaggcatacataaagtctgaccttggaaatgaatggaagaagccattttccgggtcttgccatgctacaatgtattgttcaacagaagattggtatcggggatcagcaatcagactttgacatgcgaaagtgcgctatagttcaggttt

SEQ ID NO: 25282 - DNA, 379 bp, Gossypium hirsutum
  Clone ID: LIB3272-048-P1-K1-E2
gggagattgaaatcagtgaatcacagagtgatgatgagcggagacaaagatcgatactctatagcagcttttgtcattccaaatgagggtactataatcaagacacccaaagagtttatagatgaccaacatcctcggcttttcaaggacttagatttcatggagttcttcctttttgccttttccgacccagcaaggcacatcgacaacggggagttgctccatgtctttgctggcctctcaccatcagtttccaattaaaattatgctcatatagacaagtaaaagtttggttttggttttaaattaatattacaaataataaattgagtcctatactcgagatctacgttttcgaactgtattaacatgttatatt

SEQ ID NO: 25283 - DNA, 349 bp, Gossypium hirsutum
  Clone ID: LIB3272-048-P1-K1-E3
gttgggagaggtggcaacctgggtcagcgccactgtggtctccgcctttatctcctctctcgagcgcttctcctgcgttaacctctccaccaacgaccctgacgatgacgacaatcccgacgaggccaaggaccgccctctcacctacttctgaatatctgtctcggtactctgccacgtcatagactctcttgctgtctcttgatactaggggcttggtatacagaaccaataaaaaagtattaaggaaactttaaatgctctctatatgtgatgggcctcctgaatgaaaagggaactcttgtgtaataaaggccttttttttttattggatatttaaaccatctaa

SEQ ID NO: 25284 - DNA, 342 bp, Gossypium hirsutum
  Clone ID: LIB3272-048-P1-K1-E5
cttcgctatacattcctgtttatgatttgtttccaatttgatatccatggcttccgaaacttgttccccttttaacaagttgagatttctcctaggaatggttttatttcttcttatgaatatggccactgtccagttgtcctctaccttttattcaacaacatgccctaaagcacttttcaccattaaatcagcagtcaactttgctgtgttcaatgaagctagcatgggggcttttttgcttcgacttcattctcacgattgctatgtcaatggatgctatggatccatactgtttgatgatacagcaaattttacaggagaaataacagctgtttcaat

SEQ ID NO: 25285 - DNA, 414 bp, Gossypium hirsutum
  Clone ID: LIB3272-048-P1-K1-E6
cgcgtccgtccttacacagccccgccgtcaaacaagcctctcagcagccctttcttcctgttcttctcctccccttctccccttctccggtccctgagcaggccaggccagtaattcaaataagatcttgaggatgtatacatcaatgaagaagatccacaaggataaggatgttgaaccaactgaatttgaggagtcggttgcccaggcattcttcgatttggagaataccaaccaggacctgaaaagtgacctcaaagatctctacattaattcagcagtccaaattgatgtttccgggagccggaaagctgttgttatccatgttccctacagattaaggaaagcttttcgcaaggttcatgttaagcttgtgagggaacttgaaaagaagttcagtggcaaggatgtgat

SEQ ID NO: 25286 - DNA, 369 bp, Gossypium hirsutum
  Clone ID: LIB3272-048-P1-K1-E7
tacaaattggtaaccagtagaccttggaaaccccaaattattgtcctgataatctccataattatatgcttcaaccctgtccttgtagccggtgatatgatgggagtaaaggttttaagcttttaactggtttacatggaatctttgtggtgtgggaagccatagcttctatttttgcattctcactctctgttgaactatgaaagccttcccttttccttcaatcaccaaaaggagatgctttttaatggtgtctttatctttagttggaagttgctgacaggcacataaccctaactataaagccccgtatctccctttagttaaaaagctgatctacaagaactcaatgaaagaaagcataagccc

SEQ ID NO: 25287 - DNA, 397 bp, Gossypium hirsutum
  Clone ID: LIB3272-048-P1-K1-E9
gccagaggggaggagccagataagaaaaactaaaggaaaattgttttctggttcaaaaccacagccctaatccacatgcggttcggatccggattctctaagatccggttgacattcatcgctttaattttcattctgatctgatcccaaacgaatctattcggccgtgaaaaatgacgcgtcgctgctcacattgcagccacaacggccacaactctcggacatgtccgaaccgaggggtcaaactcttcggagtccgcttgactgacgggtcgattcggaagagcgccagtatgggcaacttaagccaatattccgggtcgaattctggcgcgcataacgggaacgggtcgggttcgcccggtgagggtccggatcacaccgatggttatgcttc
